United States Patent 11,410,750 (METHYLATION MARKERS AND TARGETED METHYLATION PROBE PANEL) - sequence listing, part 3

SEQ ID NO: 30340 - DNA, 152 bp, Homo sapiens
  chr6:26172018-26172170
  hyper
cctgaaaaataacagcggtcatcctactcccggtgcggctatgcggccatgaaaaggagtcttggggccggtcgtgcccctccacgcaggctccctcatagggtcatcccatcaaccctcgccaaaaacgccggccccctcatagggccgtc

SEQ ID NO: 30341 - DNA, 97 bp, Homo sapiens
  chr6:26184021-26184118
  hyper
gcatgcctgagccagcgaaatccgctcccgccccgaagaagggctccaagaaggccgtgaccaaggcgcagaagaaggacggcaagaagcgcaagcg

SEQ ID NO: 30342 - DNA, 477 bp, Homo sapiens
  chr6:26188757-26189234
  hyper
attgattactccagcatgggcgacacagcaagagtgaaaataaactttaatacactatcctcaccggccagtaagatatgaagccaaggcgtaataagaccatttaacttgaaaaccggagctactaaacacgtgaaactacacttttagcagtgactactactctttctcctgagtggataggtggccctgaaaagggccgttggttttgcggtagtgtactgtagaggtaagctcagccgccgaagccataaagagtgcgtccctggcgcttgagcgcgtacaccacgtccatggctgtgactgtcttgcgtttggcgtgttccgtgtaggtgacagcatcgcggattacattttccaggaaaactttcagcactccgcgagtttcctcataaatgaggccagaaatacgcttgacgccgccgcggcgagccaggcggcggatagcgggcttggtgattccttggatattgtcac

SEQ ID NO: 30343 - DNA, 158 bp, Homo sapiens
  chr6:26189235-26189393
  hyper
caataccttacggtgacgcttggcgccacccttacctagaccctttccgcccttaccgcggccagacatcttgaaaccacagctgttaaatctgtaacgcaatacgtctggcagagccacgcagcacttttataatagcatgacggacctgtttgaaa

SEQ ID NO: 30344 - DNA, 195 bp, Homo sapiens
  chr6:26197272-26197467
  hyper
tggaatggcagtttgcgaatcagcagctcggtcgacttctggtagcggcggatctcgcgcagagccaccgtgccgggccggtaacggtggggcttcttcacgccgccggtggctggagcgctctttcgagcagccttggtggccagctgcttgcgtggcgctttcccacccgtggacttgcgagcagtctgcttg

SEQ ID NO: 30345 - DNA, 25 bp, Homo sapiens
  chr6:26198574-26198599
  hyper
gttttgagacagtctcgctctgtcg

SEQ ID NO: 30346 - DNA, 85 bp, Homo sapiens
  chr6:26198839-26198924
  hyper
gtaaggaaccgcgccccgccaatttgcttatgtatttttatggcatctttaaaatggacggttagtttcacgattcagtgttaag

SEQ ID NO: 30347 - DNA, 450 bp, Homo sapiens
  chr6:26199182-26199632
  hyper
acttgtttagctcctcgtcgttgcggatggccagctgcaggtgtcgggggatgatgcgggtcttcttgttgtcgcgggcggcgttgcccgccagctccaggatctcggcggtcaggtactccaacaccgccgccagatacactggcgcgccggccccgactcgctcggagtagttgcccttgcggagcaagcggtgtacgcggcccacagggaactggagtccggcccgcgaagagcgggtcttagccttagctcgggcctttccgccttgcttgccgcgtccggacattttgaattcttaaaaacgatgttaagcaatgaagacaaaaatgtaaaagtgaattttgttagcaagtgagaaactattatacttggaggtcgaattgtaaataacgctatttgattggctagaacaaccaaccaattgcaaagaaacgctagaatcaccta

SEQ ID NO: 30348 - DNA, 40 bp, Homo sapiens
  chr6:26199835-26199875
  hyper
aggcggtgaccaaggcgcagaagaaggatggtaagaagcg

SEQ ID NO: 30349 - DNA, 39 bp, Homo sapiens
  chr6:26200115-26200154
  hyper
cgccgtgtcagagggcaccaaggccgtcaccaagtacac

SEQ ID NO: 30350 - DNA, 613 bp, Homo sapiens
  chr6:26204685-26205298
  hyper
ggcgggaactggagtcgttggtgacgtcatcccagtctgatctgtgaagggtagggccagcaggcagcaccaaagttcccgtatgcgcgttttcagtcttcatttaggtccgaattcccggcatataagaatactaccgtcgcttgtttttcagatttttgcggctattttcgttggtgtgttggtcatgtctggtcgcggcaaaggcggaaagggactgggtaaaggaggcgctaagcgtcaccgtaaggtcctgcgagataacatccagggcattaccaagcctgccatccggcgccttgctcgtcgcgggggtgtcaagcgcatttctggtctcatctacgaggagactcgcggggttctgaaggtgtttctggaaaacgtgattcgtgatgctgtgacttacacggagcacgccaaacgcaagacagtgacagcgatggatgtggtctacgcgctgaagagacagggacgcactctttacggcttcggcggctaatgctaccgcttaaacgactcagcatctcgacttcccaaatcaaaggcccttttcagggccgcccacagttttccgcaaaagagctcatgacttgttagacgattggttggtctc

SEQ ID NO: 30351 - DNA, 210 bp, Homo sapiens
  chr6:26205502-26205712
  hyper
aaaatgcatggttttcgacataagtgggaaaaccgcaagacactgcgtaaccgctcaaaatggcggagagcgaagaacaaagccggtgcctggcaatgggccggacccgcgaattagcgcaaccaatcatcttcctggaaaggagtgtgggccttaaattctagcggcctgttttctattacttaacctaacgaccgagtttaggtgtgt

SEQ ID NO: 30352 - DNA, 24 bp, Homo sapiens
  chr6:26216371-26216395
  hyper
ttacaaaatcggaaaaattattcc

SEQ ID NO: 30353 - DNA, 99 bp, Homo sapiens
  chr6:26216596-26216695
  hyper
gaggtaatggtcgagcgcttgttgtagtgggccagacgggaagcctcgcctgcgatgcgttcgaagatgtcgttaacgaaggaattcatgatgcccatg

SEQ ID NO: 30354 - DNA, 98 bp, Homo sapiens
  chr6:26216755-26216853
  hyper
gagtagctctccttacgactgcgcttgcgcttcttgccatccttcttctgcgccttggtcacagccttcttggaacccttcttcggagcaggagctga

SEQ ID NO: 30355 - DNA, 30 bp, Homo sapiens
  chr6:26217548-26217578
  hyper
tgctgcctaagaagacggagagccaccata

SEQ ID NO: 30356 - DNA, 754 bp, Homo sapiens
  chr6:26233978-26234732
  hyper
gttggccattctcaacgaccagctgcacaagatcgtgggccggaagcaccttgggcatgccacgtactgctcacaaccaggacgggatgtgctcaggaagtcacctcaacgctaaagtaaactaaagcatttacaccacatccctgtgtcagaaataaaattttttcagggccacttttaagcgccgcgctttaacagaaatcggccggccaatcacacaccaccgcgggaatttgaagaaaaagtaggacctggtggctcaagtagccttagctatccggtgactgtggctgagactgagacggaaggatccttgcgcccaggctgctgggagctgttaataactgacccccaaccagcacgactaggatagaccgtggccgcacaacaccgcagcacccgcacccctctccaccccactcccccctccaaaaagcttcagctcttttgactgagacctgtgggtggctctgaaaagagccgtttaaaattttcaaaggggaacgtcccgccagtttcactttttcttcggagctgccttctttgcctttgtaaccttcggcttccccgacttaggcttggccgccttgggcttaggggctttggccttagctggactcttggcagctttttttggctgaggtgttttcacctttttcgcactcttggccactttcttggtcccagcagcggttgctggcttctttaccttcttaggagtctttttgatgcttttcttcggggtagcggcgcc

SEQ ID NO: 30357 - DNA, 191 bp, Homo sapiens
  chr6:26234942-26235133
  hyper
atcgtagccagcagccgcaagcgctttcttaagcgcggccagagaaacgccgctgcgctccttagaagctgccactgccttggtgataagctcagatactgggggtccggatgctttgcgtttcccagcagttgcgcctgccttcttcgcctttttcttcacaggtgttttttctgcgggtgcaggaatgg

SEQ ID NO: 30358 - DNA, 587 bp, Homo sapiens
  chr6:26240682-26241269
  hyper
tttaggaaagggaggcgccaagcgccatcgcaaagtgctgcgtgacaacatacagggcatcacgaagcccgccatccgtcgcttggcccgacgcggcggcgtgaaacgcatttcgggcctcatttatgaggagacccgcggtgttcttaaggtgttcctggagaatgtgatacgggacgccgtaacctacacggagcacgccaagcgtaagacagtcactgcaatggatgttgtctacgcgctcaagcgccagggacgcactctgtacggctttggtggctgagcctcaccccggctttttatttaacagctcacccataaaaggcccttttcagggccacctccttcgtcacacgaagggctgtaactgatgacgacttgggtttcgttttgtaaatttgggattctaactgagttaaaccgagccgtttttagcgatcttcctaagatggcggatgtgctaaggagaaagggaaggcgaaacattagaaacttgttcaggtatttcgatcgcaaacattcacaggaaaagatggtggaaatggtttgggaataccagcagccttttatgacgtatgtgatgtgtt

SEQ ID NO: 30359 - DNA, 41 bp, Homo sapiens
  chr6:26249960-26250001
  hyper
ggaggagtggagtggcgcgatctcggcttacttcaacggct

SEQ ID NO: 30360 - DNA, 504 bp, Homo sapiens
  chr6:26250181-26250685
  hyper
cgggctcccacagtactgggattacaaggcgtgagccgccactatcggccattttgaagacaatggccaagacacaaaagcctagtttagaagagccaccggccctgcccccatcccctaaccctccaccctccttgttttaggagacattactccctagtgctacggcgctttcaactgaaattgttggtggctctgaaaagagcctttggtttaagttggcgcacaccctcagtacaacttatgccctctctccgcgaatgcggcgagcgagctggatgtccttgggcatgatagtcactcgcttggcgtggatagcacacaggttggtgtcctcaaagagccccaccaggtaagcctcgcaggcctcctgcagcgccatcacagccgagctctggaagcgcaggtcggtcttgaagtcctgcgcgatctcacgtaccagacgctggaatggtagcttgcgaatcagtagctcagtcgatttctgatagcggcggatttcac

SEQ ID NO: 30361 - DNA, 496 bp, Homo sapiens
  chr6:26250686-26251182
  hyper
gagggcgacagtaccaggcctgtagcggtggggcttcttcacgccaccggtggctggcgcgcttttgcgagccgccttagtggccagctgcttgcgcggggctttgccgccagtggacttacgagctgtttgcttcgtgcgtgccataggaatgggtttcaagcaatggtcacaactgaacaaacagttgttcttactcctatttataaaggcaaagtccttctgattggtccgaatcttccagtttcgcgccctgaattatgtagtgtgataggacttgtgatcagctactaggtctcattttagaaaatcttaacctatctaaatgcttttttcccctagttccttacattttattatgttttatgtgcctacctgtattacgtaccttcattgattttattttaatcagtttgtttgggattatgtttgacagacggaaatgaacgttctgcagttccggagcgattcaaaaataccgcgtttgagagtgatt

SEQ ID NO: 30362 - DNA, 400 bp, Homo sapiens
  chr6:26251540-26251940
  hyper
tagaaacataatatccgtctttgtttctgtttaaattctcacctaaggagacagaacttataggtagatgttactggcaaggcattagtttttctaatgttttgaatgaaaaactacgttttttcccccgggaggtgtagaaaaggatttagggtaggtttcgcataaatatccaatcaaaaagtagacttgaatttaacttttttattggctgatttggtccaatcagggattgagaatgattaagcacctatttgcataaaagacctacaaaaacggccagctgtgctgttgagccttcactttggggtgtattcttactcctttatcttgttgcaatgcctgatccagctaagtccgctcccgccccgaagaagggctccaagaaggcggtgaccaa

SEQ ID NO: 30363 - DNA, 39 bp, Homo sapiens
  chr6:26252060-26252099
  hyper
gatcatgaattcctttgtcaacgatatcttcgagcgcat

SEQ ID NO: 30364 - DNA, 40 bp, Homo sapiens
  chr6:26252140-26252180
  hyper
cgaccatcacctccagggagatccagacagccgtgcgcct

SEQ ID NO: 30365 - DNA, 39 bp, Homo sapiens
  chr6:26252240-26252279
  hyper
gtacaccagctccaaataaatggacgcatgttcaaaccc

SEQ ID NO: 30366 - DNA, 445 bp, Homo sapiens
  chr6:26271371-26271816
  hyper
tcttgaagtcctgagcgatttctcgcaccaggcgttggaaaggcaacttgcggatcagcagctcagtcgacttctgatagcggcgaatctcgcgcagagccacggtgccgggacggtagcgatgaggtttcttcacgccgccggtggccggcgcgcttttccgagccgccttagtggccagctgcttgcgcggcgctttgccaccggtggacttgcgtgcagtctgcttggtgcgggccatctcagactacctgaaagaaaaactcagccacttggcagagtggaaactgcccttatatatactcagaaacattctaattggccttgttgattttcaaaagacccgcgcaacaaaaccattggctgaagagtccaacgatgtgattggtgaattactggaaaatctgattggatgaatcacttcatttttgaatcctctcttctc

SEQ ID NO: 30367 - DNA, 24 bp, Homo sapiens
  chr6:26271817-26271841
  hyper
gttagtctgcgatccaagaacgtt

SEQ ID NO: 30368 - DNA, 46 bp, Homo sapiens
  chr6:26272059-26272105
  hyper
gtacctgggaaatcacgagccaagaagtcaccgacatacaacagtg

SEQ ID NO: 30369 - DNA, 422 bp, Homo sapiens
  chr6:26272431-26272853
  hyper
gacagggcaacagcacggcctgaatattgggcaggacaccgccctgcgcgatagtaactttgcccaacagcttgttgagcttctcgtcgtggatggcgagctgcaggcgtcggggggtgacgcgggtcttcttgtctcgggccgcgttgcccgccaactccaggatcttggcggtcaggtactccagcaccgcctccaggtacaccggcgcaccggcccggacccgcttggcgtagttgcccttgcggaggaggcggtgcactcggcccacagaaaactggagaccagccctggaagagtgcgttttagccttggcgcgagctttgctgccctgcattccacatccagacgcagtgaagtatttaaatacttgtttagaagaaggaaagtgattgattctagtaaaacgcaagagctaaact

SEQ ID NO: 30370 - DNA, 159 bp, Homo sapiens; identical to SEQ ID NO: 8394
  chr6:26273111-26273270
  hyper

SEQ ID NO: 30371 - DNA, 180 bp, Homo sapiens; identical to SEQ ID NO: 8395
  chr6:26273570-26273750
  hyper

SEQ ID NO: 30372 - DNA, 120 bp, Homo sapiens
  chr6:26322568-26322688
  hyper
ggcgagcgagaggcggcgctgggctggcgttggagagcgacggcaggacggctgcggctacgaacacaattgcagtattttttttttttgacagagtctcgcactgtagccccggctgga

SEQ ID NO: 30373 - DNA, 157 bp, Homo sapiens; identical to SEQ ID NO: 537
  chr6:26327825-26327982
  hyper

SEQ ID NO: 30374 - DNA, 106 bp, Homo sapiens
  chr6:26328310-26328416
  hyper
gcggtaatcccaaaacgtttttttctataggtataacgcctgtcttcgttcgtcagagggccagtggcgcaatggataacgcgtctgactacggatcagaagattc

SEQ ID NO: 30375 - DNA, 108 bp, Homo sapiens
  chr6:26331703-26331811
  hyper
tgatctggagtcagacgcgctaccgttgcgccacgaggtctccgggacacctacgttttatttacctgtcaatctgattcatgaaaataatttcggtactggtgaaga

SEQ ID NO: 30376 - DNA, 132 bp, Homo sapiens
  chr6:26332134-26332266
  hyper
ggtgagttttaaattcgtttccaaagttcactgcaggtcacaaccagtgtttccgttaacgaattcacgcgggggctggcaggttgtttgtgctgcatcttttctgagagataacggcgcctccctgtagcc

SEQ ID NO: 30377 - DNA, 240 bp, Homo sapiens; identical to SEQ ID NO: 538
  chr6:26501949-26502189
  hyper

SEQ ID NO: 30378 - DNA, 292 bp, Homo sapiens
  chr6:26550767-26551059
  hyper
atggcctggaagagccgtactctggatacccgagggcgcggccccagcgccgcgacgccccgcccctctggctgctccgctctgggatgcacttccgacgccctctaggcttgggagttccgcgcctctcggtgtcgcctggggggcgtgctccggttggcgcactgattcccagttgggtaggggaggcttgactgagctcccacccggaatttcaccttagacctttaaagaccttgctccggcctcccgcgccagcgctaacacctagtcctctttagtggagttccgg

SEQ ID NO: 30379 - DNA, 46 bp, Homo sapiens
  chr6:26551083-26551129
  hyper
cggtggtctcctcccagatggcgaatttccgcggcttcttcatctt

SEQ ID NO: 30380 - DNA, 304 bp, Homo sapiens
  chr6:26577131-26577435
  hyper
tacacagaatacttccggtgtatgagaatactgctttaaagccgatcgtagtttaaaaaatgagcattaatataattaattaaaaccaaatctcctaaatggaacaagacttaaaaacccagaaacttccaggacgcacattattttggggattctagagaacgcagaactacgtgtctaaaaaggacagcgttccgtgtccttcgatagctcagttggtagagcggaggactgtaggctcattaagcaaggtatccttaggtcgctggttcgaatccggctcggaggacggtagttttgacct

SEQ ID NO: 30381 - DNA, 166 bp, Homo sapiens; identical to SEQ ID NO: 8404
  chr6:26577722-26577888
  hyper

SEQ ID NO: 30382 - DNA, 213 bp, Homo sapiens
  chr6:27059686-27059899
  hyper
aattgtctaagcaggcgagtactgaatccggacttcttctaagggcagacaccggaatgttgatgcggctgcagctgcgctctcccacctctgtctgtctcttctcaaaccccgaaaggaagaccgtgggcagctcgtgcgcgcgtgcgtgtgcgtgtttaaccgagtgctggaggggaaacgtgagttgcagtcaaccggttatcttcctct

SEQ ID NO: 30383 - DNA, 141 bp, Homo sapiens
  chr6:27064628-27064769
  hyper
cgactccggtgtgaacggttttgggaacctcggtctcctgctggctcccaggtgcgctatccgacgcagcgagacgcggtgagcctacagaagggctgaccaggctcacctgacgccccaggtcgacagcaaaccccgtgc

SEQ ID NO: 30384 - DNA, 233 bp, Homo sapiens; identical to SEQ ID NO: 2787
  chr6:27064770-27065003
  hyper

SEQ ID NO: 30385 - DNA, 264 bp, Homo sapiens; identical to SEQ ID NO: 2788
  chr6:27065004-27065268
  hyper

SEQ ID NO: 30386 - DNA, 49 bp, Homo sapiens
  chr6:27094912-27094961
  hyper
ctacattagcctatccgttattgccataagatggcgacagcccttctca

SEQ ID NO: 30387 - DNA, 84 bp, Homo sapiens
  chr6:27100309-27100393
  hyper
tgcgctcgaaaatgtcgttcacaaacgaattcatgatgcccatggccttggacgaaatgccggtgtcagggtggacctgcttca

SEQ ID NO: 30388 - DNA, 600 bp, Homo sapiens
  chr6:27100453-27101053
  hyper
ctttcttctgcgccttagtcaccgccttcttggagccctttttcggggcgggagcagacttcgctggctctggcatagcactgtgtagctataaagcgccaacgaaaaggaaaaacagcgtgagcagggtatgacaaggcgcttttatatagaatcgcttatgcaaataaggtgaagagttgaagtcttgtgtctgattggtagttattcagggtaacgtcagaggtcaggtctgcccaatcaggattcgcaaatccagaagacgcactactattggttgaaattaaactgcagccctaaccaacaacacgtcttctttttcgcgcccaatagtgtttataaaaagcgccgcctttcccgttcactttgtggttgctcgtagtgagttgcgctcgctatgtctggacgtggcaagcagggaggcaaagcccgcgctaaggccaagactcgctcttctagggccggtctccagttccccgtgggccgagtgcaccgcctgctccgcaaaggcaactatgccgagcgggtcggggccggcgcgccggtgtatctggcagcggtgctggagtacctgaccgccgagatcctggaactggcggg

SEQ ID NO: 30389 - DNA, 24 bp, Homo sapiens
  chr6:27101113-27101137
  hyper
ccgcaacgacgaggagctcaacaa

SEQ ID NO: 30390 - DNA, 39 bp, Homo sapiens
  chr6:27173508-27173547
  hyper
aagagatgaattgcccggctaatgtcactgccggacgcc

SEQ ID NO: 30391 - DNA, 549 bp, Homo sapiens
  chr6:27173632-27174181
  hyper
cgtggcccggttcctttctcttacactcttccaaggaccccttttagacctagaggaaaccccgcagaagtgacagggagagggggaaagctcttttacagtggcgaaaccacgtggctgcgagagcttctcagggagagctcctgttttcaaagtctggcaaatttatcagtttgatttttcttaaacatttatatttttatggagtagaaaatctaccaaacgagtaaagaatgtttccgcctggtttcaaaccggggacctttcgcgtgtgaggcgaacgtgataaccactccactacggaaacaactgtgggaaagggttacccacatcccccccgcccccatccccaccccgccgcttaactaagagggctttgcctgaagggcctggactgccttatacgtctgtttagaaaatgatcgttgtggtgcagttctctccttttactgttttcgaaaagaaaagcaattcataaccaagcttccccagggctccaattcccgcacaaatttcaaacatggaaagctagaacggaatgctacagaa

SEQ ID NO: 30392 - DNA, 121 bp, Homo sapiens
  chr6:27182869-27182990
  hyper
aacaaaaacaaaaagcgggtacatcaatgatagataatcgacagacgcagactgagtggccagtagtcaaaagcgcaaccgagggccagtggcgcaatggataacgcgtctgactacggat

SEQ ID NO: 30393 - DNA, 97 bp, Homo sapiens
  chr6:27203207-27203304
  hyper
aaagatataccctgacggaacggataaatttaaagttcattttaactaattcaaaactgaaaaacactctcactaagcgagtttccgtagtgtagtg

SEQ ID NO: 30394 - DNA, 505 bp, Homo sapiens
  chr6:27205332-27205837
  hyper
gaaggtgagaaccctcgtggcccgtacggggatcgaacccgcgaccttggcgttattagcaccacgctctaaccaactgagctaaccggccacccggaaaacagttgttctttcaattttaaaaaagcaaaatgtttgttgtttttgtgtttctttaacactaaaggaaattcttttcctctcctcaaagggatgtcttttaaaataattttaattgcgactacgtaatattgtttcttcaaacttctgttggtgttttgcattttcccttcctgcactcccgcagggaagaaggaaaacaaaaacaaaaacaaggacaaggccaaaaactctacctccagcagaaaggaacttcgcctctcccgtgggaaatgagattttctcaaactcacctattccgcccggagaaaatactacagagaaccattcacgagaggggcttccttccttttgaccttgggaggggtccagagacccgggggacgatctgggagcagaagctggt

SEQ ID NO: 30395 - DNA, 344 bp, Homo sapiens
  chr6:27205913-27206257
  hyper
cggcatgaggaatccgctccataatggaaggaagaaaatctccggcagctatgcctcgcgggttcataaggactggagagttactccttctctctggccccctcaaaacgcccggtggtatgtctgttgctccactacgcgttattataattaactgcttgtgttactctttgtgctgtcttgctcttcattctcctggtacctcgggtgcccgcacagcatggtaagctgctcaatagttcaatgaatggggaaaaggtgtgcagaggtcatttctgctgattatcaagacttcaattcttcgaagtggagcacgaggatcctctaggcggcaggcaaatgtc

SEQ ID NO: 30396 - DNA, 15 bp, Homo sapiens
  chr6:27228172-27228187
  hyper
gaagagcccacctgc

SEQ ID NO: 30397 - DNA, 170 bp, Homo sapiens; identical to SEQ ID NO: 540
  chr6:27228289-27228459
  hyper

SEQ ID NO: 30398 - DNA, 197 bp, Homo sapiens
  chr6:27242926-27243123
  hyper
tcgctggctgaaaaccgacgagtttctgcagaactgccataaaaaactactggggaaaatacgtggccagtacggggatcgaacccgcgaccttggcgttattagcaccacgctctaaccaactgagctaaccagccgacgctgggtgcagctcttccccccccaccccccgcccttaatctcgacactcatccttt

SEQ ID NO: 30399 - DNA, 119 bp, Homo sapiens
  chr6:27247620-27247739
  hyper
ctggcccagtgctcccggaaagggtggctttcggcaaagtctcggcctcgccttgaccctccaggaaaaatgttcctgagcggaaagatcgttcaagttgcctgcgaaccaagtccttg

SEQ ID NO: 30400 - DNA, 56 bp, Homo sapiens
  chr6:27248054-27248110
  hyper
tgcccggtttcgaaccggggacctttcgcgtgtgaggcgaacgtgataaccactac

SEQ ID NO: 30401 - DNA, 505 bp, Homo sapiens
  chr6:27255942-27256447
  hyper
tgctttccttcgccgcggttgcggccgcgaccctgttcttaccaccagcaattcctccagggacttggtcagcagcccaacttgatctgcgtctctctgctaaggtgtttccgcaacagggtcaactccaagtctcacctttctaggaatcccgggcgcagcgcgggggtcgggactccgacctgtatttccaggcggaggtttccctgggtcaggcggccactctctgccagagattgtcagttatccaactgtcaatagagccgccgctccagcgagtttaatttaggcacagaaaagtcctgcctgggttgaggtgggcttaggatgagtttacttgagtgtgtgatttagaaatagatctatgggacagacagacacgaaatcgggcattggggccctcgcaggcagggtatctagactggcagctgccggtgcaggatattgccaaggactcggcatccggctcagctcaaggtggggacgaagacgtcctggttgcaag

SEQ ID NO: 30402 - DNA, 320 bp, Homo sapiens
  chr6:27258104-27258424
  hyper
aaacatcgacaacaacgaaatcacactcttctgaattcctgcctctgccccgtgaaaacaaaaaaaaaagaaaaaaaaatcaacgtccacagtaacaagcctcgcatctgaggggaaattttcttaaattctccagtcacgtctgaaaaaaaaaagttttaatggaggactttgtagtaaagaaaagcatggtaaccttgataatttactgaaaggaaaggccaatcaactcgatgttaccaaagctgaaacagaaaaatttaattctcccttaacgaaggaagccaacgcagcacacaggtttccgtggtgtagtggtt

SEQ ID NO: 30403 - DNA, 991 bp, Homo sapiens
  chr6:27279795-27280786
  hyper
gtggggcagggtgggcgcggtggacgaactgaacccgatgaacttggtgaaggggctgaggtggccggcgtttcgtgggcctctcgggcaagtcggtgcgcacctgggctggggacgagggcgaaagttccagtttgctcaggaaactgcccatgaggagagatgaggcgcgggcagtgagttcaagcacggttttggcttccgaggtttcggacgtctgcagaatcggacagagtcgaagagcgcagtgttcggttgacggttgggattcacgcgctaggaaagcgcgagtctcagggtgcttagcactctccaggcccggcacccgcgggaacgggggacacgcgggacttcggcagtcccagtaacttgctttgctgttctgagacctcagcggggcggtcagacctctgctgtctccgcagcgagttgcagtacttggcgcggggagaggaactcgagaggaagctcactgcgcctcgcccctggcgtcggcagcggctgtctgggaccctgtggtccggattcaccaagtggcgcagagctggaatcgagtgggtgcacagtttccaggctccgactattactggcctcgaaggtacaggctcaggcggctcagggccccggcgcagatctgtcggcccgcgggatccccggagtctgagtggggagcactatccgcaccccgtagagtgagtgcgggcggctttcgcaggtgctcaggactggagatctggaccggtggctgtgccgcccggatggcatttgtggcactagcagtcgggaaagcagctgattgaggatttccgcgtttctctttttttgcagatcgtgacgccgccagtaggtgtcagtcatttgccgcacagccacctttgagatccacctgtgtctcccagcggccgaatccaggtttccttcctattcgcacttggagaactcatgcagattgccgtcaggagtggcctcagagatccggagtgggcgaatg

SEQ ID NO: 30404 - DNA, 328 bp, Homo sapiens
  chr6:27342701-27343029
  hyper
gcaggatacactgcccgcccagtggcctggagggcgcgtcccgggctcccctacgccttttggaatcagcgacagacgcaggtataaaagagagcctccactcccacctctccagggctccccacccgctccttctggccgctttctcctgaaagagcaaggcacccctagaagcttcaggctcctccacaggcgagtgcctacccacctatcaggtaagacgtgcaactgacactcagcgcgcggaggagcccgctgagaaagggtttacctgtccgaagagaactgcgcttgcatggctctggctgtgggccggctggctcttgtc

SEQ ID NO: 30405 - DNA, 66 bp, Homo sapiens
  chr6:27356988-27357054
  hyper
tcatgaagcccccagcgctcgtctcactggcgggccagcctagtccctctgcggcagtgacagcca

SEQ ID NO: 30406 - DNA, 538 bp, Homo sapiens
  chr6:27463133-27463671
  hyper
ttccacataatttttcgctccctccacctaagacacaaatcagcggaagcgattccgtgcctggaatcccctacgaacaccgtcgttcaccgaggagctttgggctcctggaagtccgaacaccccggatcagaggagagttggccatgactccccgtcggtaccggctgggtttggtgccagctatggcgagtacagaagcctggccggtcccggggcaggcaggcgctcgctggatgttattcgactgactggatatttgctggaaacgttaatgcttgtgcgatgaggactctctctaattgcagggcgctcaattaccaaggatagcctgacttcctttcctagaattctcatttcaccttagcatttccaaaaaaactcaccaaagacagaagtttgcacacgtcacctgacacgtcatttcaccaatctatcaaagggtgaagttccacagctgtagtcgtggccgagtggttaaggcgatggactagaaatccattggggtctccccgcgcaggttcgaatcctgccgact

SEQ ID NO: 30407 - DNA, 33 bp, Homo sapiens; identical to SEQ ID NO: 8419
  chr6:27471362-27471395
  hyper

SEQ ID NO: 30408 - DNA, 123 bp, Homo sapiens; identical to SEQ ID NO: 542
  chr6:27512761-27512884
  hyper

SEQ ID NO: 30409 - DNA, 499 bp, Homo sapiens
  chr6:27512994-27513493
  hyper
cgcccgctccagtccggttttagccgttccttcggaagagtaagtcagttgaatgtcatcgaagaagctcctgatttagattttaactgtacgtaaacgcagatgaccccccactctcgtgccttcatttaattcccgttgcttctcccatgggtattcagaggcttgaggttgcttggactctcaattcaatactccctttctgcgggttcgtgagaattaggtgtgaacgtggtgtccgcggatttcagcagctagcgggcaagctccagcgcccagaaactttgagtcgcttgtctaggagtcctgtgttgaattgcaacactatgcactatgttctggttattgatgtgctctgaatgagctctttcgttcgtgagcagaggccctgacgagactgaagaccaactatttccgagcgctccactcaaccattataagttcaccccagccgtcagcgatggcgtaggtaggtagtcgtggccgagtggttaaggcg

SEQ ID NO: 30410 - DNA, 555 bp, Homo sapiens
  chr6:27533822-27534377
  hyper
ggcgctgtgaggcaacggtctcaagagtcctcgagagaaagagaggtgttgcccctccctggggacaacctgacactaggtgtggagccagtcgcggggatgggcgaccgccatggggccaggggcggaagtggggatagagcacagggtataaaagactcctgctacagctccccctctgctgtcgggtgcagacacgaggtagcctccaggtgacaacacgggtggtgagagccgccgcatgaatccacactgcggctgaaggtcaagaattggcggtagcccatcggtagcccagagacccaaactgtgtccgatgtgagtgaaggtcaccccagatcagtgcgtcagttccgttttggcggccaaatttctgacgatcccatgtaagaaatgccacacctgtcaataggagcgactcacgcgctgggtctctttctcggatcgggtcgccaccccagtgccgggactatgctaaagactagagtctcagacttggaatttcgaggaaggtgttccaaaacgctgcgctccctccggcgagggacaagagca

SEQ ID NO: 30411 - DNA, 32 bp, Homo sapiens
  chr6:27551251-27551283
  hyper
cgaaccccggtctcccgcgtgacagacgggga

SEQ ID NO: 30412 - DNA, 128 bp, Homo sapiens
  chr6:27559865-27559993
  hyper
aatgacgaagaaaatcgggctcagaatagagtgggaccccttcggtagtgaataatcccgcagctcattattgcgaacagcagcccttagagatcgtagctggctggtaaaggcggctttagagcgga

SEQ ID NO: 30413 - DNA, 732 bp, Homo sapiens
  chr6:27572883-27573615
  hyper
gactgatcagttgaacggctaaggaaaagaactgggtgttaccgtcgttgctagagcggtgtgagtttacgacagttgctggtcagatcaatgtccgactcccctttcagagagacagacgatatacaggaatctggaacattcctacagggctctctgagaacggagacctttttctcgtgccttttttcttttcttttctttttttgtttgtttaatttttatgttagcggattcacagaccaatagatggaaatccgctgcttactttctcgcaggagaaaatgatctccaacagtgctgcgggactgcgtccaaatggcactgaaaatatcccaggattctgtaaatgtggggttttcctttgtcgattggtttgatgtaagagagatgcctctctctttgcgagaccctgtttggcgaacatcggttggggagggaaatcttggaggtagaaacggctgaactattgtggcattccttggcgaaactttcggtacaaatctggtagggaaaaacaaaagatcaggctgtgtcagaagtgggattcgaacccacgcctccatacggagaccagaagacccgaacacaggaagcagtaagcttgagtctggcgccttagaccactcggccatcctgacactgtgacaaaaatccttgaaactatacatgatgagtaatcacggcttacggctcgccttctggctgaatcccagccgcaaaagttctctc

SEQ ID NO: 30414 - DNA, 53 bp, Homo sapiens
  chr6:27585093-27585146
  hyper
ttttcctattgtttgcgtttataccacttccggtcacacgggcattgttttgc

SEQ ID NO: 30415 - DNA, 188 bp, Homo sapiens; identical to SEQ ID NO: 8427
  chr6:27598672-27598860
  hyper

SEQ ID NO: 30416 - DNA, 81 bp, Homo sapiens; identical to SEQ ID NO: 8428
  chr6:27599260-27599341
  hyper

SEQ ID NO: 30417 - DNA, 218 bp, Homo sapiens
  chr6:27635245-27635463
  hyper
aagaatgaaaaacatcgaagctcctggtggtacttcggtctttaaccgttgaatacattaagagtaacactggaattccaacacttcctcgcgccagcgtcagttttagaatcaacaaaatcgttacttgctgattcatttaactgctaatatattcgttaaaagtttattaggcgtcagtgatcttgaaagttccaaaaacacgaaggaaaccccag

SEQ ID NO: 30418 - DNA, 211 bp, Homo sapiens
  chr6:27635858-27636069
  hyper
tccctcaaccccattcgccttcctttcggcggcgttgtcttgaaccaacctgaaaataataagtccttaagttacaagtcactaaagggaagtttgcaacttgcgatccagtacactgacatgactctaaaaagagaaggctgccgactctgggcgtactgcctttgaattagccatactccgcaaggagcagtgccgttcaaaaaaaaaa

SEQ ID NO: 30419 - DNA, 161 bp, Homo sapiens
  chr6:27636349-27636510
  hyper
gcgcattcgtgtggccggttagctcagtcggctagagcgtggtgctaataacgccaaggtcgcgggttcgatccccgtacgggccactggatgccatagtggggcccttcacttacctgaagggaggccttttaatttaagcctgtcgaatcacaggtgct

SEQ ID NO: 30420 - DNA, 219 bp, Homo sapiens
  chr6:27647517-27647736
  hyper
gtaggggttggcgatcgaccatcaggagagcccagtctttgccacttgcggggagtcacttattgcaggcagggtgttaactgagtttaacactaggagacaaaatgaggaaataatctctcagaatgtaggttaggaaagtagaaacgccctccgagtgtatgtctatcccagaagaaaacctgtcttaaagttcgcgatttttaccaaaataggcca

SEQ ID NO: 30421 - DNA, 357 bp, Homo sapiens
  chr6:27647890-27648247
  hyper
cgaaccgagctgaacgctcattgctgagtcctgggagaaggtcgcgtttgtacagaaggctcctggcagcgagcaaggccgggagtgggcccagtgcgcacgaagtcgcgccccgaattcccactgggaggaacgcactggaattgaaatgtctgagatcaagccccgctgagaatcaagtcccagaggatcttctcggctggtggaaacgtggaggggaaaggcggtcacgaaaattgaagtctcctagtccaatacagattatccaggccgttgacggcaggaatatatttttatttattcctttacccttctctcctcacagctcttccttctcgtccacgcttgatgggtttt

SEQ ID NO: 30422 - DNA, 76 bp, Homo sapiens
  chr6:27648814-27648890
  hyper
aaccgcaaactggttcgtgcgtaagaaggaatagaaactaagcagcaaccaagaatatcataagcctacctgtttc

SEQ ID NO: 30423 - DNA, 15 bp, Homo sapiens
  chr6:27648950-27648965
  hyper
cggaaacaccctctt

SEQ ID NO: 30424 - DNA, 280 bp, Homo sapiens
  chr6:27661759-27662039
  hyper
taaacgacagagacacggaaacctccgaggtttccagagcggacccggaaatgacgccaggggatgcaaacccttctgcccctttttgctacccctgaagcttactgttagtggtcgagtttttctggaagtgggcttccgcgatcgcggggaccaacgccctgagctcttgtgcccaaaggggatcgccaggttttttgatgcggatcgaaagggactggccccggagcctacaacctgacgcaggtgggacttggggaaatgtcgagaaacctaggtc

SEQ ID NO: 30425 - DNA, 331 bp, Homo sapiens
  chr6:27774914-27775245
  hyper
tggagcctggcctggcggtgtcaaacgcattctggtctcatctttttagaaacccgtggatgctcaaggaatttccggataacgtgatcccggatgcgcttgactgacttacacggaacgagcaaagcgcaaagcagtccctgctaaggacttagtttatgccctcaagcgcaaaggtcggaccctctatggtgttggtagctatatgcacgtacctcatgtacatttcaccttaaatggctttcaaagagctagattaatttagtggatagatcaaaatgatttatgacccctcgccccccagtgataggaagagcgaaccagctcttct

SEQ ID NO: 30426 - DNA, 441 bp, Homo sapiens
  chr6:27777715-27778156
  hyper
aaaatttgagtccttcgccaatccggttactgttgggtaggccttcagcatacttttgtccaatcagcttcagactctcactataaataagcggctagctttctctttctcctgaagtgaatctagctctgaaggcatggcgcgtacgaagcagactgctcgcaagtccaccggcggcaaggctccgcgcaagcagctggccaccaaggcggctcggaagagcgctccggccaccggcggtgtcaagaagccccatcgctatcggcctggtacagtggctctccgcgagattcgccgctaccagaagtccaccgagctgctgatcagaaagctgccttttcagcgtctggtgcgtgagatcgcgcaggacttcaagaccgacttgcgcttccagagctccgcggtgatggcgctgcaagaggcatgcgaggcctacctggt

SEQ ID NO: 30427 - DNA, 206 bp, Homo sapiens
  chr6:27782436-27782642
  hyper
cgggaaactgaagcccggcccgagaagagcgggtcttggccttggcgcgagctttgcctccctgcttaccacgcccagacatggcaaaaggtctattacctttacggtcaagaaagactgaaatgaaattggaaaaacgtacattttatagcctctactgggcgcgaaaaggaagctgtgcgattggcttacgttttatttttatt

SEQ ID NO: 30428 - DNA, 213 bp, Homo sapiens
  chr6:27833079-27833292
  hyper
ctggtgaacttctctcggctgttctcagttcctccatttatcgtttcttcgtcatgtcgggacgcggcaagcagggaggcaaagctcgcgccaaagccaagacccgctcttctcgtgccggtctccagttccccgtgggccgagtgcaccgactgctccgcaagggcaactatgctgagcgggtcggggccggcgcgccggtgtacctggcgg

SEQ ID NO: 30429 - DNA, 279 bp, Homo sapiens
  chr6:27834035-27834314
  hyper
actgcacgccagcctgggtgacagcgagaacctgacttgaggaaaaaaaaataatccagtacagaatgacacggtcatatcaaattggcatgtaatagagaccccatcttgaaacttgctactatattgtcttgtgcgttgatagcatattatattaatgccgaacacattagtgacgccgaagtagctggtgcctaaatggcttaaacgcggaaaaaccacatacagatgatggaacaaaaactggccaatcagattatagagcgggctttttaaaat

SEQ ID NO: 30430 - DNA, 187 bp, Homo sapiens
  chr6:27834676-27834863
  hyper
ctgctttgggcttagcggctttgggctttgccgccttcggcttaactgccttgggcttggcaggactcttggttgcctttttcggtttggcagcggccttggccttcttagggctcttcgccacctttttgacgccagccgccgcgggcttcttcgccttcttcggagtcttcttcactgccttttt

SEQ ID NO: 30431 - DNA, 193 bp, Homo sapiens
  chr6:27834904-27835097
  hyper
cgggcttcttagctttagcggcgcctgccttcttggctttgggcttggcttccccggaggccgccttcttgttgagtttaaaggagccagaagcaccagtgcccttggtctgcaccagggtgcccttgctcaccaagctcttgaggcccagcttaatgcggctgttattcttctccacgtcgtagccaccggc

SEQ ID NO: 30432 - DNA, 40 bp, Homo sapiens
  chr6:27835377-27835417
  hyper
cgggccccgggcttatataagccggcgctgccctgtgatt

SEQ ID NO: 30433 - DNA, 890 bp, Homo sapiens
  chr6:27839683-27840573
  hyper
tatgccctctcccctcggatgcggcgcgcaagctggatgtctttaggcataatagtgacgcgtttggcgtgaatggcgcacaggttggtatcctcaaatagccccaccaggtaggcctcgcaagcctcctgcagcgccatcaccgccgagctctggaagcgcagatcggtcttaaagtcctgtgcgatctcccgtaccaagcgctgaaaaggtagcttccggattagcagctcggtcgacttctggtagcggcggatctcgcgcagggccacggtgccggggcggtagcggtggggcttcttgacgccaccggtggccggagcgctcttgcgagccgccttggtggccagctgcttgcgcggcgctttgccgccggtggacttgcgagctgtttgctttgttcgtgccatggctaagtagacgtacctactcaacacaaatgagagaaaaaaactgatcatcccggtatttatagctgccctcgcgttctgattggacagtagactgtgccatgccacgtctcacacacggaattggctcccagtttaatctgctagtgaaagggagacattccgcctctgttttgggtcaagaaacgtaaaatggttttgctagctaaagaaaaacaaaaacggaaacaaaaaaaaatcccccaaaagtctaggatttttcatgcatcaaaatcctgtttaaatataagcttgataaatctaaacttgccttgcactattttaattacgaggtgtcattactgatttgacaaaaagttaaagaacgtaaaggaaaagtgaaactagagtaaatttgtaaatggaggcattgaaggggatatgaaattcgagcgttgtggtatgccagtatttctcaaatttaaacgtacttaatgtttt

SEQ ID NO: 30434 - DNA, 107 bp, Homo sapiens
  chr6:27841143-27841250
  hyper
ctgagatgcgcttaacgcctccacgccgtgccaggcgtcggatggcgggcttggtgatgccctgaatgttgtcgcgcagaactttgcggtggcgcttagcgcctcct

SEQ ID NO: 30435 - DNA, 400 bp, Homo sapiens
  chr6:27858304-27858704
  hyper
gccgagctctggaaacgaaggtcggttttgaaatcctgcgcgatttctcgcaccaggcgctgaaatggcagtttgcggatgagcagctcagtcgacttctgataacggcggatctcacgcaaggccacggtgcctggcctgtagcggtggggcttcttcacaccgccagtcgctggagcgcttttgcgcgctgccttggtggccagctgcttccgcggtgccttgccgccggtagacttgcgagctgtctgcttcgtccgggccatagttgagaaagctatgctctgaaagcaagcagctgaatgagcagtggcttctaccagaatttataacgatgatctgatcctgattggtcagaactgttgtaggaaaaacctggttggttgttaatactatcttc

SEQ ID NO: 30436 - DNA, 96 bp, Homo sapiens
  chr6:28129482-28129578
  hyper
ggcgcagccaggccccgcccagaaatttccgggacacgccccggaagtactgagagggacttccgccccgaggcgaggcctcggagctggttgctg

SEQ ID NO: 30437 - DNA, 1065 bp, Homo sapiens
  chr6:28175217-28176282
  hyper
acaaatgggaggactcgggcagctttcctgggatatcacaccatatagactgagaatttcagaaacgcaaagtgcgcgtcccagcagggcgagaatggcgttaactatgtcaccaccgcccaaattccctataatttaccacttatcgttcctggctttattctccgtgcgtgcagggacatgtaattctctaggagacggtggtccggacttggttcccgactccctcgtggctgcaaacaggggcagctgatttgggtggatgcagaggttgtggccaggggaagggccgcggggcagcgcgtagaactgattgtaaacccaacttcccgcctcggagcgagccgcggctcggagtagcgtcattcgaaagccaccggagatatcgagagagctccttaactgctcactgagcaaacttcgttttacagctttggggttgatatttgggaaactgggtcctaaaagtggcttctggtcttcagaaggctttgttctccgcttttgattttttgacaccacgggtttcacaccccaccccaccccccagtctcacacaaaccactcaaactcgattgcgtctccattgcgctttggggaaaaataatttaagattctcgcttctgaaatacagcgtgatggttaagagcatgggccgtggaaacagacccggggaaagcctcagctcggccactctttgccgcgtgaccctgggtggcaccttctaagggtgattctgggattctatgaattaatgcatggaaagcgcttgcgagagcgctagccggagtccgcgctatttaggtgtttgccaatattattgttgttgttaaggtgtgagggatcttggaagacagaagccaggaataaagtaaacctacagagacgtccctccccaaaccccggccgctacccctgcaagaccttgtggagcatgttaggtttcgtggcgtcgccaagttgtacctcctgcgcttcgccgcagataaagccccagcttagagcatggggtcgcaaccacccagagccttcagaccagtgagcactttccgcacaggtttgaat

SEQ ID NO: 30438 - DNA, 170 bp, Homo sapiens
  chr6:28249409-28249579
  hyper
gggctctggggaaaccggcgctcccgacaggggagcaccgggcctctgagctccctcgggagcctttcacgaggtcagctacgtctttgttgtgcgcgttcctgaacttttggtccattaaccaacaattagacacgccggtattcagtgcctggcgcggtgctagatgc

SEQ ID NO: 30439 - DNA, 38 bp, Homo sapiens
  chr6:28303451-28303489
  hyper
gccaggacagcccgcagactaagcgcattccctctcct

SEQ ID NO: 30440 - DNA, 30 bp, Homo sapiens
  chr6:28303931-28303961
  hyper
cggaaatgcgtcagccgttctgagcccact

SEQ ID NO: 30441 - DNA, 30 bp, Homo sapiens
  chr6:28304271-28304301
  hyper
ggctgagatcctgatcgcttacaagctgag

SEQ ID NO: 30442 - DNA, 225 bp, Homo sapiens; identical to SEQ ID NO: 544
  chr6:28367054-28367279
  hyper

SEQ ID NO: 30443 - DNA, 67 bp, Homo sapiens; identical to SEQ ID NO: 545
  chr6:28367280-28367347
  hyper

SEQ ID NO: 30444 - DNA, 81 bp, Homo sapiens; identical to SEQ ID NO: 546
  chr6:28367490-28367571
  hyper

SEQ ID NO: 30445 - DNA, 306 bp, Homo sapiens
  chr6:28367572-28367878
  hyper
cgcggggcgcacttccgcggccgctctaggaagggagcgaaaggggctttcaactcggtagtgtttccgcgcgtctacgtgagaggaaggttgatggctttcaggcccgctggtaaatggaacgggtttatcttctcctcttctttacccagccattgtccacacttcccccgacccgatgggtggtcgaggcttgtagaactgatcttaagacagggaaatcccttgcgtctccattcactttgggattctgtgtctctgaggttagagatgcctcaaagggatgttctccgggggaccttccca

SEQ ID NO: 30446 - DNA, 141 bp, Homo sapiens
  chr6:28410889-28411030
  hyper
cctaagatgcagatacggagagttcagagtgccatcagtacagggcagagaggttgaagagctcaggaacagacatagggtgggggaaaggggtaggggcaacgacgctgacttttggttaacaaagcccttccaggctgc

SEQ ID NO: 30447 - DNA, 57 bp, Homo sapiens; identical to SEQ ID NO: 549
  chr6:28411031-28411088
  hyper

SEQ ID NO: 30448 - DNA, 342 bp, Homo sapiens
  chr6:28411151-28411493
  hyper
cggtagcccgactccgaagctcaccgaggcatccgtgagaggagatgccacctagcgcagatcacatctgctctgaatccttgacaaccgcagcccaaagaatgataaactacaaaggccggaaatgcgtcaccgcggcccgctctccgcgaaacagcggttccggctgtgttccttctaggaaggccggaggtttccacacctctgtggtcgtcactctgaatcccgtctgtagtcttaagtgagatactaggtgacacattgtcttccacgcggcaatataataacggccaacatagtgttttaacacgtattaattcattaccccgcataacaaccctg

SEQ ID NO: 30449 - DNA, 50 bp, Homo sapiens
  chr6:28414942-28414992
  hyper
atccagcattgcagccgccgcggcggtctaagagctcaaaccctttcagg

SEQ ID NO: 30450 - DNA, 118 bp, Homo sapiens
  chr6:28415091-28415209
  hyper
cgttcccctttatcggctctattgccagactactggacttggaggatcagcagtttcaggtcatgcctcagaccagattgaaaacatggtgcctgttaaggatcgaatcattaaaatt

SEQ ID NO: 30451 - DNA, 289 bp, Homo sapiens
  chr6:28457572-28457861
  hyper
ttctcctctgtaacccgtccttccacgtcccggtggtgggggggggggtcccggttctcattctttcggggacctgcaaggagccccgcccgcaggctttgaaccgatttcggctccgcgtccaggagcaggccctacgtagggccgggggaattcaggtgcgtctgcggggcccagggcacccagggcaggcggggactgagacgactgagggttgagggacaaggaggttgggactggggaggggagacccgggacccgcccagaacgctttcgtggggttggagag

SEQ ID NO: 30452 - DNA, 64 bp, Homo sapiens
  chr6:28458128-28458192
  hyper
ctgcctactcctaaacgcagccggcaaaaatgagacgtcaactaagcgccgtttcagtcccaga

SEQ ID NO: 30453 - DNA, 119 bp, Homo sapiens
  chr6:32632538-32632657
  hyper
caagggtgggcctcacggaggggcgacgacgctcacctctcctctgcaagatcccgcggaacgccacctcgtagttgtgtctgcacaccgtgtccaactccgcccgggtcccctccagg

SEQ ID NO: 30454 - DNA, 128 bp, Homo sapiens
  chr6:34110456-34110584
  hyper
agttccagtttcactcgatcgctcacccgctcgctctctcacctacctcgggctgcctgccgctgtgcaaggcgctccctctcagagaagtcacgcctccaacggaatgaagccgcccagacgcaggt

SEQ ID NO: 30455 - DNA, 87 bp, Homo sapiens
  chr6:34111685-34111772
  hyper
ccctccctgtcacttcgggctttctgccagattgacacaggggcagccaccgctctgagagacacgtggcttcgggcacccagctag

SEQ ID NO: 30456 - DNA, 1141 bp, Homo sapiens
  chr6:34112299-34113440
  hyper
acccccacaacctgccgaggccacgggcaagcggttgccgggctccggccgctggcgaaggcggcgctggggcgggcacgggagctggacgcggtgcctgggaaaggagccgaggcgcgcgaggctgggtgccctcccgccgggagactgccgggaagaggtgcaaataatgccccgcgcccccgcctgtcccgcctctccgcagaccgggatgcgctaatgccgccgcccccacctgaaagctggcacgaccctccatccggtggaagcccctgtatacagagacagtactttccaccgggcccgcaaaaaagcctctgccccattccctccctcaggggcacccggaaagcctgccttagccccgaggggagaccctctagttcagatcccgcgccctccggcccctagggctccgggggcgccagctctcctcggagcactccaagcgcgggagctcgccggaggccacctccccgagccccgatgtccccgccgcagccctcgccccaggaggccggagggcacggtcccctctgtcggtccccctcgggccacaactcaccgcgcgccagcaaggtttaagccgcggcgaggggtcggctgcgtgccggcctgccccgggggcgcaggcagtcgacggccggaggcacggttctcgcggtgcccagagcccgggccgcggcgggcagcgctgacgctgcggacccagcgcgccgcggagccgcccggagtccgggacgcagcagggatgagctggcggccgcccggccggagccgccgccaagcgcgcggcgttcggctgctgctccggcaagcgagcaagcgagagggagatcggcggcaacccctgctcctgctgcggcggagcccggcgtccgagccggaaggagcgggagaggcggcaagaggagctgggtctggccgagagctccgggctgggaagggagcggagcgggagcgaccagcgagcgcagccggccgaggtacgggcgcctggcggcgccgcaacagcggcaacagcagcaggaaaaaaaatgagagcgagctagagagcgcgctggagagcgagcgagagagggagcgagagacgagagagcgaggaaggcgctgagaggggaggctgcgggagagggcggga

SEQ ID NO: 30457 - DNA, 80 bp, Homo sapiens
  chr6:34119186-34119266
  hyper
ctctctccacatgtccgggggctgtcagccgtgagccaaatgtcattagcatggatgtcacaagccgggatgtcaaaata

SEQ ID NO: 30458 - DNA, 527 bp, Homo sapiens
  chr6:34433517-34434044
  hyper
cagggagcaacatcccgggctccgagcgcgccagctgggagggctggggaggagggcgcaccggagggctcccggcacgcgcggggccgcgggcagcccccagaagagggagccaggcaagactgctggggcaggggtcggctgaagcagcggggagccggaccccacccgccacccgccacccgccacccccggcgcctgccaaactggttgctgcctccccggcagccgcggcgcgtccacctgcgcagccaccgcgccgccctgcccgcgctaccattggctcgctaaaaatgcctctctaatctgctctgctcggtgcacgcctcctcctcatccttcccccctctccgcctcagctctgaccttcctccttcccgcagccccggcgagatcccagagcgacgcggtggcggcggcagcgccagccccctcctcccccgggaagtcggccgggcttgaggccgggccccagacgtcccgcttcgccccgagtcgccgccgatggtccccggagctcctgcccc

SEQ ID NO: 30459 - DNA, 144 bp, Homo sapiens
  chr6:35181280-35181424
  hyper
gagcgagcgcggggacgcaccctcgctccccgactctttcctaggggagcgaggacgagtcggagcccggtgctgtttggtctggagccgagcggagcttgcattgatccattgattgcgcgcggtctgcgcctgacctccctg

SEQ ID NO: 30460 - DNA, 58 bp, Homo sapiens
  chr6:35466126-35466184
  hyper
cgaaactggagagggcgatggcgaaggcctgcagggcgcacagcgggtaccggtagtc

SEQ ID NO: 30461 - DNA, 49 bp, Homo sapiens
  chr6:35992409-35992458
  hyper
gggcgggctgaggagatgagagtgggggaggggacgaggaagaggagca

SEQ ID NO: 30462 - DNA, 57 bp, Homo sapiens
  chr6:36088966-36089023
  hyper
acaccttggaggatccgattagcaagaaaggcagggcctgtccggatgggggcaagc

SEQ ID NO: 30463 - DNA, 305 bp, Homo sapiens
  chr6:36252866-36253171
  hyper
taacaattattattacgttggggtagggtattcaagatatacccacaggaaaatgcagattacaattcagtctgcaattagggaccagatagcagccaactctcaggtgatccatgcagggattctgagcattcgtcggcgcctccccaggggctgctgcgccccctgcttcccgcgcgcccaccacgcacgctgctctgggagcagggccggcggcgccgccgcctcgcagcgattggttgaaccggaggttgttgctaggctaccagtgcgccctgagcctggggccccgcagtcccatcctc

SEQ ID NO: 30464 - DNA, 165 bp, Homo sapiens
  chr6:36806918-36807083
  hyper
gcagatcggcaggggcgcagtcctggagaccaggacactctgggaagggggcgcgcggaggtttaggatcgaagcggcaggggccgcggggctctgcgtccagggccggggcaaggggacccggccagcgggaggctcacctgcaggacacggtgatctccacct

SEQ ID NO: 30465 - DNA, 376 bp, Homo sapiens
  chr6:36808176-36808552
  hyper
tctctgctgagtgtgcgccctactcgggggcgggtctcagttcagaaacagaccctacatctccttctggggaggtgtgtgggggcgaccccagtgccaggagggactacctcggtttcccagtggcccaggtggggtcggtgcatgggcgcctcccccatccgtggttcccgccagccgcggcctcgccaagtcggctgccgaaaccacgcgccagcgcccttccactcccccgcccgtcgtgaccacacgactgagccagcctccaggtctagaagctcctgccacccagtctggtggcaaccagactgggagatcggcccgagctccctgggcttctatgcagccagcaccgagtaggcgcgtgctgtgtgcc

SEQ ID NO: 30466 - DNA, 474 bp, Homo sapiens
  chr6:37663985-37664459
  hyper
agggccaggggatgccggcatcctgatcagggtgtcaagccctgagtagaagaagcgaagccgcagcaacagcggggaaggcgagcccgccgcccggccttggtgctgacagccggctcgcccgcaagccgcgcggcaactccggctcatgcatcgcttggcttccactccggaggccgagccaggacgaggtttcggtgcaagtcgctgcaccagtcctagactgggtctgtccgggtctcccgagccgaccgggtgctctcaagggttcctaatcattcccacctctagcagggtgtgggaaagtgggtgcctcctcctgacatcccggcttcccaccagaccctacgaccggcccctgtgttccgaagcagctagctcggtctccacgcgccctggagagggcggggacgcgggcatccactccagagtccgagtcgaggtctccaccaaaccccggcagcgcgcactttg

SEQ ID NO: 30467 - DNA, 71 bp, Homo sapiens
  chr6:37664481-37664552
  hyper
cgaggttaagccaaggtggagcgggacgcgggctcttaccgtagactccttgtccccggcagtggaagggg

SEQ ID NO: 30468 - DNA, 445 bp, Homo sapiens
  chr6:37673008-37673453
  hyper
gcagccccagtggaacgcatcaagtttcgctgagctggtctttctaactttctccccggcagctccgcgggaagcaggatcaaatgttctccagcctgaaaagcccggctggggtgtgaggagaaaggagaaggggaggaggggcggccaatctgcggtattggaaggggaggggccggggccgggccccagggacaggcctcgtgactctccttgctccctttctgtttaaccctcccagccaattctttttcctttagccattagctctttttgatccacgtaaaagggggtggggggcgggaaatctggcgtggacttggaggcgttcagcacacccgcgaccgctgcgtggcataaactacagggggcgccattcacataggatacgacagacatggcgcccgccccctccgcccccccagtacaacgtgggggccctgct

SEQ ID NO: 30469 - DNA, 79 bp, Homo sapiens
  chr6:39016246-39016325
  hyper
ctcagctgggagacccgggaggaggtccggggtgccagggtgggaggagggcctggcttgtcgctgaaagccggccagg

SEQ ID NO: 30470 - DNA, 240 bp, Homo sapiens
  chr6:39016390-39016630
  hyper
cggagagcagtgcccgctatctcctggcccgggaccggcagaggggtgcggcggggcgggcccaggggtctctggcggccggaagaaccgggaccctgccaggcccctcccgcgggcagggcggcccctcgccggctcctcccccaccgcccgccaccagcccgggatcagtctccgcacgcggttccgcaggtggcagcgatggcccagtcctgaactccccgccatggccggcgcccc

SEQ ID NO: 30471 - DNA, 251 bp, Homo sapiens; identical to SEQ ID NO: 8461
  chr6:39016678-39016929
  hyper

SEQ ID NO: 30472 - DNA, 190 bp, Homo sapiens
  chr6:39197136-39197326
  hyper
gggcgccctggaccgcggatgcgtaaggagcgggaagaacacaggacttgactctgggcagacacgtgggccgcttctccacgcgtcgctcctccgcgcgccactagcagtatgcgccgcgcccgcctccgcacgcctctttaaccagcgcccggcgcgctctgcccccttgctccgggctccgaccggg

SEQ ID NO: 30473 - DNA, 218 bp, Homo sapiens; identical to SEQ ID NO: 8462
  chr6:39281088-39281306
  hyper

SEQ ID NO: 30474 - DNA, 383 bp, Homo sapiens
  chr6:39281616-39281999
  hyper
ctcagcccggcttctcgcagtcctctcgctagggcgagggtcttttcctccgaggtcccccaaccctctggtccccgcgcaggaacgcccacccccgttgtgcccgcgtctgcgttcccgacgtttccctgaacaggaaacacctgaccagggcctgaataggccccctcgccctcggcccgtacaccccgcggcccgctaccccatcccgccgcgcccaggccgacgccgctcgcccctgacccggatcagcgagtccagcgccgggcggtccagacacgtgaagttctgcaacagctcccacttgtcgcgctggaagctgcggctggagtcctgcgccgcgcggccctccagcgtccagaacacgccggtgcccagcgcca

SEQ ID NO: 30475 - DNA, 388 bp, Homo sapiens
  chr6:39759800-39760188
  hyper
gcccagaggaggagccggggagaaacccgctgcccaggtggccacttttgcctctttgacccttccatgtttccaaaacagaaggggccctgagaacgctccctgccaaagtggggaacagctaccctcattgtacgcctcgccctgccggtggcgctctccccccgcctgcgttcggtctgaaagtgtgaaaattacaaatcccaagaaactgcaatcagaagtctacctagggaaaattcagagtaaccttgccataaatatcccgctccaagacgcctgacgtcagagcggggcgggcggacgggcgcgaggccgggcctggaggggcggcagccgcggcttcccggggatagcgcggagcacgcagcagcgagcggagcgcggg

SEQ ID NO: 30476 - DNA, 193 bp, Homo sapiens
  chr6:39902169-39902362
  hyper
agcggaaccgcagcccgcttcgggagcacactggccgggcactcgcccccggggtcatcccagcaagggcggggaggggcagggggagggcgggacccgcgcagccaataggcgaggacgcagtcccgcgtggccttgtgggagctgtagtacgctccctgtgcccactttcctgggccggggtagcgctcta

SEQ ID NO: 30477 - DNA, 271 bp, Homo sapiens
  chr6:40554589-40554860
  hyper
agttcccggttccctcgggtgcgttcagccccgcgccgagctcccgcggacacccgggatcgcaaagacgcagcgccggcgaccactcacctgggcgaggcagcatctacccccggctgggtggcaccgaggccggctccgcggggcgcccgggctccccggctcggccacgcatccttccccgcccgagacagactcgagctaaaccctccggcggctccggcgaatgcaggcagatggtggcctcggacgtccacgcggggaaagccct

SEQ ID NO: 30478 - DNA, 29 bp, Homo sapiens
  chr6:40555212-40555241
  hyper
cccggtttctctctccgctccacacacac

SEQ ID NO: 30479 - DNA, 200 bp, Homo sapiens
  chr6:41337024-41337224
  hyper
aggcaacaggtgggacggggagccagggagtggaaacgccggaggtcctcaggctggggatcccggagtcctcgctcagattccgattccggagaaggccaattccgggaccctatccatgtcccattccgggcaccttcctcaaaagtaggggtgggaggggcataagccggtcaagtatttcccgggccttccggagc

SEQ ID NO: 30480 - DNA, 334 bp, Homo sapiens
  chr6:41339225-41339559
  hyper
tccccagagagcgatcgccccggacttgtgcctgtgttccggcctagggcagccggaacctcccgatatccccagaggagtctcaggacagcgcacagggaagtactggcttggagctgcgtgttccttgggcggccggcggagggcgaagagcaggaagagcccgggggacgacggtagcagagtgttggggaggccacagacgcggactgcgtggagaaagcacgcacccgggccgcagtagccgggcagggggacggcggaaagcagccctctctggaacattttattctgatccccgcaggactcccccgcgagccccggcttgagcagt

SEQ ID NO: 30481 - DNA, 405 bp, Homo sapiens
  chr6:41339601-41340006
  hyper
cgtgggcacttacacgttcccggggaggctgggggcaggagcttcactgttcacacaaagagcgcttagaggaggaacatttaagtttgggggcaaagaaagaaaaaagagttaaaggtttaggagatgggggaggaggatggggcttaaggacgcggtgttgccgcggctcagccatcggggcgggaagctcggggagggagagcgcctgggcccgcttctcgcctattctacgcagaacttttctctcctccttcttccctcgctctgcctctctcggggcggtctccggggactgtctctcacatccattctcctctcctccttgatttatgctgcagagtggaacgaccttccctgacctcattttcatgtcggcgcgagcacacccggagccggctacgc

SEQ ID NO: 30482 - DNA, 186 bp, Homo sapiens
  chr6:41340902-41341088
  hyper
gagaaatgcaaacagcggggtacggccggagtccgccccagcccccgcgccggagctgcgggtggcagggtcgggccgcggtaacccgagccgccgcgccggctccccgcgcgctgccctccgcctgccccttcgcccctgaccccgcagtcggcgcgctgggcctgcgcccgccatccccagcgc

SEQ ID NO: 30483 - DNA, 76 bp, Homo sapiens
  chr6:41341501-41341577
  hyper
cctggacagaccaggcgagcctcgctcctggtgcgggagctagttttccctggatcttccgcggcagagaagcctg

SEQ ID NO: 30484 - DNA, 30 bp, Homo sapiens
  chr6:41342243-41342273
  hyper
agctcccaattacttcgcgggattgggagc

SEQ ID NO: 30485 - DNA, 671 bp, Homo sapiens
  chr6:41342779-41343450
  hyper
gggtccttcaaaaagcgccactttggagacggtgataaatctgcgctgcctgagtcgttcccctactcccaacccctcgctcctcatcactgcccctcctagaccctgctgtgtagacgggacctcaaggagttcccgagggaacagatttgaaagcccagctccgggttccatggacagtgtttgacaggtcagcccctcgctgtcctcctatccccctcctccaagtccggtccccctctttcaccccaacccccactctcgcgtgggactcagacactgatcccggagcgagaatgcggctgacagttaaattgcagtgtaggccgagggggggaaaagggaccatgtctctttaacgggccctgcagacaaagcgtctccccttggagcgagcggagccaggcgcagccgcgcgcagacctgtcagcgcgtctcacgcgcttgggagagagtttgcaaagtcataattatatctcttaacctgtcttgctctctgcagaagaaggtcccattatattgaaatgagattattagccatcaaatactttctttctcgggagttttttttttttttaattcaaataccttaacgacttggcaattgcattttgatcagatttagttggcgccccagcccggagcgggagccggggcgggaaggcagctgg

SEQ ID NO: 30486 - DNA, 52 bp, Homo sapiens
  chr6:41343650-41343702
  hyper
tctttgaaaatggaacgcgactttcagacaaggcgaacgtggacgccgaggc

SEQ ID NO: 30487 - DNA, 278 bp, Homo sapiens
  chr6:41438225-41438503
  hyper
agcgagctgctaagccggactggacggcgggagccatctgggccagcgcgggggccggggaagttcaaggcccgggcactgcgcagcgccgagggggatgacccgccgtctccggggcgccagcgccggctagttgctcaacctgctggattagtcactcggcgggacccgcgggaccgtcggaaaaacgcgaagggagcgctaacgcgcagtgggagggaaggagaggactgaagagagacgggggaggggagaggaggggtcggctgccaggccta

SEQ ID NO: 30488 - DNA, 56 bp, Homo sapiens
  chr6:41605896-41605952
  hyper
acaggcaaaggaaaacgtgcagcccgcggatctccgggcctcagagagcagggagt

SEQ ID NO: 30489 - DNA, 320 bp, Homo sapiens; identical to SEQ ID NO: 2812
  chr6:41606037-41606357
  hyper

SEQ ID NO: 30490 - DNA, 95 bp, Homo sapiens
  chr6:41606527-41606622
  hyper
cgccctatggagcccccagcgcagccccgggcccaggtaggaccgggagtggcgagcgaagctggacaggggcgggtgggcggctgaaggggcca

SEQ ID NO: 30491 - DNA, 176 bp, Homo sapiens
  chr6:42879393-42879569
  hyper
gggtcttcctccttccggttcttgggaagatcctgcaatctgaaagaggcaggagagctctttccccatctgtaatgtggtaaccgagcccgagccagctcctccctgggctggagggtgggagagtcgttagggacacctgccccgctccctccccctcccgggggggaacccac

SEQ ID NO: 30492 - DNA, 139 bp, Homo sapiens
  chr6:42879621-42879760
  hyper
cggcctccaggcagccctgggaaagcaagggccgggagcgcagccctggaggcagagtgttccctcaggaccgtcaggagagcgccatccacaggattattaaaatagccatccagacggaaatcgagtgaggctggca

SEQ ID NO: 30493 - DNA, 200 bp, Homo sapiens
  chr6:43211262-43211462
  hyper
aaggaggatcggggccgggccgggccgggatgatccgggtcggaaggccgccgccgccggagggagcgggtcacccaacgccgcactgagccgcccccgccccgccccggccccgggggatgcgccgccccgagctgctgcctccgccgccgccgcagccgcagccgcagcgggcacagagcaggtgaggcggggcgggg

SEQ ID NO: 30494 - DNA, 438 bp, Homo sapiens
  chr6:43237245-43237683
  hyper
caccctgcctgaccccgcccacttgcccgggacgccggcgccgcaggggctgtgagcggtgggtggccccggagacggagctgtcgagtctgtgcctgacacctcttttccctccactttcttggtctctttcagttggaggaggacagactctcggggcactccctcccgcggtacagccccctgcgacgactggcgtcctccgtgttctcctcctccacgctggagacggagcattaccctcaccccggcggcggcggctcctcgggctcctccggttccctcattcagcgcagccgctcggctgagagcagccctgtgcgggcgccccaccggcgccacgcgcccctcgctgctggcaaccacagactcatgccctcggtgctccgcatctcgcggtcccagctgcagcaggtgtgggcccggttcacccacaag

SEQ ID NO: 30495 - DNA, 116 bp, Homo sapiens
  chr6:43242817-43242933
  hyper
cacacactctccctccgtagctgcgcgcacttcgcccactctccggaccctgcactagcggccccggccgggagggcacgaggactgcgcagccggacccccgcaggtccccaagc

SEQ ID NO: 30496 - DNA, 42 bp, Homo sapiens
  chr6:43243433-43243475
  hyper
ccccctttttgcccacgccccaatccgcgtcccctgccccac

SEQ ID NO: 30497 - DNA, 30 bp, Homo sapiens
  chr6:43244222-43244252
  hyper
ggtgggacacggacacgcacccacgcgcac

SEQ ID NO: 30498 - DNA, 15 bp, Homo sapiens
  chr6:43612884-43612899
  hyper
ggcagggcctcagcc

SEQ ID NO: 30499 - DNA, 180 bp, Homo sapiens
  chr6:43613052-43613232
  hyper
cgctctataggtgaggaggcccccgggacgggctccccagagggtggctacctggaggcagggcggggtgggcgggtcgcagcaattgaaaggggcggggcccatggggccaagggaggtgtgggcgggatctgagatgagtggaatgggggagaccctggggggcgggcctggggacgg

SEQ ID NO: 30500 - DNA, 30 bp, Homo sapiens
  chr6:44264917-44264947
  hyper
gtaacccagggaaaccggcagtgcagtggg

SEQ ID NO: 30501 - DNA, 66 bp, Homo sapiens
  chr6:44265201-44265267
  hyper
gggcgtggggtctcccgtgggtacggaccggcgcttccccgccacggaaaacgcaacccaggcaat

SEQ ID NO: 30502 - DNA, 238 bp, Homo sapiens
  chr6:44265569-44265807
  hyper
cagggtggccaggcccggcctcgggacggttccgtggaagcggccgctttgcgggtagtgggactgtggccttgcgctatgccctgtgcttccgtgggacgtgtctaggaacgggtgggctttctgcgggaggcgggggtcgggcagggctgctggtctggagtgcttgtgctctcttggtagcttttgtgtggcaatggatagggagctggtccaggaaaagcgtctgtggaagaag

SEQ ID NO: 30503 - DNA, 60 bp, Homo sapiens
  chr6:45387578-45387638
  hyper
accaggtgtcatagccggtggcgcagaatcgcttctcggagtcaccgagggtggcagtgg

SEQ ID NO: 30504 - DNA, 260 bp, Homo sapiens
  chr6:45387838-45388098
  hyper
cttacccctcgagagcgcacacctggctaccccgcacccccacctctgctcccgcggtctggcagaccctcagtcccccgcgcatctcttcagcggggcgatcccgagtcacgcaaccacagccccccaagctcatcttgtactcgaaagggctccagagtccgcgactggcaccaggcccccatcttccgtgcccctcatgctctcagagcccttccaggccccttctagggcgcagacccgggcgtgggctcagcgag

SEQ ID NO: 30505 - DNA, 38 bp, Homo sapiens
  chr6:45388359-45388397
  hyper
actgatgatttttttcgcaaacacgttttcaagctttg

SEQ ID NO: 30506 - DNA, 30 bp, Homo sapiens
  chr6:45388792-45388822
  hyper
ataaataaacagccacggaagcattttgaa

SEQ ID NO: 30507 - DNA, 408 bp, Homo sapiens
  chr6:45391133-45391541
  hyper
acatcccggcctggccgcattgcgggctgcccgcgcagcctctctttggggctccgcgcgctctcacccgcttccctcacagccaaacgcctctcctcaggtctcggcgtccccttccccgacccgcagagttcagcggtcctggtccctcccgggctcccgtgccgggattcgtggggtgccggtgccgggcattagtgcccggggctgggcgtggggtgctgactgaggcgcgcgggctgcgctaccagtgcccgggagggtcctggacaaacctagggtctccagaggagggggtgtcagggcgggggcgtttgctctgttcgctgacccgcgccagatcccgttaccgggaggaaggcggggccgctggggcgtccgcaagccccgaagcgggggcgttcaggg

SEQ ID NO: 30508 - DNA, 178 bp, Homo sapiens
  chr6:45982792-45982970
  hyper
tcattgtgtcaataacgtttctctcccattcctccccctcctcccgttttaaaggaaaggttcacgggtccagccaggtttctgccgcatcccgacacctggagacgtctttcaggaccagcctgaatcgcgtccgggctgggctctggactcggactcgcagcggtgacagcggagg

SEQ ID NO: 30509 - DNA, 30 bp, Homo sapiens
  chr6:45983617-45983647
  hyper
gcccaaaatagccggcggctgcagggcggg

SEQ ID NO: 30510 - DNA, 105 bp, Homo sapiens
  chr6:46138639-46138744
  hyper
gggtgactggaggaacgcccccggaacgcgcaggagctcacctgcgctcaactctggagcggagcacctgaccgcgccgcttccccgccccgcctcctggcttct

SEQ ID NO: 30511 - DNA, 931 bp, Homo sapiens; identical to SEQ ID NO: 8483
  chr6:46702594-46703525
  hyper

SEQ ID NO: 30512 - DNA, 192 bp, Homo sapiens
  chr6:49518808-49519000
  hyper
cgaggggaccctgcacgggaagaggtggccggtgcagaggaccttcctcatgcgggtggagaggaccacggcgaggagcccaactacccttctgtctttcaacgacaaaagcgaatttctggcaggcgtgtagccccgccgcgggacgcagcagacccacccaaatacgtgcttgtgcgggtggaggattat

SEQ ID NO: 30513 - DNA, 387 bp, Homo sapiens
  chr6:50674363-50674750
  hyper
gttaccagggggtcccggggccagcgcggaattcgcggaattcaccaagccgcagctgcctgccgctgaatgcgaagagggcgcaggagactggcaggtacagctggtggtcccttcggcctgatttccctgctgagtgccacagcgtccgagatccacgactggccaggtggagccaccgactctgaagagaaccagaggcggaccagccaggggagagggcaaccctgggagcactgcacccttgtcggtcccctggaaagctagcggtaagatccgggaggctgaatttgaggccgcggtagtccaggcgacttcccctggaaggtgtgacgatgacttgtactgcaaaagaagcctagaccaggcctccgtctgggtgttttc

SEQ ID NO: 30514 - DNA, 460 bp, Homo sapiens; identical to SEQ ID NO: 2814
  chr6:50681604-50682064
  hyper

SEQ ID NO: 30515 - DNA, 74 bp, Homo sapiens
  chr6:50682265-50682339
  hyper
agggagcaagttgaacgatttgcacagactggattttttaaaatatatggacaatgattttgagcagcccgggc

SEQ ID NO: 30516 - DNA, 236 bp, Homo sapiens; identical to SEQ ID NO: 2816
  chr6:50682448-50682684
  hyper

SEQ ID NO: 30517 - DNA, 230 bp, Homo sapiens; identical to SEQ ID NO: 2817
  chr6:50682711-50682941
  hyper

SEQ ID NO: 30518 - DNA, 174 bp, Homo sapiens
  chr6:50682991-50683165
  hyper
cgctccaccaccagtccttccattacgagtttcagcacagccacccggccgtcacccccgacgcctactctctgaactctctccaccactcgcaacagtactaccagcagatccaccacggggagcccaccgactttattaacctgcacaatgcgcgggcgctcaagtcgtcct

SEQ ID NO: 30519 - DNA, 118 bp, Homo sapiens
  chr6:50689899-50690017
  hyper
ctgcgtgctgactctcggttaatggtgtacgcgattttgcccgcagctccggctctccaaccatcagaaccaataatctttactttaccctgtgctcgcgtatcgatagcttctttcg

SEQ ID NO: 30520 - DNA, 49 bp, Homo sapiens; identical to SEQ ID NO: 8491
  chr6:50690631-50690680
  hyper

SEQ ID NO: 30521 - DNA, 424 bp, Homo sapiens
  chr6:50691789-50692213
  hyper
attaatatctgctgccgtggggggagaggtaacatggggggaggggtaacatgggggaggagggttaggaagggtgagaggctagagaggaagcagcagagaataattctccccacccaactcacaggcgcacctcgcagaaatgcaaccgcagaacaaacagggacaggaaactcttgtaatcgcttacacatttttaatgtgtcagaaaaaaaagagcgatcactggagatgaagaaggggagaagaaaaatccctgccgtttgtatttctttcatttgaattgtaaacatctgtttggctgtaaggcgaacagatcatttattttgctctcaagatttggtctaattatgtcaacaccgacgctacgacgagtggggcggcgctgtggctttggagaggatgcgcgcaccggcccagcgcc

SEQ ID NO: 30522 - DNA, 213 bp, Homo sapiens; identical to SEQ ID NO: 553
  chr6:50692299-50692512
  hyper

SEQ ID NO: 30523 - DNA, 661 bp, Homo sapiens
  chr6:50787216-50787877
  hyper
gagcaaaatagaagtcgtagcagtttattagtttctgttttcttgtgttttgcttccttgagggtcactgcgtccgaacagaaatcgcagccgcctcctgtgtgggcatctttcacggaaatttctgcccacgttcaatgcgtacgggtctctagcactgaggctagctcaactcttcggggcaggagaagttgcgcccagccaggaggacgccagccgcctccggggcccggaccgcgctcgccaaagcccttttccggctcgggcgagggctgacgcggccagacggctccgctactcgcgggcgaggcggactaggcggacgaggcggccgaggcgggcgaggtgggagaggcgggcgaggtgggagaggcggccgaggcgggcgaggcgcggggcgcgcggcgggccaggctggggaccgggaagcccgcggagcctcgcttttaagcggaatggtctgggacagccccaggtggttgccaggggaagggaggaagggaaggttctgctgagacgtcgaggttggaaataaaaacttcggaaaggcgaagcggatttagaaaaggagggaagtcgaggcgggcgaagcgggccatggagattgctaagaggaaaagttggagagaaaaggaaggaagagaagcagactcccgggtgg

SEQ ID NO: 30524 - DNA, 452 bp, Homo sapiens
  chr6:50787949-50788401
  hyper
cgacccctccggatcgggacagctcctgaaagcccggcgcagagccgcctcgaagatcctaagagtgggcgactcacaggcgcggccggcaagctcctgggggactcgggctcggacgagcgcccacaggcagcgcctggcgcccacacctcctgcccccccccgaatcctaatgttggggtgtgtgtatgtgtggaggtatgtaggagagaggaggaggagataagagaggagagggagaaaagcaggagagagcgcgagagagcagagaggagagagattggtcttgttgctgaatgatgcttggggttttccttttctctttgtggttgtgtatcgactgtaacgaagagccgcgcctacgcgcctggtggggattgtttcggttcggcctccttttctttccttaacaggcgggataatggtaaagtccaaggcgctagaactgtcct

SEQ ID NO: 30525 - DNA, 30 bp, Homo sapiens
  chr6:50789549-50789579
  hyper
gtctgagcccagcttcgggtgaaagaggac

SEQ ID NO: 30526 - DNA, 360 bp, Homo sapiens
  chr6:50791135-50791495
  hyper
tcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcatt

SEQ ID NO: 30527 - DNA, 36 bp, Homo sapiens; identical to SEQ ID NO: 555
  chr6:50791550-50791586
  hyper

SEQ ID NO: 30528 - DNA, 316 bp, Homo sapiens
  chr6:50793335-50793651
  hyper
atagtcttgtcaaagcgtcggaaaggatttagtgtttatgtgaacggagcacctcggggccaagttgttgctgtcgggaatacagaccacagaggtagagagctgaaaggagaaaagcagcaggcagcacaccggagccacttgcaggctctccactcacccaacccccaccctgttcctcccctgctttatctcatttcgtcacctgccgggaggcccacgggaccttcttgggacgacccctatagtgcaagggacacaccctgctcctgtccctagagggaaacagcaaagacagggacggtctctgcctccg

SEQ ID NO: 30529 - DNA, 132 bp, Homo sapiens
  chr6:50794608-50794740
  hyper
tgagttgtttttctgcgcttccgcatgcagtcctaattaaatctttacgatcctccctgtgacgattaagcgccagcatgctgcgtgaatatcctgtacaaaaacccagcaggcggccgtaattagatagaa

SEQ ID NO: 30530 - DNA, 218 bp, Homo sapiens
  chr6:50798960-50799178
  hyper
agtagagagagcaaacgagtggagtgaaggtagccagcgtgataaatggctctttcatttgaagatctccagagctcgtttacggctaattttctgtattggccccctttgagctattaatgcaatctgcagggaccgtggcccctctcctcttagctgccccattagagctcccattaagctgcctagtctcaactccatggcgggagtgggcgggg

SEQ ID NO: 30531 - DNA, 564 bp, Homo sapiens
  chr6:50803804-50804368
  hyper
aatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaaggtaaccccaccacgaaaaacaaaaacaaaaacaaaaaaacaaacaaaaacccaccagtttttatttattggacagtgaggagaaggttccagcaaaacccaatctgcagtctgacgcagttgcctagcaaccgggtggccggagcattgctttcgcgcagcgcttgggaggatccgcggccgccacctgctcgcccacaaactctagtgtccttgcatccaggcctgcccgcgccgcgcaagtcctaccgcagattttgccgccctgggaacctttcactttcctggccctgcgcctggcgcctctcttcctgtcacccctaggacatctcagggggcattctccagcctgagtacaacgcggaactaacagccc

SEQ ID NO: 30532 - DNA, 30 bp, Homo sapiens
  chr6:50805801-50805831
  hyper
ggaaggtaagcaagacgtgtggccatttca

SEQ ID NO: 30533 - DNA, 116 bp, Homo sapiens
  chr6:50808634-50808750
  hyper
gcctgcagtgggcggcgctgcgtgcgcccgcacgtttctcttgcaggcgcggcccaaacagccgcgctcatttatttagtgttggaggacgcggtttgtcccgttgacagcgtaat

SEQ ID NO: 30534 - DNA, 163 bp, Homo sapiens
  chr6:50810551-50810714
  hyper
gagaaaggctgaagtcgggggaaggcaaggctttggggtggaaggggtgcattacctccccacccccgctttcctttcagtcccagctgctcgagaagggagggcgctgggaaaggaaacagagcggaatcgcccacattagcctcgctcttcggtgacccgg

SEQ ID NO: 30535 - DNA, 30 bp, Homo sapiens
  chr6:50811458-50811488
  hyper
ttattggaagaaaatcggagaaacgttggt

SEQ ID NO: 30536 - DNA, 45 bp, Homo sapiens
  chr6:50811838-50811883
  hyper
cagagcaggttctggcggctgaggaaaatccggaccaataagttg

SEQ ID NO: 30537 - DNA, 622 bp, Homo sapiens
  chr6:50813317-50813939
  hyper
cttcgtccgagagctcggccgatcgcattagatgtgttctgattgcacaaggccaggagagaccacactgaaaacgatcgtctcctttccttgcagggcaacgcgccccacgcgtgtgacgtgcgagagacgcgatggacgcgccttgctcttactgtgcaggtcctgagagcgtgtgggccacaggcgcccagtcgtgttgaggacatagaatcagccgctggaggggctgccgactgcgcgggcccttcccgctctcggtctcaccctaagggctaaggcgaccgagaaagccccattctccagtaggtaatggggcggcgcccggtgggctgcaggtggggagggctcccagcgccgccagcggccacccggggcgccggctcctggagggagagtggcctagaaatatccaaggaatccgaagcttcccctcctccacctctgccagtacggaaacaccccaccgtcacaatcctaaagcggggagatgggatgggaattgtcttacttggcaaggcagggtaccttcattgccagacgccctcatttgtgtgttcctccttgctccagcgagatagaaccttttgcgcccccaaccccgtttcgtggagtgagccca

SEQ ID NO: 30538 - DNA, 30 bp, Homo sapiens
  chr6:50814569-50814599
  hyper
ccccacttaaagaaccgaagaggcttttaa

SEQ ID NO: 30539 - DNA, 215 bp, Homo sapiens
  chr6:50817141-50817356
  hyper
cagggaccctgagaccgccagatccggtgggcggcttacagtggcccagaacgcacccgccggctcgtgttagcgggttaagggcttgattaaaaatagtgctggaaggaagacccgattatttttttatgaagccacattccttttcttcatttgcaaataacagttccgtagggtcccttcccagggaccctgggcgccgaagttaggggcca

SEQ ID NO: 30540 - DNA, 30 bp, Homo sapiens
  chr6:50817727-50817757
  hyper
tctccgccgggatcgcggtatcctagggga

SEQ ID NO: 30541 - DNA, 559 bp, Homo sapiens
  chr6:50818449-50819008
  hyper
ttgaaggggctgcagcgtgggaagccttcaattttttttttttgtaagctgcgtgtgctcagattgaggaagcagttttgtcacacatgttcaacacgttccacgctggtcacaagctagcaaggtcaggtagtttttcgcccacttgttcgaaaacctattagttcctgcccaccctgctcttcgcttttcctcctctctcctaagggctgcagccttctggagctgactcaggcgagaggcgtccagagcccaaataggggtcacacctgctgtcgagagagtcctctgcataaaaatgctctttaaaatttttaaaatcagcataatggccaatggacttaacaaagcgtgacttgcccaggctgcacggagggcaactctggcagtcatctgtaactcgaccagttaacgtcccgaacgtgcctgttcgcggagatattagcaaacgtttcaaggatgtggctgtcagatgtcattagccaacgcttgctcacccaaccatttgcctaactgggaggagggcatggccacggcgtataggcgtagaatttggggg

SEQ ID NO: 30542 - DNA, 138 bp, Homo sapiens
  chr6:50819287-50819425
  hyper
acactggaaattcagcgtccggactctcgatcagatgccctagagctcagaagcacctgattgcgcggaaggctggtggtggttacttgggcaaagagagtgcgactcgaaactcgagtttctcggatttaggaaatc

SEQ ID NO: 30543 - DNA, 35 bp, Homo sapiens
  chr6:52227751-52227786
  hyper
ttggctggatgggaacgccgcggtggggtgtcgga

SEQ ID NO: 30544 - DNA, 69 bp, Homo sapiens
  chr6:53213645-53213714
  hyper
gcagcagcaaggcggcggcggcggagggagcgcgggtggcagccggcgcagaggcggatgtagaaggag

SEQ ID NO: 30545 - DNA, 341 bp, Homo sapiens
  chr6:55443840-55444181
  hyper
gcacattccccatggcggagcctggggcggcagtcggcgaggggagggagactggaggaggatgaggggcgggcaccgcgctgggaaactgcgccagctcgggagcgcgcccctccggtgcactggctgtgaggaccagagctgttctgcgcactgcggcggcgccgagagggcggggagtggggcgtggcaggtggccgcgcctggggcagcgggtgcacggggcacctgcgggaatcgacagaaatgccgagcacctgaacaggagagaaaggagctgagccagaggatgtccaggggtgtctcattttccgcactacactgagcgcccagggctgact

SEQ ID NO: 30546 - DNA, 233 bp, Homo sapiens
  chr6:56112173-56112406
  hyper
tgtctccttacctggcgcagtgtccaggctcggggttgccgtcgcagccagctgagtgttgcgccagggggacaggtatgttccaggcagtggcaagcccaacccgagcaagacctgcgctgaaacggattggctgccctccgcccggagtccgttctccctgcagcggccagtgcagagctcagaggctcagaaactcgctctcagccccctggaggcggagcccgggagat

SEQ ID NO: 30547 - DNA, 86 bp, Homo sapiens
  chr6:56708805-56708891
  hyper
cgcagatcgctccaccgctgtgcgcagccccctgctgaggggccagcggctctccctgggtaagggatgatcggggggagggttgg

SEQ ID NO: 30548 - DNA, 113 bp, Homo sapiens
  chr6:56716187-56716300
  hyper
ctcttacctgctatccgaagcactgccctctcggcagggtccagcactgagcccccttgaatctttcttttcgatctctcatgtttaggcaaattccagggtaaggtgtctcc

SEQ ID NO: 30549 - DNA, 306 bp, Homo sapiens
  chr6:56716389-56716695
  hyper
cgttcccggaactctacagagaatgacacagaaaaagcattaacagcaaaatactcacatatgctcaatgatttaaacatctcccccaccaaccaccgccgccctccctgcccccaaactgggtctggcatatcctgcaccatcctcggagctgagggaatatgcagaaaccaaaaaaataaaacccggagctcaccatcttttcttggccaagtctccaatcgtaaaaacaatacacaggcagtttcaatacatgaagatttgcacggaagaagtgtgtggcctgtggtccggccaccagctcac

SEQ ID NO: 30550 - DNA, 925 bp, Homo sapiens
  chr6:56818720-56819645
  hyper
cagactcctggaattcggtgggacatcctgggggagggaggaggagtcctggggccatcggtctctacgtgatttctccgcgagaagtttgcatgaaagttctgggggagttggggagccccgaagtttccatgccttactttcttacccctacgctccagcgaaggatgcgtgaaggcgaggctggcgcagccccggactacgctcaaattacccttaaggctttagcaaactgactaaaaatttgagttctttcctcccctccctgccctcggcatcgccgtggttattcaaacctgggagactggagggcggaggtgacggcaaaaagggcaaggggcgttaaagaaacgcactcagcctggggagtgggcaatgatggggctaggggcagccgaggagaagggagcgagccgcgcttcactctccaaatcggcttaattgttcctggtagcccgcagaaacccgtcgcggcgtgtcttacctcggcttcttgaacgacccgagaagaccgatttcatcggatgcctccctttctggagcttgcggtgccagcagcagaagaagacgatggtggcgatggtgcccagcagaagcaacaagaggaagagggcacattggatgctgtagggtctcagcaagacgaggaaagccgcggcgatcatggtgcgggcgaggcgagggcgactcgacggcggggctggagggcggcggcacaggcacccgcgctgggcgcacgccgggacggcgggcacgggtgagcgcggctcagcgcgtcatgcctggcgctcgcggccccgcgcccagcccaatggctgcgcaccccgcgccagccgcgctacgcgagtgatccagggctgcggggagcgcttgccatgactcagcagacagcgacgaggctgcgactcggcggctgggatcctct

SEQ ID NO: 30551 - DNA, 82 bp, Homo sapiens
  chr6:56820782-56820864
  hyper
cagtgtgcctttctgcggacggccacggccacctggccaggaagcggctgctgcagcagtcattctgcggcatcttgcggcc

SEQ ID NO: 30552 - DNA, 83 bp, Homo sapiens; identical to SEQ ID NO: 2827
  chr6:58147428-58147511
  hyper

SEQ ID NO: 30553 - DNA, 214 bp, Homo sapiens; identical to SEQ ID NO: 2828
  chr6:58147762-58147976
  hyper

SEQ ID NO: 30554 - DNA, 30 bp, Homo sapiens
  chr6:58148921-58148951
  hyper
gttgctcggaagctacggaagcaaagtaga

SEQ ID NO: 30555 - DNA, 26 bp, Homo sapiens
  chr6:58180231-58180257
  hyper
ccgcagccctggagccgggcagtgag

SEQ ID NO: 30556 - DNA, 420 bp, Homo sapiens; identical to SEQ ID NO: 560
  chr6:62995455-62995875
  hyper

SEQ ID NO: 30557 - DNA, 53 bp, Homo sapiens; identical to SEQ ID NO: 561
  chr6:62996077-62996130
  hyper

SEQ ID NO: 30558 - DNA, 83 bp, Homo sapiens; identical to SEQ ID NO: 562
  chr6:62996131-62996214
  hyper

SEQ ID NO: 30559 - DNA, 426 bp, Homo sapiens
  chr6:62996215-62996641
  hyper
gtagcgcaagtcgggtggcctgactggcaggaggcagctgcagaggggaagggagctcggaagatgcaaacgctttcttcttgcgcccaagccttccctggctattaggcatgcccagttttgtggagttctctgtgtcttcagctaaggcgcagaggagagagagcgcgggaaaagcgcaggttaaagagagaggtctgagtacaagtggacaggggagatggagatgagaagtgagccacccgagagggtggaaaagcgccagggaaagtctcaggaaggtagatgggacttcacctgcgtccctaaggcacaggtgtctcctttccctcacacagctcaggcgcactccagttgtgcaggaatcagcagcgcactgggtctggaaatacaatgaagactgcatgtgatcggcagctggtattt

SEQ ID NO: 30560 - DNA, 326 bp, Homo sapiens
  chr6:69344323-69344649
  hyper
attaagactacaaaacgaaacaaaagtttagaccccgaaaccatgattccattgccaagcacaaagcaatgcaagagcccaacgtcggtcgccgcaccgcgatcctgacaaagcctgtatggagccagaacaaataagatgttaattgcagcctcgcagagaaaaaaatactattgttccagccagagacactcagcagctcggtagctgggatgtgccccctccgctgcggactggatcaattctgaatcccggtactgaaatgacagctctctggctgcgacaggtctgcgctgaaagaaagagaaagacgatcaagtccagca

SEQ ID NO: 30561 - DNA, 461 bp, Homo sapiens
  chr6:69344978-69345439
  hyper
agaactccaggaagtcgcagcggccgcgccgcgcgagccgagcctctggcgggcggcggggcgcaccgcagctgtgcataagaagggcgcgcggcacccgggacgcgcgcgcacacgagcacgcgggaggccgccgcgcggacgcgctcccgggacacgcgcaccccccgcgcgcgcgcccaagggagagcgagcactgcgcgccggcgcgcacacccgagacagagctttactatctcgctccctctcgcgcctccctcctcgctgggcattcaaacagctttccgacatcaccagccaaggatttttttccccgctctccttagtcgccgtccgtccatcagtacctgcaggggggaggaggaggagggaggaaagcggaaagaggaaaaagcataagcttgagccttccgatccgaccacgaatactcctgtaataaacccaccgccccaacaaatct

SEQ ID NO: 30562 - DNA, 32 bp, Homo sapiens
  chr6:69345820-69345852
  hyper
tcactgttgctgggacgcgtgcctgtgctggt

SEQ ID NO: 30563 - DNA, 370 bp, Homo sapiens
  chr6:69942843-69943213
  hyper
ggaagtggctgccaacgctctggcggctgctcgtgctgccgccgctgccgctgctgttcctcgcatagggctggacagagctagtcccggtttcagcacctccggcgctggacagctctctgcacgccgcaccgccgcctgcttgctttttcccactctcgctttgcattactggagatgcatctaaattacatcctgttcaacaacaagtagatttttttttcctgtacaggaattacagtagacgactctctcaattaaactgcattttcttctttacggatttggctatcaggcgtatttatcccgatttcctcccccctcactcccctttgcaggaacgagtctttgggaacgtggtccacccagg

SEQ ID NO: 30564 - DNA, 38 bp, Homo sapiens
  chr6:70576959-70576997
  hyper
actatcaattcatgccgttagagcgctttttttttttt

SEQ ID NO: 30565 - DNA, 30 bp, Homo sapiens
  chr6:70577378-70577408
  hyper
agagcgcgccggcgccgcagccacagcggc

SEQ ID NO: 30566 - DNA, 86 bp, Homo sapiens
  chr6:70991963-70992049
  hyper
ttttctaaactccaacgaccaaacaggttacaatggggtctttgtaagtgaaacctcaaacctcagctgggcttatgcgcccccgc

SEQ ID NO: 30567 - DNA, 81 bp, Homo sapiens
  chr6:70992136-70992217
  hyper
cgtcccggagccgccagcaccgctagctggactcggggttagtgcagctacggcgggctggaggagcgggagagggagcgt

SEQ ID NO: 30568 - DNA, 622 bp, Homo sapiens
  chr6:70992438-70993060
  hyper
gacttcgataggactcgcggcaggtgctcgaggctggaggaagcgcgggtctgagagccctggggatgctccgcgcctttctcacagctccctcgaccgctgcgccccgacctgtcctcgtgtgcgcttgaaaaatgcaaacactccctgcccccaacttacctcgtcggtggtctggctgggctggagaagaaaagatggggagaaagtgagaaaagcacccctcaaactcgatcgcaacttacttgagccgcgcacaagcagagccccaacagcagcagccccagggccccgcggtcccgcgcagtccaggccatgcccgccgcccgccgctaatcccttggcccggctctgcagcctggttcccctctaggcttccagacccgccactagcataggtggcacttcgtccctgcagaaaaagcacccccgggagtagcggttgccaaagcgtccaggcccgggaggcgcgcgttccccctgtttatgaatggccccggagagggtcctgggattggaggagagctagggggcaggggaggacggatagaatgacaacagtcgcccttaaccccttccctgccgccgcacaggcgaggactgagcacgcagctctgcctcc

SEQ ID NO: 30569 - DNA, 32 bp, Homo sapiens
  chr6:71665985-71666017
  hyper
gcccccgcggcccaccgcgtagggagagaagt

SEQ ID NO: 30570 - DNA, 190 bp, Homo sapiens; identical to SEQ ID NO: 8524
  chr6:71666491-71666681
  hyper

SEQ ID NO: 30571 - DNA, 280 bp, Homo sapiens; identical to SEQ ID NO: 8525
  chr6:71666698-71666978
  hyper

SEQ ID NO: 30572 - DNA, 118 bp, Homo sapiens
  chr6:72129732-72129850
  hyper
aaccacttgagcccacggcgcctaaagccgactcacccgcagcccgaggtgcgggagccctcggacggactccggcccgccccgcagtccccaccggccgcgctgcggccccggctga

SEQ ID NO: 30573 - DNA, 119 bp, Homo sapiens
  chr6:72129926-72130045
  hyper
cgcaaacttttcccggttcgcaagttgccgggatctgcggccgcggaccgacttccttcgccggccaccggagggagggggcgcccctaccccgggagggggctgggcgagccgggaga

SEQ ID NO: 30574 - DNA, 274 bp, Homo sapiens
  chr6:72130190-72130464
  hyper
cgccgccgccgcccaccgcgttctttgtgtgtctctcgccgccctccagccgcttcgccgctcgcctgacagctgatgggctcaccgcgccgggtcccgcgtcctctcggccgcagccggcggagcccggcccggcaggaggaggaggggagaagaggagcgttgacagatgctgtcttggagcgggcaccgccgggggaaaagtctggactgcctcggcgagaagcggccggtaggcaaccggccccagcctcgcattcgcctcaaagacccc

SEQ ID NO: 30575 - DNA, 79 bp, Homo sapiens
  chr6:72596056-72596135
  hyper
cgactgtaggggtagcggccggggcacgcgtggctcggacccggggagtgggcgggtgggtgcccgtgggcggagcggc

SEQ ID NO: 30576 - DNA, 122 bp, Homo sapiens
  chr6:72596136-72596258
  hyper
ccgggactgagtggctggcagctatgtctgcgagagcagcggcatcaccctggatggaagcctctgagactccgcctaactgacacccaaactctccctctccctcccgcagccccaaattg

SEQ ID NO: 30577 - DNA, 107 bp, Homo sapiens
  chr6:72596541-72596648
  hyper
gaaagactgggttctcgctctccccggctctgctgctgctgctgctgccgccgccgccgctgctcctcctcctgccgccgccgctagggctccgctgtgagggggaa

SEQ ID NO: 30578 - DNA, 75 bp, Homo sapiens
  chr6:72596950-72597025
  hyper
cactcccctagtcctcgcggctgagtgtggggaaggggctgccagggtgctgggtgcggacggaggcgcccgcct

SEQ ID NO: 30579 - DNA, 342 bp, Homo sapiens
  chr6:73329784-73330126
  hyper
aggccaagattttgacgtttaaagcgggcacacgagtcattttaagtctctagatctttcaccctgaaagtccctgcacagaaactccatagggagtctaaatatagcaacagcaccccctcccgccccctccgccttcagtcagggtcccgcgcagctctaggattggagagcttactccagggcgctctctgcatctgcctcgaatagcaccgcacggagcaacctctctcgcacctccacagtgcgtgggtgtgaagtgtattaggggaaagctagagagtgactctgggtgatggtgctcggctcacagtcacatggcgtcgccgccagctgcacaga

SEQ ID NO: 30580 - DNA, 494 bp, Homo sapiens
  chr6:73330620-73331114
  hyper
gaaggccagaggctgcggccagtggcaccgtggcctctctctccgccaagggcgcataggctttgggccacccgggtgccaggggtggtggaagacccagtcagttgttccttgcaacaggtctctaagcttgtatgttacaacataaggtgggtggggtcggaaccccgaaaagccggcgtcctggacaccccatcctccaggtgttctttcccagacactgggtcctcgccgccgctgctgaacttctcaatcatatgactttctcggacttaaatggaaatttcttgacggagggaactgggtttgttctcccaggcttcgcgctgcagtcaggcagagccccggggcagctcgctcaccgcggaggagccactttggagttttacgccctttccacaccccacccatggactggaaaggatgttcagttactcgcgagcttgtctgatactgggatggaaagtcacagtccgcaggctggagtgaggcgc

SEQ ID NO: 30581 - DNA, 123 bp, Homo sapiens; identical to SEQ ID NO: 566
  chr6:73331115-73331238
  hyper

SEQ ID NO: 30582 - DNA, 612 bp, Homo sapiens
  chr6:73331239-73331851
  hyper
ctccagcctccaggctagataatacctggaaggcagggcagggctgttcccgctctcaccccttgcggaaggatggcaggatccggcgcagcgacgtagcagcgggagggcacagcgacctgcatctccagtttctcctcaggacacaaggctgacttcaccttccggacagctgcaaagcccctgccagaaccaaaccgaactcgcgcctcggagaggggcttctggggccgtttcgctgcagggcgtggggagtggagagagggaaggggaagcctggggctgggtgtgcgcgcgtgggagcgcgcctcggagcgccccgcactcccccactctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccgg

SEQ ID NO: 30583 - DNA, 1216 bp, Homo sapiens
  chr6:73331875-73333091
  hyper
cgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtgtgagtacccgcgccccctgctatgcccgctgcaggggaccactgtccctggccccctggggcgtgctccgcgctcgcgcccttgggcccccgcgcgcgtgcacacgtggtggcttttatttcttcgcacgtgttcgtggtcttccttctggagcctctcccctcccccagccccacttctctcatctctacagcttgaaccttttccccgaggacacccaatgaactgcccggtagcttcaggctcccggggcgagagccaggcagacgcgggacttaggctgcgcggataattgggagcaattaggtcccaagatacgtaaacttcaaccgaacggggcgcccgggagctagggaatgcaaagggaggacaggcgcccgtgtgaggcttgagagtatactggagaggttaggaggtgatggcggggtaggacggggagaagtgagggggcatcgagggctaggtcctcagtcctaggggcggagtaggggaagctgctacttggagagagctgctaggttttaagcgcgcccggaaacacgcctcgccaccacccagccaccaccaacggaaaatctgtcagtgcatgtagcccttcctgccacggagaaggtggccaaggtctagaggaggccagcaggccaggcgaagcaacgctcccgcgctgcagggggcggggaggcagcggggaacctggggcgcaggaacgcgggcggaggtgcgatagcagaagcgcaaatgggtcgcctctgacagagatcgggcagtgggttaa

SEQ ID NO: 30584 - DNA, 30 bp, Homo sapiens
  chr6:73972965-73972995
  hyper
ccagagccctcctcccgcctgctctgtgta

SEQ ID NO: 30585 - DNA, 681 bp, Homo sapiens; identical to SEQ ID NO: 8540
  chr6:74019413-74020094
  hyper

SEQ ID NO: 30586 - DNA, 84 bp, Homo sapiens
  chr6:74161237-74161321
  hyper
agcagctcaccttcacgtgctcatagtagctcccggtgttcagcagcccgacgcctctgaacgcggagtcgcacttcagtctga

SEQ ID NO: 30587 - DNA, 114 bp, Homo sapiens
  chr6:74161684-74161798
  hyper
cgggcggcctctcctgggtgtccggggcgctctttttctgccgggatcccgacttcctggcggggccgaactttcccgccttaggcagggcggcctcgggggcagccggagact

SEQ ID NO: 30588 - DNA, 209 bp, Homo sapiens
  chr6:74161830-74162039
  hyper
cgtgcggaagccttgggggcagtggctccggcctcggaagctctctgcatggcctttccgtgccaaggctgcatggctggcgctttctgttccccgaaagaagaatccgtttcaggaaaaggccgcaagaggaagagccagcagcagctgttggaaaccaagcactactggcgggcacacaagagtctgcgacccgaaggggaacccca

SEQ ID NO: 30589 - DNA, 38 bp, Homo sapiens
  chr6:74405585-74405623
  hyper
acagcctgaggaacccggtgggccggggaagtgggcgc

SEQ ID NO: 30590 - DNA, 63 bp, Homo sapiens; identical to SEQ ID NO: 8541
  chr6:74405916-74405979
  hyper

SEQ ID NO: 30591 - DNA, 52 bp, Homo sapiens
  chr6:75914106-75914158
  hyper
acttttgctgggtctcgatcgccacctgtcgctttcccgacttagctgcaag

SEQ ID NO: 30592 - DNA, 138 bp, Homo sapiens
  chr6:75914461-75914599
  hyper
caattccttaactcccgcgtccagttaaaaagaaaatcacacacacacacacacaccgcgtgcgcgtcgcctacctcctctcccacccaccacgaccttggcattagccaaaggagagcttagcgtttatttcctttc

SEQ ID NO: 30593 - DNA, 72 bp, Homo sapiens; identical to SEQ ID NO: 8543
  chr6:75915049-75915121
  hyper

SEQ ID NO: 30594 - DNA, 36 bp, Homo sapiens; identical to SEQ ID NO: 8544
  chr6:75915170-75915206
  hyper

SEQ ID NO: 30595 - DNA, 327 bp, Homo sapiens
  chr6:75915601-75915928
  hyper
tccaggagcacctggcggccgccgaggcgtgggcagctgcggggaagtccaggaggaggaggagaatcccaggaggagaggcgggcgcggcaggaagactggagatggcctgagcctgcagctgccggcgcgcggacgcgtctggggcggttcgccttagccaagtggaaagagactccgcgccgcgggctacttaatagagggctgttcccagctctcagtttactcggttacgaaacgcctgagaaggtggacggctgccacggggtgatgtatgctcctccggcggtgaaggaggtctacttttgggaacgtgtgcatacttcg

SEQ ID NO: 30596 - DNA, 153 bp, Homo sapiens; identical to SEQ ID NO: 8546
  chr6:75916306-75916459
  hyper

SEQ ID NO: 30597 - DNA, 100 bp, Homo sapiens
  chr6:78172176-78172276
  hyper
gtcttggtggctttgcgctccctagcggccatgagtttcttcttttccagcagggcgtcggagactcgcactttgacttggttcacatacacaggagatc

SEQ ID NO: 30598 - DNA, 838 bp, Homo sapiens
  chr6:78172322-78173160
  hyper
cgaggacgtggacccgggggagtcggttatcagctgggctcgggtcaagcgcttgccggtcctgttgggcgtctgtttcaaaatccgggagcgggcttctacgtagatgcggccatagagggcgatgaggagcagggtggggaagtagaaagcacccaccgtggagtagaccgtgtagaggatgtggtcggtgttcaccacgcattccgacacctcctcttcggccttagcctgacgccagaagaagggcggcagcgagatagagatggagaagacccacaccagcgcgatcatgaccgccgccctcttgggagtccttttagctgagtactccacggcgtccgtgatggcccagtagcggtccagggcgatgacacagaggtgcaggatggaggcagtgcaacaagtgatgtccgacgacagccagaagtcacagaccacctggcccagtgtccagcggccggtgacagtgtacatggtgctgatgggcatcaccaggatggacacaagcaggtcggtgaccgccagagaggcgatcaggtagttagccggggtgtgcagtttccgggtccggtacactgtggcaatcacaaaggcattggagagcgtggtggccaaggtgatgagcgccaatagcataaccagcagtactttccagggtagggagatggagtcctggtaaatgtagtccttggcgctgcagttttgggagggagcagaggataagttggcttgaggaacccaggtctcggagcccgcgggcggcggtggagcgcactgagcacccggttcctccatggctctcctcgccccagctccggagcgcagctcttgggca

SEQ ID NO: 30599 - DNA, 170 bp, Homo sapiens
  chr6:78173771-78173941
  hyper
cggacgagctgccccgcggagacggagccataaaaggggggacacgggggctggagttgcggctgctcgggccgcgccgccgccaccgccaccctggtcccacgggagccactcggagccatgccactgggtgcgcgggtctggaggacctggcgcggcacactgggaag

SEQ ID NO: 30600 - DNA, 234 bp, Homo sapiens
  chr6:78175915-78176149
  hyper
tgtcctgtgggagtgcggggtgccaggaaacaattttcccgttatcctaggagaactggaaacgattagagacaagtgttaaagggatgggaagcgggggaaggccgacaggaatgtaaccagctccatgcgacctttcctcttttaatttctgctcgggagcatgggacggagaaaaaacaaagcaaaatttgttccccacacggtttttggctttagcggtttggggacctg

SEQ ID NO: 30601 - DNA, 84 bp, Homo sapiens
  chr6:78176445-78176529
  hyper
cctgggtcaccccttcggagtaggggtcgctgggtaaggtccaagtgccagctctgcagtccccagcggcgctagaaggaacct

SEQ ID NO: 30602 - DNA, 44 bp, Homo sapiens
  chr6:78176790-78176834
  hyper
aaaaccagatcctagcggtgagctggctgcggaggaaccaaaga

SEQ ID NO: 30603 - DNA, 27 bp, Homo sapiens
  chr6:79620315-79620342
  hyper
aagtgatatcaagcccgggcagaaggg

SEQ ID NO: 30604 - DNA, 211 bp, Homo sapiens
  chr6:79620474-79620685
  hyper
ggctgggactgccccagacacgcacaccctcccgacctccgccctgtcgcagttccagggcgctccgcgctgtcatgattgctgggtgcgcgctccgtgctgggacagccgcgcaccaacagcggagggcgttagcaccccaagacgctgctgcaggggtctgaaccgctccttggcctactggcaccgggtcctggacgaaatctaccgc

SEQ ID NO: 30605 - DNA, 191 bp, Homo sapiens
  chr6:79620686-79620877
  hyper
gtccaactgagctttatcttgtgcggtgacgcccatgcctaggtcttgacacttccctcctatgccctttattgccaagggtcgggatggccttcgtgtcctctgcagcctccgccttccttctgctgccagcagctgtagattttacctctttcccctaacttcctctcaggctcctactccattcctat

SEQ ID NO: 30606 - DNA, 927 bp, Homo sapiens
  chr6:80656673-80657600
  hyper
cagaagaaaaccctgcgagtgtcgggggaggggaggccttaacattcggatcagattaaccagtgctcaaccgcagtgcccgcgccggcccctccgctgatccgcagcatccgaaagccgcagggcgcgggggcctgtggggccgggcccgggagctgcgagaccaggggccggtgaccccccgcgggggaccgagcgaggatggggaagtcagcggctttacctgcgatggaccaggtccagcggtagaactctaccgtgtcgttgagtgccgtggacactacgtttaggacactacccggctccgagtccaggagccccatcgcggcgatgagcgggcgctggcggcaggagaaagcggagacccagagagagggctgaccccggaggcggtggcggccgacggggcgagcggcggccgggaacccctctaacggcggcggcccggctgcgtcttctcctgctcctcaaggcgccgcggcggcggggatgcggcagaaggcagggccaagcggaaggcgtcgtcaaggttcccgggagaaagacgaggaggtggaggaggcccagccgccagcacagtgcgctgcaccagtctgcagcctcgcgcagccgcccctccaatctcctcagccggcgtcacgtggccgcgcgcgggggcggggggccggccgcccctcctccctccctccctccctagtattgggactcgctggcgtagggatgctgcgctcaagggtgcgacgccaactgggctcgcgcaggcgcgcgccgtcgagcgggagcgggacacctgggctcctccttggcccctccccgcacaagtcgcctcattagccttccccgcccctgtcccgggcatcggcccctgcggaggagttcaccgcctccccacgggtgatttcttatccgccccggatacgtcctggg

SEQ ID NO: 30607 - DNA, 111 bp, Homo sapiens
  chr6:82461362-82461473
  hyper
acaggcagtccagcacgacgtccttcacagtctgaaactccccttccccgcgcaggtcggcgcagaagatgaggtccaggtccttgtagcccaggccgctgtcctggtgca

SEQ ID NO: 30608 - DNA, 272 bp, Homo sapiens; identical to SEQ ID NO: 568
  chr6:84417429-84417701
  hyper

SEQ ID NO: 30609 - DNA, 23 bp, Homo sapiens
  chr6:84417908-84417931
  hyper
cgtgacaccgtccccattctccc

SEQ ID NO: 30610 - DNA, 464 bp, Homo sapiens
  chr6:84418260-84418724
  hyper
cgccgccggctccaaagcctcgccgaggcccatcgcccgggccccttccccccggttccaaatccctgccgcaggggccgcccgggagctctgcggaggcgccggagtcttggggcgcctcacccttcctggctttggagaggagccgggctgacagcgaagcccagtcccccgcccgccctggagcgctccgcggagctgtcactcggccgctgcccttctccgcaccctgggattatcctctgcggatccccgcgagaccctggcgcggggagggggccgagtacggccgcgggtactcaccccgcccctgagcggcgccgcccgccgcaggatgagcggagcccgggccgccgagggaagccgcgccggtggatgtgtgcgaccgcgcgtagccccggtgcccccgggcgcaaagtctccagccctggccgggccccgctcctcagctccgcggtcccggc

SEQ ID NO: 30611 - DNA, 64 bp, Homo sapiens
  chr6:84418725-84418789
  hyper
cccaccgcccctggcccctggccccagaagccagtacccgcccgccgccgcctcttctgccagc

SEQ ID NO: 30612 - DNA, 131 bp, Homo sapiens
  chr6:84419071-84419202
  hyper
gggccgcccctccgctgctggcgccgcacccggcacgcactgggctcgcgcaccacgcacacctgcccgccgactgcggggggagccctgggcgttgggggcgttggccaagacgggcgagtgggcttctc

SEQ ID NO: 30613 - DNA, 126 bp, Homo sapiens; identical to SEQ ID NO: 2842
  chr6:84419203-84419329
  hyper

SEQ ID NO: 30614 - DNA, 61 bp, Homo sapiens; identical to SEQ ID NO: 2843
  chr6:84419330-84419391
  hyper

SEQ ID NO: 30615 - DNA, 158 bp, Homo sapiens
  chr6:84562772-84562930
  hyper
caaaacgtgtagactcgcttaattccatctcctcctggcctcttcacacggaaattggctgctcgggcgaatgttgtttttctccgcagccatgtgtcgaagggcgattaacattcgctcgacaaaaccctgtcccgggccatttgggagttgcacgc

SEQ ID NO: 30616 - DNA, 354 bp, Homo sapiens; identical to SEQ ID NO: 2845
  chr6:84562931-84563285
  hyper

SEQ ID NO: 30617 - DNA, 437 bp, Homo sapiens; identical to SEQ ID NO: 2846
  chr6:84563416-84563853
  hyper

SEQ ID NO: 30618 - DNA, 39 bp, Homo sapiens
  chr6:85471957-85471996
  hyper
cctcaaatttataaccgccctgaacgcagaacatcaacc

SEQ ID NO: 30619 - DNA, 2318 bp, Homo sapiens
  chr6:85472355-85474673
  hyper
agggcagaggggtcccgggccgggccagggagcgcgccggagaccccttgggggagcctcccggtgacgccagaggggaagctccctgctggaagccgtcctcacagccgcctggacagcaaaggacagagaaagggaactggtgagggaaacagaggggaagccagccgcggagacgggcccacctggtggctgagaagaggaaaatgaccgggagaaaaggggaagctttggtgccatcaggtcctcctaaagaacaagccagtcgatagacacccacattctgcctgtcgaaggggcgcattcagagctccagtgtggcctgcttggtccccaagtcccaagcccgggagaggcgcgcgggcagcgtccaccccacccgctgggcctccgcagggccaaggccccagcagaaaaggcttcacgccgccgccggggtctgggacgcttgcccgacggagtcagaggagctcccgggtccagagtccccagtgcaaactccgacgcaacctgcgcctcgaagcgcaagcagcaaaagcgcccggactctggtcccaagagcctgggcctccttaagccataagcgtctgcggcgcctcgctttgggccttcttttgggccgggccggaggcatcttctagaaggctcttcagaccccgctttcgccaaactcccggcgccctgcgcttccagcccagcagagaaaagtgtgaaaagcaagcccgcggtcgccgtcggccttggcagagaaatcaagaggagaagggaagggaaccgctcaactacccttcgggaaaccaagtttccaaatatgccgccctcttcctggtttgcacaaacggtttagggcattcgttccggtttcagggtggggtatgccgtcgctcccctcctccccgccctgtgcttttaaaagttaggaaacaaaaaagagcacccattggctggaaccccaagggaggcagatgcaggaagcacagagctgcaccgctaggcgcagcaaacagccgcggccgaaggcgcgggtcgccgagtgggcggcggccgcccgcgaggcgagcctggaagcagtatctgaaccgtctggagggtgaccaggttgcgcggcgagctttgcgactgacacggccaatgcgctagtggctgagtggccttggccatgtagggacgcggcgcgcacgcacacccacagactcgcagaagttcaggttcgcgccggagagaagttataggcaggaaggggcccactcacccgcggctccgcgctccaggtctgcgccactccgagccggcccagacgtcgccccagccggcggcgggagcgcagcgccttcgtctccctcagaagaacccttttcgcccgcgccgccgccgcggctgcagcctccgtcgtccacggcccccgccgcctcttcggcgcccagttttcgccgcttcttctgaagctgttgctgcttctcggcgccgatcagcgcctccaccgagaaagcgtgcgccttgaggcttagcatgctgcacggcgagccccttcgcttctcggccatcccccccgccccgcgcccgcccgcccctctctcatatacactcacgcgggcacacgcgcgctctcgctcttcccccaccaaaaactaaaaggctctcggggcctcccgagatctgcccccttccccaccgcgggcaaaaaacagatttggcgtttccgctttctcgcttgtgttgggatccaggaaccggcgacgcgccggccaagtctcctttcctgggtctctctcgcgcgctctctcactgatgcactcctttgctcccaccccttccacctcctcctgctgctccgaggtctgcctcaactgatgcgccagagaggactaacatgggtaaaaaacactctgtggacacaaattagggattgtaattgaaatttgttgccttgatctgtcagcacttccaggcaggagagcggtgggaagaacttgctcattagtgtcaataaagcggcgggggcggagcccgggtccctgtccatcacccagacggccggccaatcaggaggcgccgactccgcgcagcccgcgcccacttccttacaaggtagcgaaaaaccaggagtgaaaagcgccgctgtctggcttggatgtgccagccacacggacgctgaactctgtctctctgacgtccgtagctgagtccagccccgtagtctccagctttcctcaccaggacctggaaaggcggaagttcccggctttaaactagacgttcaacaagttagaaaatcaggaatctttcaaggttccgtaaattgccgtcccacttccgta

SEQ ID NO: 30620 - DNA, 30 bp, Homo sapiens; identical to SEQ ID NO: 8568
  chr6:85476233-85476263
  hyper

SEQ ID NO: 30621 - DNA, 169 bp, Homo sapiens
  chr6:85476998-85477167
  hyper
agcccactccaacctcggctcctggagaaggggcgtcgaatctctcttgggcatgggagggaaagacattccgagttggctgggcggagtggcagccttgagagtgacgagtgacagcaaagcctcgtcctagcaaggccttttaccaacagcgcggcatgccctttcg

SEQ ID NO: 30622 - DNA, 421 bp, Homo sapiens
  chr6:85482401-85482822
  hyper
agccaaattattccccgacggctccaatattgtgccagagtcccagagtcagttatttttatgtctgactgtatttcacatgtgcagggtgataaataaaatccgtctcaagctacaaactatctgagtgtgatgaggaacaatcgacaaaaattaacccagccaaagcgttggggttcaagcgagcgactggaccataaatcagcgtcgcggtggcgtcgggaagctgagcgctcggaggtgcactcagctgcctctgggttcgcccagtccgagagcggggctccgccgcgggagcccgggcaggaatcggactccgccaggggttcggagtcttctggggaaagggcgtgttgggagagaaaggcaagcccacgcaggagcgacctcctaattaattcatcatcgagaattctccagt

SEQ ID NO: 30623 - DNA, 215 bp, Homo sapiens
  chr6:85483309-85483524
  hyper
cggggagtcagggagcgcggaacgcgggtttctgttgataagtgcaaagtacggccctctcggtgctaagtgcacagtaagtgcgaagaataaatacatcatctcccggggcggctgtctcgaaaacgcctctcagctgcctgcgtttcagagcccgtcaagggttatagcttagtgtgggcgtccgcgccgcgcctgcgcctccgagcgccggc

SEQ ID NO: 30624 - DNA, 173 bp, Homo sapiens; identical to SEQ ID NO: 8572
  chr6:85483759-85483932
  hyper

SEQ ID NO: 30625 - DNA, 69 bp, Homo sapiens; identical to SEQ ID NO: 2850
  chr6:85484557-85484626
  hyper

SEQ ID NO: 30626 - DNA, 217 bp, Homo sapiens; identical to SEQ ID NO: 2851
  chr6:85484716-85484933
  hyper

SEQ ID NO: 30627 - DNA, 125 bp, Homo sapiens
  chr6:86159778-86159903
  hyper
ccggccctagctgctcgcccctactcgccggcactcgcccggctcgcccgctttcgcacccagttcacgcgccacagctatgtgtccccgagccgcgcgggcgcccgcgacgctactcctcgccc

SEQ ID NO: 30628 - DNA, 56 bp, Homo sapiens
  chr6:86160189-86160245
  hyper
tgccatggtaagacccgagcccgcgcccgggatagtagtcccggactgagagagga

SEQ ID NO: 30629 - DNA, 92 bp, Homo sapiens
  chr6:87647217-87647309
  hyper
ccgctctctccctctcgcctcctcttccagtccaggcgcccagactcggcgaagcgcagcgcctgccaccagcggtgcctcgggctgcccgg

SEQ ID NO: 30630 - DNA, 54 bp, Homo sapiens
  chr6:87647316-87647370
  hyper
cgctcccaggttctgtctcgccgcaccccggcgggcactggcgcgggcaaggac

SEQ ID NO: 30631 - DNA, 170 bp, Homo sapiens
  chr6:87647371-87647541
  hyper
ctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaag

SEQ ID NO: 30632 - DNA, 585 bp, Homo sapiens
  chr6:87861548-87862133
  hyper
agactccagcatccccggggtgggtttccggaggccccgctccccgccgcgccctggaaaggctccagaatctctcggcctggaggcccctggcggcctctgctcccaagcggggagtcgcagccaggctacagcgggcttgatcctcagtgctgggtggaaaaaccgcggcggcaaacgccgggcctgcaactgctgggtgtcggcgttgctggttcgcgggcggcggcggcggcggctccgcgacaacagaggacgcgagcaaccggcgcagcgcccagcagggccttggcggggtggaggggcgcaggctgggttagcggagcagagcggaccgatctggtgccctccgtggcccgaggcctgcggaccttctccgttctccggcccagggcgagagcggggcaagagacagcgccccgatagtggcgcacgctctccgccatccccgggcctcgcgctttcacctcgcgtgctggggcgagggcggggctgcggggtgtactgggtcgggggtaggaaggacctgccaggccttagccctgagctatccgtcatccgctaacgccgcgctccctgcatccc

SEQ ID NO: 30633 - DNA, 133 bp, Homo sapiens
  chr6:88875382-88875515
  hyper
cagctaagtaaacaccgacgcacgattcgctcacacggaataagaactccacgaaggacacttggggaccacactggtcgtacccgagggggcgggaggcggaaaaagtatttccaaacgcaactctgccagg

SEQ ID NO: 30634 - DNA, 509 bp, Homo sapiens
  chr6:88875729-88876238
  hyper
tggcagagggagtagcgtgcgggaggcggcgccggcgccgggctgctggcgaggcggggtggggtggagtggggtgtgcctccggcgggcggtcagcaagtcagtccgtccgagcgccggcgtcccggtctccagcgcccgcccgcgacagcgaccgggactggcgccccgctgctccgaccgccggcgagcctcgccccttcccaggctcttcactgggtcctcccgcgagccccgcctggcccggcgtggggccgcccgtctccgccagcccgggcgcccgtcgcctcgtcccgctcgcgcagtccctgccgctccctccgctcgcgctgtctctggctccctctcgctccagtcccatttatgaagcgcggtcccatcacgtgttaatgagcctttgtcctgccctggcagcggcggcggcacagaccccgccgagggaactgcgcggggagggacctgagcgcagcgcccgtagccccaaactttgcttggggcgggggacccgc

SEQ ID NO: 30635 - DNA, 193 bp, Homo sapiens
  chr6:88876284-88876477
  hyper
cgtcacctacttctcctcttcctcctcctcctccgccgccgcgctcccggaggcccccgctgccatgacctcgctgtgctcccggataccctcacaccctgaccaggccaagaaggggctggtgcatgcgccgcccacgacctcggggccattaatcacacgctcccgggcagcgcgcatcgccaacaccttc

SEQ ID NO: 30636 - DNA, 111 bp, Homo sapiens; identical to SEQ ID NO: 2853
  chr6:88876630-88876741
  hyper

SEQ ID NO: 30637 - DNA, 322 bp, Homo sapiens; identical to SEQ ID NO: 2854
  chr6:88876742-88877064
  hyper

SEQ ID NO: 30638 - DNA, 357 bp, Homo sapiens
  chr6:88877065-88877422
  hyper
tctgcctcctgtgtgcacggatcaaaccttaattggtctttacatttatcatggtgaattgcgaacctccaaacaagcctgggccgccgcttctgccgaggaggcgctcccctcccctccgcccccggggccctgcagggtgtgcggcggcggtcgtggttatttagacatctttatctctcgtgagttggatcgggagaggatcgcacggtttccacctgacggagccacgtcacgtcggccacaagggccccgtgctgggcgctgggttcggttcccggccgtcctcttgtggccgccttggcgttcattttatgacaccttgccggtgttcccagacatcatcccgcaccgctc

SEQ ID NO: 30639 - DNA, 46 bp, Homo sapiens
  chr6:88877474-88877520
  hyper
cgtactatatctggaccctatatttgaactacgtggtgagaatctg

SEQ ID NO: 30640 - DNA, 30 bp, Homo sapiens
  chr6:90120876-90120906
  hyper
ccgcgcgctcactcccgggcaggcactgcc

SEQ ID NO: 30641 - DNA, 340 bp, Homo sapiens
  chr6:90143378-90143718
  hyper
ctggggctcgtccctcgttctcctgctcgcttgcagtttgaaggaagggcggtgggggcgggggtccgagtaccccgcggtctgcggcgcgtaggagggtaggtccctggcctgcggccgcctccgaatgaccccgtccctccccgccctggacgacagcactagggtgcagtcgcaggagaggggccgatacccctcaggagccccatcggcgaagcctcagcaagtggcatctcccggggtccagagagtcggcgtgctgtctggtttgggtccagacatcagctcacccaagcttatcttgggcttttaagtgtgttgcttccggtagatctcgggg

SEQ ID NO: 30642 - DNA, 399 bp, Homo sapiens
  chr6:91004780-91005179
  hyper
ggtgaaaaccaggaacgccgcgtctcgccgcccgcgggcccgccgggagactgcgggtccgtctcgcgggtggggcgccccggtccctctcgtttcctggaggccacaggtcacggcgacggcggtgaccgggagagcaggctgcgaggcgcgcctcatcgggccacagacaaaccaccccggcagcggccgcgccggaacttccctcaagttaccaaactcgcctacgcgcgggagagtgctggggatgccccatgcgcccgcgaccccagaagccaggagtgtgccaccccttcacacactcactcccggccctgcacgcttcccctcacggtccgagttcctgcaaatgcttggccagaccgaggtcgccgagatgctcgctccagtctctcccct

SEQ ID NO: 30643 - DNA, 106 bp, Homo sapiens; identical to SEQ ID NO: 8585
  chr6:91005208-91005314
  hyper

SEQ ID NO: 30644 - DNA, 1010 bp, Homo sapiens
  chr6:91320285-91321295
  hyper
ttatttgggatagcccggcgagggggcgctggagattatgggggtgggggcggtttcttggggaggcctgggtctatggagtggaaaccaatctttgatgaatttggtcacaataacgaacacgggagaaaaaggagaattgaaaggaaatggattctgcgagagactggggagacaaaaccaagaggaaaaacacagaatcaaaaacgacaggaaacactagagaagagtaggcagaaaatagagaagaggaagaaacgagtcggacggagacggggccgggcactgggagcttgaggctgggtctccatccttcctttcatcctctcgggagcccgcagagacggcggcttcagtctcgctttacgggtgggaaagcagcgaccttgagaggttaggtgactgctcaaggtcaccgagctaagtgccagagccaggattctcaccgctcctcaccccagatcggggctccggccagaccacgctggccgccgggggagaggacgcgcggggcgggcagagcgcggccgggggccgggaaggagccggcgccaggcgcgcgcggaggaggcggccgggcggggagccatttcctccccaagcaacggcgcttttcaggggcgcgaccgggaagcctctcttggcgtcccttccccagccgcagtttgggcaggggagcgagggccgggaggcgtctaggctgtggcgaggggagaagcatcccccatccctccgctccccgtctcgctcaagctcttcctgcgccacgggcaggtctcccagcctcgccatcgcggggcgtccccgtcccggcccacacctctttcctctccagccacaccggcgcgccccgagggttgcaggcgggggctgcaccgggttgaagcccagtcaaccacacgtcccagggcttaggcgccgggcggggacaacgtgtctgcctgggctcagacgctgctagggggcatccctgtcggtgagaccagactcagacacgagggggcctgggc

SEQ ID NO: 30645 - DNA, 247 bp, Homo sapiens
  chr6:94126366-94126613
  hyper
cgtatcccttcccgctcggagcagagtgccgacctccctttgcgcccgcggaggcgcagtccctcggctcacccggacgctgggggccaggcctaggactccagggctccgcgccccggagtcctgtgggccaacaggtgatgggagaggggctagactgggggcgcgccctgacagacccaggcaacgaccgcgcgggcaaaggctggcgtcccggggctggggcggggccgtcggaggggcgggg

SEQ ID NO: 30646 - DNA, 424 bp, Homo sapiens
  chr6:94126642-94127066
  hyper
cgccaagcatccattacgcctctgccagacctgggcactccagggagccggtggcgccctcgctcgagaaggagtcgggaagaggagagtggctttcgggaagaggagagtggctttcgggaagcatctcctctgaggaagaggcggcggcggcggcggcatttacggagagaaaaagtaagcagctgcactttgccttcaagcgtcagactctgacacgcgctccctgtagcgatgataactgaccaacccgagagaacgtgcacaaggaaagtgagggaagggggtttcttatcttcctctagccacccccaaatgccccaggaggcccggcacctgcttcaagcggttcccagcgctagcccttgggtactgcgggccgcctcggggcttgtgaactcctagaacgccagctcttggtcgc

SEQ ID NO: 30647 - DNA, 46 bp, Homo sapiens
  chr6:94127085-94127131
  hyper
cgccgcctagaagccgggcgcactcgccgcccgccagccacagatc

SEQ ID NO: 30648 - DNA, 444 bp, Homo sapiens
  chr6:94127455-94127899
  hyper
tttggaggggatgagcgtgcgtttctagcagatgtccgtccttctgcaaacgcgtaaccgccagcttggaggcacggggttctctgaatgggttcagcatctatacaggttgcagatgtggaaagtggggtcagaaggtcaggctgaaagaaggactagaatttggcgccgggtttgaggggggcttgagcgaactaagaggagtgcacgatgagaataaagaaaaggtgcactaagttttcagaaatagatgaatcaaggacctatatgtaagtcccctcaacaccccgcccgataaccaccatgacctaaatttcataacagattcctctccctctacacatcaggaataagtaattatttctcttctgcttttaacagatcgaaaaatgaaacttagatacacagcctgaaagaccaggggggcgacgggatgaggggggt

SEQ ID NO: 30649 - DNA, 310 bp, Homo sapiens
  chr6:94128439-94128749
  hyper
gtaacccgagctttccgagctcatcgaagtctcggtccctctgggaaggctccgggctcccgccactcgccggcgggctggcggagacggtaggggctgcatttcccagtctccaacccaactctggccgcagctcccacagaaggcgaataaggagacaaggaagaccgagctagagagagatgtgacccgcctgaggtactaagaaataagctcgccggcagttcctccaaccccaccccacccccgttgctgctcacgccctccagactgcccgcgccagaaatcccgcacccgtcggatggacggc

SEQ ID NO: 30650 - DNA, 239 bp, Homo sapiens
  chr6:94129167-94129406
  hyper
ccccttctcggtccccgatcggctgctccacgtttagctttttttaatttcccccccactcctgttcgctcgcaccgtgtttgctgcctgcaagtctccgactgcagaccggccgcttgctccacactccaataatatcaattagggggggagggggcggggctccgagctgagagcctccgccactcgggctgagtggcaggcacagccggcctgccaggaggcgattcccagggcca

SEQ ID NO: 30651 - DNA, 32 bp, Homo sapiens; identical to SEQ ID NO: 8594
  chr6:94129782-94129814
  hyper

SEQ ID NO: 30652 - DNA, 395 bp, Homo sapiens
  chr6:96463220-96463615
  hyper
gctccaaggggcaggcgatggttgccggcattgagctccctgctggcgccttctggcgggacagccagtgccaaagagcgcccagggaaacaaacaccaatgggggactatacagatgtcatggatgcacatgtaggatcataatctgcccagaaagaggagagaaggagggcgacaggctgcggatcctggtccaggagccgccgcaatggagcgggcggcagtgtgcgcgcacaggtgccacaggccggtggcggggagagctgtagaggctgcctcccggactcagcactcgcaccagcgcgctgaagccgcggctgctgccaagcttgggtaacccccagcctgagccacgagaggaagagcccaaggaaagggcgcgaagggggaaggag

SEQ ID NO: 30653 - DNA, 122 bp, Homo sapiens
  chr6:96464082-96464204
  hyper
ggaccggtgagtaggcgggagagtgcagggggtcgggcgtcaaagcttggcgcggagagaacatcttttggtttgggaggcaccccaaaccagctgctgtgattccccgtcctccaggcaga

SEQ ID NO: 30654 - DNA, 30 bp, Homo sapiens
  chr6:96464463-96464493
  hyper
cccttcacccgatctcgcgctgacaaagcc

SEQ ID NO: 30655 - DNA, 32 bp, Homo sapiens
  chr6:99271691-99271723
  hyper
ggaaaccatccaagacgcggtttaagaaaaca

SEQ ID NO: 30656 - DNA, 936 bp, Homo sapiens
  chr6:99271926-99272862
  hyper
ccaagagtcagatggcgcgggttccctccctgtgagtttcgacagtgcatcatcttacggaagaggctaaactagtattgattttccactttctaaaaggagtaaccatttggagcaaaggcaagctctcagggacgcgggggttgatagggggcaggtctgcgaaaaagagaaacacttcaaacagcgctgcggagagtgggggatggagctgtggggagcgagcggaggcttctctctgcccaagtagtggggctgcaaagttcctgccacaacggctgagacgttctgattctgtggacctgccaggagaggcgtttcccttgccaaaatagagccttcttaggagaggtttatgtattgttcgggaaggcaggagtatcttctagtcgttttcactctcctccacctttattaccctgaatccttaggccctcccctcggaaccccttcaaagtggagagggagcgtgggagggagagagcgcgcgccaagtttcaaatgtcgccagtctttccagaagcccctggctctcgcaggactgggtgcaggcgcctctccgggcctcggagccccgccccgcctccccatccccacaatcccaaggctccaggctctgcagggaaccgcggcgggaattttccagcctcaaatacggggcggactaattttcaggtccactccaacccagagatcggattccacttgatcttggagttcgcgaagtaactgccaagtcagagcgtgcgttccgcagtgcgcggtggctgcgcggcgctggctcttgctgtggggcagacagcagaggaccaggggcgagtcggcagcgggaggagccgcctggccaggagcctcggacagtgtctccccgtcccgaaccccttcccgccacctcctccaccccccgccccgcattccccccggggcgaccctccc

SEQ ID NO: 30657 - DNA, 230 bp, Homo sapiens
  chr6:99273369-99273599
  hyper
aactgggagaaggaacgtgccaccaccgaccacctatcctggtgggaggaggtactgctcccccctactcctcccttttccctgctccctctccatcagcaacaggttgtcaagttgaggagacatcccctccaaactctctcactccccacttgtggccgaggcctgccctgtgttcatcccagacagtcaggcagacgctgagctgtccgcgtcggcgtgggcgcctg

SEQ ID NO: 30658 - DNA, 53 bp, Homo sapiens
  chr6:99273848-99273901
  hyper
ttgcaggtgtcttgccgcttaagtttcctggactgagacgttgactggtgacc

SEQ ID NO: 30659 - DNA, 30 bp, Homo sapiens
  chr6:99275545-99275575
  hyper
cattccccgcggggccggccccccttccct

SEQ ID NO: 30660 - DNA, 30 bp, Homo sapiens
  chr6:99276704-99276734
  hyper
acctgctcccctccccgcccacccccccat

SEQ ID NO: 30661 - DNA, 21 bp, Homo sapiens
  chr6:99277180-99277201
  hyper
tagggggagaaaatgcgagcg

SEQ ID NO: 30662 - DNA, 141 bp, Homo sapiens
  chr6:99277261-99277402
  hyper
taggctccattgttaagaggtcatttaactgttagtcctttgaaagtgaaattgcgggaagcaaactggaagccaccaattgtctcctgttctgtttctgagatttttgttctgtttctgagatttcgtataaacaagcta

SEQ ID NO: 30663 - DNA, 201 bp, Homo sapiens
  chr6:99278897-99279098
  hyper
ttcccctccactcagcgcaccccggcaagagggagtcggctccgtttcttcagacaagtccagctcagggtattgactgagtagaggttcctccggacctgggagaagctggggtggcgccagcatctccttacaggtgcctccatcctgtccttgcggaaggggcttaggacaccccgcagtccgcgccccgaggtggcg

SEQ ID NO: 30664 - DNA, 445 bp, Homo sapiens
  chr6:99279350-99279795
  hyper
agaatggcaggcagacgcgcggactctgccctgacagggtcagcccaaagaatgggccccagagcccggggcgggggaggaaccggtggagaggccccagtctggacctaaaaccagcgagagctcaggtttcgggagccccgaagaggtgccgcgctgggaggcagacaaggaagcccagggtgctcggaacccggcgttcgcgccaaccgggcccctggcgcctggaggggaggcggcggtagctcgtggggaggtgttgctcagagccgcggtgcgagcccagcctggcccgcccggtgattggccgcgcttgggggtgggggtggggtgcagagactgaggccccgggtaggctatttctttgtgtactcccggggatttattgggtatattaaaccctgttgggaacgtttcggctccttggccgccagcgaaatgagac

SEQ ID NO: 30665 - DNA, 240 bp, Homo sapiens
  chr6:99279796-99280036
  hyper
gggatggaagttggagttgagacctgggaagtcaacgtgggaaggatctcagcattaatcgccggtgatgtcctatcgcagacaggaagttttgatgtacacgtgcagcctattcttgtcccctcacactagcgccctatgccgggaggagggcgggggtgtggggtggggtgtggagagaaagataagaggaggaggaacttttaaattgattcagagccaggccgcctcagttccttc

SEQ ID NO: 30666 - DNA, 234 bp, Homo sapiens
  chr6:99280497-99280731
  hyper
ctagcagcccccaggcgcgcggccagagtggccccgcgcttgcgctgggacggagcgacacgctgtgtgtgtcctcgcctcgcctcgccgcgcgggtgcgcgcgtggtgggggtgcaggtccgtcctgctggcggcctgtgggctcgcccctcccctatccatttctctcccccacacacgctcataaacacaggacacgtggaaattctcagccaaagcgtcttgcccgggcg

SEQ ID NO: 30667 - DNA, 1 bp, Homo sapiens
  chr6:99281036-99281037
  hyper
g

SEQ ID NO: 30668 - DNA, 411 bp, Homo sapiens
  chr6:99281067-99281478
  hyper
cgcgcccaagttctagctaccgggcttgcaggctcggaaactcgcaggcggcacctgctctgggcggctaaagaactgatggcgcgacgcgcccgcgctccgtagagcggcgctgcgggtgcatggtcccatagtcttgctctggagttcactgctgaaagctgagctgggagcttggccagggagcgccaaagacatagactaaccccacccgctagcgcccaccgaagttactgattaggaaggttcccctggcatcagcccatttgcttcacacactcttcctccttcccaaggggctaacggaaaagttgcacctaccagcggtaggagcacggggaatcgcgcacgcaggccctccgcgcggcttcccggagcggcctttggcgactgcgccgcccctacaaggcc

SEQ ID NO: 30669 - DNA, 37 bp, Homo sapiens
  chr6:99281946-99281983
  hyper
aggtgaataaaaatccgactcccgctggctcggtgcg

SEQ ID NO: 30670 - DNA, 95 bp, Homo sapiens; identical to SEQ ID NO: 8605
  chr6:99282778-99282873
  hyper

SEQ ID NO: 30671 - DNA, 240 bp, Homo sapiens
  chr6:99283342-99283582
  hyper
cggcatgctgggcgccggcgggcagccggccggtctgcaccaccacggcctgcgggacgcgcacgacgagccacaccatgccgaccaccacccgcacccgcactcgcacccacaccagcagccgccgcccccgccgcccccgcagggtccgcctggccacccaggcgcgcaccacgacccgcactcggacgaggacacgccgacctcggacgacctggagcagttcgccaagcagttcaa

SEQ ID NO: 30672 - DNA, 48 bp, Homo sapiens
  chr6:99283978-99284026
  hyper
aaggatgacccctcccggagggactctgccgggcgccgaggatgtgta

SEQ ID NO: 30673 - DNA, 30 bp, Homo sapiens
  chr6:99284652-99284682
  hyper
tctctttctccccaccgttaatttgggagt

SEQ ID NO: 30674 - DNA, 142 bp, Homo sapiens
  chr6:99290331-99290473
  hyper
gtaccttggccttgccgcgcaccccccacctcggggaccctggccgctgtcgcgaaggcccagacagcctagctcggccgcgcggggaggagagagacagggaaaggagcggggcactccctgcactcccagccccggcctt

SEQ ID NO: 30675 - DNA, 30 bp, Homo sapiens; identical to SEQ ID NO: 8608
  chr6:99291312-99291342
  hyper

SEQ ID NO: 30676 - DNA, 15 bp, Homo sapiens
  chr6:99291682-99291697
  hyper
tggcctctgcaggct

SEQ ID NO: 30677 - DNA, 15 bp, Homo sapiens
  chr6:99291729-99291744
  hyper
cgcccgcggccactc

SEQ ID NO: 30678 - DNA, 269 bp, Homo sapiens; identical to SEQ ID NO: 8609
  chr6:99292252-99292521
  hyper

SEQ ID NO: 30679 - DNA, 114 bp, Homo sapiens
  chr6:99295750-99295864
  hyper
acatcctggagtcgccgggagtggcgctgcggtgaaagccggtgcctagagtgggcttaggggtcccattccactcggaaagtcctctcacctccccaagggccattctgccgg

SEQ ID NO: 30680 - DNA, 304 bp, Homo sapiens; identical to SEQ ID NO: 575
  chr6:99296061-99296365
  hyper

SEQ ID NO: 30681 - DNA, 104 bp, Homo sapiens
  chr6:99296407-99296511
  hyper
cgcctggagggccctgacccttccggtgttccaccgcaatggggtcggggggagaggggggctgtggctgcctgagacctccagggcagcgcacattacgggcg

SEQ ID NO: 30682 - DNA, 30 bp, Homo sapiens
  chr6:100036662-100036692
  hyper
tcctgctgcgtgagccgatctgcagatcca

SEQ ID NO: 30683 - DNA, 110 bp, Homo sapiens
  chr6:100036959-100037069
  hyper
acccagcccgctctgcggatgggtcgtagattccggctggaagccggaggaagtgcatagagggcagcttcaaaagccaaggctgcgctgctttgcgcggggcttcttcc

SEQ ID NO: 30684 - DNA, 67 bp, Homo sapiens
  chr6:100038640-100038707
  hyper
tgccttccttcccctcgtcgccttcctcccactgtgcgagcttcggaaccctaaggccggttcactg

SEQ ID NO: 30685 - DNA, 369 bp, Homo sapiens; identical to SEQ ID NO: 578
  chr6:100038785-100039154
  hyper

SEQ ID NO: 30686 - DNA, 7 bp, Homo sapiens
  chr6:100039274-100039281
  hyper
cggtggt

SEQ ID NO: 30687 - DNA, 37 bp, Homo sapiens
  chr6:100050390-100050427
  hyper
ttcagacctgctccccggcccgcgttcaattattccc

SEQ ID NO: 30688 - DNA, 57 bp, Homo sapiens
  chr6:100050754-100050811
  hyper
aacagcaaggaaaatcgaattgagtgcgggctcattcggcagcggccggcagagaag

SEQ ID NO: 30689 - DNA, 251 bp, Homo sapiens; identical to SEQ ID NO: 579
  chr6:100050858-100051109
  hyper

SEQ ID NO: 30690 - DNA, 149 bp, Homo sapiens; identical to SEQ ID NO: 580
  chr6:100051359-100051508
  hyper

SEQ ID NO: 30691 - DNA, 328 bp, Homo sapiens
  chr6:100051771-100052099
  hyper
cgtagcctgcctctcggagggccggcggctgctggtgagcattccagcctcgttagggcaacctgttaccggagagggagccttgcccgaacggttctactgtgggcagggagcaggaccgcccctaaaccgcctttccccgcacctcggtgtaggagagatttcgctttaacggagactctggacgcccatttcaagtcgataaaaaaaaaaaaaaagccgagtggaatgttttgattgagtctcaacattgtctttgaataaggctgagaccatgtaattaatgtgtctttttaataagggacaatacggccgttcaagctattta

SEQ ID NO: 30692 - DNA, 107 bp, Homo sapiens
  chr6:100052482-100052589
  hyper
ggagggccagggaggcgccccgaacccaggcccagcgctcgccccttcccgcttgcagtgctggtaatttaaactgggtgtcatcccagagtcgccaggccagaggt

SEQ ID NO: 30693 - DNA, 222 bp, Homo sapiens
  chr6:100053289-100053511
  hyper
ctgagttgcaggtgtcgccaccttgcgtcctgccacccttgctaaccacaatcgctccagcactttcagccgacaaagcctcgaggagaagctagcgtgggcgctgctgagggccctctgcccttttgtgcagtggttgggcctctggcgctaggcttggaaatacaccaccactcaggcctctcttggaagaactgcatcgggctccggtgctggctgcat

SEQ ID NO: 30694 - DNA, 393 bp, Homo sapiens
  chr6:100054839-100055232
  hyper
tccagctctgtcactcgcgcccttccaaggacctggagcacccgagcgcctgcctggtggcggcggcaacaatgcacggagccgccagagcgccagccaccagcgtgagtgccgactgctgcatcccggccggcttgcgcctcggaccggtgcctggtaccttcaagctgggcaagtacctgtcagaccgcagggagcccgggcctaagaaaaaggtattgaccattcagacctctgcccactgccattcgcctctcagtgccctgacccgggaaaggggtacgagagaaagtggaggaagggagtgattgagtcgttacctgctaattctgccgggtggaaggggactcctattattctgagcaagtagcctctttaactgtgagagctgga

SEQ ID NO: 30695 - DNA, 64 bp, Homo sapiens
  chr6:100055269-100055333
  hyper
cgacagccctgggtggggtgcactgagcgctgtaggtgccgggaccattcgcagcttgtgtttt

SEQ ID NO: 30696 - DNA, 36 bp, Homo sapiens
  chr6:100055566-100055602
  hyper
ttttttttcccttgccgatgtcggcttgtgggtatg

SEQ ID NO: 30697 - DNA, 701 bp, Homo sapiens
  chr6:100060996-100061697
  hyper
cagcggcggtggaggcggcgccttcctgcaccacgaacacgcggctcgccaaggcgccgtcccagcggctgatggcctcggtctctccccaaaacccccggcgcccgatttcgccgcgccttcccaggcaggaactttgcgaccccaccccctgggcccgccaccagttcaggcctgcggtgcgcgggagggcatcaagcgcgaggcctcttccgcgccctcggccacctcgccgaccccaggcaagtgggggcagcccaagaagggcaaggagcagctggaccgtgccctggacatgagcggagccgcccgaggacaagggcacttcctcggcatcgtgggcggctcctcggcgggggtcggcagcctggctttctaccccggcgtgcgctcagctttcaagcccgccggcctagcgagggcggcggcggccgctcacggcgacccctaccgggaggagagcagcagcaagcaaggagccggcctcgctttgggcaggctgctgggcgggggccgggcgtgcgggcgccccgggagcggggagaactcggcggcgggcggcgcgggtcaccaccatcaccaccacgcgcaccaccaccaccatcccaagtgcctgctcgctggggacccgccgccgccgccgccgcctggcctgccctgctctggggccctgcgcggcttccctctgctctccgtccccc

SEQ ID NO: 30698 - DNA, 682 bp, Homo sapiens; identical to SEQ ID NO: 2868
  chr6:100061988-100062670
  hyper

SEQ ID NO: 30699 - DNA, 186 bp, Homo sapiens
  chr6:100062902-100063088
  hyper
gagctcaccctgaaccgcccaggcggtctgctcttggtgttcagaatcacatcaatgcgaacgtcacagcgccttcgagggcgcagattttaactgccacgtatttttaagttgtacttttctgtggaggaaattgtgccttttgaaacgacgttttgtgtgtgtatttcacgttagcatttcatt

SEQ ID NO: 30700 - DNA, 196 bp, Homo sapiens
  chr6:100066823-100067019
  hyper
ctggactcacagcctcgccctccctgggctcacagcctcgcgctccctgggctcacagcctcgcgctccctgggaataggggtttctggggtcttgttggggcagaggtgcgggagtctcgccgcgtttaggtggacagtccaggagtcctgctggagaggaggacctgggaagacccgcgatgccggcaggagga

SEQ ID NO: 30701 - DNA, 283 bp, Homo sapiens
  chr6:100067144-100067427
  hyper
cgccggcgccatcgcgaggtcaagcgtgacccttggccacccaggtgtgagttgtgaagaggaggactcatcagacggctgggccaacgtgtttagttccagaaggagcgtggcgctcgctctgggctcggcgacctccctacaaaagatgaaaggagggcttctgtcatatgcgactgtagtttaattcaaattaagccgttgtaccacagacaacttgttaatgcctttagcttgcaaaccctccaagagtccttcaaaaagggaccgaaagtgggtggac

SEQ ID NO: 30702 - DNA, 2 bp, Homo sapiens
  chr6:100441306-100441308
  hyper
cg

SEQ ID NO: 30703 - DNA, 241 bp, Homo sapiens; identical to SEQ ID NO: 583
  chr6:100441497-100441738
  hyper

SEQ ID NO: 30704 - DNA, 404 bp, Homo sapiens
  chr6:100441761-100442165
  hyper
cgcgcccacgccagagcccggccctcgcgcggcagcccgcgggacgtcacctgggtgctcgcgtcctccccgcgcggcggacagcccgggcgcccttcctctctgcgggactgcaggtctatccgctaagcgcgcgtgaccaaaaacggctctcagcgggtcccagctgacggaaggtgggggaggagtgcgagggtctctgagacaggttgggagccagccccacctccatttccaaagcgggggtccaggcacaggaacagccaaacgcccgaaccagcggggttacctttgccacttcatccaatccgagcatcgggtgcgtcgtgctcttttctaggagcgtggggtgccttcgcgaataaaatctgaaggcatctctgctctcgcggagcttgttcttt

SEQ ID NO: 30705 - DNA, 169 bp, Homo sapiens
  chr6:100729528-100729697
  hyper
agggccatcatgaaccggcgtgcggagaccgcctcgccactgctgcattacaaatgctctttattaacagcgatctgtaatcaatgggctcaggctttttgccagagcccccaaatcagacaggcgggcccctgcgtcagggtgggcggagccacggggcccagctatc

SEQ ID NO: 30706 - DNA, 58 bp, Homo sapiens
  chr6:100903347-100903405
  hyper
caacctattctccttcgtttctgtcacgacctgctcttctctttctaaatcccggctc

SEQ ID NO: 30707 - DNA, 221 bp, Homo sapiens
  chr6:100903560-100903781
  hyper
cggggacgaagggccggggcactcgagcgagcctggagcgggcaaagactgcgttgcgactggggacaggtctcgcgcggttcccgaagggtgcgaagactgcgctgagcattttgaaggcctcccaaagcggctggaagacaccccgaagcggcctcccaaccagaatgatctgaaaatcccccaggctgggctcgggataaatactagttctgaactcc

SEQ ID NO: 30708 - DNA, 610 bp, Homo sapiens
  chr6:100903832-100904442
  hyper
cgcctacgagggaaaatgagacttccccacaggttaataaacaacctgtccggcacaggttaacaggagcctctctcgccctctcctgccccacccccgccaccttttaaggaagcttttgccttcccggaggtttgccttctctttctgttccccgtagaaatcttacgattgtgtctgggttaatgttttataagggactggctactctcgtctacctgccgggctttcccgatctaatatcgaaggaacctccccaagtcctagtaaggggtcccccctccctaaagtctcgaagtggggtagagaccttctccctggagcccctcgcctcctgccttcggtgacgcgctctagcacacccaatttcagttggcgagggggtaagctgagatttcgtttctgcacttgacctaccgcagaaaattcgcaaatcctttgattgtctgtttaaaatgaggaggaaaccagctccctttgcggcgggattacagtgggaacaagatctaaagattctcttgcaattcggcgaggccgagggaacggggttttgcaaaagagaaaaggagctctgtgagggaggcgataactaaatcgggttttagacaaa

SEQ ID NO: 30709 - DNA, 76 bp, Homo sapiens
  chr6:100905783-100905859
  hyper
ccgggccagagacaccgcggccgcacccagggaatccactaatgttactgtaaatgtggggtggaggccgaaggtc

SEQ ID NO: 30710 - DNA, 248 bp, Homo sapiens
  chr6:100905919-100906167
  hyper
ctctctctctctctctctctctctctctgccttcgcggagctccagccctcgagtttgggcttcccgtagggatagagcctgcgggccaacctggctgcccgagttggagccagccgcgaaaagacggcagaaacccaaggagggcggggttcggccagactaaaactgggggcgaaattcatgcagcgttcatgagacagtcctgcgtgacggccgaaaaacgtcaatcgatgtcgccctgggactc

SEQ ID NO: 30711 - DNA, 373 bp, Homo sapiens
  chr6:100912073-100912446
  hyper
caagggatcttccgccgcggatccccgagtccgcgcccaggccgggcgcacgtcccaggaaagcaggtttccgcaaatcagaattcctccaaggcgaggcaggggcctttcagctccctaccttggcagatctggaccttggctacctctttaacttgggtctcaagtctgagggattcctcaaaaagtgacacttacacaccaagtctctcgggactcccaaggcgacccagcgctctggctgcccagcaggggctgcaacaagcggggcccagcagcgccaggttaacaggtggcgcgctcgcgacagcccctcgcaggctcccccgggggtgggaggcgccgcggcctctcccacaccaccgcggagctg

SEQ ID NO: 30712 - DNA, 124 bp, Homo sapiens
  chr6:100912465-100912589
  hyper
cggggcgtcttctgcttcacctaccttcagtccccacaagcggcagaggtttcgggggcgcccatctcttaactgttctcatgcctaccgtccaacccagcgacaccgccggcctctccgcttc

SEQ ID NO: 30713 - DNA, 161 bp, Homo sapiens
  chr6:100912890-100913051
  hyper
cggccaggggcgaggcgctcattggccaatagggctgagtgacacgagtcggccccgagccgccctccgcgcgcccaggctccgggctctgaatcttactacccgcgggaccgctggactcctaatgagctcagggtgccgggtcggcgctgtccggttgc

SEQ ID NO: 30714 - DNA, 30 bp, Homo sapiens
  chr6:100914823-100914853
  hyper
gtaaggaagtcttcacgcttaaggctgacg

SEQ ID NO: 30715 - DNA, 30 bp, Homo sapiens; identical to SEQ ID NO: 8634
  chr6:100915720-100915750
  hyper

SEQ ID NO: 30716 - DNA, 100 bp, Homo sapiens
  chr6:100917210-100917310
  hyper
cgggaattggcattccgtaagggagcggagggcctcaggccactaggcagctccgaacgcggggaagcgggagcaaagatgagctcagagcgagggttgc

SEQ ID NO: 30717 - DNA, 1266 bp, Homo sapiens
  chr6:101840708-101841974
  hyper
caatcttggagtctgcgacctcaggttcggcgcccactagatctcgaatccaacttctttctgaaatgtgtttaggttgagagttccggggcctgggcgggagtttggtggggagaggggagtctgctatttaaggcgccatacatacacagagacagcccgcccgacctcctaacactcaggaaaagtcaatttccaagcatctgttctcaataatggtggcagggagcagggcactgtgactcccagcatctgagggaatacccgcagcagcgctaccagagcgcatttgctctatgcgctggaggtcggggtgggagggtgcgcagatcaagatctttttttgcgaacctcagggaaatgaccgtagttggactaagaggtccactttggagactaccagcagccctccaagccctggcagtggagaagtttcgttgctatggtttcggagaggcataaaagccatcacccagaagcaaatgtgtttgggctccttatatgtgttgtcaccacccaaggctaggcaaattcctcggcgctttgcatgcatcactcactccctgacagagcatcttggccttagtctccccatcccaggaggcgggtgtgcgctaagggagcgaagtccagccggaggcttcgtaacatccaagtctagggacaccaggaattctctcgctctagctcctgtggtccaggggtgggagatgcccccgagtggccgcggcggccaggagcgtgcaggggccacggggaaaggagcgcggcgcctttaaagcaagaggcgaggaacccccgccaggaggcgtgtctgtctctgccgccgccgccgccgctgctgctcctcggtcaccgtcttcgccgctgccgtcactcgcgctcggcgccggcggctgcgctggtcggtctggtagctggggacttttccgcccgacctcctccggctgctcctccccgaggaccaccccaccccctccccgcccacctcacccctagctccaggtaaggactccccggctgtgggctgcactccgggctccttcacgaggtgtttgttttcaagaggacgggagggactgcgggtgggcgaggggcattttccacctggagagaaggaagaaggcgaacagtagcgctgcggacgtccgtgcgctcggggcgcccgctggacggattcactgcgagtctttgtcgggcttatctcagccaattcccgtcaagcatgcaagtggctctgttggctgcagtcgcctatgttctcca

SEQ ID NO: 30718 - DNA, 225 bp, Homo sapiens
  chr6:101849985-101850210
  hyper
gtgaggggcagcccccgcttagagtgctgaacccttgccacgtccctcgcctcccccgcccgtcttcagcgtgcgcaaccctcttccccgcgcttccctctccctctctgtatggcacacacaataacacacacatacacacacacacattctctcacacacactcaaacatagacacgcgctcgcgcgcactaagacacatgcgccctccgggtgcatttggca

SEQ ID NO: 30719 - DNA, 15 bp, Homo sapiens
  chr6:101850524-101850539
  hyper
tcctgggtgcccacc

SEQ ID NO: 30720 - DNA, 104 bp, Homo sapiens; identical to SEQ ID NO: 586
  chr6:105389509-105389613
  hyper

SEQ ID NO: 30721 - DNA, 249 bp, Homo sapiens
  chr6:105400913-105401162
  hyper
tgtcaagaaagttaccgccaagtggtttaccaaaacgcggcggaaggaatcaggacagtttgcccgacgggcgggtcggcggctttcaggcgggagagatcttgccaggggcagagagagatcccgaaaatcgcccccagccttgcgtccagccctttctcgccgacgttttttcttgatcctccgaaggcccagggcgacgtttgccatcgcggcttcccgaaaggacggcgccgggtttgctggaag

SEQ ID NO: 30722 - DNA, 234 bp, Homo sapiens
  chr6:105401581-105401815
  hyper
tggggtctcaggtctcggccgcctggggagcgacctgcctggagaggcgggttgcgatggcagcgctgggctacagaccccgccttatttgcggggaggagaggacgggtggagtcacttgccgcattgccacagcccctcctcctagttttaagaagaaccgaagcattgtttctgctttaacagaagtcactcattccttataattgaaaacaacgacggtgggctctggca

SEQ ID NO: 30723 - DNA, 155 bp, Homo sapiens
  chr6:105404519-105404674
  hyper
taaatatgaaattagcgttccaagcaggtttactgccatggaatagctgaattcttaaggggaaaaaaagcgttaacatcggttgttttatttaaacgaccccctcccatgattttagtcaggcttgtgtgtaaggcacgcgtgtgcacatatat

SEQ ID NO: 30724 - DNA, 30 bp, Homo sapiens
  chr6:105404921-105404951
  hyper
taattgacaaagtcacgtgtgctcaggggg

SEQ ID NO: 30725 - DNA, 889 bp, Homo sapiens
  chr6:105405576-105406465
  hyper
tttcctcctcgtgcccgccggagagaatagtttcgctgaaaatttctctttgtcaatgggatcagtattaaatcagcaatatacaagtaaagtatcgcatgctgtaatgtaaaatgtggctgaaaaatggagttaaatgaataagtacacgtatgtatagaaacgtggaagttggtgtgatcgatagaacagtgtggcttccccctcccccgctttccttttaacccttttcattttaagtattttctgtggagaaaagaaatcaaaccattaaaaaaaattttttttttctgttacccttcccccccaaccccaggcaggcaattttttttttttaatctttgaatgcacattgaatgggaatacagactgacttttttgtcctgttccttctcaggcggggctagcaaaggtggtggagaagagcccgggaagctgccggagccggcagaggaggaatcccaggttttgcgcggaactggccactgtaagtggttcaatgtgcgcatgggatttggattcatctccatgataaaccgagagggaagccccttggatattccagtcgatgtatttgtacaccaagtaagccaaacttttttgtccccctcttcatctttttccatgtggaggagctgatcggtagttatgccaatagacgtacgataagatgtccttcggtatattgaaagacaaaatcttccctgaaatcactaggtagtccaacgtttagggtacgtgtatgggccttttcctgggttttctgtctaaagagaaaagaaaatatttgaaatttcactatatatattaaggttgacgttattagcatttccccctgcttcattctacagcgaaatagtgttcttgttgtttccggtattacctatac

SEQ ID NO: 30726 - DNA, 139 bp, Homo sapiens
  chr6:105584077-105584216
  hyper
tgctaagagtcttttcgcacttattcatgcttcaaagcaggcagtttctgggacttgtctggccaacaacccgttcccaaaggctcggggaaggaggttgcgggtgggtggcgcggacctcgggtccccagccatcggc

SEQ ID NO: 30727 - DNA, 103 bp, Homo sapiens; identical to SEQ ID NO: 588
  chr6:105584217-105584320
  hyper

SEQ ID NO: 30728 - DNA, 185 bp, Homo sapiens; identical to SEQ ID NO: 589
  chr6:105584366-105584551
  hyper

SEQ ID NO: 30729 - DNA, 1036 bp, Homo sapiens
  chr6:105584552-105585588
  hyper
gcggccgctgaccgttgagggtctctgtggccgcagcgcccagacccggggagaagggcggcctccaagggccgggagcccctcgagggcgcggccagcgaggagggacagagggcggcgcccccggctgcccgggcgcgtagaacaagcagctgccgccagggccgacaaagttgctccccgaggggctgagatccaactttcgcttcccgatttagccaggggagcgcgaggccgcacacaacccggcgcggggggaaagccggctgcagctgcgcctcccatccttacccggctggtccctggcggggagcctgggcagcgccgaccaaagttcggagcggcagcttcggggcgcgggacgcggggcacacgggctcagctgctcgacgggagcccgacgcgcgctcctcggcgggtcggcgggtccggaagctccgctgcccgggccgggtccccaagcccgcagccgctttgactaaaataggcatcgcgacggcggcggcaggcggcggcagccagggctggggccgcaccgcgcacgcgcatgcgcccgccgccccgcgccccccggcgggcggagcccggcgccgcggccaggatttcccacctcgctcccgcgactccgctgcgggtctgcacacccgaggactcggtttgaaacgcccgcttatttattttcttgtcgcctcgctacaagattctatccttgtttgggcatgagtggggggcggcagtctcgtgggaccggcggcattcgtcgttcctccttacggggataattcgagaagtgcggtccgggtagggagagaaatcaggagagaaaatgagaaagagaatcctcgtttcccctcaaagttggacgacccactcgtatatctcctttttgggagattcgcccataactcagcacaaacagggaatagcccggaaagcgcgcgagttcccgtccgattgtggcgggggaggctgaacgtttggtccacacgggtgcaggacgcgggggtcaggcctcctgctgcggaggaagaggggg

SEQ ID NO: 30730 - DNA, 709 bp, Homo sapiens
  chr6:105627368-105628077
  hyper
tctgggaggaatattcgcccagaagcctctagggcatacgactcgcgttcttcaggggtcggcgcggataggaaccgcagcaaaggatcccctagacctccgagctgtgagcggcgacacagccgggaccccagaccccggaccccagggcgcggagttgaccggagccgggaagggagcggcgcgggcagcgcggggcagcgagacgcaagcgctcgcaggggtcggcggcccagcagaagccgcgcccgctaagttgcccgaagcggccgcgaggtgcgagggtgcggacagcaccggaaggcggcggacgcagcgcccccgggctcaccttcttacctttccttcccagccctgcccggagcttcagcccggcgcccgcagaagtttcccggcggagcgcgcttgacccgggtggcccgcgcggaagccctcagcgtccccctcgtgagtgcctcgccgcccaccctgcggcgccgggcgcagcgtgaccgcagcgggctccggagcggcgcggcggcgcgggcgggtgccgggcacgggcgcgcgccccggggcgcagccgggtgggcgggcgcggcggctgcgtctgggccggggcaggcggttcggccaccggggtgcggggctgcggagaatcctagcggccgctacggaccgaagtttccaaagatgcggttccccgagtgtacaccgctcccggttgtaa

SEQ ID NO: 30731 - DNA, 473 bp, Homo sapiens
  chr6:106429003-106429476
  hyper
aaactgctatgaattcggtgactgtgcaatgaaattgtcaattatcctctctgccttcctgcgttgaaagagtttcaagaagttgtggtgagtggatgtattcccagacggatgcgggcggtccccgggcagggaccccgaatccggggtcgcagggtggtagagccggaagattggattccatctccgcaaggattgagaaaaacggactcaccgactgaactattccatctccaagttgtttttattttccactttaagcataagaacgatgagaaccaggagccaggcggccccgcgtagcggtgggagcgcaggtacccgagagtaccctctgggggccggcccggcgcgctcgctcctcctcgcctttccgggaaccgtgcgcaggagctcacacggcacgcctgcggccaggggcaatcgggttctcggttcccggagtcccagttcccggtttccagtttccttat

SEQ ID NO: 30732 - DNA, 35 bp, Homo sapiens; identical to SEQ ID NO: 592
  chr6:106429589-106429624
  hyper

SEQ ID NO: 30733 - DNA, 127 bp, Homo sapiens
  chr6:106434152-106434279
  hyper
cgcggggtctctagtccggaggcacggaaggacctgcctgcctgactctagtctgcaagtctcgggcacacgcgcggcttctgcccacccgcgtaaatgccctggggaaaggcgccctttcttttat

SEQ ID NO: 30734 - DNA, 1307 bp, Homo sapiens
  chr6:106441813-106443120
  hyper
aatgaattgcagagtcggatacagctaatttgggggaatgtaagctggatgtcttttcctaatttatgaaacgtgaacgggggtaaggtatttatttgtacgctagttgaagtggggcaggagcactgattcctggacagtcactcaaaagctgcgcccaaagttttaaaaagcgcggggacggtggagagggaggcgaagagcccgcgctgctgggctgggctcgggtgccgcgctggggacgccgcatctactgagcggtcgccgaagacgccgggaggcgaggggcgaggtaagacgccgcctaaagaggcccgggctctcccccggggtcgttgttggaaaagcaaattccacggtgaactctaccaagctcagcgcgtacacagctagcggctctggattggactgcattcgcctaaattgcgtaattaaaaaaaaaaaatacaccactgccaccctacagcgacgcttccgctggaagacgagcggggacgcgtgacagcgcggggatagcttttctattacgtttcttgttctccgagctcgagcccccttttaaaaagtcgctcaccaaaaacggggtgggggatggaggtggggacgagaagtttccgaatgctgagttcatttggacgaggtgaggagaactagggtcctaacagcaggtccagaggactctcgagataggtttagagcccgtccttttgtctggagtgtcgcgggactccagaagtgggttgtgcaagacaaacttccagataaatctttgcccggatcctcctgcggtcaaagcatcagtcctgcccgtaacttcctaacgacatcttcttggagcagattccgcggcggggatggctgggtgtgcaaaccgaaaacagtttgtcagccctccagtcccgccgcgtcgggaatgcgagcccggccacgcggtccgaccgggtccggggacggcgcgcttgtcgcgggagcctcccggcttgcggagggcttgagttttttggcggagacagaggaaagcctctggtcgagaggattagagcgcgcgttttctccgccgagcacgctgcccgacgccgtcgcagccgcgcacttcccggttttgaaagccagagagatgagtcaagcgcaaaagctccggagtgacaatgcgagcttttggccagcctcatcctcctccccattcccttgccttcttttaggtcttcggttcgtgacaagtgcataggttaggcttgcacggaagagggtcggggcaggtgccagctcagggcacctacccggcgttgtcacgttccctttgggat

SEQ ID NO: 30735 - DNA, 69 bp, Homo sapiens
  chr6:106809115-106809184
  hyper
agccgctggggttgacgaggttcctcgcggcttttggttcagaccaagcaccggcgagaggaacttgtg

SEQ ID NO: 30736 - DNA, 97 bp, Homo sapiens
  chr6:106958240-106958337
  hyper
caccgcgcccattggcgggtttgcttttattggtttgttctgcgctccctcccgccttctggcgcgggcactggatgctagccgttttgctccagga

SEQ ID NO: 30737 - DNA, 83 bp, Homo sapiens
  chr6:106960311-106960394
  hyper
cgctgccagggacgacgcggtgttcgacgacgaggtggcgccaaacgcggccagcgataacgcctcggcggaaaagaaagtga

SEQ ID NO: 30738 - DNA, 356 bp, Homo sapiens
  chr6:106960667-106961023
  hyper
gcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctgtaagtagccgcgcaagtcccggccgagttgctgtccgcacacgtgctgggggtccgctctgagaggctcggggtatctgcattgtggaagaaacgtctggtcactgaa

SEQ ID NO: 30739 - DNA, 77 bp, Homo sapiens
  chr6:107809976-107810053
  hyper
ccaccactgtcataacgaacactccacagtaacatgcagtggaacaatggacacccccatatcgcattgtgtcaggt

SEQ ID NO: 30740 - DNA, 163 bp, Homo sapiens
  chr6:108434942-108435105
  hyper
tggtcagcccaagggcgagatgcgcctcggggtcggagtcgcccgagtggagactggacactccatgggggaggctggaaccccctgtgccacagataaatgctcgttctccaccacatgtgaggcatttgaataggagcaagtctcccgggttgggaatact

SEQ ID NO: 30741 - DNA, 715 bp, Homo sapiens; identical to SEQ ID NO: 2884
  chr6:108436072-108436787
  hyper

SEQ ID NO: 30742 - DNA, 33 bp, Homo sapiens
  chr6:108438124-108438157
  hyper
acgtcctccctggcccgggcagcccaactgggg

SEQ ID NO: 30743 - DNA, 317 bp, Homo sapiens
  chr6:108438260-108438577
  hyper
cgtgggcgaatgtctggtggccgggtgagtggaacccgccgcccagtccttgcagcgggctctggtctagtgggtgaggatccctggggaggtcccaactccggtgcagcgtccgcggggtgaagggcgcgagtgcattcaggccccaagggaaactcggggacatctgcacagacaagaatccccaaggaggcccaggtcccacggccaaagtcctcgacccccaccaggctgtctccctctagtcctccccactcctgacctgccattcgggacggagccagtccgcgggcacccaagggcgcaagctggtacaa

SEQ ID NO: 30744 - DNA, 98 bp, Homo sapiens
  chr6:108438779-108438877
  hyper
catgtgatgtgtgagcggtgtgtgatgtgcgtgtggtgcgaagaggggaggtgacaggccagagaggtttccccaaagggagaggcacggagggcttc

SEQ ID NO: 30745 - DNA, 1150 bp, Homo sapiens
  chr6:108439495-108440645
  hyper
gtagcagaaaggaatcgaggcccccgtccataatcgcaggtgtcggcgtggaaaggagccacgcgtgcacactcatgggtctcaccgcgcgggcttccgcggcccggcaagccgctgcgcctgcctcgccggcggcccacggagcccgtccgcgcttgccctgcacacctgcgcccgcgcgaggacccagccgccgaggccgtgcgcccgccgggctgcgggggccgtgggcagggggcgcagggggcgcagggggcggccggcgcggcggctgaacccgggctgacgaggcccagccgcctgcggggcccggagcgggaggtaccggctaggggcgcgtttctttcgcatccacaccccgcccccacccctctctccagggattttttttttttttttttttgtatccaggcacagctgggggctccctcaccacccacccctggcctccccatacagaataaagtcagtctgtatttaatggttatggcggatgtgagggggatttggcagaggcagaagagaggcctttcgctctcaaatatcgtcccttacgtcgtgtgagtctaccaacccaccacgacctcatattcttgtgcgggtgtctgactcgaatgacaagcgagctgattttttcagtacatagctgggaaatgtagtgagtgataatagagatttctctttcattttttacgcttgacttggttattgttgcttttcttttcccgtgattccttctgaggattagctctgacttccccactattggcggtcaaagtggccccgactcgggatgacaattgacggggatcaagggattgcccattctgtgcctgtaagaaccgattcgtgccagagaaactcatcaagtggaggcggagaataaagaccgttcgggggtaaatgtattcattgagaagggttctcccaaattgcttctaagtttttttaatgaaaagtaacgattgcggcaatcagcggctttttggcggattacaaatctggagggagctgcggcgctgcattgaaaagtgcccccgccttcgcaccgggcagccggttcacaggagcagcgcgaggggcgggggtccgatagcgggacaaaggcggggagggggcgagcggaggagggcggctcggggcgcccggg

SEQ ID NO: 30746 - DNA, 223 bp, Homo sapiens; identical to SEQ ID NO: 597
  chr6:108440744-108440967
  hyper

SEQ ID NO: 30747 - DNA, 890 bp, Homo sapiens
  chr6:108478806-108479696
  hyper
gtggggaatcttggccgcggccccctcccccgccttataaaaaagaaattgacttttgtttggagtttgtgaaaagtggggctcggggcccagtcaatggggcgccccgcggcgcgggctgagtggagctagcgcgaaccgctcagccgcggccccaattaatccgccctttgtgcggcccgcccggccgcccccgccgcagccgcaccagcggcccattgttcggcctcgccgggccgcgggatttacccttttcaaacagccggttttgtccagggcagttcgagcggaagtttctcactgacaatttgccccaaatagatagatttgtcagaagcgaccttcgggaaggaagcaaaaagccaccggcccgaaggttgggcccaaaacagggactctgcgtcccacccgcggccgcgccgcccccccgcgcccccggccctgcagtcccgaagccccgcgggggtccagaccactgcacctgctgagccagacactccgcggacctgacctccgttttacccatctgtaaaatggagcagctgggcgctggcaagccgtaagtccaagagctttggctccaccagcgtgtacgacgctcatttcctttctctctccccacaccctttccaaaaactgtaagccagaaaacctggccaggcctccgcgacggcgagaaacggtcttgaaggtcggtcggtcgccgtaatgcggtccggatcgtgcacgtgctgtttcgccactgccctccggctcctccttaacaaagatgtcaaccgtgctaaatcacaggtggtgcctttgtaagaccagctattgtcccctcataagtcaagatataaaacgctttgtactgaatggcccatgatctggagcgctcaacttgggag

SEQ ID NO: 30748 - DNA, 294 bp, Homo sapiens
  chr6:108484872-108485166
  hyper
gagtagaaggcagcccgcactaaggctccaggcttatttgggacctggtgggcgacggggcctcagcccctcccgcctaccctggagcttgttgccgccgttaccactgaaccagtcatgccagaaagtcatcacgatgatttcagaactgtattgtgatttatgcaaagcgcgccgataattacagccgggcgcacagaacacaggatgcatatgctgcgggtgtgtgcgcgcagtgttgtgcctttcgccagggctgaatggggtgtgtgtgtattccgtaggcatcttctt

SEQ ID NO: 30749 - DNA, 494 bp, Homo sapiens; identical to SEQ ID NO: 2891
  chr6:108485513-108486007
  hyper

SEQ ID NO: 30750 - DNA, 456 bp, Homo sapiens
  chr6:108486008-108486464
  hyper
tgctgtcggagcccactggagcgcacagcccgctccccctgggacgcccaggcggaggacctgctgcgccctcccagggctcgggggactccagcattcacttgcacgcacaggcgaactctgattgaaagcccgggatgacaccgagtctggagaaagagggaccggggggtgggctggcggaattgcagagcgccggccacagctcccctccccgcgaacgtcgagcggagggcgggaggtgtaacctctgacctctggccgggtccacgccctgaggagggactggcaagctcttgttcgacaagttcaagctgccgagagagcttaaatagaattaatctcttagagatcggggatcatcgctccctcggcatgcgctctcccagcgccgcgcacagagcaaggcgcgagagagctcaggaatcgcgggaaggcaagcggaatggggagggg

SEQ ID NO: 30751 - DNA, 160 bp, Homo sapiens
  chr6:108486846-108487006
  hyper
gcgcgcacaatcacacgccagcacacagccacccaatttcttccgcgaatctatctggcactctggagagagggggaaaagcgttttgagaaagccccgtcacccctccccttccttcttgccgtgaaatatacgaattcatttttattacgagccgcac

SEQ ID NO: 30752 - DNA, 9 bp, Homo sapiens
  chr6:108487077-108487086
  hyper
cgcctgcat

SEQ ID NO: 30753 - DNA, 63 bp, Homo sapiens
  chr6:108487419-108487482
  hyper
tctgcgcttgggttccggcagcgcggagcccgtctgcctctgagactgcggtagtgttttcct

SEQ ID NO: 30754 - DNA, 747 bp, Homo sapiens
  chr6:108487779-108488526
  hyper
atttccactgttggacgaattctgagcgcccagggagcagcgcagcgcgcgactgacacccacctgtcccgcccaggagccttgcaggctggagggcagctggagagcggcggcgcccggcggcgaggcgggcgctgccggccgggactcgggcagcgcccaccaaccgctccgccccgggacagccagcatgagcaagccagccggatcaacaagtgggtacctctcgggccgccgtggggcctaggcgcgcagcctggggcgagcgagcggggaggctgggggaggtcctgcctggagcgctgcgaatctgagcccctgagagggattccagcgggcgtgtgcgttcggcccagacctgtagaccgtgagttggagcatttcgtggagaggggagagccgtttcgttgcctctggattgcttgatcccccctgtctggtgcggtgagaaggttacgacccgcgcagcccaccagtcggatgagttgtctccatttagccgccaggtgctggatgggggggccatgggggcgggaactgggccgcagctccaggcggtagcacaataacacactcgctcaaaactccgagctccagcgcgcaaaagcaactctgtgcaaagcggattttgaatggaatgctttgcaccccgtttctagctatttcaaataatcctgcaaactgggaagcagaaacaatttaaaagtcacattttccttaatcctaaatccgcgtaggtcataactg

SEQ ID NO: 30755 - DNA, 148 bp, Homo sapiens
  chr6:108489661-108489809
  hyper
cgcccccgctgtggactaggaggcaggccaaccctccggactttgggggaaaaaccacagcgggctccttgcggaaactttggccgttctaacttgccaagagcctgagtgaggccttggaagcctccagccccggctcaggtcggga

SEQ ID NO: 30756 - DNA, 180 bp, Homo sapiens; identical to SEQ ID NO: 600
  chr6:108490066-108490246
  hyper

SEQ ID NO: 30757 - DNA, 219 bp, Homo sapiens; identical to SEQ ID NO: 601
  chr6:108490296-108490515
  hyper

SEQ ID NO: 30758 - DNA, 464 bp, Homo sapiens
  chr6:108490537-108491001
  hyper
cgaggaggggcccccaccctgcactggtcttccctccaccctcatcgggttctccagagatgttgtcatgggcctcctgtccggatgggaagtggggaaaaagagaccccaccactgctcctcccactcactcatcttggcatcttcaacagtgccacagggaagaggacagctggggtgacagtactgctgggccccaaacgtggaccctggagcggtcagagggcgcgtgttaagcagaggatggttgtaagatatggaaaccaagtttaccgcttccagagtgagtgcagtgcagcggagctccagacccggttcctgagcgaccaggaactcccttgggcgcagtgacaggcccgaaggagtggaggacaagacccgctgtgcccttgcctggccctctccagcccctccctcccacagcacaatctcccctcccgccctgtgggaggggggcgccgagc

SEQ ID NO: 30759 - DNA, 303 bp, Homo sapiens
  chr6:108491107-108491410
  hyper
cgcggggttgtaattacccggccgagcctggtcgttaccgaacaccccctcacccccaagcacggtcccccgcgctctccttcccccaccccctccacctgagacgagtctgggacccacggtgcaagctcgcccggacgcctcgggttccaggagcaagtttacacctgcggtgcctcgaggccctccccgcgccacgccctcacctcccctactcccctcgcccagacgttccactgccgccccttcccacctcaatcccatcgtagtccccaacccaagcgctttcggcagcagctgtcg

SEQ ID NO: 30760 - DNA, 290 bp, Homo sapiens; identical to SEQ ID NO: 8674
  chr6:108492251-108492541
  hyper

SEQ ID NO: 30761 - DNA, 179 bp, Homo sapiens
  chr6:108495639-108495818
  hyper
tctctggggccaagtcgctgtcttcggtcctgaagtctcgtccctgttccaccactccgcgactggcggaagttcccctagcgagagccccgcaggcctgcggggtctgccaaacccggctctctaagcttcacctgcttggagaaggacgtttcccccttgtccgctttcttggggtc

SEQ ID NO: 30762 - DNA, 551 bp, Homo sapiens; identical to SEQ ID NO: 603
  chr6:108495915-108496466
  hyper

SEQ ID NO: 30763 - DNA, 173 bp, Homo sapiens
  chr6:108497294-108497467
  hyper
aaacgaggtgtctggcgtgcgcgacgctccctctcttttggatgggggcgaggatacctggctactccagcccagagggtctctggtttccctgcgaacccccttccctggtggggaggagccctggaccgaaggagaacacacctggtcttacttgaggctctgccattatc

SEQ ID NO: 30764 - DNA, 185 bp, Homo sapiens
  chr6:110299509-110299694
  hyper
tctcactcgcggagccggcacagcgacaggcgccccgcgcttgcctcctccccggcccggccgcctcctgcaggcagctgctctgtttgcgcggggagctcagcccggcgccccgcctcggcgcccatgaccagcgacttccagaagtcctgacgccccaggtgagtggccgagttcccagggaa

SEQ ID NO: 30765 - DNA, 30 bp, Homo sapiens
  chr6:110299948-110299978
  hyper
ccgccacaacccaggcgggactctcccagg

SEQ ID NO: 30766 - DNA, 509 bp, Homo sapiens
  chr6:110678891-110679400
  hyper
cggagcctagaagggcgcccggccacggcgacccccaagtactggctgaatagtgaatgaactccgcttggccgcacttcagtctatctgggcactgaaagatgcgacccgtggagccgcctaagagagcacagggggaagagaagaagcggaagcctccggaggtcccatcgaggcggcctgcgggacctgagcgccgggctccgtagcgcggtcgggagggggcttctggtcccaggcccaagaccgaccgctttgcaactgaccttccggcgggggcgcccgcgcggggcacagcagccaggctccggcgtcccgctcccgccgccccccggcggcgcccggcgaccgctgcgcacgtaggtcacctgcctcctgctggcgccgcgcggctggcccggcgcgggcggcaggtgcggcccaggtggccgccaggccgggcccggcggggcgctgcgggtgggggacccgggcccggcgcgccgcagctctgcgcagagccgcaggcc

SEQ ID NO: 30767 - DNA, 298 bp, Homo sapiens
  chr6:110679401-110679699
  hyper
aacaacagcacagccccgagtagacaccggcgcaggacgccgcagcccctcccgggcggcctctcccgggccatggcgctacactcggggtcccgcgggccgcgcctggccggcagcagggatgtagccccacaggccggagcggccaactgtgggaactcccccgcgggccggggtgcgggctcggacccgcctccctccctcccgaccgaggaagccccggcgtaaccttatcctgccctgccgagcgcgccccgccgctggaacggtggtgggccgaacgcggtcacagggggcc

SEQ ID NO: 30768 - DNA, 230 bp, Homo sapiens
  chr6:110797490-110797720
  hyper
tccgagcgagcccagcgcctctgctcaccatgccaggtcccgctgccagaggcctagaggagaagcccagctaggggccggcgtctggacgcccgtgtcccgactgcgcggggtgaggaggaagtggagatgttttcggatcgcgagcgccgcgcgagaaccccgccgcaacggaaagaaacagacccctcggcgccgcctcccgcgtggcgccgcggggcccctccccc

SEQ ID NO: 30769 - DNA, 217 bp, Homo sapiens
  chr6:111409641-111409858
  hyper
ttcaaccccagtcatcgccctgtcatttttgtggtctctttcgtgactatgccagttatgtagttcttcacctgcctccctgggccgcagaggggtgtgcgtatgttggcggggcggggggtggagtttggaggaatgaaagagatttgtacgaaggtcactggagttccaaagggggccctgcaagagtcacggttccgtgcgttcccgtcccccc

SEQ ID NO: 30770 - DNA, 167 bp, Homo sapiens
  chr6:114663194-114663361
  hyper
gtcttccccaggcagcgcccaggagaaccgaaccccacaaagtgcttttttgctggcatcacccggatgcttccctttggcgatttgccccttctcatttccccccaaatctagaggtctcaaagcccctcccccgcgcgaggcgggcagcgcgccttgctcaccgt

SEQ ID NO: 30771 - DNA, 37 bp, Homo sapiens
  chr6:114663777-114663814
  hyper
gccggagaccgcagccgctctgcggggggaggtgcgc

SEQ ID NO: 30772 - DNA, 53 bp, Homo sapiens
  chr6:116783514-116783567
  hyper
ccgcaaccgcagctgcgccgcggagctgccgctggtgccgtgcaaccaggcca

SEQ ID NO: 30773 - DNA, 48 bp, Homo sapiens
  chr6:116937976-116938024
  hyper
agtctagagccaagacgcctctgggtggccccgcgggaccagaaacat

SEQ ID NO: 30774 - DNA, 240 bp, Homo sapiens
  chr6:117086239-117086479
  hyper
gaaggtgggtcaccccgcacccttgcggccggggaccgactctccttcgcgcggcggtcgccacacttacgggatccgaggcgggatctcctccatcgatttgaaacgccctgtccacagcaggattttcttgtcgaactgcgaaggcctgcgctgcgtggggactcggtgaatctcccctgcagcgaaagcaacccagatggacgcgggaactgacgcaccggcacagaggatcagcgc

SEQ ID NO: 30775 - DNA, 160 bp, Homo sapiens; identical to SEQ ID NO: 605
  chr6:117086480-117086640
  hyper

SEQ ID NO: 30776 - DNA, 32 bp, Homo sapiens
  chr6:117197673-117197705
  hyper
agtaatcgtcagggacgcgtttaaattacaaa

SEQ ID NO: 30777 - DNA, 4 bp, Homo sapiens
  chr6:117198217-117198221
  hyper
gaaa

SEQ ID NO: 30778 - DNA, 30 bp, Homo sapiens
  chr6:117198544-117198574
  hyper
gcttgctagtctatccggaagaaacagtgt

SEQ ID NO: 30779 - DNA, 316 bp, Homo sapiens
  chr6:117585882-117586198
  hyper
gaaaagccagacatccgaggccgggtaaagcctcctggactcctcgaaagcagctcacaccgggagcagccggaagcgggcgcgatctatgcgaagctaacgggttccggtggagaacatcaaagagaaaggagcaggatcgaactttagaggggcagaagggcacggcccaagagagcagaattggggtgtgggacaggcggcgggaggaccaggttagagggagcgaaaggaagtggattagaggacagcggttacaggtttcagccactgccatttccccgcagaggtagctcttctgcgccctggaggggta

SEQ ID NO: 30780 - DNA, 243 bp, Homo sapiens
  chr6:117586401-117586644
  hyper
gagcccggatcccttcgtccccgcctccttctctctctctctttctctctctctcctattttgtcctgggagattcctactcgcggtgcgaagcctcggatccgctgggaaccgcatagtctccggcacccttggccgcatgcttgtcagaggtgggccccgggaaacacactcgctgcccctccaacaagcgtccctcgctccccattggccccccggtccccgccccccaccgccccctcc

SEQ ID NO: 30781 - DNA, 157 bp, Homo sapiens
  chr6:117587133-117587290
  hyper
ggatgcggggattgccggagccgcccccagttggtagtgcaattagctaacccctttagctcgcctgtttgctctcgggaagcagctaagccctgctaatgtgagcctaggtcttccctggaataatcagaggaagatggcacgggctggattttct

SEQ ID NO: 30782 - DNA, 76 bp, Homo sapiens
  chr6:117587572-117587648
  hyper
taattttttcctttgcgaagttctgggagcattatccggagtgcgaatgacccggcagaggcgagcctgatagaca

SEQ ID NO: 30783 - DNA, 391 bp, Homo sapiens
  chr6:117591206-117591597
  hyper
gcaagaaggctgaaacgcgagagggggtagtgagatcactaggcggccgaccaagagtgggaagaggtatcgttagcttggggagaggttaaggctaggaaagggaggccgtgctgcgctgagtcgcgggaagctccttgagcttcaaggacttgagtcggggagggagtctctccgctcttgctactctacccgccacttggtttccgcactgaggactcggctgcgaaatgggaggaagcaggcctccttttcgtgggttcccagaagcccccattttgcagttcccccacctcgctttcacaggttgcagcccccttagaaaaacgccgctgcagaggcgggggctgcccatcagccccggccatggctagccagccctgtgcccgcc

SEQ ID NO: 30784 - DNA, 167 bp, Homo sapiens
  chr6:117591683-117591850
  hyper
cgcctccccggccggcctacagactgctccttcccgatgagccagcgcagcttccccgcctccttctggaatagcgcgtaccaggcgccagtgcccccgccgctgggcagccctctggccaccgcgcactcggagctgcccttcgccgccgccgacccctactcgcc

SEQ ID NO: 30785 - DNA, 72 bp, Homo sapiens
  chr6:117592066-117592138
  hyper
ggcccgcctcgcaaccgccccggcgcccgcgcccggcagtcctccctgcgagctctccggcaaaggcgagcc

SEQ ID NO: 30786 - DNA, 188 bp, Homo sapiens
  chr6:118228044-118228232
  hyper
tttgggtttctaatccggggccggcacctgtctcggcgtcctgccgctgtcccaggccggtggtgctggattccgcggcgcttgggcagaaacgaggaatccccgccaactccacagggaggatctattcccagcccccttatccccctaaaaaacacccaaaccaaaacaatcaccacaacctagac

SEQ ID NO: 30787 - DNA, 546 bp, Homo sapiens
  chr6:118228323-118228869
  hyper
cgcccgcgccccgctctgccgccgccgccgccgccgccgccgccgccgccggcgcccccgcccggctctccgggttcaccctcggtctctcactccgtgagacacagacggtagctttccgaccgagcggggcacaggctgaggcggcgccagcacaactgccgccgcgcgccccgaggagacccgggcacgaggaaacaaggagaaatcaggactccttccccggaaccgaccggcagctccgcgcccccgcgcgacacccttcgcagccacttcgcggggcgggccaggacttggggacgcggctcgggaagagccggggcgggcggcggcggcggcggcacgggcgcgagggtgcgcgcactgggactggagaggagtgagtggcgggctgggcggcggcggccgtagccgcgggtgcctccccgcctcaccgcttcgcaggcagcaccgcctcccgggccgcggccgcccggccgggtcctctgcgcgttcccgggcccggaaccggcacacgatgcacccggctgcgttctgatcgccgcc

SEQ ID NO: 30788 - DNA, 520 bp, Homo sapiens
  chr6:118228870-118229390
  hyper
cgcctcagcctctgccgcgatgatcccccctgagcagccgcagcagcagctgcagccgccgtcgccagccccgccgaaccatgtggtgaccaccatcgagaacctgccggccgagggcagcggcggcggcgggagcctgtccgcctcctcccgggctggcgtgcgccagaggatccgcaaagtgctgaacaggtgagcggcggcgccgggcgagggcgcggggggcgggggctgcgggcgcccggctccgggtcccctccgtccctggggcggcccacgggtcctttgggacggggttgcggccggaggagactgaggagatcgggcgacgacgcgctccgcgggcgcagagaggccgcggcagctttgtcccggcgcagggagccctggagtggtggagctgcagctggtccgaggcgggagttcggggagaggcggggtttttcgtacctagccaccctgtatgtgtgtccgcactcacaccctccatacgcgtgccgcctcacttccctttccctct

SEQ ID NO: 30789 - DNA, 56 bp, Homo sapiens
  chr6:118229676-118229732
  hyper
aagtgcaaaacattgcgggcagggtgtgagccggcggcgcccagttattccgaagc

SEQ ID NO: 30790 - DNA, 117 bp, Homo sapiens
  chr6:118229733-118229850
  hyper
cccatgccggagggggcgggtgccgatcgccggcgcctccagtgctggaatctgcgtagtggattcaggacgttgacgttttaggatgaggacctgggttgacgtgaaaatgggggt

SEQ ID NO: 30791 - DNA, 304 bp, Homo sapiens
  chr6:118241005-118241309
  hyper
tcagcccaggagctccgcggtacctgtggttcctgaaagagagtttgacaggcttcaggaaagggttagtgcctcttgaactggggagattacaaaacgagcgtgggcctaaaaggctccacagaggcaggcagcgggatggatagagcggctcagagggaagggacagagccgctttaatgtgctaatgaggggaagcccagatgccagcgggctcagtggagctctttgtgacgccgggttcccggggctggctggagtctctgtacctatctggatcctgctgcaggccggggaaacactg

SEQ ID NO: 30792 - DNA, 128 bp, Homo sapiens
  chr6:119399076-119399204
  hyper
ggtgcaagtcccttacgcgcaccgtgccgctgtgctgtctagcttaaattcatgttgccagcgttccaccaaagtttgcagggttttggaggtgtctccggctgttgcttcggcggaggagtagagtt

SEQ ID NO: 30793 - DNA, 316 bp, Homo sapiens
  chr6:121758621-121758937
  hyper
gttcctgaaacttcccgagaatgaggcggggcggctcaaggggaaagggcagggaggagagaccctcgggaagctgatgacgcgtccggggcaagtcagcctgtttccgagacgcgcgcctcacggtcgtagcagcgctgcgcccaccctgcccctttagtgacccagccagcctttgctgggggtttctgataacgctcatcgataagctctccttgctcccaaaaggcgtgcttctctttctctccaggtacaaagtaggggtgggaaggggagagctacacaatgttgtaaaaagaagcgtggctttatttgg

SEQ ID NO: 30794 - DNA, 250 bp, Homo sapiens
  chr6:122932220-122932470
  hyper
agtaaactcaagggtcgcccgtagctattggattttccctgctcctaggaccccggcaggccgcagggagggacacgagtgccaggtggtcgcgggctgagggagcggagggcctgtgttccggttggtgctgatgctagccccttggggaaattcctgaaggtgcatttcggagccaaatgaccctgccttgcagcaggtcccttccaagggagctgagagggccaggtcagaccggtcttcgtagagc

SEQ ID NO: 30795 - DNA, 114 bp, Homo sapiens
  chr6:123316893-123317007
  hyper
tcatataagttcctccggaggcttaatcatcagtacattgtcttggaaccactctggtgttttctaaattaaatatctctgtctacaacaaatgcgaaaagtacagaatgtttc

SEQ ID NO: 30796 - DNA, 642 bp, Homo sapiens; identical to SEQ ID NO: 2911
  chr6:123317072-123317714
  hyper

SEQ ID NO: 30797 - DNA, 156 bp, Homo sapiens; identical to SEQ ID NO: 2912
  chr6:123317715-123317871
  hyper

SEQ ID NO: 30798 - DNA, 673 bp, Homo sapiens
  chr6:124124293-124124966
  hyper
gccactcgggctttccggccgctctggatgcctcggttgcacccctgttccatgaccccagcttccttccctaaccctcctcttggtcccttctcccccgagcgcgcgcgcacacacacactcggttcgctcccgcggagtggctctgggagcacgaccgacttcagctcagcaaaccgcggtcatgccgcccagactcctcgccccgaggccccggtccccgccgccgccgctttcgcgccgctcctttccgcctagacaccgccgcctgcggccgcctgggcggcagcccctgcggtcctcaaagttggccccctgggagggggcggcagggagcaggatgaaggatttgttgtaggaggaggattcacacatctgggcgaagggaggggcagcgccgctgctgggacgcggcgcggacccgcatcattgcgcgcagcagccgctgcagcagccgccggggaccgcggagccgggacgcccccgctcggcccgcgccccgctccccgccccacccccgcccgccgggcccagcaacgcagggtgcctaggagccgcgggctgcgcagggaggcgggcagcggccctcgcgcgcttctgccgcccccggagccggcgcgcggcgagcgcagggcgagcgcgcgtcgggcggcggccgcgctggggggcgtga

SEQ ID NO: 30799 - DNA, 61 bp, Homo sapiens
  chr6:125282732-125282793
  hyper
gttggaggagtagatcgaaagtgctttttcgattatttatgggtttcgaagattcttccta

SEQ ID NO: 30800 - DNA, 269 bp, Homo sapiens; identical to SEQ ID NO: 8704
  chr6:125283133-125283402
  hyper

SEQ ID NO: 30801 - DNA, 250 bp, Homo sapiens
  chr6:125283925-125284175
  hyper
gtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctggacgtgctgggtcagcggcgcccgtccctcgccaagagacaagt

SEQ ID NO: 30802 - DNA, 200 bp, Homo sapiens
  chr6:125420809-125421009
  hyper
gcgaaaaccttccttcgggaacgcggagctagtgcacgggggcatgttcttcccccgcagccctggcaagcagaggccggcggcctgtggcgcggggcagttgtgctggctgccgggcggggctgctctgggtctgggtgcacggagaggagcgcggagtgaagcgcacggtgcacactgcggggcgctgcttgtcacct

SEQ ID NO: 30803 - DNA, 43 bp, Homo sapiens
  chr6:125475547-125475590
  hyper
agggagtgagaggatcgcccgccgagggggtggctccgcagcc

SEQ ID NO: 30804 - DNA, 168 bp, Homo sapiens
  chr6:125684529-125684697
  hyper
attcttgctgctttccggtcccacgggacggctcccaggctcccgcctcacggcaagaaaaataaaggcctccccgcacagccagccagcttcgttcattcacgtcaccgacaaacactcctagcaggcgttgttaaacgttcagggagcgcccgggacctagccgag

SEQ ID NO: 30805 - DNA, 15 bp, Homo sapiens
  chr6:126068007-126068022
  hyper
ctaagccttcccttt

SEQ ID NO: 30806 - DNA, 110 bp, Homo sapiens; identical to SEQ ID NO: 2913
  chr6:126068068-126068178
  hyper

SEQ ID NO: 30807 - DNA, 782 bp, Homo sapiens
  chr6:126068793-126069575
  hyper
aacgtgcagccctcacggaaagttgtgacggtcgagcttgagcctggcgggccgcggagcgttcacctgcggccgggaggtactggcccagggcgctcggggcgggaggtggcaggcgaccggcgcgcgtcaggctcgtcacccgctggattgcggggccggagcggggacggggtctgggtcctggcccgccctcgtgcagccgatcggaggccccgaaccccgcgccgacccagccatccgccctgaggccgacaggggagctggggttcaccgacccccgcggccccgccgtcgggcgcggaccccatccagccccacctggccccgccgagtgtgtgctttgcctggggttaagtttcagaagccaagatggaacgattcgggtttctattcacaaggttattgaaggcatggcggtggggaccgcgcaaaagagatgagagtgtggggggaaaggggtttctgttctaataagggcttagcacgctggccgcaggtcctccgcgccgaccgggctccttcccgctctcccccgggccaaaccccgccagggtcccgtctttcccagtcgcgtcctttcctcttctccccgccccgcgccgggcttgtgtggacagagaacggagtgtcaaagggacgccctgggccgatccccaggaagctatgaatccctccgtgacggaggggtctggggatcgatagacggccctttctcagaggctctctccactactgaccaagcggccctgccaacgtgtggtttccggctggaccccaac

SEQ ID NO: 30808 - DNA, 137 bp, Homo sapiens
  chr6:126069805-126069942
  hyper
ccaatcttcacctcccggactctaactctgcggctgcgagtgcatacaccagggggactggaggagactggaggcaattatctggataatccaagcccgaaaaactcgaacttgaaaatatacgattatgtcctgaa

SEQ ID NO: 30809 - DNA, 86 bp, Homo sapiens
  chr6:126071232-126071318
  hyper
cactgaaaggcagagcgcaggagttggcgagggagggtcctggctgtcacagttggacgcgcgaacggcagcgtctgggcgacagg

SEQ ID NO: 30810 - DNA, 83 bp, Homo sapiens
  chr6:127439190-127439273
  hyper
gaaggtcaggaaagccgggaacaagtcagcagccagaaactctccagcgatctgccaagggggagagggtagttgcgcgccgg

SEQ ID NO: 30811 - DNA, 166 bp, Homo sapiens; identical to SEQ ID NO: 8714
  chr6:127439321-127439487
  hyper

SEQ ID NO: 30812 - DNA, 727 bp, Homo sapiens
  chr6:127439783-127440510
  hyper
cctatgtggtgctcccgggagcccagcccaacactggagcgtctcctgctcgcgcacgccagaagcagctcggggtctctccgccgccccttggccatggccgctgtgccgacggcgcccgctcccctgcgctccaggggcccccgccgctgcagccgcagccgccgcagcttctgagcccaaggggccgccgctgcagccgccgccgccgccgctcgcccgcccggatcccgcctgcggcagttgccgcacaacatgctacctgcggccgccccggcggctcctggaaccccggttcgcggcgatgccagccaccccagcgaagccgccgcagttcagtgcttggataatttgaaagtacaatagttggtttccctgtccacccgccccacttcgcttgccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaagtaagtgcagggttttttacgcgtttgctccctcccgccgcgttcacctgtcgggtcgctttgcctgtccggagcc

SEQ ID NO: 30813 - DNA, 452 bp, Homo sapiens; identical to SEQ ID NO: 2915
  chr6:127440511-127440963
  hyper

SEQ ID NO: 30814 - DNA, 1041 bp, Homo sapiens
  chr6:127441030-127442071
  hyper
cgtgtctgcgcgtttgcagagctgccggacgtcccccgcccgagggttgaagacagcaaaaccccagctgtggggagccggaggtgcggagtttccaggttctctcttgtcacatgtgagcgtctgtaccatctctggccctttcaagtgtgtcccctgggacacacacgtacagagagtggggtctccctaaagattcgcctcctcgctgcccttaatgctgttatttggagggttggattgtgatggcttcttaagacggtgtcctagctggaattaagcggacaccaccacggcagcctcaacctgggttggtctgtctgaaaggtagaatcttcccaagatgaagggacagatgcgaaggtgtcacctctcctcgctccagggtagcctggcgccctcgctgctctagtgtctgtgttcccatggggagtcctttcgcagatctcagagcaggggcgaccctggctctatggttgggggcgctggtggagagagggaggaggaaacttctcctggagctcgcgaggggcaggaagcgatgctgctgctctgggctctcgcacctccgcggcgtgcagcccaggcccagcggccccacctggtttcccaaggggatccctctcccagcgtcccgcccgggaagcctttcggggcagacgtcggggcagcgcggaggacacaacaccggcttgtgtgagatggaaatttagtaatcgcttctcggccgctgtttgtccctgccctgcccctgggcatgagggtcccctgaaagctccctttgtattgctggcctcggccagacaaggtttgattcacctgaaaattgccttttaaaaaggtggcagtgccagagcgacaggggccctggccgggcctcaccgcctttaggatcacctagcagggggcaggagagcccaaactaaatatgtcagggcatccgatttattattcttggcctccgaatggtgtgtactctggtaactccccacccactctttcattccggcccggacgcggaaggggaggcctggggttcag

SEQ ID NO: 30815 - DNA, 190 bp, Homo sapiens; identical to SEQ ID NO: 8720
  chr6:127442089-127442279
  hyper

SEQ ID NO: 30816 - DNA, 50 bp, Homo sapiens
  chr6:127442649-127442699
  hyper
atgctcttgctccttcgcacttgagtctgcgtttgcggcttggtttgctg

SEQ ID NO: 30817 - DNA, 30 bp, Homo sapiens
  chr6:127836173-127836203
  hyper
tcagctcatcgatctcgttctgaggcggtg

SEQ ID NO: 30818 - DNA, 907 bp, Homo sapiens
  chr6:127836715-127837622
  hyper
ctcttggagctgctgcgggtgcggctgcgacgaagggggcgctgccgcctgcatgcccccgccgctcgcgctgccctctgcgctctgctgggggccctccgccgccgccgccattggggaggcggaggcgacggccagggtctcgcaaacggcaggggggccagacaccggggagctgcggctactgctgccgccgccgttcttagcgtgcatctgagccgcggccgccgccgctgccgcccgctccttcttgagatggaactggatgagctcagactgcagacatccttctttccagtagctccctccaccaccgctgccgccccccgcaacgccgcttccggagtttctgctgccggttcctggggttttgcccgcagaagaggaggatggagaaggggaggccccctccccgccgctgccgcccctctgctgagcgcgtacgcctttccctcgccagcccctgggcggcggcggctgcggagcgcccccctccctttccccggagccgccgccggctcctcctccttccccgccccctcctcccccttctccgagcggagggggttccccgagtttcgagggcacggactctagctcccgaggcggctcctcgggcggtccgggcctcctgccgcccaaagcggccagggtcgcggcgggggccgcttcagcaccagccacaggctggacagctcccggagcggcccctttgggcgccaggggcgtcgccttctcggccccacctccgcctcctcggatgctggcgggcggccccgtgcggctcccggtcttgttaccctgctgttgctgctgctgcagctgctgctgccgaacagaattgagtttagtgccggcccccactggggaccgggtggccgcgattgtctgtcgcagcgaactgtcc

SEQ ID NO: 30819 - DNA, 15 bp, Homo sapiens
  chr6:127839806-127839821
  hyper
tattgtgcctttctg

SEQ ID NO: 30820 - DNA, 68 bp, Homo sapiens
  chr6:127839929-127839997
  hyper
cggtaacgtcaagattcagctgcccccagagcgggtgacttcccggcggtccgcggctgggctggagc

SEQ ID NO: 30821 - DNA, 337 bp, Homo sapiens
  chr6:127840356-127840693
  hyper
gctttgtcctgggttcggtcattctccatcaattatttacttgagcttcttttccaaggaggcggactagaacagccttccgggcgtgactaacatctcctgatgcagctggctggcggctgctgggagttctctttgttcactcactttaattctcagtcgagctctacacgcggtgctccctccccacccccagcccgggcggagtcatcagatgtcgtttccacgaatagataatggttgccatgatgggacccaccgtcccacagacaaagggttcttgcgaagccacgactaatttagtgcaaaccgaaataaatatcggcccacagagatc

SEQ ID NO: 30822 - DNA, 276 bp, Homo sapiens
  chr6:129204360-129204636
  hyper
cgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtacagtcgaggcatgggcttgggttgcatcctttgccgggaccgagattcctcacttcttccactcttccgagagttgctgtctgtggactgccgtcttgcttcgccttcagagagtgcgctctggggcaaga

SEQ ID NO: 30823 - DNA, 30 bp, Homo sapiens
  chr6:130088257-130088287
  hyper
agatgctctccttaccggaggtgaaagcat

SEQ ID NO: 30824 - DNA, 55 bp, Homo sapiens
  chr6:130339629-130339684
  hyper
acagggaagccagagcgagcctccccggcagcggcggcggcggcggcggcaccgg

SEQ ID NO: 30825 - DNA, 786 bp, Homo sapiens
  chr6:130686407-130687193
  hyper
ttggagtcgaacatccgcactgctcatcgaagacccccgtgcttcagttccctctgtcttccatttcccccgcccatggttctcgcccccccaagccgttctccggaaccccttgccgggccggcgggaagcgtggaccgagcgggccttggccgcgtcttttccggccaggtttggtttagctcgcgcagcgcccgcgcagcccgccagggggaccccggcccgccgggcggcatctgaggagaaagcgtccgaggggcgtggagccagggtcctgcggtgcctgctccgggaatactgcgagtcggctggagctccccagccgctccggagaactgggggagccgggtccctggctcggtaaccggtggtcccgcggtagctagaggcgggccccacgggtgggtgtgtccgtttccgcacgccagccttccagcccgggaagagcgcctgcaagcgggtactttgttcccaaagatgggttttgtctgcgggtgatttgggctctcgaagtgcaactttgtggccgggacgcggatcggccggcctgggctcctgcagagcagatcctgtctgcgtcctccaggaggagtgggtggcaggactggggtttcccacaggttttggggcggcggcgagattggcacggtccggggtcgcaggcgcgcagccacgcccctggaagtccgccccggcccccgcccccaacccgcctcttcggggctttatggcgtgaggtttggggctgggatccatctggagccgagcagaaaacttttcccctcc

SEQ ID NO: 30826 - DNA, 625 bp, Homo sapiens
  chr6:130687224-130687849
  hyper
cggtggcggcgccgcctgagcggcgactccctctcccctgcccggcttgctgcgcccggtgccctccgagggcaggcgcgcctggactctgcgcccggatggcggcggccctctgtgagcaccggcagcggcgcatcccctgccccgaggcctccggtgcccccccggcgcgggcataggggcgcccccaccctccgtccgcttgcaccccttgccacccgccccctcgcctgactcatccgcccgcggtggccgcccgagccctgggatggggagggagaccgcggctgcccgcggcggccgagattcccgctgacgcccccgaccctgccgccttcttcgtccgcctccagaggcgcccgacgtcccgacagctcctggagtgagaccaggactgagaacagggagaggcgacccgacccccagggcccggtgctcaggacaggtgaggggaaggaaagggtgctgacgggagtggggaggtgggtgggcggccaccgcagccgaaaccgggcacttcttcagccctctgccctcccctcccctccgctacagcctccagagttaggtaaacgctgtctctcctaaagtttgggaaataaaccaagtccgccatcaggtccag

SEQ ID NO: 30827 - DNA, 30 bp, Homo sapiens
  chr6:131602928-131602958
  hyper
gggactgacttgcagcgtgctgtttaagtt

SEQ ID NO: 30828 - DNA, 30 bp, Homo sapiens
  chr6:132271740-132271770
  hyper
ctctcacatccagagcgtcagggatgcgag

SEQ ID NO: 30829 - DNA, 64 bp, Homo sapiens
  chr6:132722078-132722142
  hyper
ctgcctggggtcatccgtgctcggcttccctaccgcgcgccttctggggctccgggagagcagg

SEQ ID NO: 30830 - DNA, 859 bp, Homo sapiens
  chr6:132722157-132723016
  hyper
cgagagtgagcgtggccgggggcgcggggctgcgccaggtgagagagagctgcgggccccggggacgacccgcacctgcgccctctctggggtccggacgggaccgggctcggccgggcgggctccgggaggagacgcgcttacctggaggtagggccgcccgtgggccaccccgcccacgacgatgtcggcggacgccatggccccggtgggcgagaagccgaagcccacgtagcctgcagtgcgcacctggaggcggaaggcgatctggctgccccgctggctccagcccagccagtacttgccctccgagtccaggagggtccggtgcggataggttcggcccgagccccccgccgccgtcccggggagcagcccccacagcaggagcagcggccagcagcacatcctcgggcgcctcctgcccgccggtaccggcctccagccgctggggagtgaggagcagaacgaggagcggcagcggcggcgagcgggagcccagggaccgcccctcgggccggccgcgcgcccgcccgggaggggcaggacccgctctccccgccccgggccgcctgcagggcgcgccgcgtcccgtccggtcccgtcccgttccgtcccgtcgggtcccagccccgccaactctcaccctgcccggcccttccagcggatccacttgcagcccccgacccctgacttggtccccgaggtcggggctcggtgggaaggaaagcgaggggcttcccggaaagaaagggaggaggaggcaggaggaggcagacgccgagagaggagaaaaggaggccagaggcagagggaaaaggaggagggcaagagaatcctagagcgggaagagcgtggg

SEQ ID NO: 30831 - DNA, 302 bp, Homo sapiens
  chr6:133561966-133562268
  hyper
tcccttggggtaagtggaaaggagtccggcagggggcccgcagtggcctgcacaggggaactgggtagcgagagagttccaggcaattccgggggctgccccacagaagcaggtggggatcgacagtggctctccggcccagggaggagagcgcggtcgcgggtccctcccctcagcctggaggctgcagccgctcgagtcggcccgggtgggggcggggtgggggcggcgcggagggcacggagattacggcggcgccacccgggacatccagggccccgaggccctgggcggtccccacg

SEQ ID NO: 30832 - DNA, 89 bp, Homo sapiens
  chr6:133562348-133562437
  hyper
cgcgtccctggcggcctcccccgaggcccccggcggcctcacgagcccgcagtagccggtggcgacgtcgcccccgccccacctccctg

SEQ ID NO: 30833 - DNA, 421 bp, Homo sapiens
  chr6:133562674-133563095
  hyper
ggagccggcttctccctccgccccgcttctcccccgcttgtgtacgctatttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgaggtgagtgaccccttcttccaacccccgccccagggctcccgggggagcctgagttgagagaacccccaaactttccgggaaagtgcgcgaggctccgccggggacgccgagcgctgggtactgaggacgcgcagctggacggtgcgtgggcgcctgcgtccccggggggcgcttggaggccgggtgccccacgcctgagggcccgggc

SEQ ID NO: 30834 - DNA, 945 bp, Homo sapiens
  chr6:133563157-133564102
  hyper
cgagcctgcctgtcccttccggggtcggcgcggagcctgcgcgtaacggagttcatccagcagtccagcgcgcggcttctacctgcaccccgcctccacctggcagaggcgcgagcatcggggtctcccccacatctttcttatgacgtgtattactttctgatgaccccctagatggtccaggcgcgaggatgctgacccagagtccttcggagggtcacaggcgcctgggctttcccggtgccgggtgcgtgtgtactttaaaggctcgcgttctaatctccaggcactgatcgggcttttcaactgcggcgatcccactttaatagtttttatgtggcgtggactgaatgtctcctgcagtttgccagggtcggtgaaattagaggcgccttgtcagagcagtcgcgttcattggctcgagtagcgggtgccatggaaggcttataacttctccaaaggaagggacctggctgggtagagcaggtttttctctccttccaagcctgctgggtctggggaggcagtggaacttgaaatggctcggatttttagcgtggtgaagcgaggtttggaagtagacgtgtgtgtgcttgttttattctgcgccgcacagcaacccgaactttcgtttggtagcacttgaaagagttttctccctttgtttgcgagattctgaacagctcggagcgattagggaatttgcggaccgagtccggtggcagagctggggcgaaagcagagagcgcaatttaatttttgtcatctcttccctgcttgggaggatagtgtttcccttcaccaccacccctctttctccttcctatgaagacaacggatttgcgcctggggtgagagtgtgtgcgggagagtggtgtggagactgtcctctctcaccgcgtctcctgcgcctctccccgccatcccgagcgggcctagagagtc

SEQ ID NO: 30835 - DNA, 46 bp, Homo sapiens
  chr6:134175969-134176015
  hyper
cgatctcgcagaagccgcggcgagtctcccccggaggtctaggagg

SEQ ID NO: 30836 - DNA, 462 bp, Homo sapiens
  chr6:134210557-134211019
  hyper
atgtggaggaccttcaagaggtggagatgttggaatgtgacgggttgaaaatggattcgaacaaggaatttgtgacttccaacgagagcaccgaggagagctccaactgcgagaatgggtctccccagaagggccgcggcggcctgggcaagaggaggaaggcgcccaccaagaagagccccctgagcggggtcagccaggaggggaagcaggtccagcgcaacgccgccaacgcgcgagagcgggcccgcatgcgagtgctgagcaaggccttctccagactcaagaccaccctgccctgggtgccccccgacaccaagctctccaagctggacacgctcaggctggcgtccagctacatcgcccacttgaggcagatcctggctaacgacaaatacgagaacgggtacattcacccggtcaacctggtgagtgctcccggggctgcagctgcagtccagg

SEQ ID NO: 30837 - DNA, 224 bp, Homo sapiens; identical to SEQ ID NO: 611
  chr6:134211111-134211335
  hyper

SEQ ID NO: 30838 - DNA, 76 bp, Homo sapiens
  chr6:134212320-134212396
  hyper
ttgcgatggaagaaacgaaagtcggactagggaaatagatggtgatgaaaggcgatgaaagcgacagggccctgaa

SEQ ID NO: 30839 - DNA, 288 bp, Homo sapiens
  chr6:134214076-134214364
  hyper
cgaggagcctgcgacccgggtccctcactgccccagcgcagcccgcggcggccgatgcgccagatgccaccggggctgtttaatgttcggggttatgaccgcagtgtttacaagacgtcttcggttatttatactgttattcctcgcagagagccttgaaacttccgcttcatttgctctttcttttcgattttttacccttttttctcggcttagtttggtacctggagcgagagcttctccgcccttccaccaaccccacaggccgcttcgcgggtggagccctct

SEQ ID NO: 30840 - DNA, 97 bp, Homo sapiens; identical to SEQ ID NO: 8736
  chr6:134216904-134217001
  hyper

SEQ ID NO: 30841 - DNA, 91 bp, Homo sapiens
  chr6:134217370-134217461
  hyper
ttcttcagagtccgccgggcttccttcaggcgtttggaggaacacgcctttgatctttgggtctgggcaggctgcgcgggcccaccctcct

SEQ ID NO: 30842 - DNA, 299 bp, Homo sapiens
  chr6:134499553-134499852
  hyper
gaggggagggggagacgggggagctgtgtgtgacgcgcgcctgttaacactgcacaggcattaggttgccctgtagctgctattcaaactcttgatctgttcttccttcctgtcgccagcctctttctttggtccagatagtcctcctactgggaggaatccggcccctttcctcatactccctggtggcgaagtggtccgagtagcctcccgaactgtttgtaaatgcaacctagagggcgatcgagttctctgggagaacttgctccatatacgcgtatacgcggcttcccccactt

SEQ ID NO: 30843 - DNA, 228 bp, Homo sapiens
  chr6:134638726-134638954
  hyper
gctcagttcttcactcgcgcattctgcagcaccagctactgcagcaacctctccccactttcagttgccaccgacagcggcttttctccttccatcattgctccgaaacatatgcatcaccgctgcaggaccctgggggccggacggtgggatacggccaatctccggggagatgctgtggctcttaccgagcgggagaagggtacgcctccccgcccccagctacct

SEQ ID NO: 30844 - DNA, 244 bp, Homo sapiens
  chr6:137241818-137242062
  hyper
ctttggctgaagtgtcgcgttcagcacagaggtggaagtaagaggcagaaaacagaagaaccacgagagaaatggatcctgtctattaaggcaacgtgatgcagcgctaaaaggttaggaggttacgattcccggggctaagagaaataaactgctggtggtgaacgaaaggggtgctggagcgcagcgatctcgaacctttcccttatagccaaaccctggccaaggccacaaatttcaaatc

SEQ ID NO: 30845 - DNA, 537 bp, Homo sapiens
  chr6:137242063-137242600
  hyper
cctgaaaaccaaactgtctggcgcttaacggttacctcggctgagcgaaacccttggctgctgctgatttaactacaggtccgcgcgagttactttccagggaactgaattcagaacaaagagttaccgaagccttactccctctccaaaattagaattccctttttctcttagtcatataggaaacacacagttcacaagtcctgtggtgcaaaggtgtgaaccctggcccagggaggtggtgactctccccgccctccgcctgccggttgtcctgcttccgaaagcaacccacgacggtcccgcagggtgagggttccctgggatcagttccctgggatccggagaacgccacgcggagtctccctgcagggtgaggggccccgggttcccgccccctccccctctactctcccattctgcgagcgcagccagcctcccctcccacgcttcgggaagcgtcgcccccgagctcctcggttcctggtggtggctactcgtgttagtgacttcgtttctgcgcgtttgcttattttc

SEQ ID NO: 30846 - DNA, 297 bp, Homo sapiens
  chr6:137242949-137243246
  hyper
gctgcagcgccggggcgagggggctgggggcgccgtcacttgttgcgaccaataaacggcgctcgatcctgatgcgctgtttctaaaatctttagctgtgtcccgatccctccaacccaagcccctcggccaggaggaaggggcaagcgagagccgctggctctgtggggggagaggggcgccgcgccccaagagcccccgtcccgccctgcggcagccgccccggggcgcccagccgcccgcttccctccgcagagcgtcttccctgacggtgaaaccgcgcgggacacaacccac

SEQ ID NO: 30847 - DNA, 68 bp, Homo sapiens
  chr6:137243566-137243634
  hyper
atgcggcagctgtgccggggccgcgtgctgggcatctcggtggccatcgcgcacggggtcttctcggg

SEQ ID NO: 30848 - DNA, 310 bp, Homo sapiens
  chr6:137243839-137244149
  hyper
acgctctggtccctgcgcggcctcagcctgcccatgtacgtggtcttcaagcgctgcctgcccctggtcaccatgctcatcggcgtcctggtgctcaagaacggcgcgccctcgccaggggtgctggcggcggtgctcatcaccacctgcggcgccgccctggcaggtgagcgggcccccgcgccgacccccagccgaccccacccaccccgctccgtcgggcagagaccgcggggatcactgagttcaacgacctcacttccagatggggagactgaggcagagagagccggagagctttgagagtggt

SEQ ID NO: 30849 - DNA, 231 bp, Homo sapiens; identical to SEQ ID NO: 613
  chr6:137244235-137244466
  hyper

SEQ ID NO: 30850 - DNA, 67 bp, Homo sapiens
  chr6:137310875-137310942
  hyper
agtccaaagccaccccgggaaagatgtggcccgcagcctggcaggctgaggacgtgtagggggctgc

SEQ ID NO: 30851 - DNA, 222 bp, Homo sapiens
  chr6:137311158-137311380
  hyper
tgccgccctccgccccgctcccctgcacttacccacccacctcgcctgcgctgatccgcagacgcgcgcggggaaaggcacgcgcgatgctttcccactcgctcagcgggcgccgctcactggaaactcgctccggattccgaacccgagagcagagcagagggaagcccctttgctgagcagctccttagtggagggcaatgaacgcgctgaaatcccaga

SEQ ID NO: 30852 - DNA, 126 bp, Homo sapiens
  chr6:137808768-137808894
  hyper
gccataaaatgcacccgcgccaccctccatgtcccccagtggaattgaggatcttgcttgtggcaaaagtgcgttcttggcaccacagccccgcagctggggaggggggcctcagtacccggcttc

SEQ ID NO: 30853 - DNA, 366 bp, Homo sapiens
  chr6:137809000-137809366
  hyper
cgaggaaaagaggggtcttactcaagtcagggccggacagaactccaaaacttacgaggacagctatccaacactgcctcacagacccttaggcgctgccccctctttgcccctgtcctcctgcggtgcgagaaacccgaccactctgcttctacccgaaccccaggacgcaacagtaaaatcaaggcccgtcgttgaactcccaggtctgcgcatccctccctcctggctccctggggtcttggccccagcaggtccagtacccatccccagagggacccactaccctgggcgtcccagggtgccaggcacgatggcctgcaatgggggctgcaatttaaccgaggcgagttaaattccttttgc

SEQ ID NO: 30854 - DNA, 472 bp, Homo sapiens; identical to SEQ ID NO: 615
  chr6:137809445-137809917
  hyper

SEQ ID NO: 30855 - DNA, 1092 bp, Homo sapiens
  chr6:137810032-137811124
  hyper
cggggatcgctcacaggggctccggggccaccgcgagcgcggactgcggctgctggcgggctccttcgtcgtccaacgcaccccatcctctcccgccccgcagtgtcccagggaaggcttcactgaaaacagacgctcgacggaaaactgactctgcaggcccgagctttcggagtttgatttctgtgggccccttaaacgggcactgggtacaggagaggccccaactctctgcagggacggggagggaagggcactcactctcccgcaagttttcctagaggcgagctgaagatgcaggccacctccctcccgcacggcccctcccttggcctagttctgtccaaagacacttcccagccctcgagcggcggctcctccactcgattcctgcctacacgtgaagagcttggacccagcggggctgcactcgggaggacaggcccagatcctgcacggccgggaggacacctggccccgctgtcttctcttcacagctcccctttctcggcttcggcctggagcggtgcagggaggggtggacctggggtggccttaagatatctagcctgggtgcggagacttgggagcccacccttagcagtcactcctcctccccagtggagggtgagaaaaggggaacagagggccccggagtctctggaagggacgtggaacgcgaagttaaatgttggtgtctgagcgatgtgctggtggggcagagggggttccagcgtcctcccagagtgaggaggcttttgcaatttctgctgaatgcgtcagtggaggcacaaaaccttgcttgacctagcagctgggaaaaaaagaagttcgaggggacacaaggccccctgctgctggagcgaggaaaccctgggcttggccagctcgggccgcttctccctgcccgtttgcgggctgtcggcctcagcggtcccagaaacaaagatctagtgagcccagccgacgccggcctcattttccctttctaagggtcactttcttccgccctctaaattaggtcatcgcctgggaaagcgccgagaggtttctagtgtgggcttctcaaggtgtctccgcccaggaggattt

SEQ ID NO: 30856 - DNA, 100 bp, Homo sapiens
  chr6:137813941-137814041
  hyper
ggtcttgatctctctcgcgctctctctctctttctctctccattgtctctagaaaaactgtggcaaggacagagacaatcataatcgcatccatctcaag

SEQ ID NO: 30857 - DNA, 279 bp, Homo sapiens
  chr6:137814340-137814619
  hyper
agatctctcagacagcgtgggaggctgcgggccccggagcctgccctcccgtgggccgagcgtgcagcctccctcttccctcccggcccggcaccgcggcccctcccgccgctctccctcctccttggcagccgggcccgcccgctgctcacttgagcaagtccttggactcggccgacagccgggccatgttggctgtggagagagcggacaggtgcggcggcggcggcatctggcagatggtgcaggggcagggcagaccagcccagtgctggaagc

SEQ ID NO: 30858 - DNA, 518 bp, Homo sapiens
  chr6:137814653-137815171
  hyper
cgccttgagtagcgagtggggaggccggatggtgccgatggcgggaagtgaggcggcggacagcggtgacgaggcgttgccagatgagagcgcgccgcccaagatggggtgcaccgggtgcacggagttggccgcgtgcgcggggtggccggccgagtggcccacggtcccgcagtgaaaggccgagtggtggcccccatagatctcgccaaccagcctcttcatctcctccagggagctggtgagcatgaggatgtagtttctggcgagcaggagtgtggcgatcttggagagcttgcgcaccgacggcccatgcgcgtagggcatgacttcgcgcagcccgtccatggctaggttcaggtcgtgcatccgcttgcgttcgcgtccgttgatcttcagcctcaactgctgtaggtcctgctccgacagctgcttcttgattttgtacttgctgctctctcccgcggccttggcgccagcccgcgagaggctttccccgggcatcttctgcatcatat

SEQ ID NO: 30859 - DNA, 727 bp, Homo sapiens
  chr6:137815224-137815951
  hyper
cggtggtggtggtccctcaggtacatctcatccatgtccggagatgaagctctgctggagacagagctcgaatcagaattcattttattacaggggatgcggccctaccgtggggaggctttaggcgggaaattaaagaaaatcttgaattaaaaaaaaaaaatctgcactgcccaggaacccacttctccgcggcaagacgtgagaagaaaagcggagacgctgcttttccccgcctctctccctcccacgcccctctctctggttaggctgcttcctggacagctagttggtgtgtgcttgaactaacctcacgctgaaaaagaggggcttttatagagctgcggcggagaaaagagacaaaaggagccctcctatctatcctgggctggttaggatgacgtgccatcattcagggcggtgcgctttgctgtcccatttagcaaggattcctattcatattcattgtggggccgccctgggacacctctgctccgaaccgctaggagcccccaggcacaaaaccctctgattgacacactcaccgctccagcttacgccttcctgattttttttttaactttcttccaccccaccccccttcccaatttctctaaccaaatcacacatcaggaacggaaggaaggcaagagaaggtggccaggcggttggtggaggttcctctgagtttggagagaggaattgaaacattcgctctcctttcttt

SEQ ID NO: 30860 - DNA, 777 bp, Homo sapiens; identical to SEQ ID NO: 619
  chr6:137816459-137817236
  hyper

SEQ ID NO: 30861 - DNA, 148 bp, Homo sapiens
  chr6:137817618-137817766
  hyper
agtggctagtcctaacgacaaccctctgcgactcccctgctgatcaaatggggtgaggagagagaggcggacgggggagggcattgggagcgagcactggactggacgaagagcagcttccccgccctgcggacggtgcacaggtctg

SEQ ID NO: 30862 - DNA, 537 bp, Homo sapiens
  chr6:137818062-137818599
  hyper
gggtagagcagccctcgaaatacaagcttgcggggctggaagtccggggccagggttctgggagtccaaaccagaagccactctccttcagcacagcctttcagccgagagggggctgacgcctgccgcagccggttccgagggggctgcgatgggccgggaaggggcgactgggcctttgcccgaacagaccaggacattcccttccttcttccctaagggttttcagctccagtaacagaggtgcctgaaatgggagatctgcggggaccaggccgggactccctggctccgaggccgggacgtggcgcgccctccgctcctcggtcaccctctgctttttcgaaggtccgtaatgcgtgagtgtgggtggtccaaggttcagggcctccttccagtaagtacttttagaagctagttcccccacttcccatccgttgcggggcttgacaactagacgaggggagtgagtaaaggtgccacaactttgcttaccgtaaaatgggttaatactcgccggggcccaaaaggctgagt

SEQ ID NO: 30863 - DNA, 649 bp, Homo sapiens; identical to SEQ ID NO: 621
  chr6:137818618-137819267
  hyper

SEQ ID NO: 30864 - DNA, 280 bp, Homo sapiens; identical to SEQ ID NO: 622
  chr6:137819268-137819548
  hyper

SEQ ID NO: 30865 - DNA, 45 bp, Homo sapiens
  chr6:142409847-142409892
  hyper
aggactgaacgcccacgatttaggtttaatcgatgtccctccctc

SEQ ID NO: 30866 - DNA, 109 bp, Homo sapiens
  chr6:143247641-143247750
  hyper
tgtgaaaagaaagagcgtatattctatccgggcaatgacaaacggactcaggcctcctgaggtcagcgctcctgggcaccatcaggccccacttcgggagcccccggtg

SEQ ID NO: 30867 - DNA, 91 bp, Homo sapiens
  chr6:146349205-146349296
  hyper
ggagcaggggaggaacgggagagggagccaacttcagccccgcaggcggctgagatttggcgcctctgtccccaagcgggtgggtttggat

SEQ ID NO: 30868 - DNA, 148 bp, Homo sapiens; identical to SEQ ID NO: 8761
  chr6:146349536-146349684
  hyper

SEQ ID NO: 30869 - DNA, 201 bp, Homo sapiens
  chr6:146755460-146755661
  hyper
cagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagct

SEQ ID NO: 30870 - DNA, 42 bp, Homo sapiens
  chr6:146864466-146864508
  hyper
cttccaggctgggcccggaccccacgccgaccccggccccgg

SEQ ID NO: 30871 - DNA, 116 bp, Homo sapiens
  chr6:146864762-146864878
  hyper
gggtcctccccaagccggcgccaggccctgccctcgtccggccctgccctcgtctggccccgcccgggccgcgagcactggcgggttctgggtcctgtgaccggtcaggcggcgtc

SEQ ID NO: 30872 - DNA, 30 bp, Homo sapiens
  chr6:147829471-147829501
  hyper
cagcgtagaagccaccggcttcccgccggg

SEQ ID NO: 30873 - DNA, 32 bp, Homo sapiens
  chr6:148663762-148663794
  hyper
aagatctagaggctccgcggccacccctgccg

SEQ ID NO: 30874 - DNA, 41 bp, Homo sapiens
  chr6:148664007-148664048
  hyper
gtggccacctagacccgaggtgcgggcgcctgcgaagggcc

SEQ ID NO: 30875 - DNA, 303 bp, Homo sapiens
  chr6:149069188-149069491
  hyper
agggaaggtcctcttcgttgcattgttagtgaccgcagttcagtcccgtcccgcgccccggggagtgtgggtgggtttagccctttgccaccgtccgctctgagaattctgtcccgcagatcccccgcctgcccgccggccctagtggctccgcgctgtccccgggctggcttgtcccttggctgccgctgcccaccccgccgcccgcagctagcctggcgcggggaacgggttgcatccaggggtttggggatgcccgagggcgctggtcagcctggccagcagtgtcgcccccagtaaccc

SEQ ID NO: 30876 - DNA, 111 bp, Homo sapiens
  chr6:150284700-150284811
  hyper
cggctgcgccctggacggagaggggcggggacttcgcgactgcaggcggagggagggcgggtgtcgctggcgcaggcggtgacagggagacaccgccgccactgagtattc

SEQ ID NO: 30877 - DNA, 314 bp, Homo sapiens
  chr6:150285055-150285369
  hyper
gcatgcctaggatcccgcccagtgtatccctgcgcgcggcgggccgggctgggcagctttataaacagccgtggtgtgagcctcgaagggaaccatcagcgcctcctgtccacggagctccaggtctacaatggcagcggccgccagccccgcgttccttctgtgcctcccgcttctgcacctgctgtctggctggtcccgggcaggatgggtcggtgagttcggggatgtagcctaagcagggcgggggccaaacctgggaggttgtggactgcagcgggtttcagaggaggggaggcttctggaaggaccgg

SEQ ID NO: 30878 - DNA, 342 bp, Homo sapiens; identical to SEQ ID NO: 624
  chr6:150285544-150285886
  hyper

SEQ ID NO: 30879 - DNA, 454 bp, Homo sapiens
  chr6:150286099-150286553
  hyper
cgaacatgcccggctgaaggcactcagttcccctccgcggctcctttcctccgggtccgcttcctgcggctgctgcttgccccataggccaggaggcttctgggtggaccagcgcgatctccccgaatatcgcggtctacccgaacatcgcggcctccccgaacatcgcggtctccccgaacatcgcgatcccccagaacatcgcggcctccccgaacatcgcggtctccccgaacatcgcgatcccccagaacatcgcggtctacccgaacatcgcggcctccccgaacatcgcggtctccccgaacatcgcgatcccccagaacatcgcggtctccccgaacatcgctgtctccccgaacgtgcctggctgaaggcactcagttcccctccggggctcctttccgccgagtccgcttcctgcagctgctgctagcaccgcagtccaggggga

SEQ ID NO: 30880 - DNA, 30 bp, Homo sapiens
  chr6:150310175-150310205
  hyper
gaaagaaatcatttacgtagatagggtaaa

SEQ ID NO: 30881 - DNA, 324 bp, Homo sapiens
  chr6:150311072-150311396
  hyper
tacaacctggcaacccgttcgggacacctctctgtgacagagagctgttctttcctttctcccataaaactcctgctccaatctcactccgtggatttgcgtccccgtccttgatttccttggccgcgagaccaagcatttattccaggcgaccagctgtttcactgcccttagtttctggtctcgtttccgccactgtgttttctcgggccgggagaagcagtcccagggacgcgacaggggcagaaggagccctgcgtggggaattgagaagggtgcggcgcggtcagaaagatccgtcctccgcgacgccctctcctcttt

SEQ ID NO: 30882 - DNA, 258 bp, Homo sapiens
  chr6:150311819-150312077
  hyper
gtgatgaaatcgggtcggagtcgctctaaagtcatttttgtctcttgcgcgcctcagggaggatattaaaggcttttgtggatttcaaccgctaaagcctttcctcaaagttcattgcgaggggtttcagttccgcccggcagcatccctcagggttctgcgcgctcccgtggcaccgtctgcgcccgagctccggtcccgtcccgattgcctgatgccccgcagggagcgcccagcggccgccgatgtcccaccagc

SEQ ID NO: 30883 - DNA, 40 bp, Homo sapiens
  chr6:150312743-150312783
  hyper
cactcctgcccctgccgcactcaggcgggcagctgatgtc

SEQ ID NO: 30884 - DNA, 105 bp, Homo sapiens
  chr6:150358880-150358985
  hyper
cctctccgagttctgcgcgctcctcccagggcgcccgctgtccccgagctctggacccgggtcctgcccagtggagaccgcggagttggtgccccgcttgcggcc

SEQ ID NO: 30885 - DNA, 207 bp, Homo sapiens
  chr6:150358986-150359193
  hyper
atgctcccgggcctccgagtccacagcgtccggacaaaacggcctttggaagacctgggaggactcgccggtagcggcaagggaaggagccaggaaatgcgggggtcggtggggtgaggagcacggggttcctacttcatcctcgcggaaactttgccaccggctcagtgtggagacctcaccgtcccgcttggatccgtggggctc

SEQ ID NO: 30886 - DNA, 15 bp, Homo sapiens
  chr6:150359438-150359453
  hyper
cgggagaaagggaga

SEQ ID NO: 30887 - DNA, 346 bp, Homo sapiens
  chr6:151560995-151561341
  hyper
tccctgctcttgccacgtgaggtgcccaaatatggtcggactcaggaggagccagggagcgcttgcctttctcctgctaatggggaggaggctggaacaaatgtttggagttaaacacaatctgcaggaaagcaaatggggactcggactcgctcctgggcgagctgaaagtcggctgcagcagaagctcctgccttgggtgatccatcatttaataaaccccagagaatccagtgtccccggcaggctttttgctcccctgctctcttgccttctgaggccctgggtcgtccccgcagctctagtcgccctgttagaaacgggaggcgcccgagggccgggtggg

SEQ ID NO: 30888 - DNA, 624 bp, Homo sapiens; identical to SEQ ID NO: 8773
  chr6:151561368-151561992
  hyper

SEQ ID NO: 30889 - DNA, 387 bp, Homo sapiens; identical to SEQ ID NO: 8774
  chr6:151562056-151562443
  hyper

SEQ ID NO: 30890 - DNA, 637 bp, Homo sapiens
  chr6:151814974-151815611
  hyper
tcccaccgggaggaccgaccgttatccccgccgactccccccaggtcgccctggcagtttcggccgctcagttgcaggccctcgccacggaggccacgctcgggggttcggggtccaccccggcctcctgcggccgggccaccctactcgcgcgcagccgcgcgccgccgcgtccccgcggtgtttacccgttgcccgaggagacacccgcgccacccgccggctcccggcgccgccgcttcctcagggccggttccgggtccgagcgcgcccccgggctcgggtcgtcatgagcctggactgcaccagccatatcgcgctgggtgccgcttcgccagcgcccgaggtacggtcccagccgccggccgcgcgcgggggtggccctggggatagacgacccaggaggggccgaggcgcccctgatttgcacccttttcctcccggaggcgtgggcagaatcagagcagctctgtgcccgcgagggctgtggcctgggactgccagggcgctgatttcaggaggggatgggcaggaccggagtttgcggagcgcgtctgaattttaggttgtgccactctgcttctctgaccatttaaaccggtgacattcgaaagactgtggccgggcagttcctccc

SEQ ID NO: 30891 - DNA, 558 bp, Homo sapiens
  chr6:152622914-152623472
  hyper
ccctgaaatcagccacggagagggaacatggagccactcgccaggctccagtcaaagagcaaagccgcggggacccactggatccttaccatgaccacagaggggtgggccgaaggcgtggggaggagctccccatccaggtcctctgtcccttccgccagcccctcgacctcggtcaccgtcagcagcatggtggcgtgcttggctttcatcgtcagcatcttgcacttggaattcaaagaagcgatctgctcctggtagcccttaattttctgcgccagctcctgaggaaacatttcccccaccggggtgtcagagcagcatcaaaaggaaacagaagtagtagcgttcatcttcctgcagggcgagccaatgagcgcgcagagccgcgcgggcccgggaggcaggatgtgtaggcggcgagtcctcctgcatctcgctaccgagccagaccgcaggctgcgcggcgcggcgcaggcacagccaaagtgcccgagcccgcgtccccgcgtcggtacaaaaggagaaatgaggggatgaggccgaatgagtggtttc

SEQ ID NO: 30892 - DNA, 293 bp, Homo sapiens
  chr6:152957488-152957781
  hyper
gagatgtgccacaagcggaaatgacaactcagagagggggatattaatagggacatctacgtacgagatgcaaagaggctccccaacctcctagtctccttatctatgagtatcgcacacgtacacacatcactgccaccaccccctcccatcaagcacgcagagccccagcgtgcaggcacaaacttgctgacaatttgtctgcaatgtgttcgtcttgcacctctctctcctctccctgtctctgtctctccctgtctcccagtctctgtctttccttttaccttctctct

SEQ ID NO: 30893 - DNA, 184 bp, Homo sapiens
  chr6:152957815-152957999
  hyper
cgagcgaacgcttcctcccggctctctgcgcccaggctcggcgggaccccggggatgcgcggctgtccgcccgccctgtcgccgggatcgggcgcggtctgcaggactgcgggagcccagccgccctggtgacagaggacaacaatctcagcccgctgcggccggcggccgcggcccggcgccc

SEQ ID NO: 30894 - DNA, 485 bp, Homo sapiens
  chr6:152958000-152958485
  hyper
cgctcaccctggctggctcgcccacactcactcccgcgccgggctgctcagccgcgctccccgccctccgcgaccggttcctcctcccggctgctcgctggggggtgaggcctcccccttcgccctcccccacgcatctactgctcctgtcgggaaggaaggtcgcccaggccggttcagcctctgggcagggtccctgcaccgccctggcccgccacaccccctccccggctccgtgccccgcgccccgcgcccggctccgggatgcgccggtgcctggaagagctgggggcggggacccggaggctcgcaggcttccctacctcctggagatgcacggccttgggcgtttctccgcagctgcaaagctgtgctgtgacccacccgctcagcgagcctttataccgggaccacctcccgggggtcgaggtgggaaggaaatgtccctgagagccgggacgcgctgcctccgctgcctggaggag

SEQ ID NO: 30895 - DNA, 1153 bp, Homo sapiens
  chr6:153450977-153452130
  hyper
ggagccagggtcaatcgtccccgggcgacaggggttctcccacgtgaaccgacgtcccgggctccgggcgaggcgcagggctcagggcgcagggcgggtcccgtacgcagggcgggcgcgcgggcatctttgtggccaggcgaccccggctcgctctcccggagcccagggactcccgaggctggcgcgggctgcccgcgacaaggtgccagcagcctcgggctcgcgaggagcagctcccacccgcggcttccgagtccagctctgtccctccgccatcccctagtcctccggcatttattcagggagacagggaggcagagagaagaggagaaagcggccgtgtctgcacccagcctctgccgcagcactcgatgagggacagcagggaggctggcggggaggcagagattaaactatgattccatcgatcacggaaagaccaccatcacctacagcaaaggaggctccgatgcgcccacccgggcagcgactcgcggttggtgggcgttcctcgtcctcgccccctcggtggctgtggaatccaccccgcgccgcacacgccaggactccctttcctttgactaaggggaggggaaggaacaaaagagaccccccaccccctatacatacatacacatacacacacacacacacacacacacacccctccggtattttactgctggtcaaaggattcattttcgcaacctcttcttcgaacaccttccccacctgagcagtgcattttcccaaaggtaaagagagataagggaggaaacacagcacccaaggtgatcagtcgattggacactgttgatggcacattctcctcgttcccaaccaaccgcacaaaacccgcaacacctcgcgtccccgcggggtctcccgcgcccctggcccggccctcccggccgcccccagcaggcgccccgctctccgcgggaactctgggacctggccgagcgttccccggcgggcaggacactcgcccggttccctgcagcagctgagggcggcgagcggaccgcgtccaggcagcgacgcgggattcaacttcccggacccgcggcgcggcccccgctcccgctcagggcgccgcggccacagctgagaccccagcgccgcgcagccgcccccgccggggcatggg

SEQ ID NO: 30896 - DNA, 187 bp, Homo sapiens
  chr6:153452568-153452755
  hyper
tccccgggcggcccccggccccgcccgacctcgcgcgctcgcctgggcgcggcgcccaccgtgcggaggggctcggccgggactctcggcttcggtgacgcccgtccggagcttcgcgggaggcccggagtcccgagagcttccctgggtgacagcggctctccgcccgggcccctgcaactccact

SEQ ID NO: 30897 - DNA, 136 bp, Homo sapiens; identical to SEQ ID NO: 8783
  chr6:154360584-154360720
  hyper

SEQ ID NO: 30898 - DNA, 106 bp, Homo sapiens
  chr6:155316115-155316221
  hyper
ctgacctcagttttgcgtgcctttcctcggtgggacccgggaagagccgtctttaaattccttggggaagggacggggtcgcactggcgcatcgcatccccggtag

SEQ ID NO: 30899 - DNA, 96 bp, Homo sapiens
  chr6:155316256-155316352
  hyper
cgatgtttcttgaattgttttatttgtgttgttccaaagaaagcgcgagggacatggtccgggaccagccgggagctggcgcgggggtcctgggcc

SEQ ID NO: 30900 - DNA, 295 bp, Homo sapiens
  chr6:155317032-155317327
  hyper
ggggagcgcccgctgcgcccacgcccgcccggcgacctcggagcctcagaaaggcgctgcggcgaagcaggatcccaggcggtcggctcagcgagtgtagaccgtgcggtccctgctcagcccctccggcctttccgagcgcgggagccatcccggacgggcgcggctcctgggggggctgaggtgccaagtttctgtgaaagccgacacgttgtgcccctaatggatcctatttaccaaaaacagttcagaaagaaaagagtccattcttccagccattcgttgctgacagccg

SEQ ID NO: 30901 - DNA, 573 bp, Homo sapiens
  chr6:157556724-157557297
  hyper
aggcatgagccaccacgccggaccaaatataaccatttctaaaagcattcctcagcgcttggaacttgcgagctgatggcttttggtggagcccaggaggggcgctgtggggcacagacgtgtgcggggccggcagctgcggagagagcagcgcaccccagccttcaattccccgccgaagatgggactctgcccagagccgaggcccctggctgctgccccgctcccttgcggccgcagtgacactcagagccagattcctcagacaatcttcactcctccgtggtggctgccttgggaggcgttgcggggtgaaggaagtcgcagctggtcccaagcagtggggagggcaggacagggagtaagacaccgccttcctggggtgcacacggaggaggggcgctgcccaggagcggaggggaggggagcggagcgcggagaggagaccggtgccagacttcacccgcctagctctcggaacccccgggggccgcgctcggctccgcctgggggctaccggttctgggccaggagaagaagtggcatccgcggggcagggcgggcggtgacggc

SEQ ID NO: 30902 - DNA, 65 bp, Homo sapiens
  chr6:158430625-158430690
  hyper
aagcaaagacattctcgtgtaggaaaacttacaggaaatgcaactaaaagcgtgggagacaggaa

SEQ ID NO: 30903 - DNA, 188 bp, Homo sapiens
  chr6:158957782-158957970
  hyper
ctgcctttgagcccccgctctgcagcgagctcaagcacctgtgccggcggctgcgggaagcgtaccgcgagctcaaggaggacctcacgcccttcaaggatgaccgctactacaggtgggcgcggcgcgggcagcggcggggcggccggaggcttccgggccgcagtcccctccgggaccccggcgcg

SEQ ID NO: 30904 - DNA, 109 bp, Homo sapiens
  chr6:158958375-158958484
  hyper
cctcggaggcgggggcgccgccaagggctgggggcggatgggcgcggcggggaagacgcggcggggcgccatgcggggacacggcgcctgggagcggctgtgtggaact

SEQ ID NO: 30905 - DNA, 88 bp, Homo sapiens
  chr6:159589999-159590087
  hyper
tgggcgcgccgggtgcgggtagggacgtggaaggactgggctagccacaggaactacagcgctgcggaccgggtgaggggtcccggcc

SEQ ID NO: 30906 - DNA, 608 bp, Homo sapiens; identical to SEQ ID NO: 2944
  chr6:159590154-159590762
  hyper

SEQ ID NO: 30907 - DNA, 290 bp, Homo sapiens
  chr6:159590971-159591261
  hyper
cgggaggctccagccgtctaagtgtcccgggagattcaggcacagcggggaaaaaaggaaaagaaaggcgactttcagcgtgcggactggggtaatgcctttctttgcccagaatttctcgggagcgtaggtggtcatcctactttctccgcgttcacctctcgcgaggcaggatgacgggcgcactcgggagaccggagggaggcagagcagggctgttctagaaggtcgtgggggaaaggctgcgagctgccgcagggcgtcgggtgcctctgcgctccagaggagaa

SEQ ID NO: 30908 - DNA, 106 bp, Homo sapiens
  chr6:159654897-159655003
  hyper
cgcaggggcaggtggcgaccacaggtcccagcgcggacatgcggcctcccccgccaggcccagccgacccggcggcccccagtcccgcgcccgggtacccagcagg

SEQ ID NO: 30909 - DNA, 30 bp, Homo sapiens
  chr6:160402852-160402882
  hyper
catcaacttagatgtcgtgtttgacttagg

SEQ ID NO: 30910 - DNA, 55 bp, Homo sapiens
  chr6:160769518-160769573
  hyper
tgctgctgtgcctgacgggcgtcaccttcgccttcctcttcgtcggcgtggtctt

SEQ ID NO: 30911 - DNA, 98 bp, Homo sapiens
  chr6:160769827-160769925
  hyper
cgtgccgcggcggctggcgctacgcccaggcccactccaccatcgtcagcgaggtaagggcgccccggccctttggaagccggcgggagaggacgatg

SEQ ID NO: 30912 - DNA, 133 bp, Homo sapiens
  chr6:161188410-161188543
  hyper
cgaccctggattgctctccccattctcagcctcaccccccactccttccaccccatattttgccgcctcgaaggacatgaaccatctgctggctgaaggcgcttggacctgaaaccagcgacaggttttggca

SEQ ID NO: 30913 - DNA, 187 bp, Homo sapiens; identical to SEQ ID NO: 8792
  chr6:161351859-161352046
  hyper

SEQ ID NO: 30914 - DNA, 44 bp, Homo sapiens
  chr6:161352264-161352308
  hyper
tggccaggccaaggccgctgggaaaggcaggacgctcgcccatg

SEQ ID NO: 30915 - DNA, 69 bp, Homo sapiens
  chr6:163834314-163834383
  hyper
ctgcttttcagactacgcgcacagcctctttatttcctactgcggcttcattccctcacggaacactga

SEQ ID NO: 30916 - DNA, 128 bp, Homo sapiens
  chr6:163834405-163834533
  hyper
cgagcacgactgacgctccccttattatttgctaagccgctgcgctcgggtctggctacgatttgctttcagaataacgggaaggtgcaacaagatcgcttccctagaggcgcgtcgcccgcgtggcc

SEQ ID NO: 30917 - DNA, 119 bp, Homo sapiens
  chr6:163834710-163834829
  hyper
cgacaaagcgggagccgggcgcgccggccgagggcgcccggcgcagagtcccgcagaggcggacgccgcggcacgcgcctcgaaaagcctcaaactcttatcctcggctctcccgcccc

SEQ ID NO: 30918 - DNA, 687 bp, Homo sapiens
  chr6:163836544-163837231
  hyper
gggccggggtggacccgccggtgccggacgccccctgcccggccgggaccccgcgccgctggcgtccaagttggcgcgttgcggagggctgcggggtgagccctgcggcccctctagcttcggcggtcacatttccgagaggtcggcgggggctgcgcggactcggtggtcctcgccgagccctcccgagagcaggcccacgccgcgccgccggcctggaggacgcgtgtgcccggcgcgggccccgctcctccgctcggcctcccgagcctgctctgcgcggacccccaccgccccgcgttcgggagctctcccctcccgtgaggactaaagcggggtttcgtggttggggagttggtgcagctgttcaatactaagtggaagtcagtgtggggctcgttagtttaaagaaattccgtaggagaccgaaattatgctggcgtagccgacaaggaggactaagtgacggcgaaaagcacttttttcccttttgtttggggaagcgagaactgttagggagttgaacttcacttttcgggggtggggggggggggggtggagtgcgaaataacgcgatgacagatcggagcgcagcctgagttagaagaacttgggcggagggtttgctcccggggacgcagccgcctgagtttgtaggacagggtttcgagacgtttggaaagggcg

SEQ ID NO: 30919 - DNA, 97 bp, Homo sapiens
  chr6:163837469-163837566
  hyper
gcttagaggcaccaccggaggactgtgtaaaggaaactgaaaactacaggttgaagagatgaacaatggagtttagatttttcgcaagaatttcgag

SEQ ID NO: 30920 - DNA, 1105 bp, Homo sapiens
  chr6:166074020-166075125
  hyper
aggagcggccgatcccggcgcgaatacgctcgccagcccgggggctgcaccccaaaggtgcctgagcgggcggtgagcccggagcagcttcggccgcagggaggggctcaacctcgggtgccctggagacccgggtcggccaaagcctgggaatgagccgcagttgggagcgggaaaccgaaacagcaatcctggaagagcgtcggcccagagaaggcgccgcggaaacgcggctcctgagcgaggcgcagacaaaggctcgggtgcacacgcggtggacggtggctccggagccgcgctctgggccgcgggaagccgcacccgccccgactggcgccggagtcgggcgggggcccatgggcgcgacctcctgcacccggaggtgctcctacccggccccgccgcggtcttcccgtcctcaccctgctccccctccatccgcgaccgcgacgcccccctcctctgcgcaccgggcgcctcctctttcctcactgtctcccgcctgcctgcttccttctagcgaacccctgccttgacttttctgctcaatcttgtcccccacccccgtgacatgcctttctgccacctctgcctcagcgcgctctcggccccgcgcccgcgggtggcgaggaggagtggccacgccacagtgggcccgggggcgcatcctgcgagtcggaggcggcggcgcctttctcttccaccctagcgacctattgtccttcccttttctctaccaccccggaccccagagaagcccgggaccaacaggacgcggcccggggtgggggtgcgtcccctgggtggaggtgcaaccgtttccaccccgccagtccatgctctggatgccggtcactgcgcggggtgggaggccgggcgcccactccgagtcctggagaacggcggtgccatcacagttggaagcgcggggttctgaggccctggcctccctcaccccggctacagggacccggtgggctggacccccaagtggaaggaagcgcatctgctccagccaagtggccacaggctcaagagggaggaacctaagtggtcacaaagttgagtataaatacgcgccggacaagtgtggccagaaacggca

SEQ ID NO: 30921 - DNA, 231 bp, Homo sapiens
  chr6:166075258-166075489
  hyper
cgctccgccaggggcaccggctcctgcccctccagagaagccccctgggcgctccacgcccgggcacgggcacctcgctcgacacccgcttcccacccagcaggccaagccccccacctgcccccaggggatgaggagccgccccacctccggggaacggggagcaggccacttactggggctcaggaagcactcggtcagccttcggaagcagctcgcattattagaagg

SEQ ID NO: 30922 - DNA, 107 bp, Homo sapiens
  chr6:166076095-166076202
  hyper
gggcgggcgcgggggcgcggcgcgctccgcccggccacggccaggccactcgggggccgggcccgggcccgccgcgctccccccgccggccgcgctgagccggggtt

SEQ ID NO: 30923 - DNA, 98 bp, Homo sapiens
  chr6:166076501-166076599
  hyper
ctgggggccaggccccggcgacggcgcctggctaccctcaggcgcgcacaatcggcgtcctcccgggccggggctagggacggcggagaccctccctg

SEQ ID NO: 30924 - DNA, 44 bp, Homo sapiens
  chr6:166077015-166077059
  hyper
gaatcctcctggtagcgggccagcagctccgacccagctgtgct

SEQ ID NO: 30925 - DNA, 298 bp, Homo sapiens
  chr6:166077335-166077633
  hyper
acccccacccccttccgtagccatgaatccaggcagttgccactgaagggaaatgagccgcccaatgggcgctcagaactaggagccgccagaagtttggggaagttggagcgcaagagcgcacacagatgcacaggtgtccgcgttcgggcaggcacgcgcggcggggccaccatggcgcgctgggtccgaggaggggcggtggctgtgctgttccacggtggcacgggctgtccggactgcctggacgaggtcaccttccccggagtggagcacacgcgccaaagctcagctttca

SEQ ID NO: 30926 - DNA, 332 bp, Homo sapiens
  chr6:166077668-166078000
  hyper
cgctacagtgcagcaactgggttgacccagggccctgggctcccggtgtgccccgggtcccggggccatttctcgccctccacgttttcttctttctatccagtttcacatgtttattttgaagcgtgctccagattcctcactagtcgatgctttccccgactcccatccaaactccccccaatggaaaataacacttttgtatttgcaccaagctgagcagttgggatgcaaaggacatgctggggctcccctcccccagtaaagtccacagacgtctccgcgattgccgggcagattctgagtgtcgcgtgtaacgggcatcagacttg

SEQ ID NO: 30927 - DNA, 52 bp, Homo sapiens
  chr6:166218127-166218179
  hyper
gccttggcctgcaggcggggctggtgggatcagagcgcgtggtcgcgaaggg

SEQ ID NO: 30928 - DNA, 244 bp, Homo sapiens
  chr6:166218546-166218790
  hyper
tggagggacatggggcgtacggaggggcagcggggcctggggtcgagcagaggggcgcatggaggggagcatggagggacgtggggcgcgcggaggggcggcggggcgtgggacgcgcggttcttcctcgcgaagttggagaggcctcgggtcgcagggcacccactgtgcgccctggacgaagcctaccctggaggcagcggctccgagggacgccggaaggaacggccgctttcctcagggt

SEQ ID NO: 30929 - DNA, 367 bp, Homo sapiens
  chr6:166267525-166267892
  hyper
gtggtgagcaggctgcgctggacccagacagacgcgcggggtcctagggaagagcccaggcagggggaagcccgtgggcggtgagaccctcccgtgccacgggcgcagcgcagcgctggctggggccgacggggcgcaccggcggacggtgatgaacccggagacccggcagccaggctgggctgcagcagcctttgcctggacgtcagggtggagcccgggaatcgcccctgcgccgggtgacggaggagaaaggggcccgcaggaggcaggagggagcgcctggcacagggacccagggactcgagcaggtggtccctggggaacggggagtgaggccggaaggagagaaagccaagaccaggtg

SEQ ID NO: 30930 - DNA, 30 bp, Homo sapiens
  chr6:166399418-166399448
  hyper
tatcctgaagaaacacgtaaaatcccatct

SEQ ID NO: 30931 - DNA, 349 bp, Homo sapiens
  chr6:166400601-166400950
  hyper
ctcgggaggcacctgcgggtctggcgcggcagccgctgcggtttgcagctggcgcgcagccctcgctgggaacttggagctctcaaactcctcggatcaagcgttagccccgaggctgtcagttggcgctggggcgggctgcagtctctctcccctcctctgcaaacccttgagtcttcggctttatatactcccttttcttctttctcgagtccactcatcaccctttcccccaaacagtcacctccacaagcacaacacaccacacacgcgcacacgttttcttattgccaaaaagggtggagggaaaggacaggaagtttttttaagtacacgcacacacacacaa

SEQ ID NO: 30932 - DNA, 232 bp, Homo sapiens
  chr6:166401268-166401500
  hyper
gcgcgccgatcttctcgcaaaaggcgagtgtgtggggttcctccttccctcctttccatctgggggtctcggggaaagctgcacccagcgccttgggcgcccatgaagaccagtccatctcagctcaagctcccagcagcagcaacttcggactcagacctctctctttagaacatgagtgcttgtgtgtgcgtgcgtgtgtgtgtgtgtgtgtgtccgagtgcacttcaca

SEQ ID NO: 30933 - DNA, 702 bp, Homo sapiens
  chr6:166401949-166402651
  hyper
cgccccttgtcactacgtgtcgggctcgctctgcctggagggaggctggggtgcggggaagcagggagtgcaaacagacattggttctctttcctcttcccattcatacatttctgttggagtcctagggccgccgcgccgggagtcgcaatgaatggatggatgcccgcgcgctgggaccaccaggtccgcagagatgtcgccggcgctaggggcgctcctcccgcgtggggacaggcgccctcgcctaggcgcagtgtggggggaccccaaaagacccttaagaggccaaaggcctgctctccccgttctccccaacacacaccaggggtcttttctgccccggagaagttgggacgcaaaacgtagggaactgcgctcagtctccgcaccacgaagagtcgagatggggaccgagaccagcacggacggtagcaacagagaggggagcgcccaagtggcgcaacgttgtggctgaagccaagcctgtcgcctccccctgagtaccgctggcggcccaggaccgtgcgctctcccttcctgagcacccagggatgcactgcgcagggaaggagggcacggcgggagggtgcttgcaggggactgctgcgcggattccccatccgcacccggctcgcggggaatccgtgggcttgcactcgccagaaagagctgctgcaggagcagccggatggtgaggcc

SEQ ID NO: 30934 - DNA, 30 bp, Homo sapiens
  chr6:166420026-166420056
  hyper
ggtttgcaggcaaatcggttggttagaggg

SEQ ID NO: 30935 - DNA, 59 bp, Homo sapiens
  chr6:166421933-166421992
  hyper
gcgggggcggaggagcgggtcgcgccgctgacattcgccaaggacaggatggggtgggc

SEQ ID NO: 30936 - DNA, 226 bp, Homo sapiens
  chr6:166421993-166422219
  hyper
cccgccggtggccgactccgccccgcctctcaggggtgcgagtcatcagcgcagcggcggatcctggcccagggagccaccggcccaccctcgcgcccaggagccggactcggagacgtccacctggtggagagacgcgagggagccatgcagacaggggctgctccgtggagagcccgggaagcctgcggggcgccggaggggtgggtcccgggacagaccagtg

SEQ ID NO: 30937 - DNA, 2678 bp, Homo sapiens
  chr6:166579715-166582393
  hyper
tttacaagtttgttccgactccacgcagtaagtactgtggcgcatgtttaaatttaaatgcgactttgccatcaaggctgatatcttttccacccccaggagagtttagggctagacaacggaagttccccaaaagctccagtccttcaaaggggagtgctcccgctccccgttcgccaggcgtggatgttatcagcttagtataaacagcgctaaaggccttattagagaaggctgtggcagtttctccagggcagacgtcgcctcccgttcaagcagcgtcccttcccacaacccccgtgcagaaggcgcagcgcggccccctcctcgctggtcccagacctggcgggctcctcacacctacctggccccctccgttgagcttgttggtgagcttgactttgctgaaggagacgggagccttcatccagtgggccccgaagttgggcgagtcggggtggatgtagacgcagctgggcgcctgcggctccggcttgccccccggcacccattccccgttcacgtacttccagcggtggttgtccgccgccacgaagtccagcaggaaggagtacatggcgttggggtccaggccagacacgttcaccttcagcaccggaaacatcctcctggaaaacacggggcgggcgcaggaggaccccgacactgaccaggtaggccggaggcagaagctgggcacagaggcctcagttatttcggggcacagaggagccccctggggaacgtccgagggtgactcccaagctcccccttccccgagccctgccaggtccaggtggcctcctcaccatctccacggcctcgggagggaggggaggagaggacctggcgaagggtttcagtgcaggaggccacatcccgcggggacaggcggggaccagggcgcgcctcgcgggtcccgggatgcctccgaggtcgggacaccgaagtgcgcgttcctcctccccaagcttccgcggagaaagccccagaagaggggcttgtagaaatgcactcgagggagttaaccagagcgggaacaaacacaaagccctcctccaggagaaaaagggttcgacctccgggaacttgccaggtcccccaggctgcccaggcgctggagagcgcggcgcgcgcgggctccggacgcgcacccacctgccgttcttggtcacgatcatctcattggtgagctccttgaagcgcagccacagctcgctctcctccaggcccacgcgcagttcgcgctctgtggggtcgcccttctcgctgcccgcctgcagctcattctccacggcgctcagcaggtggtccactcggtactgcaggctctttcccgcgctctcggtgccaggggagctcatcctcccgtccggctcccctccccgccgtccccgaagcccagactcgctacctgagatccaccttccctgctcttggccgccgcccttccgagaaaaggggccccttggaccgagacctgcgacggctcccgggtcccgggtcccggcacagacccgggaggagggcgcggaccaagacttggggggaggggacgggggcagaggggtggggagaagttattccacttgaactccccaaggctctactagtgtaggtctctggggaccgaaattcagtgccctccccataaatagagccgcggcggcagcgctggggtgctcggcggattgggccgcgcacgctttgaagtgccgggcagcctcccattggccgagagcggccatatcagacccagccgggcgggtctgggaggccgggggccaacaatgggctcccgcacgcctgtttcatgtaaatccggggccccagccctgcgagccccggcccagcccctacacccccgcccttctccaaatgtttgcacctccatcaaagcggcggggcaagccccggaggaaggtaagctggacgccccggcctgccccagcccgccccagcccgccccagcccgcacttccgcgaggggctgcccggcagcctgcgatgctccctgattcccgcgcggggtcctcctcgctttcccagcgcgcccggatcccgcagccgcgccaggctggaacgttcgcgcggcctcacctgtccccgctccaggcgcgcctccctcccctcccagggacgagcgcatttggccgggctttgggatgcgccgcgctcgtctcgccgcagtagtagtgctgttctcgcgcctccgatgcctcaactctccagtctggcagtttccggtgcacctgtccccacacgtccctcgcccacggagccccaggcggcgttacgcacacccaggatcgtggatcagcctgccccggcgtcgggtgtccccgcggctctcaccatctggaaaaggaaggtccgcgcgcagagagggaaatggacggaaataagcaaaagcaaaacaaccccttctgagaagtgtcctcctcgctctcttataaaaacaggacttgttgccgaggtcagcgcgcgcatcgagtgtgccaggcgtgtgcgtggtttctgctgtgtcattgctttcacggaaggtgggagaaggtcggggctggcggggtggtccggactagtgggactcggggcgctttccccgcccggcccagcgccaagcggtgtcggcagcggttgttttattacctttcggtgagaacttacgcgaggagagc

SEQ ID NO: 30938 - DNA, 433 bp, Homo sapiens
  chr6:166582394-166582827
  hyper
aaggagaggtgacaatgagcaggaaatagttcagtggggtctctttaaacagtaacattcctcctaaaacgggagcccaggaagggggaaggaggcagaagctcccccttccaaggcctggctttgcgcttctgcacacctcgcccattcgctggacgagggcctgcctcgggtagcagcctctgtttcccggtctcctgagcgggcaccccagccccaacccctctagagaaagcctgcgcatcgggtggggcagcgagttcagaggagtcttgcgccctagcaagggggctttcccgcggacatggtatctgcgccccgcgctaagtctcccctgccccctgccccctgcccctcgcccctcgcccagccgggctcgctccggggtcgggaattgctggggaagccgaaggagggatccccgcccgggact

SEQ ID NO: 30939 - DNA, 155 bp, Homo sapiens
  chr6:166582941-166583096
  hyper
cgacgagtcaggaagccggagcgtctagtccctgtccgcatttctcagtgtcttttgatgtctgggatgcatggatattcccagggggctgacccgaggtggggaagtttccttctagaaagaggcaccaaaaggacctcatttgctcctgacgc

SEQ ID NO: 30940 - DNA, 88 bp, Homo sapiens; identical to SEQ ID NO: 8811
  chr6:166583152-166583240
  hyper

SEQ ID NO: 30941 - DNA, 114 bp, Homo sapiens
  chr6:166666746-166666860
  hyper
aagaaaaagaaaaccagaacgagaaagtgcggccagcccgggctcaggagctgggtgggaaacaaagccgccagaaaatgacaagtaaacacgcagccgcgggaagccactggg

SEQ ID NO: 30942 - DNA, 184 bp, Homo sapiens
  chr6:166666879-166667063
  hyper
cgcgcagcggggccgccacgcccgcgcggacacggagcagcggcgcctttccctgcgactggctgtgtcgcctggagcccggcggccgccaccccagggagaaagctccggtgaggggagcagacgctgggacccgtggtctcgccctctgctctttcctggctggggacgggggtagctccca

SEQ ID NO: 30943 - DNA, 83 bp, Homo sapiens
  chr6:166721361-166721444
  hyper
cacgtggctggggcccgcgcgcggctgggcaaggcctggggggagacgcccggaggggccggcggctgcgtcctgtccaggcc

SEQ ID NO: 30944 - DNA, 442 bp, Homo sapiens
  chr6:166721677-166722119
  hyper
cgctcagccactgtgcgcggagcgggtccccgcagtccgggcggcccctccacacccacctgcgtccagccgcggcctctccggcttcctcacatcccagcgaccaaacccggggactcaaagagaggcgctcccaccctcccctcctcctgggggtgctcccgggactggaccctgcaggaaccgcctcccgccgtccgactgtgggcgagtcgcggcgcccccgggtccccacagctgagacgcgggccgggccggcaggaggaggagcccagcgcgctcgctaaggacgcggccctgccaggccccgggctgtgcccggctggtgtcacgaccgactgttgaatgggagcaaagtgccaggacagcggagggcggagcgcgcgccaggcatcccggggctcccccagctggcgctccggtggtccgaggttaatgtagt

SEQ ID NO: 30945 - DNA, 165 bp, Homo sapiens
  chr6:167040127-167040292
  hyper
gaccatcccacaccccgtgcagccagcggcggagaaaccagctggaaatgcagtgggggtggagttgcccccgcgaggacccacggaccgcccaattactacggagtcccagcgataacgtttggagccgtttggttcgattttcggaaccggaccagctttcca

SEQ ID NO: 30946 - DNA, 88 bp, Homo sapiens
  chr6:167041866-167041954
  hyper
gagcagaaacgagtgcggtggtgagttgacaagtcttgcttgctcttttgcagtgcgaactgcaaaatcctcgcgttgttttgctccc

SEQ ID NO: 30947 - DNA, 291 bp, Homo sapiens
  chr6:167275668-167275959
  hyper
tccttttctgctggtcgagtattgatagtaggaaaggaaataaacagaggctcggaccggcacagggggacggccagacgggatgtcggaagccaagggacgcagaggccggcgggtggcggcgatggagaggacagatccggctcccagaggaggtcgtgagcgcggggcctgcgccggccggaggagggacccggggggctgcaatatggctgctcgggcgccgtcccctccctgccaagccagggctctggggagctgctgccgcttcccgctcgggctggggcgagg

SEQ ID NO: 30948 - DNA, 149 bp, Homo sapiens
  chr6:167276322-167276471
  hyper
cacggacggagggaccgggacgaggggagggctccacgcagcacagctgctttcctgcggagcgttcaggagactcgggcacctctggaagcgctgcggactgagctgcccgcggctgcccccgccccgagggccgggacagcacctca

SEQ ID NO: 30949 - DNA, 124 bp, Homo sapiens
  chr6:167764978-167765102
  hyper
gttacttcagagatgcgctgtgagctgctttgtgccgcgaaatgacctgtttacccgacagcgccctctgcagcccagcgccggaacgggctttttcatgatgttcctgcgttgtgtttacagc

SEQ ID NO: 30950 - DNA, 19 bp, Homo sapiens
  chr6:168719889-168719908
  hyper
cgcgcggggcctccatgtc

SEQ ID NO: 30951 - DNA, 59 bp, Homo sapiens
  chr6:168841594-168841653
  hyper
gtgtgtgtgagagtgcgcgcggggaaggaggcacagagacagcccggacaggccactgc

SEQ ID NO: 30952 - DNA, 490 bp, Homo sapiens
  chr6:168842028-168842518
  hyper
cgctcccgccacctccgccaccatgctgctcccccagctctgctggctgccgctgctcgctgggctgctcccgccggtgcccgctcagaagttctcggcgctcacggtaagcccgggcccgcgggacctggagctcaagtggtgccgcctcttgcagccggccgggttcgggtccccgcgccccgctccaggcccaggcgcctgggcacggggagcaggtggccccgggggccgtggagccttcgcctgccggcgaggctggagcaggtaggacgcagcgtgcgcgcctgggacccggctgggatgggcttctggggaccctgcccgccggggtcctgctgcggctgcgacgggctcctcgggttccacccggctgggaccccacctgcctcgggggctctgacccggctgtgagaggatcctggggtcctgcagaccccggacaagtgggagctgcgggtgcgctcgggtgtcccgcactcactgctgg

SEQ ID NO: 30953 - DNA, 1 bp, Homo sapiens
  chr6:168843060-168843061
  hyper
c

SEQ ID NO: 30954 - DNA, 164 bp, Homo sapiens
  chr6:168843080-168843244
  hyper
cggccgctgggccaaggccgggtgtctgcagcccccagctccagccgtcctcctgggcttgcagggtttgcaaacccatcattaatgcaatcgccagaaacgaaaacattccacttaaatgtgtttttgaacaagtgtttgagaaaacacgaaggtagtgagaa

SEQ ID NO: 30955 - DNA, 124 bp, Homo sapiens
  chr6:169653925-169654049
  hyper
tccggtggacgtggccgagcggctcccgggcagcgcggctttatatgccgcttctcctgtgcagggctgtcaatcagacacacgaggaagcacgtttaattcattccttcgaaggaatgacatc

SEQ ID NO: 30956 - DNA, 30 bp, Homo sapiens
  chr6:170598584-170598614
  hyper
aggtgcggcactcaccggccaggtgaagcc

SEQ ID NO: 30957 - DNA, 262 bp, Homo sapiens
  chr6:170605558-170605820
  hyper
ccggtggaccccagtcgccgtcgtgacggccccacgcagcctcgcgcccggccgccgcctcgtgcgggactcgtgcccgcattcccacctcaccgggtgcagccggcccggccccgggctgtgcgaggcgacggcgcacacctcggagccctgggggccggggtcggcgggcggggccggggcgcgccctttgtgcgctcttagcggaaaccgcgcgttcccagaggagcgcggcccgccgagaccccggatcccgacgcca

SEQ ID NO: 30958 - DNA, 32 bp, Homo sapiens
  chr6:170921693-170921725
  hyper
gttgggtggaagcagcgcggacccacggcaca

SEQ ID NO: 30959 - DNA, 30 bp, Homo sapiens
  chr7:191863-191893
  hyper
ctcacacacccccgtcggccccaagcagga

SEQ ID NO: 30960 - DNA, 71 bp, Homo sapiens
  chr7:192430-192501
  hyper
gaggaggaaggagagcgggagcgcagccggcccgggcccagccgtgactcgtggggcggcggctccgccaa

SEQ ID NO: 30961 - DNA, 52 bp, Homo sapiens
  chr7:192976-193028
  hyper
tccggagaggccgagcggggacgggcccgagatggcgcggggacccagcgct

SEQ ID NO: 30962 - DNA, 72 bp, Homo sapiens
  chr7:193612-193684
  hyper
gctgctgcgagaccccggcccgcgtcggtccgagtcgccccccggccccggcggagacgcctccctcctggc

SEQ ID NO: 30963 - DNA, 50 bp, Homo sapiens
  chr7:329805-329855
  hyper
gggggccgccccgcccgtcggaccacccagcgcgccgcctcctcctccct

SEQ ID NO: 30964 - DNA, 253 bp, Homo sapiens
  chr7:330425-330678
  hyper
cgcggggaggggcctccgcaggtcgggaaagagcttctggggtctgggtggcgccggggaccgcgagctgcggggacactttccccaacaccgcctcgctcctccgcctctgcgccccacggcgtcctgcgggatggggggaaggacggggggctgcccggtggagaccccgcctgacccccgggctccgcagctacatcgccttgatcgccatggccattcagcagagccccgcggggagggtgaccctgtc

SEQ ID NO: 30965 - DNA, 27 bp, Homo sapiens
  chr7:330720-330747
  hyper
cgccaaccagcgcgcctggcagaactc

SEQ ID NO: 30966 - DNA, 30 bp, Homo sapiens
  chr7:560245-560275
  hyper
agggaaaggagccaccggtgagggtccccc

SEQ ID NO: 30967 - DNA, 163 bp, Homo sapiens; identical to SEQ ID NO: 2953
  chr7:751986-752149
  hyper

SEQ ID NO: 30968 - DNA, 156 bp, Homo sapiens
  chr7:752150-752306
  hyper
ccgccctccacgcccgcccccgcgccgcgcgcagctgctgcacccccaacgccgcccgcgcgggcctgcagcccgtctccccccgaccgcctccccgcggggcccccaaccccggcccccacccccggctctccccgcccccgccccatcccccac

SEQ ID NO: 30969 - DNA, 78 bp, Homo sapiens
  chr7:752350-752428
  hyper
cgccccccgccccctccactcagactctgagtcgcccactccagccggtgcaggccgcggggccgcctctgatggcct

SEQ ID NO: 30970 - DNA, 104 bp, Homo sapiens
  chr7:1126563-1126667
  hyper
gaagacccacccctccgcctggagagccggggctggcggtgcctgaggaccccttcggcctggacagcccacgcgggcttggggggcctcgctctgccctcatg

SEQ ID NO: 30971 - DNA, 566 bp, Homo sapiens
  chr7:1263707-1264273
  hyper
cccaggttcggttcccggcttcctggtctttgtttaccaggctccgaggaggacctgcctctctcctcccgcagccctgggccccccactcgacagtttcacatccagggagggacaaagggggacgcggccggattagctttcgcagcgcgcggtgcgttcccggggtgcagctgcttcggggcccctgccaaggctccggcttctgcaggcgggactcgggctcgggccaccaccgcgagcactttcctggccagctccgttcccgccccatcgggccgggccgggccgagctgagcggggcgcggagaccgcggcggacggtggggagagcgcgcgcgcgtccatccgatttcaggcctttgttgccggagcctcgtgccgatgggttaatggggcagaagagatcggtgaagggcgacagaagcggcctttgaaagagggtgtcagcgcggggcagcgagacaaaggccaaaacacacacgggcggagagggacagatggggacgggcgagggaaaacaattaggccgcaagtgcgggggcggggcgcggctccatcgtttt

SEQ ID NO: 30972 - DNA, 321 bp, Homo sapiens
  chr7:1265151-1265472
  hyper
gggatgacctgagagcgtttcctggaagccgcgcagcccctctcccggcctccaccatcggggccgctcaccctctggggactctggccccgggaccccgggatccaggcccggtgcgcgcggctccggccccgagcgcgctgtccaggctggatccccaccaggcggcgctgcgcccctccgagcccgcccggccgcgctctgcaaaccgatgctgtttaattaacgtgcaaattgagtagattaaatgactctaaataattagccacagatcctacaaacaggataacagatttaattaagcagcgatatagattttgg

SEQ ID NO: 30973 - DNA, 267 bp, Homo sapiens
  chr7:1269197-1269464
  hyper
cgctccggccgcccccgacccggacccggactccgggcccccagctgggcccaagcgcaggaggccggtcctcacggtgcgcccgggaagggaagggccgagcggcctggagctgccagaggccgcggcccgggcgggggaaggggcaggcggaaggcgggccccggaggtctccggctgggccgggcgcgcgcgcctgggccctttgtctcgcgcggccgtcgggcccggggccccagccctgtgcgctcggggcgaggaggttcc

SEQ ID NO: 30974 - DNA, 127 bp, Homo sapiens
  chr7:1269552-1269679
  hyper
cgggctggaccgggccggggcgcgtccggcagcgctgagaccccccaccccgaatcaaagtagcggcggctgcgggggcggcgggtgggtgggggggagccgaggaacacggcgaggcgagcggcgt

SEQ ID NO: 30975 - DNA, 455 bp, Homo sapiens
  chr7:1270162-1270617
  hyper
aggaggttttcggagcgcgagccggcccgacagcatgaaaaacacagggcgattgaaatgcgagcattgggacgcacggagccgccgcggcgcggactcgctcttgaggtcaagtgacggacggattgtatgcttcttcataataatattaattaaacaatttgcatgctaataaggtaacaattatcagggcctctgttgaaagattcgggttattacaacacgccaatctgaaggccaggggtcagagagtgagaggcgagcgaaatttcaactcaaattaacattctgtcagctccagaaaatgggataaataaagtcgaattaattcattataataaagagagatgggcgagggagctcggccggcgcgcgcccctcctctgccctccccccgggccgaatagattacagctctgtattcagaaacacgcgccgcgcgcattcctcctcgc

SEQ ID NO: 30976 - DNA, 82 bp, Homo sapiens
  chr7:1271057-1271139
  hyper
accccccaccctccccggcccaggcacgggcacctgacccggagggacgcagagatgcgcacggtcccggcctgcccttccc

SEQ ID NO: 30977 - DNA, 30 bp, Homo sapiens
  chr7:1272309-1272339
  hyper
cccccgcccccagcccgtcttgttgtgaca

SEQ ID NO: 30978 - DNA, 443 bp, Homo sapiens
  chr7:1272543-1272986
  hyper
ccgggtccctgtctccgccgccgccgcccgcgcctcccgccgctggcccgccccggccccggcccgcgcccccgcgccccgccaccggccccgccggccccccgcgcgagatgatggacggccgcctcctggaacacccgcatgcccagttcgggggctcgctgggcggcgtggtgggcttcccctacccgctgggccaccaccacgtgtacgagctggccgggcaccagctgcagtcggccgccgccgccgcctcggtgcccttctccatcgacggcctgctcgggggctcgtgcgccgccgccgcctcggtggtcaaccccacgccgctgctgccagccgcctgcggggtcggcggggacggccagcccttcaagctgtcaggtaggcgcggcgggcgggagggcggggaggagtgcggctgggggcgggggccctggtcc

SEQ ID NO: 30979 - DNA, 96 bp, Homo sapiens
  chr7:1273204-1273300
  hyper
ccgcaccaacttcaccggctggcagctggaggagctggagaaggcgttcaacgagagccactatcccgacgtgttcatgcgcgaggcgctggcgct

SEQ ID NO: 30980 - DNA, 366 bp, Homo sapiens
  chr7:1273589-1273955
  hyper
cgtccgaaccgggaagcggcgtggtgggttggcggaggccgggccaagtgaggtctccaggcaggggcgaggaggggaggaggggccggcttggctccgacccggaggagagagggaaggggacccccccccgcccccgcaccgcctcaaccttccgcgcgaggctctgtcacccagcctggagcgaacgagtctgtttaccttgcgcctgcaaaatattcagatggaaacatgtatttattcatcgctttgcagaagggaacagctgaggaaggggaggcagaagcttaaacagttaacacattgagaaagtgggagaaaaaaaggtgtctgaatttttaataataaccccggtctcatcttttt

SEQ ID NO: 30981 - DNA, 452 bp, Homo sapiens
  chr7:1274473-1274925
  hyper
ggacaaggctccctgcgacaaggctgggcctgctattgtgcaagtctctgtgtggccgcgacaaagaatccgtattaacgcgccctcctggggagggcaggactgcccgagcttccgcggggctcagacggatttgactgtgtgtgtttggtggctggcggttgagtgagggtgtagcgctgccgtccccggatgtcctgtgtggctccccaggacaaggactgcagagaggatggaagagacgcgatgggcccagcctctccttccggcctggtggtcgcctcttgcctccccacctgccttggccggtggcccaggccaaggaccgcaggtttgggaaggctccgttggcgccctggcccagggtttgcggaaagaaggctgtgttagctgtgccctgggagggaggctgcagaggcccacccaagtacggctccccaggcccttccgga

SEQ ID NO: 30982 - DNA, 113 bp, Homo sapiens
  chr7:1275567-1275680
  hyper
gcgagcccatggacccggaggagatcgcgcgcaaggagctggagaagatggagaagaagaagcgcaagcacgagaagaagctgctgaagagccagggccgccacttgcactcg

SEQ ID NO: 30983 - DNA, 8 bp, Homo sapiens
  chr7:1275909-1275917
  hyper
gcccaggt

SEQ ID NO: 30984 - DNA, 104 bp, Homo sapiens
  chr7:1276436-1276540
  hyper
ggggactgcgcggacgcggggaccgccggccccgcgcccccgccgcccgcgccgtcgcccaggcccggccctcggcctcccagccccgccgaggagccggccac

SEQ ID NO: 30985 - DNA, 382 bp, Homo sapiens
  chr7:1277174-1277556
  hyper
ctccccctcctaccccgcgccgcacacgcacgctcacatccgccgcgcgcccccgcgcgcactggcacacgccggggcgcgcggcgcggggtgacggagccgggggctgcgagggccgggccgctgggctcctgcagagttttgatatgaaagtaattattttccggtggctgctgcggggactgggtttcttgcccaaagggttattatacattaccgatttctagtgatatggaatcacataaacttcctacaataatagaattagcatgaaaggctggggtgtcaaattgaaattggagaataatagcgccggcagctgggggagtgcgtgcgcatattggagcggagatggggaatcgtggggcggaattttcatgag

SEQ ID NO: 30986 - DNA, 115 bp, Homo sapiens
  chr7:1277861-1277976
  hyper
catcccaaagtgaaccgccacccgtcctccatctccccccacccccccaaaaaccccaacccactggcctcaattttcctgggccctgggtcctcgttgccgcaaaagccaccaa

SEQ ID NO: 30987 - DNA, 431 bp, Homo sapiens
  chr7:1280395-1280826
  hyper
aaattagccaggcctcgcagtctcctaatgagagggtattatttcggcacctcggaaggagcgtgaaaaatgagagagactccatccggaggtgtcggatcgattcaggatcagggtgtaaattatatacaactaaatatccagccgcccataccgctgcttaatacggagcttagaaatgcaacattaaacaaagattatgagagatcgacgcctctggaccgagcccaattcactgctcagccgggtcagcccctgccccgcgggccgaggatggggagggggcgcgcaaggagtgaaaacggcgagtttgggatgagagccagggccaggaggggagcctcgccctcgctactccttccctttcttctaaagccagggagctccccgcccagcattgcccgttccttcctccccgccagggcccagag

SEQ ID NO: 30988 - DNA, 150 bp, Homo sapiens
  chr7:1281075-1281225
  hyper
gtttatctcacttagcggtggagggactggagggaaggggcggcccgaagggaggccttggtggggcccagcggctccctggcgcaccccggacacggtggccacgaggagccggggctgtggccgagggctgcccgcaccccgagaccc

SEQ ID NO: 30989 - DNA, 84 bp, Homo sapiens
  chr7:1281471-1281555
  hyper
cgcccctcgcccagccgtgactccctttcctctcggccgcccgactccgcgcgcccctctcggcttttccgagctgggatcacc

SEQ ID NO: 30990 - DNA, 268 bp, Homo sapiens
  chr7:1281876-1282144
  hyper
tcggaaagtttgcagcgtttcccgagcagcgcgggcaaggccggacctgcggtggagccggcacctgccgctccgcccgggattagggagctcccggcttgtggggggtgcgggcggccggtggtccagctcgcccgccccggccgagacgctgggcccggcccccacaggctgcgcctgacgggaccggcgggaggcctttgttcgcagcccggaggccccaggctccaaaccacactcgggctgcggggagcgagcgcgggcgttg

SEQ ID NO: 30991 - DNA, 109 bp, Homo sapiens
  chr7:1282572-1282681
  hyper
cctaagatcacacagcgtcccagaggccttactgggcaggggagggggtggcccggccgggccctcgcgcgccggcttctgctgattctttctgcggcctgataataag

SEQ ID NO: 30992 - DNA, 170 bp, Homo sapiens
  chr7:1283626-1283796
  hyper
gacacaggggctttccgggatcgaaaggtgtttcttccctttctaagtcacgtcaggccacctccgaccccagccgacacgctaccaggcctgcaccatagaagtgggctctgagagtgttcccaagccctgggggagggggactccccagagatcgtgtccccgacccc

SEQ ID NO: 30993 - DNA, 30 bp, Homo sapiens
  chr7:1284194-1284224
  hyper
ggggaattcaattttcgctgaatggtgaga

SEQ ID NO: 30994 - DNA, 104 bp, Homo sapiens
  chr7:1286007-1286111
  hyper
tttgttcttgttatccgtgataattgcgaagttcagcctctcggaattgggccggcctggtgcctccagcgccgggcagggcgggcagaggccgggctgggagg

SEQ ID NO: 30995 - DNA, 287 bp, Homo sapiens
  chr7:1286886-1287173
  hyper
cgaagggagtcgccgggtacccggctcaggccgtgtctgagcgccagggatgcgcagaaatgggagcctggccgcgcctctgcagcggccttggaggagcctctggagcgggccccgcgggcgcgtggggtgggacctgctggagacccgcaggcggcggcggccaagcagggtcaggcggttggcaccacaggtcgcgccctcggctgcagtcggggcagctccagggggccgcgtacctcccgcttcacggctacgcgtgggggcggctccgtcctggcctcacc

SEQ ID NO: 30996 - DNA, 30 bp, Homo sapiens
  chr7:1288109-1288139
  hyper
ttcggtgctgaggtgcgtgtaggcagggca

SEQ ID NO: 30997 - DNA, 283 bp, Homo sapiens
  chr7:1288552-1288835
  hyper
tctgagggagctttccgtgggatggctgggcctctgttgcagttgcgaccaatgctgcggtttaaattctccctgggtccaatcctgcttccctcccctaagcctctcgcacacacacctcggctcaggctattcaccgggaaagccacgcggaggcagggcaggcagcgccccgccagagacccccggatggtggagatggtgcggtggagtcgggactgctgggggcacctgctgatgaggtgggagggtaaagccacgggggatgcgggtttctggactt

SEQ ID NO: 30998 - DNA, 122 bp, Homo sapiens; identical to SEQ ID NO: 8836
  chr7:1289414-1289536
  hyper

SEQ ID NO: 30999 - DNA, 270 bp, Homo sapiens
  chr7:1408501-1408771
  hyper
cccgcccctgcctggcgagtgcagattcccgcctattttccgacacccgcctgcagaggagtcgggcgccagatgggatcgaacccagcaaggtgagaaatccgggcggggtggcagatggggaggccttccccggggaactccaggagaggggaggacagcgagggccccgggcgcggcctctcgtgtgcccccagccgcggggcgcaggcccgcagccccccaggggcgccgcagctgtcactccgcggtgagtggcgccatccggat

SEQ ID NO: 31000 - DNA, 201 bp, Homo sapiens
  chr7:1408874-1409075
  hyper
cgcggaccccggcccatcccggaccccgcccaccgcggacctcacccatcctaggccccgcccatcccagacaccggcccatccctgaccccgcccgtccctagccccgcccaccaccgaccccacccctccagaccacgcctatcccaggccctgcccaccgcggaccccgcccatcctgcaccccgcccaccacggacc

SEQ ID NO: 31001 - DNA, 144 bp, Homo sapiens
  chr7:1443541-1443685
  hyper
gggtggcgcctggcccggcatccacactcctggtgagctctgtttgttttcataaccaattcaatatttaagacccggccagccgcggccgcaagctctccagctcccccttcctttgtctctgccgctccctgcaccccgcct

SEQ ID NO: 31002 - DNA, 15 bp, Homo sapiens
  chr7:1443733-1443748
  hyper
cggctggtctctttc

SEQ ID NO: 31003 - DNA, 616 bp, Homo sapiens
  chr7:1704139-1704755
  hyper
aggccgttggacccacgtccggacaggagccccgcgcgcccatccccggcccggccatcctcggggcgcgctgtctgcggcctcccgcgccacccccacccctgtcccgggacctcctccgggaaagacacccggggagcagccccctcccctccagtagtcccctcccctcccctctccctgccctcttgacggtgtggggctccccggccggaggggcgcggcgctggcagcggggtccagagtgtcgcgcccagcgcgcgctgggggtcccgggctccgcagctccgcacgcggccggtttgtgaagcggcgcgcgggggcttagccgggcgagggcgctcttgagcctggtttggaatttttagcccacacgaaagccgcaggctggggaaggggcgggtgggagcgggagacgccctgggaagccgtgagaccgctcggcgagggctcgggaccaccagggagcgacgggggacccctcggctcagagcccgagggcgcgatttcggatccgctgggattccggaggcacatgaagggagagggaaatccgctaaaccgaaccttccgggaatcggaaggcgccgggccgctcccacgcctccccctcctc

SEQ ID NO: 31004 - DNA, 138 bp, Homo sapiens
  chr7:1704984-1705122
  hyper
tggggtcaacttccacgaggttgccgggcgcctgtgagcacagccgtgtccccacccaggggcccacctcccagcgccaccagggtcccgacccccagaccttcggacgcttctcttccaaaccgaagcctgggagcc

SEQ ID NO: 31005 - DNA, 198 bp, Homo sapiens
  chr7:1705412-1705610
  hyper
cggccgccaccactgcgcccgcgcccgagcccgagtcggagccggagccgccgctcccccgcctgcccggccagccccgggctccgagcgcgcggtccccgccgccgccgccccgcgctcgccccgcgcttgacgcagtgagcgccgcagcctggctcccgccggctccgctgggctccgggtcgcaggccgagtcca

SEQ ID NO: 31006 - DNA, 183 bp, Homo sapiens
  chr7:1706209-1706392
  hyper
gcgccgcggggaccccgaaactttccggagcgcgctgagagcaaaaagccggctgggcagaaagagggggagggggctgggcgcgccttcgagtgcgctggggtagccgcggcgccccaagttgaaccacagacgaacccctcttcatctgaaacctggtctcggagtcggaggtggggaggg

SEQ ID NO: 31007 - DNA, 82 bp, Homo sapiens
  chr7:1706634-1706716
  hyper
ggctgccgagtggggcgggaccccggggcccagagcggacccccagctctcctggtccctcttccgccgctcttccctccct

SEQ ID NO: 31008 - DNA, 274 bp, Homo sapiens
  chr7:1706985-1707259
  hyper
ggccccatctgagggcggggagaggtcgctgggggcagcttcgggggttgtggagggcaggggggacccgcgaagctcctggagcgtttagggatgcagctcgggcggcgtgtgcagggaggaagcagcgtcccggcgtccccccttcagcgtcgccttcgcgcgcctcgagggcccaggagggttcggtctcccccaccccacctggacactcaggtctgagcctgagtggatttgaggatctgggggacggggaatacggagtccttcttcc

SEQ ID NO: 31009 - DNA, 488 bp, Homo sapiens
  chr7:1709074-1709562
  hyper
ccgccggggcctgcccggcccgagcgtggagtcccgaggctcctgccgggggtccaggctgcccctggggctctgccttcgacgcgctgtgtagggccagattctgggcctctcttgactcagtttcccttcctgtaacatgcggacgggggcttccgcacaggcaggttgtcagggtgaaactgagccgaagagtgctccagaaccccctgaagtcctcacagaggttggggtgaatgaaggaaggaagcggggccagggctgggcagaggaggcccggcctgcgccctgcgttctccgcccctaggtccctgccctcccggataaggggcggaccgacgggaggacctgagaacgccttggctttgcttgaggtggtgggagtcgcgggtagcttgttcagccaacagctgtcgcccccactccccccacccacccacccaccccctccaccttttagatgtgggcggggagggccggggacggac

SEQ ID NO: 31010 - DNA, 306 bp, Homo sapiens
  chr7:1709617-1709923
  hyper
cgtcgccgggagagggaaggagcgggttgccgcggggagccgaggagagcagggggctcgggaggccagggagagaaggggagggccagaggctccgagccggactcgcggcggaggaagagggggtggaagggagcgcgcaggcgggcgagggagcgagggagggagagaaggagggagggagggagggaaggggggcgggagggggcagggcgagcttgaattcccccccggccgcgcggcgaggggcggggccgcgcgcgcagatcgatgggcgaagctggggaggaatttcaatcccgggag

SEQ ID NO: 31011 - DNA, 289 bp, Homo sapiens; identical to SEQ ID NO: 8844
  chr7:1709955-1710244
  hyper

SEQ ID NO: 31012 - DNA, 46 bp, Homo sapiens
  chr7:1710324-1710370
  hyper
cgtccgcaccctgcccggcgccccccagacgcggccccctgccctt

SEQ ID NO: 31013 - DNA, 386 bp, Homo sapiens
  chr7:2727866-2728252
  hyper
ctgctgcccggggctcggtgcccggcgcggcctctgccggctccggcgggcgcgggactgcgaggtaggggggcgcgcggggaagactcgggggcgcagggaccgagagggacctccgtgccggggcgggtgggtaggggcagctccgggtccagcccggcccgcgcaccaagtcccgagggcgcccgggcggcggcggctacgggcgcgcggggaccgcggagacgcgaagggcgcacttggcgagggtttggtgcagcgccgcgccggggtccgcacagccccggcaggtcctgcagagggaaggccgggccagggaagggccacgcgccccctccccgccatcctctcccaggccagggcgacctgcgcgcttcccgatggga

SEQ ID NO: 31014 - DNA, 45 bp, Homo sapiens
  chr7:3083160-3083205
  hyper
actcccatcccccgacgccccccccgccaccgtgtcatctcactg

SEQ ID NO: 31015 - DNA, 34 bp, Homo sapiens
  chr7:3083407-3083441
  hyper
tcctccgaggggcgccgcccgcccaggggctgca

SEQ ID NO: 31016 - DNA, 584 bp, Homo sapiens
  chr7:3340231-3340815
  hyper
cccgccctcctccagcgccggccaaaagtgaccttggacgcttctacaatgccatatccactcctctgaacaggaggcgagtttgcacccagtggtgcctttggttgctagaaattaaaaacccgattgcgcgtgtttgcaattacggtaacttggcgcgtcacccccaagcactgagctagctggtggtagccgggcgcctctcggggcgcgccctattccgccctcggccctgggctgccgcacgatctgcgcgtcctgctgcacctgagcccttcccactcgggcgcccgcaccgctgcggggccgggcgaggatgcaccacccccgcccgcgagcccgccacgggagcgcgtgccgaatcgacgccgcctgcagtccccactacgggtccctagggggcgcagccggcgcgggaagccgcccgagccaggcgccgcggccggcacaaaattgcaggcgggcgggcgccgcgactttgaaaacaagcgagggcctggggggcgggccctgggagcgggcgccgcctccctcggccaatcaacggcgggcggcgggcggcgggcgcgggcggcgcgtgcggc

SEQ ID NO: 31017 - DNA, 123 bp, Homo sapiens
  chr7:3341286-3341409
  hyper
gggccccgggcggccgcggggatccccgcccggccgcgcccgcccctcgctggcgccgcgccccggcccggagccctcgcgaccccgggcggcgcccgagacctccggcggggacacggcggg

SEQ ID NO: 31018 - DNA, 417 bp, Homo sapiens
  chr7:3341569-3341986
  hyper
cgaacttgagcagcgagagtgtgtccggggtccccccgcttcccggcccgggtcgggatgcgccttgctgggggctctagggagcccaggggctcctccacgccagactcggaggagagggaaacggagccccgtagagcctgcaccccgtctgctactttgcgttttattttttttataccgcagtagcacaaacaaaaatttttaagttgaggacccatttctcagctccttaaaaggatgcccgagtccccttcccattgcatggatgaaaaaggggctggtctgtacctgagtcttcgcaccgcagggtctggtttccggtgagtgacatccagaagacttggaaatatcaagtgccagtcgctgtgaaaagccttttccagcccctccccagggcctcgtcctctccccagc

SEQ ID NO: 31019 - DNA, 68 bp, Homo sapiens
  chr7:4785735-4785803
  hyper
tcctgatttctccaacgtggagatcaaaaatgaaagtaactcgtacaattcggcgaaggtcagcagta

SEQ ID NO: 31020 - DNA, 112 bp, Homo sapiens
  chr7:4837872-4837984
  hyper
agggcgcggggcggacgcgctgcacctcgccgtagcgcacaccagggggcagcgtggagctgcacgaggcccagggcctgggacagacccaggacaccgatctggggacccc

SEQ ID NO: 31021 - DNA, 103 bp, Homo sapiens
  chr7:4922604-4922707
  hyper
gaggccccaggagctcggctcagcatctgttatcttggatgcagtatttgtcgaggggctggaaatggtacataaatagccgggaaacaatgctttgagctgg

SEQ ID NO: 31022 - DNA, 135 bp, Homo sapiens
  chr7:4922839-4922974
  hyper
ggacgaagctccccctccagggcacagccgggaaaactgagggccgagagtcccctggagttgggggtccggggcccacgcggacagccaggctcaggagctctcgggggtcggcagcgcggacccccggatccc

SEQ ID NO: 31023 - DNA, 302 bp, Homo sapiens
  chr7:4923327-4923629
  hyper
ggcggcgcaacgggcggggcggggcctcaaggggacggggccacaaagggtggggcgggggagaacaggtgggctggagctgggcctcggcgcccaataggcagaaagaaagcctcgaggaggcggggtctccaggagaggggcggggccaacctgctagaaaaggcgggctgtgctctggcgcctcctgccggccgcccaatggacggggatgcagcctcgagggggcggggcctcaccggagaggcggggttttgaagaaaggggtggggctggttgtggagaggcgggacttgcagccc

SEQ ID NO: 31024 - DNA, 386 bp, Homo sapiens; identical to SEQ ID NO: 2958
  chr7:4998201-4998587
  hyper

SEQ ID NO: 31025 - DNA, 121 bp, Homo sapiens
  chr7:4998770-4998891
  hyper
cggcgcccggagccggagccggagcccgagccggagctggaggcgcccggagccgccgacgccaaatcccgagcagatggtggcgggggcggggcgggcgggggcacgggggggctcccgg

SEQ ID NO: 31026 - DNA, 30 bp, Homo sapiens
  chr7:5459075-5459105
  hyper
gacccaaaagacacacgcatgcacacacac

SEQ ID NO: 31027 - DNA, 30 bp, Homo sapiens
  chr7:5467207-5467237
  hyper
tctctctcaattcggcgttgaacccggttc

SEQ ID NO: 31028 - DNA, 400 bp, Homo sapiens
  chr7:5467505-5467905
  hyper
cgtgtctggcgggcgcggctaaaacccggagaggctgtgcccgggaaagccacgttcgccgtcccctcgctgcgacaggcccagccgcgatacagcgccaagtctaggtcgggccaacccagccaggagctgcccggacctgcctgaaagaccagggacgcggcgccagcgccccacaccccaccgagaccagggcgcaaggcgggcagaattcggactgatgcgccaggcccagccccgatggattccagctcctctcggccccgcctccggccctggcctcttcctccagccggggtcgggtcctccactccactgtttggctgggaaaggaccgagacgcgctcagtgcacagggggccggctgcggccataaatctccgggcgggccctccttccc

SEQ ID NO: 31029 - DNA, 105 bp, Homo sapiens
  chr7:5526299-5526404
  hyper
aagaaaaagaagagacggcggccgatacccagtcgtgtgtgaaggtgagtctgtcagagacaggagggtgatggccatcaaaaaaggcagcgcggtcaccagcaa

SEQ ID NO: 31030 - DNA, 72 bp, Homo sapiens
  chr7:5632917-5632989
  hyper
ccgcctgtcctgcttcgcgcagacggtgtcccccgccgagaagtggagcgtgcacatcgccatgcaccctca

SEQ ID NO: 31031 - DNA, 35 bp, Homo sapiens
  chr7:5635640-5635675
  hyper
gaaagggatgtgggacggcgcgggggtgggggtac

SEQ ID NO: 31032 - DNA, 72 bp, Homo sapiens
  chr7:6543150-6543222
  hyper
ggcggccgggcgcctcgcggaaggcctggtagcgctgctcctcgtcggcgtcgggcgcgaagagcagcagct

SEQ ID NO: 31033 - DNA, 107 bp, Homo sapiens
  chr7:6566129-6566236
  hyper
agtgcctgtgagccccgcgtacctgcgcgcgcccccggggccggcgaggccgcccaccagcaaggaggccctgcgcgggggcggctcatcggggcggcgcggcgggg

SEQ ID NO: 31034 - DNA, 320 bp, Homo sapiens
  chr7:6566246-6566566
  hyper
cgtggacaccaggaggcgctccggccgctcctcgctgcggctccggcgcagtcgctgcgcgccctgggcccggcgtgcgcggcacagcttgcccaggaggccctgagacaccacctcgtcgaagcgcgcccggtgcttcttggggatgaagatcctgccggcgaggacggcggagtcggggcgcgttcccggaccccggatctctgcaaaccgcggcccgaaggcgcgtcctcgcgggcgccgccctaggctctcccacctcttcctaggagtggcggagggctggggggatcgggatgagcagccggtagcaccccagt

SEQ ID NO: 31035 - DNA, 409 bp, Homo sapiens
  chr7:6570454-6570863
  hyper
gactctttagggccacgcacgggttctgagcgcccaacgcttagacctcgccgccccggtacccaccgagtttatttccaacctccctgggcctcgggctccgcccaggctcggagggtgcccacccagggcagggaagcccctccacgctccagccccacccgctttcagaccagcccgaggcggatccgtggcgcagagggcgcacggttcccggaggcgcgggacgcgatggggaagctaccgaaagtgccgagagaagccctggtccttccccatctggagccggggaccgcggcgcggcaggtgccgaagggcagggggtagccgagcccaggaatggagcgagcgcgccgcgactccacgcacctctgccctgcgagcgcgcgcggcccctcccgagccgtcc

SEQ ID NO: 31036 - DNA, 277 bp, Homo sapiens
  chr7:6570900-6571177
  hyper
cgccccctccaggtagccccgcctctgccctgctgggacccttttggtcgctctggggtgcagcggaaactggcggcggtttgaagccgccgcgctcactccccttggctctctccgttattcccttcccaggatcctcgcctgcgtcctctccagctactgcgccccggacccccacacagtggcgagtccccgcagttcagaggaagccccgacggcctttggtagaacatgcaatattttccggaggggatgccctttacgctgggcctccagg

SEQ ID NO: 31037 - DNA, 48 bp, Homo sapiens
  chr7:6576049-6576097
  hyper
gcgccctgcccgacccgctgccgcagctgccggcggcttggggaccag

SEQ ID NO: 31038 - DNA, 357 bp, Homo sapiens
  chr7:6654798-6655155
  hyper
cgcctactccctctccgagtgccatcgaattgtgtgctaattagccacaatttgcaccgcggcaggggcgccccgaggccacgcctgccctctagggggtggcagggatcgggttgggtaccccccacccagacacccaggcagtgacagtcgccaaccccgtggcgcgaggacacgcgcagcagggatgcggcacagcgcgcgctgcgctcggcaccggccagcccgggacgccccaggggccgccgcatcgtgtcccccgggccgggtgagtggccgggccgggaatggttaagcccaccgagctgcggctgcctagagcggcggcggcgacggcggcggcggcggcgggggccg

SEQ ID NO: 31039 - DNA, 30 bp, Homo sapiens
  chr7:6655418-6655448
  hyper
gccgccgaccccaggcggggccaccccgtg

SEQ ID NO: 31040 - DNA, 30 bp, Homo sapiens
  chr7:6655736-6655766
  hyper
ccgtggccttcacctcgcagcctctgctga

SEQ ID NO: 31041 - DNA, 153 bp, Homo sapiens
  chr7:6703555-6703708
  hyper
gtggagcctcctgcccgggcctgtgtcgcggcagagcctggcgggctttgtgcgcaggcgcttgcggcttcgcggggctgaccgtgcgcttcgcctgcggggtcgtgctggggcggcgggtgagcctggggggctgcagagcgggcgcggggc

SEQ ID NO: 31042 - DNA, 94 bp, Homo sapiens; identical to SEQ ID NO: 8858
  chr7:6703709-6703803
  hyper

SEQ ID NO: 31043 - DNA, 66 bp, Homo sapiens; identical to SEQ ID NO: 8859
  chr7:6703804-6703870
  hyper

SEQ ID NO: 31044 - DNA, 173 bp, Homo sapiens; identical to SEQ ID NO: 8860
  chr7:6703915-6704088
  hyper

SEQ ID NO: 31045 - DNA, 223 bp, Homo sapiens
  chr7:8473070-8473293
  hyper
agagacagccagagtcggagcacagaggccgagtctgggagacgctggttgagtgggaggtgtcagtagcgagggaggtggtgacggctcgaagcatcccccgtcctcctcctcccccttcacgctcagcccagccggcggcgaggagtccagaggccaaggtcgcccagtcctctcggctgtctcgagctgaatggctggcagtctgcggctcccccgcctc

SEQ ID NO: 31046 - DNA, 607 bp, Homo sapiens; identical to SEQ ID NO: 629
  chr7:8473635-8474242
  hyper

SEQ ID NO: 31047 - DNA, 47 bp, Homo sapiens; identical to SEQ ID NO: 630
  chr7:8474515-8474562
  hyper

SEQ ID NO: 31048 - DNA, 271 bp, Homo sapiens
  chr7:8474839-8475110
  hyper
cactgccagggctggcgaagaaccagccgccgcctttagtccgagccgccgggccacccaacacaagggcaggtctcgctgccggagaagcctgggctccgaaccagcctgcacgcggctcagtgtgctccgccgcctgggaactcgcacccgaggagcgcagggggcaaggagcccctcaccctccctctcgtccgcccgcccgcctccccagctgcggaccgcgcgcttgctggtctcaggcgctggatttactcgcttttcaattttt

SEQ ID NO: 31049 - DNA, 119 bp, Homo sapiens
  chr7:8475321-8475440
  hyper
aggaagtttgagacgcgggagaatgcaggctgcgtgctggtacgtgcttttcctcctgcagcccaccgtctacttggtaagtcttggaaggttcggggctttcgcatttttaccccggc

SEQ ID NO: 31050 - DNA, 107 bp, Homo sapiens
  chr7:8476614-8476721
  hyper
gaatgtgtatttaaccgatttcagcttcaatccaagaaccctcaatgttgcctgtctttgcccctttatcgcctgaccgtagcagccgcggacgccagagggcgctg

SEQ ID NO: 31051 - DNA, 264 bp, Homo sapiens; identical to SEQ ID NO: 631
  chr7:8480763-8481027
  hyper

SEQ ID NO: 31052 - DNA, 959 bp, Homo sapiens
  chr7:8481339-8482298
  hyper
gataatatattttggcggcttcttcaaacccctccgcgcgcccaagagcgcgtttgcgcattttccaagtttgccctgccctcgcgggttggtggctgttgtttaaacttctgatgagcgcgctgcgtttctgctacgggatgaaaacctaattacctcctctgcaaagagctttccctagtatattttattgattgcggaggtgggagccggcagggggtctgtgggggtgggcggggaggggattctcttgctccggtgccctctgttgccgaaagttccttaggcgtctagtcaggggttcggggtggtggaaagcgagatggcgttgggagccagggcgttgggacggcacaagcagtggggtcccaggagcagcaagacagtagctcctctcgggccacggcttacgaaaagctttcctagctccttcttcctataaattaatgagggtattttactcgttcaagccggaaatacgatggggagggggagacacaggccgcatccagagcgcatcgcctcatctgcatgagaatggagaaccgggaggcttttcttgtactgtttctttctcccacaataagacaaattgctgcttagaaaaactgagtgtttccttagaaactggcttgcgggagctctgcgcgtccccgctgaacctgcctctggccgcgcctcgccatcacccccgccgccctaatggattctgaagcgaaggatcctagctgccgcggctaagggcgcagggggaggccgcgcgtcctcgccacaccggaaggagagggcatccggctcacacatcccaccctatgtcttagaccccgtcctcacacattgactttaaaaggccattttccttcgtcttctacaagaagcaagaaacttttttcgacgtaggcttcataccctcccttcggaaactcagtccgctgaccaaagccgcagtgttcaggccc

SEQ ID NO: 31053 - DNA, 156 bp, Homo sapiens; identical to SEQ ID NO: 2965
  chr7:8482669-8482825
  hyper

SEQ ID NO: 31054 - DNA, 1107 bp, Homo sapiens
  chr7:8482884-8483991
  hyper
cgtgatcaccacggagattttgcgaatccttcttttccccaacttctccccctacccagtctcccattctttcacagttcattaaatctacccctcccccgaaacagaaacgtgaaggctgtaacgaagagctagaagtgtctctagtaatgtaaaagtctcaactgacagacaaggaaactgaggcaaccaacttattcgcaagagtaaaaccctatggggagaagcgattcctgcccctcttcccccggcgaggaacacggctggagccacccaggcgccttccaggctaaggcgcctttagcggcgcgcaggggtgagggagagggtggggagagtcctaattattatgaatttctaaaggcgcagtaattattcacggggagcaggacaaaccatggctaggcagggaaatcgatatatttgctatcgaaagttcctggctcgcctttaatgcagacgaatgggggatgcagcctcattattttccgtggttaggctcgccagcgtggggcctgatgcagcgtgaaatctatcatcattagacccgggatggagcggcgggggggagtttctctttacttaccaaaccgcaacaacaaacaaacaacgacgaacaaccgccccctacaaacactcattctcacacaacgttgccctacctccctcgccgcttgccctggccgctgttgcacactcccctgggggctgtctgcacgccctagagcagacactgcggtcacttaaagtgcgcccagttcctccaccgcagcggtcacaccgttgatttgatccagaaataagacggatagtaccgagcgttggcgctaggggttgtctatgtcaaaggcgaaggttggctgggaagttctgtccgtttctcttgccttagcataggagtcaatccttttcttgtcacccgattctgcaaattctcgctgtattaaaggagcagagatctggcatgtagtgctccattaacccgtagcataagttagctcggacataaggcaagccctcgagaagggaacgaatcagaaggtgaaaagagcggtcggaaggtgaggaagagaaggtttaggcgcaacgcctcggaggtattctctg

SEQ ID NO: 31055 - DNA, 465 bp, Homo sapiens
  chr7:11871392-11871857
  hyper
cagatagagggtgggcgcctccgcctcgccctgcgccgcagccctgccggcgcccgggcgtagcagcagcagcaggagcagcggcagcggcagcggcagcggcagcagctgcaggacgccccggcgcggccccgcagcgccccggctcccggacgcccagcgcctggcttgcagccccatgccgcctgcagccactccagggtccagagccgtagcacgctcggcagggaatttttctccgctcttggaacgtcttttcaaagagtacagaaagcaaagctctttcctgctattgttcgcttcagatgagaaggagggagagcgcgtctaacaccagggaacaatagcgtccgcggtggtggccgtggccgctgccgccgccgccgccgcctctggcggggatgctgctgccgctgccattcctcgcagaatggcaggtcccggcggctccggaggcaactgtcc

SEQ ID NO: 31056 - DNA, 303 bp, Homo sapiens
  chr7:12151170-12151473
  hyper
gggatctgggcagagcgtgggagggcctgtggggcctggggttctctctgcgcacgaaatccggggcgggcactatgtgattcgagcccgctgcgccctgggctcctcgtgtcgcccgcggggaaaggaggagggagactgctcacatggcccacttcgcggcctgagatggagtgcgcgcagggcgtcagggcagagggaggcggggattcaggataaagagcggcctgatgcccagagccgggtgcccggacctcctgcctcctgcttctgatccctgcaagccgcccaccctgcgatcgc

SEQ ID NO: 31057 - DNA, 185 bp, Homo sapiens
  chr7:12151523-12151708
  hyper
cgtcgccggtcctgtgcgcctctggtggcgcgtgcgccctgtccttccctgcccaagagggagaaccctcagtgccccagcctcagctctgcgcacagcggtcccctgcatgtccgcactcctgttctgtactgcacgctcgccagagcacagagccccatgtcccattgcgagggtcccacaga

SEQ ID NO: 31058 - DNA, 424 bp, Homo sapiens
  chr7:12443294-12443718
  hyper
ggccaggaacatcagcgcgatcaccagcacgcaggctccgccaggcatcgctgcttccgcaggtggggcgaaaggcgtcgcagagcccgggccgcgggtgccaggaggatggggccacagcagcccctcgggcctcctttcttggattttctcagtctgttgctgcttggaacagggaagctccgcgtcctcgttctggggtgcacccagtcctttcgtgggatagagccttcgcgtaatccgtctgcgactcctcccttcccattttggctgctggctgacctgaaagccacgcccaacctgtccccatagcccagcgtgtaccggcagtggctccgccgccttggatgtcaccgtgcagtcgcacagccaggagtcaagctacagggatgtagctctccgcccgctgcgtcttgctgttcta

SEQ ID NO: 31059 - DNA, 30 bp, Homo sapiens
  chr7:12610212-12610242
  hyper
cagcgctgcgctccccgtgggaagcgatcg

SEQ ID NO: 31060 - DNA, 34 bp, Homo sapiens
  chr7:14029885-14029919
  hyper
aaaattagatcctatcgttcgtgggacagaaaca

SEQ ID NO: 31061 - DNA, 261 bp, Homo sapiens
  chr7:15725085-15725346
  hyper
cgagccactcagagtcggcaacttgcaagagaaaagtcaagaagcggcacccgcacgcacgcctgcccaacggacgctgcatccctgggcgcacgcccctccctccccagcgctgggatggaaggtcacgcttcacaatcgatttcacagccacttgtccttttttatcaaccttctggtaaactagtttaggactttggagggcttagagctgctggctgtatacgcattgctctcgaataaacacgtgtccccaaatat

SEQ ID NO: 31062 - DNA, 241 bp, Homo sapiens
  chr7:15725949-15726190
  hyper
agaggattgggagaacgggtgcaagccttgcgccgtggcgtgagggctgcgcaggcagccaaagagcgggtgttccatagcatgcaagtttcgggttccaggcagaagacttcacggcggttccaaaggccaccaccctctgtcactttttcactggaaaccgtgtgattttttttttaacctcccaaagcaatagcggtgcacttctgcagagctcggataatcccggtcctgagcccca

SEQ ID NO: 31063 - DNA, 391 bp, Homo sapiens
  chr7:15726686-15727077
  hyper
gaaaagctagggatacgcctatcctttcaggaacacgaaagaagtaatagggttaaaggaaaagaccagagctagtttggcgcaccctcgaagtttttcaaactttgcatcttcccgtgccccgggcgccgcagcgcgcctaggttttcgcagctggtttctgtcggtgggttgttaataggctgggacgccagatctgaggttgcggggatgagcaccatggcctggaaaaggcggttctcagtgcagaaagaagacggacctggttgggtgggtgggaggaaggcgtgagtctgaaagggttgcagatgcctgctccctggcatcctcacgtgcgatgccaggtggaggctcccttccccctctttcccggtcccgctcaatttcctag

SEQ ID NO: 31064 - DNA, 54 bp, Homo sapiens
  chr7:15727290-15727344
  hyper
agaattcttacatttcgatagctcccaaaattcactcaccgtgggcacttggtt

SEQ ID NO: 31065 - DNA, 30 bp, Homo sapiens
  chr7:16460326-16460356
  hyper
gcagagccccaggaccgcgagactatccgc

SEQ ID NO: 31066 - DNA, 33 bp, Homo sapiens
  chr7:16461245-16461278
  hyper
ggcaggcccagctgtcgccgcaagtggaaatgt

SEQ ID NO: 31067 - DNA, 82 bp, Homo sapiens; identical to SEQ ID NO: 8881
  chr7:18125980-18126062
  hyper

SEQ ID NO: 31068 - DNA, 76 bp, Homo sapiens
  chr7:18126082-18126158
  hyper
cgcttcagaaatcccaagtcgtcttaggttccctggtccttcccctgggggggaaaaaaaacgctggtgcagccca

SEQ ID NO: 31069 - DNA, 549 bp, Homo sapiens
  chr7:18126466-18127015
  hyper
gccgcccgctcagctcgcagctcgcagccgcccgctgccgccctcccgagccccccccgcgcggcggcggcggcggcggcggcggcggcgcgtcccgcacatcgcgcagcgcgcaccgagccggccgcgccgcgcccgccgctctcgccgctttcgccgcggtctcctcctctagcgcccgccgcggccggtaaatctcggctggaggagcagcggcggcccccgagtcaactttcattccctttttgcttctgcctcaccattctcttctcctcctcgaaagatggctgtttggagaagggggagaagttaagaggtcgccagcgcggagcgaaggagggcgcgatagcctcagcaggagcgggcggaggtgagtggcaccacggcagagtccccggctggtgcttgaggaaagccctgggaattgggggccaccggtcctcaggatgcgccgcggtattcccttctcgggttccgcaggttaacagcatctcagtccggactctgatgccacttgccttgcatctcgcagcccggagaccggtgggt

SEQ ID NO: 31070 - DNA, 37 bp, Homo sapiens; identical to SEQ ID NO: 633
  chr7:19145857-19145894
  hyper

SEQ ID NO: 31071 - DNA, 154 bp, Homo sapiens; identical to SEQ ID NO: 634
  chr7:19146031-19146185
  hyper

SEQ ID NO: 31072 - DNA, 345 bp, Homo sapiens; identical to SEQ ID NO: 635
  chr7:19146237-19146582
  hyper

SEQ ID NO: 31073 - DNA, 957 bp, Homo sapiens
  chr7:19146942-19147899
  hyper
cttttctggagtcctcggaacagctggccggggcttttagcacacgggacgggaccttcgcctttgcctgtttttttttcgaccaggagaagcaggtgcgagagtctggggcttaggaggtggaaggcggggaaagagaatccactaggtcctcgtgtagagaacaacagtcgctccttagatattactccaggacggaaacctgattgcaaaccgctgttccttcgaaacttgcaaaacccggaacagaaaactcccgcccagccaattttagctctcgctgaactctcccgcctgcgttacgtttgcacagcaactctttgtaaatgtccgagtcctctcggaggaaagatcgttagggcgacgagaacattaagaggggacctggagggcagatatcctcgatcccaagagagcaactttgtcgcctcagaaaacacgccaacttccctcctgctctttccttggtcaactcagaatcaaccgattgtattgaaatctcctgaaatcccgaacagggattggcccagtcggcttctgaaaccgaggccggggaatggcaggaatggggggcagagaggatcggaaagaagagtccttcccccacagacattcccagctgggacacgagctcgctcgcagcgcgtttatggaaagagggggcgctgggaaccgcgctggcggcgagcagactccagggtcgagattattcgacacgtgtcttttattcctcacaatccatttcttacgggtgatttatgaacgaatctctttgatcagggacggttttatctgtccactgctacagatgacagatgcggctgctaaaatgcctggtccccgctgcctaaaaggttgctcccccccttcccaaatgctgttgctttttctctggcggtccccaccccctgcttcttcgttctccttccctacccccaaccccgtttgctgtcttag

SEQ ID NO: 31074 - DNA, 62 bp, Homo sapiens
  chr7:19156000-19156062
  hyper
aaaacggtccttacccgtgaccctgggtgtctctgtctcccctcctgtcacgcacactcacg

SEQ ID NO: 31075 - DNA, 8 bp, Homo sapiens
  chr7:19156125-19156133
  hyper
cggccttc

SEQ ID NO: 31076 - DNA, 443 bp, Homo sapiens
  chr7:19156303-19156746
  hyper
ggccctgctgagggggtggggggctccgcctgctagtgggacgcggacatggaccaggccccctccatcctccagaccgagaaggcgtagctgagccgctcgtgagccacatagctgcagcttgccatcttggagtccagctcgtcgctctggaggacctggtagaggaagtcgatgtacctggccgccagcttgagggtctgaatcttgctcagcttgtccgagggcagcgtggggatgatcttccgcagcgcggcgaacgcctcgttcagcgactgggtgcgctggcgctcccgcacgttggccatgacccgctgcgtctgcagctcctcgtaagactgcggactcccgccgccgctgctgctgccgccgccgccgcccgcgccgccgccgccgccacagcccgcagacttcttgccgcgcttgccctgggccgggctgcc

SEQ ID NO: 31077 - DNA, 138 bp, Homo sapiens; identical to SEQ ID NO: 640
  chr7:19157055-19157193
  hyper

SEQ ID NO: 31078 - DNA, 69 bp, Homo sapiens; identical to SEQ ID NO: 641
  chr7:19157194-19157263
  hyper

SEQ ID NO: 31079 - DNA, 303 bp, Homo sapiens; identical to SEQ ID NO: 642
  chr7:19157264-19157567
  hyper

SEQ ID NO: 31080 - DNA, 382 bp, Homo sapiens
  chr7:19157633-19158015
  hyper
cggtggcagccccatccggagtggctgtgacagcagcaatggcaacagcttctacacagtgggtgatgtctcatctcgcccaagagccctctaggtccgtggggccgatttgggattgctggggctgggggggtggtgtggcgcggggtgggggggcatgccaagaaaagtgtcaaccgcggagcccacccaatggtcaggtagacgaaccccttggagttccaaaggccaaaccgcggcggcccagcccggaggtcctgggcgtttctgaagacgtggccgcgccgcgggggctgaggatttgcgtcccggcctgctctctcgcccttctgggccctcctttcccctctacaacgacccagtctgacgctccccaacatcc

SEQ ID NO: 31081 - DNA, 30 bp, Homo sapiens; identical to SEQ ID NO: 8895
  chr7:19183647-19183677
  hyper

SEQ ID NO: 31082 - DNA, 368 bp, Homo sapiens
  chr7:19184058-19184426
  hyper
caggctttttaaaaacgtaagaatttctactttattatctctatgaaaaaaaaaatgtaaagaagagaggttagattttatagaagctccaaagtctgccatttgcgaggagggttcacttcccacccacccagcccacggaagctcttaggagcagcctgaacggccccgactcagcctcacgctctctgacttccccgctcgcccctgaccccgacttcacttagggcggtcgcgtagatatgaactctacagcagccactctgctcagcgcatgtggggatcttacaatctcgaccccgacctccagaagaccagacgttctgtcttggggcctccctcccggccctttagcctcacccagtgcc

SEQ ID NO: 31083 - DNA, 166 bp, Homo sapiens
  chr7:19184669-19184835
  hyper
cggcctggcgctgggcgtaggtgatcacccttttcctcttggggcggcctaatagggagacacctcttccgcgctcctcttcctcctcctcttctccgtccccctggtccacttcgcactcctcttcttctgggtccccctcttcaaaccgcgccatcctcctggg

SEQ ID NO: 31084 - DNA, 317 bp, Homo sapiens
  chr7:20816259-20816576
  hyper
cagctttccggaccccggagagagggggtgggggtgtgggctcacatcgccggctggcttgagggaggagagtggtggcggctccggaggtggacgtgtcaattatatcctggagctccgggaagccagattgcttctaccggcggctgcaggggcttgcaagcgaagataggcggccctccttccttccccactgtgggggattggggtcagtggagcccgtggatttagccacgaggggacatgactggagccctgtcacgcgcaggtgtgcgtctccgagagctctttcaatataagtgcgggagaagatttat

SEQ ID NO: 31085 - DNA, 83 bp, Homo sapiens
  chr7:20817170-20817253
  hyper
agtcacacttaattgcgccttctttatgataacagtgtggggaaatgtgggcaagttccttcactcgtcgagtctgccaaccc

SEQ ID NO: 31086 - DNA, 309 bp, Homo sapiens
  chr7:20817648-20817957
  hyper
ttgagagcccacaggcgagcggggcggggggaggctccccgcgcattcccaccgtgggtttgcccaaggtcagaggcccgggactggcggggcgggtctggccggcattgcccgcgctgagcgcgctgcagaacgggagcagggcacagggtggcgctcgctgtccgtgcagcgggcggaggcggccgcggtgcctttgtgtgcggtgggcgcggcgatgggctgctccggcccgcagcccgaggggagcggcgggcccgggccggggccagggctcgcggggagaccccagaccaccacctcactctt

SEQ ID NO: 31087 - DNA, 305 bp, Homo sapiens
  chr7:20817982-20818287
  hyper
cggatcgccagttcggaaccctccccgggagggccccggggtctttctcaatgtactgggcacttcgaggagctgggaagaggaaagcggagggtagcgtttagaaagggagggaaatcctcccaggctcaaaacctctcgcagaattcattcgaaaagagaacgaagggaactttgggcaggccggacctcggctcagcgccctgcgagagaagcagaggtcgctgccagcgtttcctcccgcgcagcaagaaattggtgcctgagaagcaaagttgaggaatgggctttttaaaagcggcagc

SEQ ID NO: 31088 - DNA, 70 bp, Homo sapiens; identical to SEQ ID NO: 645
  chr7:20823261-20823331
  hyper

SEQ ID NO: 31089 - DNA, 497 bp, Homo sapiens; identical to SEQ ID NO: 646
  chr7:20823382-20823879
  hyper

SEQ ID NO: 31090 - DNA, 120 bp, Homo sapiens
  chr7:20823919-20824039
  hyper
cgttgcggtgcccgggctcggggggctgcagcagctctggggagtggcagggcgggctgcccgcggcgctgtgctcgctgtcggtgtcgctgcccttcttgccgccgctgcccgagcccg

SEQ ID NO: 31091 - DNA, 345 bp, Homo sapiens
  chr7:20824475-20824820
  hyper
cgcgccggccagcggcgacggggccgagtccgggtaggagccgggtagcactggcttgaagccgtccatgaggtgctgcccggcggggctgagcaggtgcgaggaggcgccgctgctgaaggccgagtgactcaggcccgagtaatccgagttgtagcctccgagcggcgagtgcagcgaggtttggagccccccggcggcagggtgcagcgagccgggcagcgcagccgcgctgttcgggttctgcacgtcgatccagccggcccccacgtcccaccagctggaggcgccggccgagcccacctcgcccgcagcacccaggcccgggtgcgagggcttaaacca

SEQ ID NO: 31092 - DNA, 131 bp, Homo sapiens
  chr7:20824835-20824966
  hyper
cgccatgcccacccgcgggtagatgccctgcagcccgtccacagaggtgtgcaccttggagatgaacaccggctggtgggagccgtcctgcgagtgcgcggaggagccgccgccgccgcccccgccgccgc

SEQ ID NO: 31093 - DNA, 227 bp, Homo sapiens
  chr7:20826611-20826838
  hyper
gcgccgtgaggtcatcggcgccgccgcctgccgccgtggtggaagggggagtgggagcggagggggcgggggcggctgcgtgtgttacaaagcgcaaagcgcgcgctcgcgtgtatgagtgtgtgtgtaacaatgtaactgtgtgcgagtgtgaccaggcgtaggagaggacagtgcggagactggagggaggggggatgggggtgtgacaccgtaacagtgacagt

SEQ ID NO: 31094 - DNA, 99 bp, Homo sapiens
  chr7:20827355-20827454
  hyper
ccaccttttctttcccggctctccaacgaaatagtagaaaggttgagaggctaagggttatttttagggatgcgttgggacgtggatgcgcgcctgcgc

SEQ ID NO: 31095 - DNA, 93 bp, Homo sapiens
  chr7:20828502-20828595
  hyper
tctgaatgattttagcgtgttgagaaggcgtgacaggccagcccagaaggaggaaggggtgggggaaggagggtactccgtttaacaaataaa

SEQ ID NO: 31096 - DNA, 265 bp, Homo sapiens
  chr7:20830670-20830935
  hyper
gggagacagagcgaacgcagtgctggcactgcgtccctggcctgcgcctctcccagaatgggaagacgacccccaaccccttgactagtgtgcggggtcctcgcacgcggacgtgttggctactaaataaagcgtgaagagggatcgctgggtagctgagcgccgccggcggccgccgggagcagcgagctgagccaggttgggtgggggtgtttcctcgtcgagagctctctggtcaaagtttccttcccgctggaaaacaaaa

SEQ ID NO: 31097 - DNA, 30 bp, Homo sapiens
  chr7:20831186-20831216
  hyper
aaatgggaacttccacgctgaacaatagcc

SEQ ID NO: 31098 - DNA, 198 bp, Homo sapiens
  chr7:20833089-20833287
  hyper
tgctttagaatcattcgactctgagtccaggaaaagcagggggtgtggtggcagtgggggtggctagggaggggtgtatatgagtgggggagccgatttcatctcggatcgcaggaagagaacttgctcaaaagaatttttccccagcaaaagtggtataatttacagcgcaacttaataatccgaggggcaatgcaa

SEQ ID NO: 31099 - DNA, 30 bp, Homo sapiens
  chr7:20833492-20833522
  hyper
gcatggcaatgagtccgagcaggagccctc

SEQ ID NO: 31100 - DNA, 30 bp, Homo sapiens
  chr7:20834600-20834630
  hyper
ttgaaacatttttcacgactgagttcaggg

SEQ ID NO: 31101 - DNA, 30 bp, Homo sapiens; identical to SEQ ID NO: 8910
  chr7:20836099-20836129
  hyper

SEQ ID NO: 31102 - DNA, 208 bp, Homo sapiens
  chr7:20836779-20836987
  hyper
aaggaaattacaagccgatgctgattgacttttgaaaggcctggcacgtcccagtctatataataactcagttggaggaagaacctcgaggaccgagtgtctccagatcacttaatgcatcggcatccaccacgctcggctcatgggcagggcccccgaggctgccaccaacccacggagccttgaggagctgcgcttccccgcgatg

SEQ ID NO: 31103 - DNA, 50 bp, Homo sapiens; identical to SEQ ID NO: 8912
  chr7:20838460-20838510
  hyper

SEQ ID NO: 31104 - DNA, 105 bp, Homo sapiens
  chr7:21582536-21582641
  hyper
gagggcctctcccctcggccttggccttggcgtatactgggcggtggcgcggtgcgctcactccgcccccagcgggctggggcggggacaccgtcccccgggaaa

SEQ ID NO: 31105 - DNA, 161 bp, Homo sapiens
  chr7:21582791-21582952
  hyper
cgctcacttcggggggcccagagtctcgggtgaggagccagccggcctcgcgttccctcggacggttgcccaatggcagcccaggtggcagcccgggaggcgcgagacttcagagaagccccgacccttcgcctaacctcgggggccggcctggaggcagt

SEQ ID NO: 31106 - DNA, 15 bp, Homo sapiens
  chr7:21583263-21583278
  hyper
gggagacagcccagt

SEQ ID NO: 31107 - DNA, 84 bp, Homo sapiens
  chr7:21583303-21583387
  hyper
cgctcactcgggcactttaacaaacttggcttgaagtccccatcctgaggcccgcaggactcctccccacgtgcacccactctg

SEQ ID NO: 31108 - DNA, 80 bp, Homo sapiens
  chr7:22539833-22539913
  hyper
gcctgctgcaggccccgcctccttgtcagttgcgcgtccagcgccacctgctggcgccccgcgtccgcagggttcgggaa

SEQ ID NO: 31109 - DNA, 572 bp, Homo sapiens
  chr7:22589298-22589870
  hyper
ctcaaactatctcgacggtcaggcccctttcccaggtggtgccgtggtggccgtggggtgaggaaaatatgtacggctgtagcccgtccatttctcatcctgggatagcgaggggtttccggaggaggcgtcagcggtgggaagtgggagaaagcgagcaaaaggggcgggggcgaaggagcggactcgcctgctgccgcgggggcgggaatccgcaagccagcctgggagaagggacagaacagcggctgatccttccctgggctagggaaggaaaataaactgtgctggcctcggagtgggggatggagaggggcgatggcgctgcatctgcaggacgttgcaagggctaggagcgggcaagactagtgtcggcaggaaggtagtggtggtgatggcgggggtgtgtggcaaacagagcccgagcgaaagcctgagaaggttctggttgccccccagcctactttagtccctaaccctccagcggggcgaggagggagcgcatcggagaggtacctgtgcgatgggcagcggtgcttggcacctgagcgtaggtacgatactcagcaagg

SEQ ID NO: 31110 - DNA, 123 bp, Homo sapiens
  chr7:23287228-23287351
  hyper
ggaagagagctgagccgctgtaaccctgggcctgggattgcggggacgggacgggtgggaagcggccaaaggcgcagcggcttctggtcagagccgcagaggcctgagacgtgggccgcgccc

SEQ ID NO: 31111 - DNA, 92 bp, Homo sapiens; identical to SEQ ID NO: 2987
  chr7:23287532-23287624
  hyper

SEQ ID NO: 31112 - DNA, 1569 bp, Homo sapiens
  chr7:23508102-23509671
  hyper
ttgcctttttgggaccgagtgctcaacttctatgggtttcccgtgcagttctattttacctgcggacacacaagaagtgagacggtcggccgagttcagcggctctccctgcccgaagacccgcacagcccaagcggcgacacaaatggcctcctgaggccctcgaagggcccccgaggcccggacgcggctccaggcggagggagaagccgaccccctcgagcggcgtgggcatttaactcgcagatggttggggagcagggtccgctggcgggcccactacttgggtatcagtccagtctccaagcctcccccacccacccctgggggccaccaacaccacgaggcccgcaagagggacgcggcccaccctctcaccgccctggacacgctccacagggcagactcggggcagggggctcccctggctttcttcaggagggggcgccctggccctgccctctgcttcagcccagacccgccgggaacactcagcggtgggcttgaggaagacagggagtggcgagaaagggtcggggacggcaggggagaccacgaacgggagaactggcagaggcgcagctcggcacaggctgaaccaggcgcgaaggacggcgaggcgcccgcaccacgtctgaattgattaaaagggaagccgaaaggcacggggctcccatggggaccccaacgcagccttccccctgggcgtcctgctccgcccggcaccgtccctcgccctggcggagccatacccggaggccgcagccccgcgccagggcccggagagcggcgggcggccggtgcgtggcggcgactcccttccaggcgaccagccgcccccgcccacctgcccctatcgctcgtcggaccaggggaggtggaacggggaaaccgggcacacactctctcctcccacagggtggggaggaagcgcggggccgcctgtgcgaggcaccagcctcgcggtctcactcggcagcacggtcgaggccactttccgttctccacggccgggggtttcggggcgcagcacagacagcgccgtaaataacgaccgaggaaagcaggaaggaacgaggcacaggcgggcattctagctcggcccccgaggcccagcgtgccggggcctggagcacgcgcctgggcccgggcggggcgccgggggagcgcgcctcccccagccccgcgccccccttagccagcgccggggctttcttgacagcgcgttcgccctcacccagcaaaccccggccggggaagcagagccgcgggccggagtgggagccggagctgaggagagccccggcccccacgcgcgtgggtgtgggcgctcaggcctcacccccgctcccccagcgcgccgggcctggggcccgcggagccacccggtgggcctgggcgggcggtgcagggctggggcgagagcccgggtggggccaggcccgggcccacctgaaagcgcctcgatggccttgagggcccagctctcgtccgggcagtccacgaacgcgtagccagtcttcaccaggaagggtcccgacaccgggatcttggcgtccttgaagatac

SEQ ID NO: 31113 - DNA, 108 bp, Homo sapiens
  chr7:23510878-23510986
  hyper
ccgcagcgtcctgggcgggtgtctgggcgacacctcctccgcctccgcctgcgctcgcggtggctctcggcttcgcgtttgccattggttgcgcgattcagaaaaggc

SEQ ID NO: 31114 - DNA, 906 bp, Homo sapiens
  chr7:23513519-23514425
  hyper
cctctggctctgccccgagaaagagggcgggatcctcacggctcacagtggggagggtctttcgtcggccgccggctcgcctcggagggcctggaccactggaccgcccttccccggggccctgccgcgggaccgcgggcttctggctcctcctggggctgcgtccgtatgcgcggagcgtgtggccgggccgtcgccgcgccaccccacctgagtccgccggccagcgcggggacgcaccgggcagcgtgtgtttggcgaccctcccgcacctctggtctcagttgcgtgtgtgcacgaggggttccatagggcccagggatgcttggtacccacgggggagaatccctcgccgaaccctgcgggtctgcggggcgggccgcgagactggcgcgcaaaagcggctccaaggcggggctcccgcgctccccggggccggcttgccgagtccaagttgagcaaccggcgtcgagagagacaccgcccctgctgcgggcgggggcctctcctcgcttccgattggctgacggggggaacctatcgccgtcggccgcctccgccagagcggtttgctggttttcattcattggccccggagccgcccctggatttccatcttttgtggcgcgaaaataaccctttgctccctcgttggttttgttgaggttgaggggtgggactgtgttcccctctgctcgctctcgtttttcctgccctttaacagctcgcccccagccccaacccccaaggaagaaagagggaggtaacgctgaggaagggtggaaagcagttctgcgtccgtgggtggagcccgccccttggctgaccgcatggtgcccgcacggtcccttcccttcccccagcgtccagcgcccggaggttctggatttgcgccatgctcagcag

SEQ ID NO: 31115 - DNA, 36 bp, Homo sapiens; identical to SEQ ID NO: 8922
  chr7:23514666-23514702
  hyper

SEQ ID NO: 31116 - DNA, 156 bp, Homo sapiens
  chr7:24796478-24796634
  hyper
gagctctctagataccggagcaaagtggagggggacttttttccgtccagagagactgaactccgtatctgttccgcggtccgcctccctgcacacacgcccccgagccgggagagcctccgcagcacccagagaagagaccggaacacaaaggat

SEQ ID NO: 31117 - DNA, 15 bp, Homo sapiens
  chr7:24797022-24797037
  hyper
ccgctgctgggtccc

SEQ ID NO: 31118 - DNA, 543 bp, Homo sapiens
  chr7:24797067-24797610
  hyper
cggaggagcctgcgctgggccggcggggggcgggcgcttggggagggcggagagagggcccgcccgccgggacctttgctcggtccgggcgccccagagccgcgggactggccgccggaggctgcgggaggggcccgggccagacctcccagaagccccagagagagccgcttcccctccttcgtgtgactctctgggagccgggttgctgacggcccagcgctcagccggagtccccgcgcgcttttcgggactcacccgggagatgtcggggcctctcgggaagagtgggctgcgcctgccttccgcggccgcctcgcctcttcgctgcgcgggaccgtggggtttgagagcggcgcctcctcgcggggccgaacccgccacccacagtggagtgtggactgacaccgcggcctcacggttcaaccaggaaagtccaaggcctgtccagcctgtgggagcccctaatgcccgtgcctggagtagtatctgggtgtgtggtgcgacagtgcccacacttaggcctgccgctaatcagtgatt

SEQ ID NO: 31119 - DNA, 297 bp, Homo sapiens
  chr7:25891946-25892243
  hyper
gccttcaggccgccccggcccctcgtgggaatgcgccgcgccccccggactctggagcggcccgaccctgcttcccaggccccgggcaggcgggcgggcgagacacaaagcaggccccgcgggcggtgctccgggtttcgcgagggcggcggtgcgcttgattgatggattcacggcgtttaacccccgccgcctcgccggaggcggccgatccagctgcggccgagggcctagggtggccatgggcccggcccccgcgtcctccgcgcccccgccccggctcgggagggctgcccc

SEQ ID NO: 31120 - DNA, 199 bp, Homo sapiens
  chr7:25896420-25896619
  hyper
aaattccttccagatcgacctcagtgtgggtgagagcgcagtctgtgaccaccagcgcttctgactcagcggaaaacgccggcaaacaggactacacctcaccgcggcggcaaaagcggcctcagctccagcactcacagccaccactttcaccgtcgccccgccaccaccaccttcgctgcctcaaccctgagagaga

SEQ ID NO: 31121 - DNA, 259 bp, Homo sapiens
  chr7:25896679-25896938
  hyper
cacaaacacctctccctgctgtcaatcatacatgcgcgccatagcgcgcatgcgcactggtggactccagcccccaccgatcctacgccctgtctctgcgtctgggaccagacgcaccaataagagagcggattcgggggcgggccacaaggaagtagccaatgagagcgcggttggaagccagggctagagaggagtaaatccttctgtcgtccccgttctgccgcccccgcgatgatttatgcgtcctttttattat

SEQ ID NO: 31122 - DNA, 304 bp, Homo sapiens
  chr7:25902345-25902649
  hyper
gtttaataaagagggcgtgtttattttgcataaatagtgggcgggcacccagggctgctttgtaactcgagaacccggtgtcccgcctgtctcccggggggtatgggcgggtctcccgccagcctcgccagactgagccaagggcctgaaggaaataaatggctttctgaaaaaattcgtcttaattcgcccttttgagagaattctgtttctaaatgcatttttttcgttggttcttacaagtcgttaagagttgtaacatgaaataagtagagatcaccaatctatccgcccccaaattaat

SEQ ID NO: 31123 - DNA, 36 bp, Homo sapiens
  chr7:25990174-25990210
  hyper
tcccggtcttccagccgcccgcgcccagccccggga

SEQ ID NO: 31124 - DNA, 41 bp, Homo sapiens
  chr7:26192685-26192726
  hyper
gaggtaggtgcagagcgggaagcgagcgaagtgcggcgtct

SEQ ID NO: 31125 - DNA, 310 bp, Homo sapiens
  chr7:26415774-26416084
  hyper
gccgcctgttggttgcggcgcctccgcggcccgcgcgcatcccccgcgctgcgtcccgcacacgcgcgctcccgccgcgtcccgcccgggccgctccgctggcggcggcgactgggctgcaggtagcgagccagccggcctcggtccggtaacccatggcaaccgccctggtaacccatggcaactgcgcggcggaaagaaaaaaaagaaccgtggtggggcggggggcggcgggcggtgaatgggaacaacgaccgcaaagagacagcgatttaccgcgcgggcctgcggctcccggccgcacctgctg

SEQ ID NO: 31126 - DNA, 138 bp, Homo sapiens
  chr7:26416380-26416518
  hyper
gaggaggggctacaccgtgctgccccggccccatggggcccggcccccgagggtccccgcgagcggacgcggtggggccgggcaaactctacgtgccctaaattttgtcatctgcacacgcatcgcacacattagtta

SEQ ID NO: 31127 - DNA, 34 bp, Homo sapiens
  chr7:27128016-27128050
  hyper
ttgccgcagcctagccggccgggggcaggcgctg

SEQ ID NO: 31128 - DNA, 505 bp, Homo sapiens; identical to SEQ ID NO: 651
  chr7:27135266-27135771
  hyper

SEQ ID NO: 31129 - DNA, 445 bp, Homo sapiens; identical to SEQ ID NO: 652
  chr7:27135979-27136424
  hyper

SEQ ID NO: 31130 - DNA, 365 bp, Homo sapiens
  chr7:27136425-27136790
  hyper
acttggaggggcggatgagccctggaaactcagagctcgccggaaaaggccgggggcggccgggctcttcttccccaccttccctctctcgtcgctctccgcccctttctctttcccactcagttttgcaccgggagccctccgggatgcggagctactcgaccgccggatttttaggggtaggaggcgggggagagagatgacgctggcggacgtggccagcgcgggggccgggcggtgcgctgcaggccatctgccggcgccctgagacccaggagcctccgcgctcccgcgtgggcctcacagggccggtccacagctccaacatagtagctgaactcccttcgttgcgttcctctttttct

SEQ ID NO: 31131 - DNA, 892 bp, Homo sapiens
  chr7:27190219-27191111
  hyper
tacaggtagtctctccgattgcagaatcccaaagccagagtgttccctgaaccagcgtgcgcccccagaacgccttgggacgcgcagtttggacagaagcagccatgacgtgccaggcggcctgtgcaaccagtctccatggtgctggagtgggggtgggggaggacccgagtctataacggcgtccagctccggtcaggggtagccgaggcggggagatttcccggccatataggctctgggtgatcgccccccaggtccccttgcgtccccctctaccctgcttgctgggaaatctctgaggggccagtacagcagtcgcgccaggctgcaagaggcgggctgcagctggcgccggtcccggcgacggccacggcgtggcagcagcgagcgccagcacggtcgcaataaataatcggcccgcggcagccgcagtcaggaaggcggcggacctaggatgcaaatgcgccgctttatccgccccgagcgcacgcagagcacgggctaacgtcctaaacatccacagccccttcctatttatcgaatccataccaagatattgtctcaagttggggaaacaacaacccaaacaaaaaacaaacaaaaagaacctcggactcttttcttgtcgctgtccgaggagttctcggggcaaatctggtctgatgtgcacttaggccgagctacagttcgagccaccgcgctacgcaaagccaccgccagcagcacgctctgcgcttcctcccgggcagctccaccatcctctccccgctcgcggaaggtggggagtgcggtcgccagtccgttgcgccaaggtggattggggggtccccctatcgcccagactcggtttgcgtccttccttcaaccttagctgcgggaccctgccacg

SEQ ID NO: 31132 - DNA, 47 bp, Homo sapiens
  chr7:27191507-27191554
  hyper
aacccaaagggctggcggggaacacagtgtgccgggccacttccttt

SEQ ID NO: 31133 - DNA, 16 bp, Homo sapiens
  chr7:27195586-27195602
  hyper
atgctatgggctccac

SEQ ID NO: 31134 - DNA, 27 bp, Homo sapiens
  chr7:27195866-27195893
  hyper
cgcctttggcgaggtcactgcagagcc

SEQ ID NO: 31135 - DNA, 1 bp, Homo sapiens
  chr7:27196152-27196153
  hyper
c

SEQ ID NO: 31136 - DNA, 132 bp, Homo sapiens; identical to SEQ ID NO: 658
  chr7:27196154-27196286
  hyper

SEQ ID NO: 31137 - DNA, 351 bp, Homo sapiens; identical to SEQ ID NO: 659
  chr7:27196287-27196638
  hyper

SEQ ID NO: 31138 - DNA, 368 bp, Homo sapiens
  chr7:27204402-27204770
  hyper
ggacgaaggcaggctcgagagaaacctggcgggccagcagatccgggaggccggcgtggaggcggcggcggatttgaagggaggagacacttactgggatcgatggggggcttgtctccgccgctctcattctcagcattgttttcagagaaggcgccttcgctgggttgtttttctctatcaactggaggagaaccacaagcatagtcagtcagggacaaagtgtgagtgtcaagcgtgggacagtcaccccttctggccgacagcggttcaggtttaatgccataaggccggctggagggcaagcccgcgaaggagagcgcaccgggcgtgggctccagccaggagcgcatgtacctgccgtccgg

SEQ ID NO: 31139 - DNA, 116 bp, Homo sapiens
  chr7:27205265-27205381
  hyper
cgctattaatggtccgatgttttgcagtcataatttttatagcaaaagccatatgtttttatgtaaagggatcgtgccgctctacgatggggtttgttttaattgtggccaacgac

SEQ ID NO: 31140 - DNA, 13 bp, Homo sapiens
  chr7:27205382-27205395
  hyper
attaaaagatcaa

SEQ ID NO: 31141 - DNA, 148 bp, Homo sapiens
  chr7:27205642-27205790
  hyper
agccacacaggctggcgggaagtcggaaacgaccaacagattcgtttgcctcgccgtggctcccagctgtaaaaatttacgaggacttggaaaggttagactgttgtgtttggttggcgagctccctgtaaataatccctgcggtccc

SEQ ID NO: 31142 - DNA, 165 bp, Homo sapiens
  chr7:27209508-27209673
  hyper
tgcagcccagcgagccggcgccaagaggcggtagccgtggaaggctcgaaagcgccagggacggtacagatcccggctccctgtctggccccggcctcccgcctctcgctctccccctctccctcctagctgcccgcccgccggggcgcgcgctcctgcgccccc

SEQ ID NO: 31143 - DNA, 485 bp, Homo sapiens
  chr7:27212499-27212984
  hyper
cgtaaactcgaacttcgccggttaatgggcttatttattggcgctggcggctgcttattttggatgccttacaaacatccgcgctatctgcgggcgagctactttccctccctccccctccccccgcgtgggccgcgccgcgcaggctgggcagggaccagggctctgggtcctcccggccacaggaaagagcgcacaggagggggcctgctcgctggtgtcctcgtccctagtcagggggagctgaggccagcgccgaggacgtcttgctgtggggcgctaagccggacatgaattttactgcgtccccacgcccaaatattaaaaagcaagttcacaaggtcagcctgcctgcagcttgggccaaggccggccggctgctgcgcgggctcctagttttctgatccttctcctccttgtgtctgcctgtctgcccgcctgactgcagccctctgcagccctgcttacccagggaatccttctcc

SEQ ID NO: 31144 - DNA, 796 bp, Homo sapiens; identical to SEQ ID NO: 661
  chr7:27213188-27213984
  hyper

SEQ ID NO: 31145 - DNA, 277 bp, Homo sapiens; identical to SEQ ID NO: 662
  chr7:27213985-27214262
  hyper

SEQ ID NO: 31146 - DNA, 37 bp, Homo sapiens
  chr7:27214329-27214366
  hyper
cgcagaagctgccactagtccccggtgtactctaacc

SEQ ID NO: 31147 - DNA, 448 bp, Homo sapiens; identical to SEQ ID NO: 8945
  chr7:27219396-27219844
  hyper

SEQ ID NO: 31148 - DNA, 79 bp, Homo sapiens
  chr7:27223114-27223193
  hyper
ccttaacatctggggcggctgccgggtctttgtcagcctgagtcctggccaccagcttctgcctccccggccagccttc

SEQ ID NO: 31149 - DNA, 59 bp, Homo sapiens; identical to SEQ ID NO: 8947
  chr7:27223221-27223280
  hyper

SEQ ID NO: 31150 - DNA, 1035 bp, Homo sapiens
  chr7:27223574-27224609
  hyper
actttatctgttaaacgcgctcctagcgccgtcgttaaacagcgacgcctttgaatcccggccgggactggagtcccggcgcaacacatggcttttataaaaatctccggattacctcgctatcaaaagctcccgaagcccttgcagggggaatttacaggcgcccacctccggctccccagcctggagctggccccgagcggggtcgagctgctgggcttgggagctgagaagggaaaaaagggaaaaggggagttgtttttttttgcaggcatgccttggccggtgggtatttcacggccaatttcagcactcgccacgtgatcccgccttttataacaaagttttgttgggggaaacctaaaggcccttcataaaccttatatgcttataaaacagcatataaaaatttaacagcggtgctgcgctagatttccaactcccctttcataaagcgcagggcgctgcctttatacgtactggagccgccggccttgtcctcagtgtggccggaagacgactcggggctgctgctgctctcggggcgccgccgccgctctttctcctctgctgccgccgccgtctcccggcagccgccgccgccgccgctgtccgaacttgaagttgccggcgcgcccgttgcagccgccgccgccgccgcggaggtcgccgtggccgccgggggccccttctcggcgctcttgtccccggggtagtcggaggaggcgaggttttccggggtgccgtaggctgtctcgaaaaactggtcgaaagcctgtggcaggacgccgttcctgcccacggtgctatagaaattggacgagactgcgggggtggggtggtggtagacgttggccgagctcttggccagcacgtcgccaggcacgccggccgcgctgggcgcctgcaggcagtctctgtgcacgagctcctccgcggagtagcagtgggccagattgccgcgggggtgccatttagtggcgggctcaatggcgtactctctgaaggtcacttcgcgcacgggttggacctggg

SEQ ID NO: 31151 - DNA, 152 bp, Homo sapiens
  chr7:27224906-27225058
  hyper
gctggtcatgtgacccgatgttgaaattgacaagctgctagctagtccgggccttttccccccccctttccttttttttttttcctcctctcccctccctcccggcttcctttctttgtagccacctcaggggaagcaacagatcgtcactc

SEQ ID NO: 31152 - DNA, 98 bp, Homo sapiens
  chr7:27227776-27227874
  hyper
tggggctgagaaaggcgctccgggagcggctggcagggcaattcggcaggctgcaccgaagccgagtgcccggagggacttgccgcccggaagggggt

SEQ ID NO: 31153 - DNA, 30 bp, Homo sapiens
  chr7:27228676-27228706
  hyper
gaaggccaacgcctgcgccaggcttgtcag

SEQ ID NO: 31154 - DNA, 724 bp, Homo sapiens
  chr7:27232256-27232980
  hyper
gcctcgggctgcgggcggcttcggggcctacagcccagcggcgcggagcgtggcagaggcgcggggcgcagcgcagcccgaggctgcctcccgcccgggcggacggcgcggccgctggggtgcacagcgtagccccgcgtgcccggctcgctctccgttccctcggatagctcccaccgctcggctccgggctcagaaagcggaagtatttggtagagaaaaacacggtttcttttcagctcgtctcaaaatcccttttagagaaaatgctcctgtcaagttttatttcccgttgcaaaccaccttccacgctgccaagaattaagaccgggagagattaaatacccgattattctcctggggagggcggggcggggccgggaagtgggcacccacaccaaacattccttgaagtaggcttgtcctgatccagccgcgcccggggagccccacgaaggcccgcgcggcctgcggtgacgtcagcctgcagttgcggggccactcacccgcacagacacggcccttgctgttccgcgccgggacctccgccagccgtcctgccgcagccccgactggcccgcgtgccgtcagagggaggcccgctttacaccggcctgagcctccattttgagtagggggttcttgtagaagcgtggagggtttggggccgcgcctctgtccccgaggggcgcgacatcaggtagctctccgagttcacacccca

SEQ ID NO: 31155 - DNA, 30 bp, Homo sapiens
  chr7:27237273-27237303
  hyper
atttcagtaccttctcgtttcccctctaaa

SEQ ID NO: 31156 - DNA, 88 bp, Homo sapiens
  chr7:27238082-27238170
  hyper
aagttacacagggatcggaccccagccagggcataggcgacagctcgatctgagccacccgccttgcagcgcccggctgctctttgcc

SEQ ID NO: 31157 - DNA, 78 bp, Homo sapiens
  chr7:27238793-27238871
  hyper
gaggtggggaggctgcgcctgctctttggggcagtacatttggccgttccagccgttgggcagcgcccagggctggta

SEQ ID NO: 31158 - DNA, 32 bp, Homo sapiens; identical to SEQ ID NO: 8952
  chr7:27239141-27239173
  hyper

SEQ ID NO: 31159 - DNA, 618 bp, Homo sapiens
  chr7:27239225-27239843
  hyper
cgagcaggggctgcattgcttggcggcctctgcgcccgccgggcccgccgggccgggacctcccgaggacgacgcggcggcggcggcggcggctgcagcggcagccgcggcagcagcggcggcagccgacgggggcgcctccccgggggcgctgctgtaggcggacgcggctcctggcgccaagggcgccgggtgcgccatcaggttgcggcactggttggccgcggccgccgccgcagccgcggccgccgccgccaccgagaagttgccccctgccgccgcagccgccgggtgggggaagcccccgcccccggccccggcagccgccgccgctgcagccgctgctgcagccgccgccgccccttccatgttcttgttgagctcgtcggccaccaggccgccgccgttgtcgtagagaaacatgacggtgggctcgatccagcgggggtggaggagcacggaggctgtcatagcccgagccgcatggagaagaccccagtggcgctgttttaaaaagcccccaagaagtgaagagcgcgcggcgcggggccggggcccgagcgaggggggcggatcgcgccccgcggggtcgcgccaggcggccgcccattggcccgg

SEQ ID NO: 31160 - DNA, 77 bp, Homo sapiens
  chr7:27240230-27240307
  hyper
tttctttccaggaaccggcgcgtatttctgcagtgagaccacaggacggacatcggcgccttcggcttcgatggagt

SEQ ID NO: 31161 - DNA, 181 bp, Homo sapiens
  chr7:27240992-27241173
  hyper
tgaagaaccaagcagcgacccgtcttgtagctgccatgttttgtcgaggggttctgggggtcctgctgctttagagccacatacttccacttcctgattcactactgtgagctggtcagatgcctagaagaggaacaagcgttcaaagtgaaagtgggcacattaccggaatagtgctggg

SEQ ID NO: 31162 - DNA, 72 bp, Homo sapiens; identical to SEQ ID NO: 8957
  chr7:27244539-27244611
  hyper

SEQ ID NO: 31163 - DNA, 513 bp, Homo sapiens
  chr7:27244797-27245310
  hyper
cgcgggggacaccggcttgctggactgcaggggcccgtgccacccaggaagtgacctgcgggtcactcagccggggcgctgggcgagcgcgggacggcccggagaattccgtgcggctgcgacgggaaaaggacgaggggtctctgtacccgacgctgccactggcccaaaggaattttacccgcgagcgcccaccccaccctagcttgatgcttacgcccgcaacaaaacaggaaaccaggactgggcagtgcattctttaagtcaacaaatacactgaagacttcgagcgtttgaaggaaggagggggtttgcacgtaagcctggccccgccgggctcggctttctcgctgagaaagcggcgcaggcagccaggcggcctgggcccgcgggggtccatctcgccctagactcctaagaactcccacggccctgttcccagctgcgaattcttaatgcacaacgcgacggagggaaggaaattcaccagcgcagcgacgaggaaggggaact

SEQ ID NO: 31164 - DNA, 64 bp, Homo sapiens
  chr7:27245526-27245590
  hyper
gctggtgacatacttcgctggcgcatctccttactcactcttacttttccgacccctcaccatt

SEQ ID NO: 31165 - DNA, 165 bp, Homo sapiens
  chr7:27250066-27250231
  hyper
ccaggaggttgcagtcgctgtgggcggcggcggaggatgctcgcaggacaccgctgcagttgcgacctcttcccactagatgtcttcccagttaatcggaactcaagggcgctgtctctgctcctcgggccgagactcggtttcccctgccgctttttgaagtct

SEQ ID NO: 31166 - DNA, 175 bp, Homo sapiens
  chr7:27252380-27252555
  hyper
gcgaccgcacccttccgctgaagtcccccacttctgcccctccgaggtggggtgggggtgttctgaaataacggtggctgcagttagatggctgaggacatagaaagcggttgttatttattccaggcaccatcacaaaaggcttccaaaaatatcgagccgagatattttattg

SEQ ID NO: 31167 - DNA, 24 bp, Homo sapiens
  chr7:27252795-27252819
  hyper
tttttctttctctcccggattgtt

SEQ ID NO: 31168 - DNA, 284 bp, Homo sapiens
  chr7:27252895-27253179
  hyper
cggagaggcctacgcaggtccccggtgcccgcggccctcggaggccgggccctgcgtcttggccaggcactgggtggcagctgaggctggtggcccggagccctcgcggccgcgggcaggccccttcttgggcagggtcgggcactcccgctgtccagggctcttcggcaccctccttccaatcaggtcgctctcccctgctccccagactcaactcctccgaagctgctccaggttgaaatgtgaccgctaggccgactccctgggcccgcgagcagttctcg

SEQ ID NO: 31169 - DNA, 787 bp, Homo sapiens
  chr7:27264797-27265584
  hyper
agttcttttacacaacgtgaattatattgaaattgggctacttcatagagcttcgcctcagtggaggacagcctggaataggtgagggggtctcgaaaggaataccaggccggggagtactggcaagtgtcggaggggaagggcaggtcggggagaggatccccaggggctgggtgtctgcagggctccccgtaactcagaggggccggcggccgccgcccgaagcctgagcttttctcagcagatggagaattcatttttaacccccaggaaggaatgggctgagacatcagaccaccgctcctagagggtcaaatttcctccccataaatccaaaacattctctttagggagttccctccgtggcgcgcaaacccgggaagccgcgcgccctggggtttcttggcgggccgtgcgcgcagcctgaaccgccaaagtcgcgtcatcccgcatttgcctgcacccaggagtttgcaacccgcagagcccgcagaggccaccgccaagagtgcgcgccttggcgccccgtcggcctctacttcctcggatctgagccagcgccgctaatccgcaggctgcagcagaacctgtcgccagcttggagagtccctcgcgctgccctggcttcccggtccgcgggcgactcgcgctgctcccgggtttgtcgggaccccaggagggcgctcaagcctgtcggcccctacttgtgtgtagagaataggcccgggtacaccacctcagaaatgcagaggaagccggggacactgaagcccgggtggttgcagtg

SEQ ID NO: 31170 - DNA, 57 bp, Homo sapiens
  chr7:27275040-27275097
  hyper
atgggggattggggccgctgctccgggcagagccgcgggatccgagccagcaaggat

SEQ ID NO: 31171 - DNA, 132 bp, Homo sapiens; identical to SEQ ID NO: 665
  chr7:27279237-27279369
  hyper

SEQ ID NO: 31172 - DNA, 62 bp, Homo sapiens
  chr7:27279453-27279515
  hyper
cgccgggcctggagcggcctccacctcagctgctatcaccccctctccgctgtcatgggatt

SEQ ID NO: 31173 - DNA, 1058 bp, Homo sapiens
  chr7:27282237-27283295
  hyper
gaggcccacacctggcgcatcactgccgagccattagctgcgggtttcctttcatcttcgctgtggcagacgtttctatttatccacttgcgctcgccgagtggcgtcaccagcggtactgtaatgacgattgcagcaggaggatgacagcttagaaagaagagggcaatggggcttcctcccagaggcggtgcggcacagaggagcgctcgcttcacaaggtgaccctagctcccaccgccaccgccgcggtcgcggtccagaccgcgctccagcagctccgcgccctcccaggcacccggcctttctttctccctcttgcaaccaagatccgtccggccgctggagacccagggagccggggttaggaactcacttggggctttcccctcccccaccggagagccccgggatggagagccgaaaggacatggttgtgtttctggatgggggtcagcttggcactctggttggcaagagagtctcaaatttgtccgaagccgtgggcagcccgctgccggagccgcccgagaaaatggtgccccgtggttgcctgagccctcgggccgtccctccggccacccgggagcgcggcgggggaggcccggaggaggagccggtagatggactcgcaggcagcgcggcggggccgggcgccgagccccaggtagctggggcggccatgctcggcccaggacccccggccccctcagtcgacagcctctccggacaggggcaacccagtagctcggacaccgagtcggatttctatgaagaaatcgaggtgagctgcaccccggactgcgccaccgggaacgccgagtaccagcacagcaaaggtagccaccgtgcccctccgctccccgggcctcccactgcgcccacccttcacttcggcgcaggccaggaggaagacactcccttcccctagggcaggatggctggggggacccacctgagcaactctctctgctatctgcgttctggcgggggtctcctactgtgttctggcattggcgggactgagggtgacagcagtgccttgagtgcggggtgct

SEQ ID NO: 31174 - DNA, 15 bp, Homo sapiens
  chr7:27284655-27284670
  hyper
tcgctgtgcagggtc

SEQ ID NO: 31175 - DNA, 205 bp, Homo sapiens
  chr7:27285620-27285825
  hyper
cggcctgccctaccccttcccatcgcacctgcccctgccctactactcgccggtgggcctgggcgccgcatccgccgcctccgccgccgcctcgcccttcagcggctcgctgcgcccgctcgacacgttccgcgtgctgtcgcagccctacccgcggcccgaactgctgtgcgccttccgccacccgccgctctaccccgggccc

SEQ ID NO: 31176 - DNA, 84 bp, Homo sapiens
  chr7:27289482-27289566
  hyper
ggcatgccccacgaacggtttctttagtgattatgttgactccaccttcctagtttcaaaccctgcacccgcactctccagaca

SEQ ID NO: 31177 - DNA, 55 bp, Homo sapiens
  chr7:27289813-27289868
  hyper
cagccaccatatgtccgccggagaataagcgtgagtgtcgcggtggacagttgcc

SEQ ID NO: 31178 - DNA, 173 bp, Homo sapiens; identical to SEQ ID NO: 667
  chr7:27290946-27291119
  hyper

SEQ ID NO: 31179 - DNA, 877 bp, Homo sapiens
  chr7:27291314-27292191
  hyper
gggctgggcaagccgaggaacagcgagcccccggacgctgactgcaggacgtcccagtttgtgcccgggtctccgtccctccccgtacggggctcgtacccccgggcctgggtctgacccacagggcgctgaggcctttgtagctgaagtcggaaggcctcgttgcgagcgcggcacaggttgctggtagcttctggactctggaggcttggccttccttctaagccgatggcggggaaagaacctcgtttccacagcttccccgacccccgccgcttgccatttggggacgggaagcgcgcccgggtcgcttcacgtccctctgggccggagccctttccatggctggctcctctgggggcccttgggcctgtgagcagcgtctacttccctcagagaagaatcctttccttcccccatcgaagtgtccctttctgtatcctgaaataacccctcctgggtgaggccagttcccctctgtcgccctcctcccgcaggcgtccgggagcctcgtgaggaccccgtgcagttgagtccaggcgacaggtgcctccccaggtgtctacttgccctccctcaacctgtttagggaaagaccagaacgatgtgcgcggggaggtggttttgtttctcccgaaactggcgctcttgggtaaaaccgcgtgccgcgtctacgcgggctctgttagtgtgcgtgtcccagaagagtgggccttctaggcggcactctttggagaagtaagtgaggtgaactcagaacagagaagcgggaacgatcgtttgatgtgccgagccggaaaaagagaggagagggagaggctcccagcgagcgcggagacagaggagcccacgcggcacagcacgagccctactcttg

SEQ ID NO: 31180 - DNA, 371 bp, Homo sapiens
  chr7:28448920-28449291
  hyper
cccacgtgacgtcaccgggggggtgatgtaatgcactctaaatagaatgtattgtaatctttgctcagtccaacgtggtcccttcacccgggctccgctcttgccttctccacacttgtttggtaagttcctaaaaatacggctcggccacttctggggcttttgcatttagccacttttgttgcacttgccgcaggagccatctcgggagtgtacttgtttgcaggggttggttctcggcagcagccgcgaggttacttggtccagtgggcaggtcacagggcaaggagtagggaagatgcgatgcatttttttctggagggtgatctgtgtttgtaaacattttggcggaccagagggaagtccggccc

SEQ ID NO: 31181 - DNA, 124 bp, Homo sapiens; identical to SEQ ID NO: 3013
  chr7:28449658-28449782
  hyper

SEQ ID NO: 31182 - DNA, 184 bp, Homo sapiens; identical to SEQ ID NO: 3014
  chr7:28449857-28450041
  hyper

SEQ ID NO: 31183 - DNA, 221 bp, Homo sapiens
  chr7:28893380-28893601
  hyper
acaaaacaaaaactacgcaaaagacctgcttctttgccttgggccctgactttttagggggcagggtcttctgcgaggggcggttaagtggcagggaagcgcagatcccgctgcacgccgcagcagcccgggtgtggagcgcgcagagggggcacctcggctgagtttcgggcacgctgcgcacccacgggaggatttcagggaggcggtggccaagtcgg

SEQ ID NO: 31184 - DNA, 222 bp, Homo sapiens
  chr7:28995770-28995992
  hyper
ggctgctggccaaagcggtcaaagagcaggcggaagcgcgcgccgcccagcggccggggactgcggtgctcgcgcacggcccagcgcaccgaggcgctgtctgcgcccaccgcctccaccgtcaggttgcacagaatgaacttgttgaagtcgcatgggtcggacaccagcggcggcagcccggccccaccgtcggactgggcggcacgctcctggtgctcc

SEQ ID NO: 31185 - DNA, 56 bp, Homo sapiens
  chr7:28996341-28996397
  hyper
tcatctcctcccctgcggccgtgggtaggggctgccgcctgcggtcagcggtcagg

SEQ ID NO: 31186 - DNA, 862 bp, Homo sapiens
  chr7:28996623-28997485
  hyper
cggcgaagatgtccccggatagggcgctgagcgcgttgttgcgcaggctgagctcgcgcagccggcccaggtggccgaaggtggccgggtgcagggcggacagctcattgccgctcaggtccagcgcctccaggctgtgcagaggctccagcagcgcagttggcagctggctcagccgattaccctccaggcgcagctcgcgcagggcctccaagccccaaaaggcctcaggcgcgaggtgcgtgagctggttgcccctgagcgagagcaggccgagacgtggcaggtgctggaagatgcgcggcccgaggtgctgcaggttgttggccgagaggatgagggaggagagggagcgcagcggtgcgaaggtggccgcgtggcgcagggagggctgtagctcgttggcagagaggttgaggaagcgcagcttgcctagctgggcgaaggcgttcttgcccagaaagcggatccggttggactccagatgtaggtagagcaggttgcccaagggagcgaagaccgcgtccggcagcgcccccagggcgttcccgtccagccgcagcttgactagactctccaggccctcgaaggagccgcggcttaggcggctgatctcgttcccgttggcgtagaggatgcgcagcttgcgcagcggggccagcgtgcccggggcgagcgcctgcaagaggttgttccccaggtacagctcttccagccgcgagagcttctcgaaggtcttggggtgcagagagcggatctggttgtactgcaggtccagccgtctgagctgccccagacggtggaagtcgaaggccgtgatgttggttatgaagttgccgccgaggctgtaggtgagcacgtc

SEQ ID NO: 31187 - DNA, 160 bp, Homo sapiens
  chr7:28997486-28997646
  hyper
tgggggctcggccagcgagctggtcttgggcactacgcggagccccctgttggtgcacaggagatgctggggatgctggcagtcgcagcgctccgggcacacgggctcggcagcggcgggagcgcgaggcagccgcacaccacgagcaggaggcgcaagg

SEQ ID NO: 31188 - DNA, 511 bp, Homo sapiens
  chr7:28997676-28998187
  hyper
cgtgcagcggccggatcgtcctcttggcccgccggctctgtgtctcctctgcattccccttagcctggccagagtcgctaaatggcctctttcggacttcgcagcgccgtccagcccctcctccgtcctttgtccggaggccggcccgggtctctgcaggcgggcttcgcccggccaagtcaggcggcgcggggcgctctgcagaccccgggtactacttgttgcatttctgtataaaactgtttctccgggtgcgcgtcggcgggcgggaggagggagcaagacccggcgctttttgtttgcagctgagtccggagagctggattccctggcgcggattctcccagccgagtggattccccagctgcaggcgggagccgttccaagagcttcgcggggcgcggcttggcagcagagccccggctgctcggcccccgcagacggcaccttctcgctcgcggtcccggacggggagggcggctccagtgcaatagctcggggagcacgcggg

SEQ ID NO: 31189 - DNA, 382 bp, Homo sapiens
  chr7:29185815-29186197
  hyper
tcaagagtattccctcggctgggcgcacgcagtacatccccaatgctccaatttgaactttgactcggccacgaccaccccactccagtctcactctacggtgctttctcccctgttggtgctgagggcttttgagactacctgccccgcgctccctaagtccgagggaccgaggcgaggacctgtcccgctgagctggcacgacccacgcagggcaggcggcacttacgcggcgcagtcggtgctcctccctgagccgcggcgcgcaaggaccccagccggttgtccttgcagcgcttcccaaatcaggcagaagtgaggcagccccacccagtcacgaggaccctgcagaactcgagcctttaagcgctcctctaggctc

SEQ ID NO: 31190 - DNA, 141 bp, Homo sapiens
  chr7:29603652-29603793
  hyper
gaaacactactagcccggaaagccgccctggaccttccacccgggcagcgagtctggcggcccctcgccgccgccccctccgaccagaacagactgcgctgcgagccccgggcttccgccgcagcgcgcagcaattggagg

SEQ ID NO: 31191 - DNA, 441 bp, Homo sapiens
  chr7:29604285-29604726
  hyper
aatgacttgggggtacgggttgcttttccgatctgcaaagtaggagggaatgggatgtttgcagacgcagttgctaattgtgcctgagggcgtgggtgccttttgtaccgaaagaacttttggccgttttttcttgtattgttttcaagtcgctgcccgagtgtgtcctcagggcatcctggggaggagccggtgttgcggtttcggggcgcagccgaggccgccccgccgcctcccgtaggcgatcagacttcctctccctggcggttccgggaggagaacctcctacaacaaacaccgccgaagtttccctctccagcgcgatcgccaatcccaggagcgcccggcgcgtgggctgggaaggagccgagcggaaacctggaagtgagccgcggcgcaggcgaatcctgccgttgctggtggcagcgcccaagagacccc

SEQ ID NO: 31192 - DNA, 495 bp, Homo sapiens
  chr7:29846202-29846697
  hyper
ctgcgggacggagcccggagccggaggcggcggcggcggagacgtcggccggagctcgagtccagtccagcccccggctccgccacctgcaggtagcggcttcccgcgcgggtgcgggtcggtgcccgagggtggaaggaacgggcggtgtggcggccgccgccctggtcggtcccggagcagagtggcccggcccgggacagagatcctgagggcgtgggagggccggggaacccccgccgggctgcagccccgggcccaggaggttgtcgacgtgccgcgcggcgctcacgccccccacccgcaccctgccacgccgccccggccgggccgggccgggccgggcggaaacaaaccgcggggtggggagcgaggtcaccacggggttgcttggtgacttctccggactggactccccggtgagcagcccctggcaccgaggccgcctcggcctggtccttcgcgacgctctctcttctccgcttcgcccccgga

SEQ ID NO: 31193 - DNA, 741 bp, Homo sapiens
  chr7:30721202-30721943
  hyper
gggaacttcaggcaacgggaacctacaatgagggaaggaggtttacactccaagaggaggaagtatttccttctcccctttttgggctgtcaccgcatggagcacgggaattgtgggcaaatcactggcttactgagattagacgctgtattgggggtagaagcagaaggcgcgcccccaacactgtaaggggtccttaacgcccgcggtccgcggtaccgcggccgtcagcagctttgtaccgctgggtccggaatcctctttactccctaaaccgccttctcaggaggccggtgtagagcaggcagcgagggccgggggcactcacgggtcgtgttgtacttgacgccgttgaagtactcggggcacggcctctccacgagggctccggcagcgctgcggggccagcacgttccgatctggtccaaggtcgtgttgcagtaggagtagggacctggcggcgggagagagcgcagtagggctcagaggggcccgcagggacgcggggctctcggagcgcggggtcaggggcgcacccagcgcgcgagagaaggagcccgcgcagcctccgaccgctcgcctcccgcctaccctcggggtccaggggtggcccccagccgtccaagagcagctcttcagccagcgccaggctgcagttggcctccagcaggctgtggagcagtgccgcgtccatcgcgtcccgcagccgcgtgcggagagggagtgggagtgcgcgcccgg

SEQ ID NO: 31194 - DNA, 96 bp, Homo sapiens
  chr7:30722018-30722114
  hyper
cgatctcccgggcagcctttgggcgccacctccggtcgcccagagctgtcaagtggggaccttcccggagaggagccgccgagtgcacggagctgc

SEQ ID NO: 31195 - DNA, 332 bp, Homo sapiens
  chr7:30722115-30722447
  hyper
ggtacagccgctccgccgcggccaatggctgcgccggggggcggggccgggcggctcctctcggaggggctcagtctccagcccccgggccctccaccctgcccaaagtacggcttctcagttcgcagctctcttccactcgcggcgtccagaggagggcggtgggctggagagcgtgggcctggggtgacggaatgctctgtgcggggatcgcaggcccccgagctgcagggggcagcaaagcgcgcccacctgcccgcctgcccgaggagaacaccgcagctctgctaatcgagggacagccgcaacccaaagttcggcagctttccgcc

SEQ ID NO: 31196 - DNA, 222 bp, Homo sapiens
  chr7:31091945-31092167
  hyper
gcttcgcggcggaggcggcgcctctcccgcaggacggagccaagctggactgccgcgccgcgcggggcgggcaaagggggcgctgcgctcggccccgggcagggagtgacggcggcggcggcggctccgggcgagcgtggtccccgcgtgcgcacacgcacacgccgccgcgcagggacacacggaccccggccgccagccggccacacaggcgcggagacc

SEQ ID NO: 31197 - DNA, 458 bp, Homo sapiens
  chr7:31092241-31092699
  hyper
cgtcctttgcggagtctgccccggccccacggacaggccccgcagtgagcaggtaagggtcgccccgccgcggctgcccctccacgcctcggccgtcttctccccctccagaaccttcgcccagccgggacctcggatcccctcctctggcttggcggtctccgccagccgcgacctccaccgacggagagcgggcgagggccggcgccaggcaagcctcccagatctgaaatgaagccccctcccgccgctgcgcccttcctgcgcgtcaggctgacaccccccaacccaagtgtctggcgctgcgctcggggcggccgatcgccgcagactgccggggtgggggtcgacctagctatctcacgcccctcctgatgcggagaagggagaccaggggggcaggcaagccatgcggccggagggacccggagggacatgcctccctacccttaggtgga

SEQ ID NO: 31198 - DNA, 167 bp, Homo sapiens; identical to SEQ ID NO: 8988
  chr7:31092713-31092880
  hyper

SEQ ID NO: 31199 - DNA, 296 bp, Homo sapiens; identical to SEQ ID NO: 8989
  chr7:31092894-31093190
  hyper

SEQ ID NO: 31200 - DNA, 30 bp, Homo sapiens
  chr7:31232688-31232718
  hyper
ggctgcggattgccgcgctgcccctagagg

SEQ ID NO: 31201 - DNA, 151 bp, Homo sapiens
  chr7:31376067-31376218
  hyper
gatagctggagctatcgccgcctgcgccgcgtccctgcttgtggcacaaggggcgggtgaaggggcaaccccctttctccctctccgagcgagtgcggggcagagcctccaggcccgcgcgcggcggtgcgctcgccgctctccatgccac

SEQ ID NO: 31202 - DNA, 128 bp, Homo sapiens
  chr7:31528357-31528485
  hyper
taactccaaggagcccgggtatcattgtagtccatgtcaatggcgccccctggtgttcgggggcgcagcagccctgtgcgagtcctgcagcaggccctcctggcccatccactcggtataccccactt

SEQ ID NO: 31203 - DNA, 143 bp, Homo sapiens
  chr7:32110353-32110496
  hyper
acaaagccacagaagcgatcagcgcgcagctaaagggtttggaggtgaaaaggagggctgggtggggaggagagaaagtgagaagggagagaaaagcggcggctgagcaaagcgggagccggcgcgggcggtggggcctgacc

SEQ ID NO: 31204 - DNA, 99 bp, Homo sapiens
  chr7:32110703-32110802
  hyper
cgccgtctgccgggcacacgctgggctccgaccccggccgggcacactcacccccgcagggcagccgcggccaccaccgacctgcggagctgcgtgggc

SEQ ID NO: 31205 - DNA, 176 bp, Homo sapiens
  chr7:32337807-32337983
  hyper
ttctatcagtgtccccgtgtctggatgttcctgccgctctgtctgtgtgtctctatcatgtccacatcttcctgtcgctttctgtctccctctctcggcactatcttcatctctccatcgcagcgtctccagccctatttccacccctcctttcccccggcctgccttattaaaat

SEQ ID NO: 31206 - DNA, 175 bp, Homo sapiens
  chr7:32338043-32338218
  hyper
cgccgggtcggagcccgcgaggggtgccgggggggacagcccagggtgcggcttctgtcccgacccagtcgccgctcccgggggctcccgcccggagagcaccctccggccccagcccgacccctgagctccccctgcccgcttagaaaggaactctgaccgccaccggagaggg

SEQ ID NO: 31207 - DNA, 403 bp, Homo sapiens
  chr7:32338283-32338686
  hyper
cgatgctgaaagtggcgctccggcattttttgaagccctccttcctgttgccggcgtccgtcatggctcggccggccgggcaggggcctcgcagcgagaccagcggcgtctgcggtcccccccacggcggagtgagcagcccggggctcggcggcgaatcctcccccggccgcgccgcgctgtcactctcagccccgccgcgcgctggcagctgagcgcctggagacaacagcggggacccaatgtcaacagctaaagcgctaggagctcggcggaggcaggagccgtcgcgactgccccatctccaagccgagttccagaggcggcgagaggagtgtcaggaagggaggacgcgcgcccgagcgcgtggacggggctgaccggtgggcgcggagatccctgc

SEQ ID NO: 31208 - DNA, 143 bp, Homo sapiens
  chr7:32338925-32339068
  hyper
tccaaacaaggaagtcgggaaaatcgccacgcccacttccttctagccactgcccccagcactggcctggagccccgatagtgtttcttctccactgtccctgccaggaaggtaattgtcaaagtcaccggaggctctatgat

SEQ ID NO: 31209 - DNA, 30 bp, Homo sapiens
  chr7:32467165-32467195
  hyper
ccatggtgccggccccggtactaagctggg

SEQ ID NO: 31210 - DNA, 237 bp, Homo sapiens; identical to SEQ ID NO: 670
  chr7:32467419-32467656
  hyper

SEQ ID NO: 31211 - DNA, 116 bp, Homo sapiens
  chr7:32467946-32468062
  hyper
cgcctaacagtctggggtggatgggacttggggagtcgctatatagaggctgtccggaggctttactggaaattgaggggaggaaggggcgtggcattaggcgagggatacttttt

SEQ ID NO: 31212 - DNA, 30 bp, Homo sapiens; identical to SEQ ID NO: 8997
  chr7:32468472-32468502
  hyper

SEQ ID NO: 31213 - DNA, 36 bp, Homo sapiens
  chr7:32801612-32801648
  hyper
cactcgcaggacccccgcctccgagcttccctgagc

SEQ ID NO: 31214 - DNA, 70 bp, Homo sapiens
  chr7:32997312-32997382
  hyper
tgcccgacgagtgcccgcgcaccgtgcgcagcggcgacttcgtgcgctaccactacgtggggacgttccc

SEQ ID NO: 31215 - DNA, 799 bp, Homo sapiens
  chr7:33943650-33944449
  hyper
ggagacccttaggtccgttccgtggggacccggtttcaactcttggacagaggaagtcggtagtccaccgtgagctcaaggacagctagctgatcgtcaggtcccaacacttgccaagcgtccctcactcccacctcgcgccttcgtactttggttacaaaaatcatctctctgcgattgcaccccttttgagtagagggtgccactgcgtggggaggaggcggcgattcagcagggggatcacaggagctgactccccgacacccagtgctgcagaggcgagagggcgcagccgggctgagagagcgacggagctccgagctgcagaggccgccgcgcggcggcccccgccagagatgagcggtggggcgggggttcctccctcttttcgggtgaatgaatgattagtcaaacaccacctccccgccccggtccgcccgagattggaagggaggagtctcggagcgactgttcattttttaaggacgaaaggcgtttgcctcggtacgtttttaaatcgaccttgtgtgtgtttcaacttcggtcatccctagtgtcaggacgcgcagacagctaagcacagaacacatctctaaggccacttgcccctctgtccgctcagccccctgagttcgctgtcgcgcccccgccagagggaagcaaagcagggcatgaaaagttgcgggggccctactgccccgggtgtgtcgctccttcccaaaggtggggcacccgggagcgagcagggtggtggggcgcccctgcgtcccgtttgctgctccctcgctggattggggca

SEQ ID NO: 31216 - DNA, 497 bp, Homo sapiens
  chr7:33944650-33945147
  hyper
cccgggcgcccccagcgggttccgggaggcgcccggtgagcccacgtctgttgcggcggagcgagcgcgctccgggagggccgagagccggcggggctggcaggaggtgaggagtgcgggagtggaggacgctgcggcagcgacagcgacagcccccgaaacagtagcggcagcccgggcggcggctgagcggcagtgcgcagtcggcagcgccgcagctcctctcagtctatctccggctgccgcaacaccccttcctcctggccccctctccggcgctgaggggctgactgctaagccactgcaagcaactccctcaggaaaaaaaaaaaaaaagccgcatcggaggagcctggccgcaggacccctcctccccgggcgcccccacaccttggtctctccccccgccctccctcacacccccccgccccccagctctcgggcgcccgcctccctccttcgcggacggtctcccgacacgccggctgagagccctt

SEQ ID NO: 31217 - DNA, 198 bp, Homo sapiens
  chr7:33945356-33945554
  hyper
aggtaggggagggggcgggagggaccggccctccgggacgccggtttggtacctgggaaaggtggcgctggcttgccccggggatgggagggtggggagcgcgcaccttggcgcttgccctgcgctggtcgatggggatgaagcgaagccccgggagggctgggaaggctggtgaagaggttgcgggctgagaggctg

SEQ ID NO: 31218 - DNA, 561 bp, Homo sapiens
  chr7:35225273-35225834
  hyper
aagactcaagaaaagcgccatgcggctccctcctagggctctcctgccctctccttaccgatgctgagagtggttctgctggggaaccaccgcgcctgcagttcgtgcacctcttcccggagctgcgccagggaattacggacgaactggaaggggtcgagaagggtcttggccaccacctttagctccaagccttttcgctttttcagatttgggatcctccccggggaggacctcctggcgccccctggcagtttcccgccgcctagggccgacttttccacctccagctcccgggcgggggaggccccgtacggccgcttagacgggctggggcgggaagattgcagcggctttgggtttactccttgtttcttcataatccctagtggagctgggtcaatttcaggcacagcccatccgagtcaggcgaggtccagaaaggcctgactcgcctggcagcctcaacggacttgtccccgcagccgttgactagccgttgacgagcggacctcccggtcgtcatggcgactgtgaaatgtagggtggagcgcatgcgtt

SEQ ID NO: 31219 - DNA, 479 bp, Homo sapiens
  chr7:35226044-35226523
  hyper
cgcagccccacgtacagcccccaacacgctcccagccccactggcgcagaacccatcaccgcttgcccttcacgcgcttcattgggagtgcagctcccaccccgagcgcgcagctccacgcagcctctccacactctccccagcgcttgcagcaccccccagtgcgcacagctctgccagtagcttcccggcgcgccgcccctgcaccgcttcgggccataaccttgctggcgactaagtctgaagaacttcctgtggtttcattcttttcttcaggtttagtcttagctctgacattttaaccaaaaggttacacgttaattaacgaggtattaaaggggaagatctcagctgaaagaaatgactgtaggaagtgtgtcagggaagccaacggaaccgctggcccgccggtggtgcgcccggcattaggaaagtctctacgatcgctgaggtatcgggcagtcagtgcccgttgccaa

SEQ ID NO: 31220 - DNA, 54 bp, Homo sapiens
  chr7:35226556-35226610
  hyper
cgtggcagagccggcgtgagtccggtgggtctgatcccagagcctcaggttgac

SEQ ID NO: 31221 - DNA, 92 bp, Homo sapiens
  chr7:35226611-35226703
  hyper
ccacttccttggcacggaacagcgtttactgaatcttagagcaaaatgcttttccaatgaggttcctcagaagtcatcggccctaggagcgg

SEQ ID NO: 31222 - DNA, 210 bp, Homo sapiens
  chr7:35292877-35293087
  hyper
gacaacttaggagaccgacgggcccagatataagatgcacattcacagcattcaacagactgaagcctccaaagaaaacttggacccaaaagaaaaagatctcccacccgcgatgtatggctcatggcttgagcatcagacgttgctgcgagccgcctgcagccaggggcacagacggatgcgcagcatccccagtcctcggcggacagc

SEQ ID NO: 31223 - DNA, 296 bp, Homo sapiens; identical to SEQ ID NO: 673
  chr7:35293182-35293478
  hyper

SEQ ID NO: 31224 - DNA, 641 bp, Homo sapiens
  chr7:35294031-35294672
  hyper
cgcccgagatccgggcatggcccagttggggaagctatgaccagaccagtggaagcctcgggagttctcgctttttccattctttttcttacctgcgctcaaagttccaaaagaaagtagggaagcgctcagtagaatccggcgcctctgagccggcgccaactggccaggtccatactcggggcagatcccagggctgggactctcattcgatggtcccaaatttgatctctttgacagtggggctgagcaaatgcagccctgaaaaagataagcttagcgagagctgcgggcatttggcaaaggatgctgctctcagaaccgtggcttctgctcctcaccagtgcgtctctagcctggggctcctattttccctagagggaccctggaaaatgggacggctgccgaagagaaggcgaaggtcagggcgcggagctctacggtaaccacgcgacgcgtagtgggagagtgcgaaccttatggtagcgcccggactaagcggacacagacccctctggttttacaaaggcggctgtgacgaggacttcccacggccttgttggagggcgtcctgttagccctgctcagcctgaataactcaaattctccgaattcgcagggtaatccgcttcgcttggagc

SEQ ID NO: 31225 - DNA, 29 bp, Homo sapiens
  chr7:35295077-35295106
  hyper
gctggaaggaatttacgctgtcttctagc

SEQ ID NO: 31226 - DNA, 266 bp, Homo sapiens
  chr7:35296739-35297005
  hyper
ccgtttaaactttggcgcctaagaatgtaaaattttgttatacatctgagtttgtttatatggaatttgattatatggaagactggaagatgtctccttatatacaccactctttcaaattctcatttgtagctcccggaactcagaagacagtcgacccccaaaactgtccaggaagtaatcggtttccggcttttggacaatggtccctcgcttaacgaatgctaacgaatgctcccttagctgggagctgcagggaccggtcc

SEQ ID NO: 31227 - DNA, 217 bp, Homo sapiens; identical to SEQ ID NO: 676
  chr7:35297137-35297354
  hyper

SEQ ID NO: 31228 - DNA, 547 bp, Homo sapiens; identical to SEQ ID NO: 677
  chr7:35297470-35298017
  hyper

SEQ ID NO: 31229 - DNA, 27 bp, Homo sapiens
  chr7:35298121-35298148
  hyper
cgagctcactaccgcagggaccggccc

SEQ ID NO: 31230 - DNA, 222 bp, Homo sapiens
  chr7:35300787-35301009
  hyper
gccgcacgtggacaacgggcccgggcggcctttgtaatgttattttttcttttctgaagataattacctagtattctgcaggttcctctggtgcaacagagactgccgcggggcgggggagaaggtggtgaggggggtcgcgcatcgctcagtgcaggtctgtgctttcacttggcctgcgctcaggtcagtgcgccccttaccggagcacccatggcctcc

SEQ ID NO: 31231 - DNA, 847 bp, Homo sapiens
  chr7:35301101-35301948
  hyper
cggagccttagtttccctagttgtgaagagggagggtgtgaccatggcccggagctctccgaaaggctgtgcggattgctcggtggcgggatgtggagcgcgtcttctatgatgccaggtgctggccaagcgctcgatgcaggctgctccagttaggtcgatgcgatggcgggaagcactttcctctgcaatggagagacgccgacaccccgagcccgaaggcttgcaaggcgcgctctcgccactggggtcggggatccgtgggttctctatcccgcttacccactccatccttagcagctgtcgtcggtcccagacctctaccttggagagaccaaggcggcccagagcccaggagactactgcgcggtacgccaggatccagaagtggattctgacttctaaagacccctcccaagccaacgctatcagggtccctgcaagcggttgactgtggcggaggcagaaccaaaacctttgctctgcccgcggcgctccagcctctcacccaggacagtgctctgggctccagccgctgcagtggggtcgggacacagacgccgagttagaagccccgccgctgcaggtccctgcttggtcggcgcggtgacggtgtcgctggcggcggcgggggccttcctttggctgcccggccatttaatcagagctattatcagacagggcttgcaggatggcgccggccgagctttacccccattagcacagggcaggctgggggctgggtcctgaggccaccgccggtcccggccagctgcagcttttctggggagctatgagaaaggcaggcctggtggctccggccttctctacccggccactctcaggc

SEQ ID NO: 31232 - DNA, 87 bp, Homo sapiens
  chr7:35839940-35840027
  hyper
caatgggggctacagcggccgacctctggggctgtgccaggccactagagtgtgatggcgcgagggaagggtcggggaaacagggcc

SEQ ID NO: 31233 - DNA, 143 bp, Homo sapiens
  chr7:37487113-37487256
  hyper
ggtcaaggcaggtcccgacccgcctccaacttcaaatggccccctaggcgggagagggtcactgggcggggagttcctggctgtgcggtcacacacacacacaccgactcacacacacacccacaacaccccccccacacaca

SEQ ID NO: 31234 - DNA, 78 bp, Homo sapiens
  chr7:37487376-37487454
  hyper
cagcaccgacttcccaaccccaaacacacgcgcgcacccccgggacagctgagttctgtatttcctcttcctcaaagc

SEQ ID NO: 31235 - DNA, 211 bp, Homo sapiens
  chr7:37487755-37487966
  hyper
gggggattccctcccatccccgagtgcaggagaagacgccgagtctgagccgcagccgcttctctagctctataggaatcttgactccaagatcccagccccacatcccccgtccccagtaaccccgcgccagcgtcgcaaccctcccgcgccccccctcccgcagaccctggtcgaaatgtctcggcgggctcccgggccccgggccctg

SEQ ID NO: 31236 - DNA, 1035 bp, Homo sapiens
  chr7:37487984-37489019
  hyper
cgcacctccagcgccccctccctccgctcccactcccactcccgccatccccggagctcagacttccccaactgcagagcgccccgacgcgcccgcagccctcaccctgccgagcgcggcggccacccccgcccgagccgcggcgcccccagggaggaaacaaaagtgtctccgcggcgcccggagtcccccggagcaggacgcctcctcccggccccagtcccggccccctcccctgccgcgccgaggtcagcgagtcggggcgcggcgccagcccaggaaactttacgaacctgcttggggtcgcaggacagcagcggcaagggttcccggcgatcagagctccggcgacccgccaccattgaaggggaactggaggctctgtcgcccagcgtggggccgcggcggcgtgggtggctctgcctctatcctgtgcccatcctcgcccgctcccgctcgccccagcacacgcacttacactctgggtcggccggctgctgcaccgccggctgccgctgctctcacttcctcttccttcctcctgctggccagagacacattttgcatctgcaaggcatccggagatcagccgcgaactctcctcccgagcggacgctgcggagttgcagccgccgcccccggcacctgcgccaggacactcgtggtctgcgcgttcgccttgcgcccgcaccctgcctggtccctgcccactgcactttgcctagggggatgcccacgactttttgaagtccccctacttaaaagacagaaatgtcaaacaccatgcatgcctcagatctgctataaataatatgtgtgcagagcatgacttcgatgagctcacacacggcgtttggaggcactaattaactccgtcaccctcatagcgccatctccgggaggccaaaagcgagtagcatcttttcacatccttttttaatttttggcaaccggttccggatattaaggggaaacttcggtgggctgtttgaacgctactttaagacgtgtttgttttgacgctgtgcctctacc

SEQ ID NO: 31237 - DNA, 289 bp, Homo sapiens
  chr7:37955745-37956034
  hyper
catagacaggcagctcgtcgcaggccaggctttcgggccagctgtggttgtacatcttcatgaggggctcgcagtcgtcgcgcgcgcgttggcacaccgacttgcacggcttgatagggtcgtgcaggaactccagggtgcaaatgggcgcgtacatggcacagaggaagaagcgcagcacggcgctgcagttcacgtccaccagctcctcgtactgctcgatggccaggatggcgttctcctgcgtgctgtggtgcaggtggttgggcatccgcgtgatgttccaggg

SEQ ID NO: 31238 - DNA, 308 bp, Homo sapiens
  chr7:37956260-37956568
  hyper
cccccaaactccagtcggcagcaaagcggggccgcggggtccggccgcggagctccgccgtctggcacacagggcacgagcagcgccagctctcagccttcggggcgcgaacccgcccgggcagctccagtcccggactccgcagctcggagcgcagccagccacggccattgcgggaccctatttatcccgacacctcccctgacgtgggctcggaacgctcccttggcagctgcagccgcggcgcgggctccccctcggccgccccacccccaggcccgtcggtgcagaagcggtgacatcacccc

SEQ ID NO: 31239 - DNA, 302 bp, Homo sapiens
  chr7:37960235-37960537
  hyper
gtgagcagtgaaaaccgaagcggcagaaggcagtggcagcaggcagtggcagcaggcagtggcccaggcagaaatagctcccgcgcgattcactggagccttccccgggccctggtcccggctaccgggactcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgac

SEQ ID NO: 31240 - DNA, 396 bp, Homo sapiens; identical to SEQ ID NO: 9019
  chr7:37960562-37960958
  hyper

SEQ ID NO: 31241 - DNA, 358 bp, Homo sapiens
  chr7:38670306-38670664
  hyper
agcactgtgtgatcacgatcctaccctattggtcctgggagatttttggtggcttctctgttaaatcgttcgtgtctgctgcacttaagtagccacaaaatcccccgcaagaaggaaggctgctgcaatctcccgccccgatctgcgggccgcgtccccgcgagctgcctgcgggcgcgctgggagccggcccggggagatgcgagcgcagggagatgcgctctgctccgggcgcagcgggcaagctgccgcacctcctacttctgttgcctggcttggggccaggagagcggcaacccggggccggctccggagctggacatatccggcgtctccggggccagggtctgcgggtccc

SEQ ID NO: 31242 - DNA, 29 bp, Homo sapiens
  chr7:38670956-38670985
  hyper
cgggtccggggagctgcgaagagcagagc

SEQ ID NO: 31243 - DNA, 178 bp, Homo sapiens
  chr7:38670986-38671164
  hyper
cgcagcggggctggcggcggcgcggaggagcgggaggaggagcgggaggaggaggagagggccgagcaagggaggagcgggagaagcggcggggagccgcggagcgcggaggggtgagggcggggcgcggcggcgggaccagcttaaagcgacagagcgggggcgggatgcgtcggga

SEQ ID NO: 31244 - DNA, 391 bp, Homo sapiens
  chr7:39015542-39015933
  hyper
ccgatcgggtggcagcgcgtggggaacccaggctgcactacagaggacgcaggacgccaaaaccaccccggggctcacgccatccgcgcaccggctctgctgcctaagtccgaggacgcaggcggagggcgcggggctcccgggcgcccaggagggcggtgccgccggggtgcgctccaggcttggctgcaaaccccccaagaattagaaagcgggggcggctgctcagcggctgctgcggcctgggactgcagctcgcccctcctccgcaacttcccactggtcccgtcacctggctttctgtctagtgtccgcccaggcggggtcccaagaaggcgatgccaggagcagtcgcgccccctgccctctgtgagcccgcaggtttcgggca

SEQ ID NO: 31245 - DNA, 748 bp, Homo sapiens
  chr7:39453541-39454289
  hyper
aagatgccccacaaacgacggtcccctggtccgaggagccgggcagcgccgcgcagccgtctcgcgtgggacccacccgcgggcggagccaggcggcagggctgccccaccgagcttcaccccagcaacccctttaactttcttaaccctgtattccccaaccgaacacttcccagagttcacgctggcagagcccacttcaaaaaatgctgcaggaagccattcacactcattcctatccacgtttttaaaaatgcgaaatagtgatttaaatcagaacagaacctcttccaatgggggtttcctttgcaaccggggcttcgcggtgatttctgtgctgttttgagggcacacacctacataacacgtttgcagagataagggatctcaaactgttcccaaaagtcccagggactcgtaatatgcaaaccgagggcaaatgaacgtgggaggatccgaggcgctcgctgaaggggctctcctgcagtgcccaggcagagggagagtggagggggcggctgtggagtgaagggcggaagtgccctcgccgtcctgaggcctgggaccctcttgatggtaaatggcgctgttgagccccgatgcgcagggactccgcgggcggcggacttgacaggaagctttgctgcggggcggcccagctgcggacgcgcgggacgtcagggccccagcagaagcgccgggctgtgcgtccttaagactgcgggtgcggccccgcccaaggtcgccc

SEQ ID NO: 31246 - DNA, 38 bp, Homo sapiens
  chr7:39873278-39873316
  hyper
cagagaccttcttgtcggagattcgatgggaaaaaaac

SEQ ID NO: 31247 - DNA, 84 bp, Homo sapiens
  chr7:42267628-42267712
  hyper
ttcaccacttttgcccgcgcctgcgtcccctgcccgaggtcccaggccgcggcggcggcgcggtgggttcattagcgggcgcgc

SEQ ID NO: 31248 - DNA, 89 bp, Homo sapiens
  chr7:42275797-42275886
  hyper
ctctctgccttctcccgcccgttttcccgctgctactcaagaaagtaactgtcccctgctgctctgtgtaaacgcggcaccttaaatga

SEQ ID NO: 31249 - DNA, 799 bp, Homo sapiens
  chr7:42276096-42276895
  hyper
cgcggcggaggtccccgcgcgcacccaccatgcctcccgcctccttccgcccatcccgagcgccgtgcgcgcccgaagcccgagccgtagagcgccaccgcgcaaaggaaggagccaggcgcgtgcggggctcgcggagttcttctgaaccctttggatgggggcggaggcgaggggcgccgccaccactgcggcaaacttcgtcccccctccgggaggtgaaattctccaatccgtctccggccggtccgcgggtcggactcttcggaaaggaccttccaggaggagggagcgaatgcaagccttgctcggacgcctcaccggcggctctctaaatctgggcgccttttgacagccattttcactccatcccgtccccacgctggggaccacctctggccccggaggcgcgggcgcggccgcaggagcgggctgcggggtccgcgaaacaaagaacttcgagcgggacgtacctgcggcggcagcggctgtcaagtccccgaacttcccatagacccgcggacggggcgcaggctggcggctccccgctccgcgcggccgcgggcggctacggctaccgcgagcggccgggctgggcgcggggtgcgcccgccgcgggcatggtgcggcgcgggcggccgcggggcgcgcggggaaggcgggagagcggcgcgggtgagtgggagcggcgggtgtgcgcgagtgcgagtgtgcgagcgcgccggtggcgctgcccctgcccgctccctcccgctcgtgcagctccggcatcagtttcggggatcgtgtaatccgatcc

SEQ ID NO: 31250 - DNA, 141 bp, Homo sapiens
  chr7:42277420-42277561
  hyper
cccgcttctcccgcccgccgggtccccaagcccggagtgggtcccagctgcgaggcgggcggcggcggctgggaggcggcgcgtcgcgggccggggtcgggggctgggggggagcccgggcgccgcgagccacgcgcgcgc

SEQ ID NO: 31251 - DNA, 200 bp, Homo sapiens
  chr7:42277621-42277821
  hyper
cttctcctcctcctcctcctcctccgcccctccccggtcttcacacagacacattcatgcctgctcctcctcttccccctacttgaccccgcgccctcccggcgcgccgaagccccacccacccggcgaggggaagggggcccgggcgtgatgtcacccgcgccctctctcttctctctccacaccgccaggacaccccc

SEQ ID NO: 31252 - DNA, 20 bp, Homo sapiens
  chr7:42533061-42533081
  hyper
ggaaagggaggaggccggga

SEQ ID NO: 31253 - DNA, 30 bp, Homo sapiens
  chr7:42927875-42927905
  hyper
gaggagagtaattgccgggctaaactgata

SEQ ID NO: 31254 - DNA, 30 bp, Homo sapiens
  chr7:42928140-42928170
  hyper
ccggctccttgcctgcggcgcggagggcag

SEQ ID NO: 31255 - DNA, 238 bp, Homo sapiens
  chr7:43151970-43152208
  hyper
cacacacaaaagggccgaggagccagggttggtgttggatatgcccagtacgcgtgctgggtgttggaaggatggggccggcggtaacaagaatcgatatatatttaccgcgggggcgggggtgggggtgcgcggaggctgcagggcggggcagcgctaatgagagcaagcccggcttgtggttggttctggagtctggtacccacagaggagcaggcagggagggaggggatgcaag

SEQ ID NO: 31256 - DNA, 502 bp, Homo sapiens; identical to SEQ ID NO: 3038
  chr7:43152413-43152915
  hyper

SEQ ID NO: 31257 - DNA, 315 bp, Homo sapiens
  chr7:43153229-43153544
  hyper
cgacttgcagacaggcagggagggagctgccggggcggggagggggggggaatgcgtccggtccatttttggctggaggtgcgcttcctgctacccccacgttcccgggcggtgacaatgcagcaaaatccgagggctcaaacaatgtggcccctccatccccggctccagggcattctgattgctctgccgctttgacgtcccggccacttggctgattttcagagccatgatgcgcggtgtctctgtcttgcacacagaggctgggcaccataacttcttccctgccgaatttcagcgcgtagggggagctgg

SEQ ID NO: 31258 - DNA, 27 bp, Homo sapiens
  chr7:44143915-44143942
  hyper
aagccccggcgcccccgccccgggccc

SEQ ID NO: 31259 - DNA, 405 bp, Homo sapiens
  chr7:44144029-44144434
  hyper
cgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggcccc

SEQ ID NO: 31260 - DNA, 33 bp, Homo sapiens
  chr7:44349574-44349607
  hyper
cgggaagagcctttccgccggctgagccgtggg

SEQ ID NO: 31261 - DNA, 44 bp, Homo sapiens
  chr7:44349655-44349699
  hyper
cggtggccgagaccgggcgggggcgggggcgctttgggagttag

SEQ ID NO: 31262 - DNA, 194 bp, Homo sapiens
  chr7:44364485-44364679
  hyper
tcccgccacccccgccgcctgccgctcgggtgggggtggggacagcgcacccgcgtcggggacgaccctctggggccgcagccgacccctcccggcgctccaggcccgggggccacccccgcgcgcccctcctctctgacctccccgccgccaaatgcgtcacgtctgccgggcgctccggggacacctgctgc

SEQ ID NO: 31263 - DNA, 384 bp, Homo sapiens
  chr7:44364698-44365082
  hyper
cgcgagcccggagccccggcccggcagccgcgctgggcagagctgggcagggccgcgcgcgctgaggtcaggcagccaggcccggggccgggggctcgcgggtcggggccgcgcggggccgtgcgcttgggcccggagcccagagaagccggcggcgcgcgggcccgcagtgcgcctggagccggcggcgcggagggtcccggaggtcccggccctctggggtccccggcccagcccgcgcgcgccgctgctcttacttgccaatatcctcgtagagctggtactcgtcggtgaagcgggtgcaggtcaccgtggtggccatggcggcggcggacgggctcggcgtgcgctcggctgcgctcgggcggcggcgactccggctcc

SEQ ID NO: 31264 - DNA, 119 bp, Homo sapiens
  chr7:44365117-44365236
  hyper
cgggagacacctcggctcgcggcgccaggcgggggccgggctgggctgcgccgggcggcgagcgcacgcgagatctgctcgctccgtcctcgccaggagcgcgccgcacacctacgcgc

SEQ ID NO: 31265 - DNA, 30 bp, Homo sapiens
  chr7:44924253-44924283
  hyper
agcgcttggagtccacggtgatggaggtgc

SEQ ID NO: 31266 - DNA, 292 bp, Homo sapiens
  chr7:45128841-45129133
  hyper
cctcagggtggcattcgcccgtggccaggaagaggcggggacgcccctagaaccctggttgtgggaggctggggaggtggttgggattctgggatgctcggagcgctttgggtggagttggcggcgcagcctccttccccgctgaccaagcagagggtgcagggcctggggagggagggggccccgcccagcccgatgcctccatgcaaaaggtgagctggagctgcagctctggagtgattggctggtcctggcagtcgtcggtctccgtggcaaccgcctcctgtctcca

SEQ ID NO: 31267 - DNA, 51 bp, Homo sapiens
  chr7:45197382-45197433
  hyper
cgcccccagcgggaccgagcgtgacccagctgcggccggccagccatggag

SEQ ID NO: 31268 - DNA, 327 bp, Homo sapiens
  chr7:45613487-45613814
  hyper
tgcgcatggaagggacgtacgccccaggcctccaccttcctcctgaccccggggattcttggacgtcgattctccgtctcgtaggggcgagggccctgggttcgcagtcagacgcgggcccctctcaaatctagtggcctggttttattgagtgggggaaggcacatattttccaagattaactgccccgcaacagggaatttcgcaggatttcagtattttcgactccccaggtgacgccaagagggtgggttccactgtgcacggtggggaaactgaggctcggaggggacaaggaaggtactcgaggtcacgcggctcctccgg

SEQ ID NO: 31269 - DNA, 880 bp, Homo sapiens; identical to SEQ ID NO: 3040
  chr7:45613857-45614737
  hyper

SEQ ID NO: 31270 - DNA, 87 bp, Homo sapiens; identical to SEQ ID NO: 9039
  chr7:45928490-45928577
  hyper

SEQ ID NO: 31271 - DNA, 51 bp, Homo sapiens
  chr7:45959968-45960019
  hyper
cctgggattgcagtccgtgtgcacccccgtgcggggcgaggagaatctcct

SEQ ID NO: 31272 - DNA, 267 bp, Homo sapiens
  chr7:45960227-45960494
  hyper
cagtgagaagaaaagcggagtctcccgcagcggcacccagcaacccccaggcccttcggcgccagtgcgccgggtgctgcacgcagcgcacctggcgcgggcggctcacctggagctggcggcgctggcagcaggtaggcgcgcaggcggctgacggcactagcgttgacgcagagcccgcggccgtccagcagcgcctgcagcggtcgcgcctcgtcgggcgacggctggcagcgaaggccggagccacagcgctcggtgtagatg

SEQ ID NO: 31273 - DNA, 373 bp, Homo sapiens; identical to SEQ ID NO: 9040
  chr7:45960743-45961116
  hyper

SEQ ID NO: 31274 - DNA, 43 bp, Homo sapiens
  chr7:45961508-45961551
  hyper
gcaagaagactctcacgtgttgctacaccgcaagtctccaatt

SEQ ID NO: 31275 - DNA, 201 bp, Homo sapiens
  chr7:45961756-45961957
  hyper
gtcattttttgaaggcgacttcgtattactgtattctcgatgcgttgggattctagcttatctctgcaatctaaacacttttcagtaaagttcgggggcgcaattgcgcgctgaggtcgctgtaactcctgtcggccttctctggcactcgagtttcttcagttttgtctgcgcaccccctcccttcggtgaccaacagag

SEQ ID NO: 31276 - DNA, 962 bp, Homo sapiens
  chr7:48074917-48075879
  hyper
ggttccccgtggcatcgctgcgctgccctgccctggtccggctctgggctacgggcagttgacaggcggcgcccgcgctccgcttcctgccctgattggcccaccgctccccctcaggcttcccctattggctgacagtgctccagccgcgcccgccggttggccgttcagccgttgccctggcgacgccgatgttgtggttccgcggcgcgctgggagtttgggtttggttggctgcagccagccagccgtgtaaaaactccaacgccgggcgccgcgggcagcacccacggagacccgcggggagctggtgagcctgagcgggctggaggacaatgggggcgcccactgtggtcccgggccttgtccactgtgcggagctcgcagtgcgggcagtgcgcgccggggctggagggaggggaccaccttgtcgccgggttgggatgagcacagggcgggatctccaagcctgcccaagtcccgcggccccttggttacctgttgcttatcctctctgtacttgctgtgtccctggcgtggacgtgcctgtactggatacccggcgtgacgtgccccctctgtgtgccccgcacgcacgtgtctctgctgaataccccgcgtgaatgtgcccctgctgtgtacccggagtgcgtacgtccctgctgtgtaccctgtgtggacgtgccctgctgtctacccggcgtgcgtgtgttcctgctgtataccggcgtgatgtgctcccttctgtttacctggcgtggacatgccccctgctgtataccctgcatggaagtgccagcgctaggcgatcgtaaggcgcctgcaggcgtgtcagggcgaggcgtacagaccgacccagagcgggcgcgcggattttgcttttgcagctgcagctcctggcaactggtcaagcaggcagcgtccagcgcacccgcgaacaccaggtccggcagcatctgtct

SEQ ID NO: 31277 - DNA, 327 bp, Homo sapiens
  chr7:49812691-49813018
  hyper
agaggaagatgggagcggggagagattggcagagattcagaaagttcgcgcttgagatttttacgtttcttactcgtaaacgtctatttctctgggtttctgaatgcaaagacgagaaagtctcaacagtctgctaaactaacacggccttcgaatcccaatctgaacacagtagctgaaacaagctgtccacaaagaggaaagccagagggggccaattaggaaggaagaaattaaagaaaagagaaaagccaagatgaaaggtccagcgcaaagtgaatgactcgactggagaatggcagccctggcagggtctgcggccggctg

SEQ ID NO: 31278 - DNA, 284 bp, Homo sapiens
  chr7:49813809-49814093
  hyper
ggaggaaccccctcccccgcccaagtttgtgaatatgggcgcttcgcccagtgttgaggtcggcagggaccgggcagggggtcagcagggccgggcacgtccggagccctcagggaggagggctgagggggaggggacagacgcaccggagtgcgcagagtgggggcgttcggggagtgaggcggagagaggctggattgccggtgtcctgcggcgtctcgggctctcccagcccctttgggcggcagaaactttggaatccagaaaggctggccgggatccag

SEQ ID NO: 31279 - DNA, 630 bp, Homo sapiens
  chr7:49814121-49814751
  hyper
cgccctggggccccagcctcccgcactgcacaccttggtgctgcccgggcgcttctgctccgcagccaggacactacaagactgagcgctgcggccggcgacctggctcccaaggctcggaggggcgggccggcagaggagctgaagccccgggaatccccgacccggccctctggcaaggggccgagggcatcctttcatgcagcggggcttagagagcggggagggggcgtctgctcccgagacgggagtcttttaagaagttgttagaaatgaatcgtggagtcctaggagaagctttgtttaacctccccgcattttcccagcacaaccccctaaagcaaatgaggaagagtttccctcttatcttcctgtacattcgtccgtctctaactccactgctgaattctccatttaataaccttcgggaaatgtggccaggacctagggagggacaccctgggtgcctgaattacgtggttcaaggcagagctttgcaggggggcgcgggcctggctcgctgcgttccctgggctccgcaagccgcccttggccatctccaacactaatcacgactacatcagaaacacgccggccggtgtcgttcttggatttcgcttccaatgtatc

SEQ ID NO: 31280 - DNA, 134 bp, Homo sapiens; identical to SEQ ID NO: 685
  chr7:49815116-49815250
  hyper

SEQ ID NO: 31281 - DNA, 109 bp, Homo sapiens; identical to SEQ ID NO: 686
  chr7:49815656-49815765
  hyper

SEQ ID NO: 31282 - DNA, 269 bp, Homo sapiens
  chr7:50343221-50343490
  hyper
ctcgcatcctggggccggagcctgaacccgggagccaaggggccccagttccagggacgtgaagctgagcgtacagcgggcgctcccagacactggggaaagtgctttacgatgtcccgagtccctccagtctcgccagcggggcgagcgtgagggtgccccgaccgaccagcggccccgggtgcagggtggcgggcccggcggcgcgcgtccccctccccctcctggcggcccgcacgtgtcgcccgcgccgcgcccccacgggttac

SEQ ID NO: 31283 - DNA, 320 bp, Homo sapiens; identical to SEQ ID NO: 3046
  chr7:50343974-50344294
  hyper

SEQ ID NO: 31284 - DNA, 36 bp, Homo sapiens; identical to SEQ ID NO: 3047
  chr7:50344295-50344331
  hyper

SEQ ID NO: 31285 - DNA, 406 bp, Homo sapiens; identical to SEQ ID NO: 3048
  chr7:50344332-50344738
  hyper

SEQ ID NO: 31286 - DNA, 40 bp, Homo sapiens
  chr7:51383352-51383392
  hyper
aactacaaagtccaccgggactgcgcgctaccccgcggcc

SEQ ID NO: 31287 - DNA, 46 bp, Homo sapiens
  chr7:51384251-51384297
  hyper
gccccctctccaccccgcccgaccgcggggccgcttacccggtcgg

SEQ ID NO: 31288 - DNA, 166 bp, Homo sapiens
  chr7:54609786-54609952
  hyper
tgtcctcctcggcaccgagcgatctgatccgccgagccagaaagacacccgatgggggagagaagcaaagtggaaaaaaaccgacgtccctgctctccagaagggagaccccagcggcgccgacgagccctgcgccctccgcggccgcccggcgcgagctcccggg

SEQ ID NO: 31289 - DNA, 31 bp, Homo sapiens
  chr7:54609991-54610022
  hyper
cgcagccattagagggaaaagttgcggcgcc

SEQ ID NO: 31290 - DNA, 130 bp, Homo sapiens
  chr7:54610023-54610153
  hyper
cgagcccggcgaagtcctcagcccgccccgcttgcccactccccacttcccgagccggctccgtgtttagggagggcagtgatcacgcaagccggagcggcgggctgacgttggacgagctgccaggtag

SEQ ID NO: 31291 - DNA, 434 bp, Homo sapiens
  chr7:54612363-54612797
  hyper
tgtggagatgtcctgcgccttccagagcggctccgcctcggtgtatctggagatccaatggtggttcctgcgggggccggaggacctggatcccggggccgagggggccggcgcgcaggtagcggagcccgccgaccccgcgtctccccttcgctcgcccggtcctcagggtgtccggcccggggctgggggccgaggtgctgcctggacacccctggggacctgcccggttctgtggaagcgagtgacccccagggcttctagggagggaaagggaatttgtcctggggacgcgaagttaaaacccagaaggaagtcctgctgcccagtttcttcctgttaaaccgggaagcgcctcctcctgtaagttctggtacttaggcagatgcccgccttgcccctaccacgctgccacatcccgggacatccgggag

SEQ ID NO: 31292 - DNA, 99 bp, Homo sapiens
  chr7:54614009-54614108
  hyper
ggaaaaggaaaatagcgggaggaggggagaggggaagggggtccgggcgagggagacctagttgagcgagaggcggcgcccctgcgagccagcaagaga

SEQ ID NO: 31293 - DNA, 50 bp, Homo sapiens
  chr7:54614391-54614441
  hyper
gccccgggacagccccggggaaagcgcggggacggcgtggggtatgccag

SEQ ID NO: 31294 - DNA, 30 bp, Homo sapiens
  chr7:54614739-54614769
  hyper
gcccttccctgtccccgagaaggcggcttg

SEQ ID NO: 31295 - DNA, 510 bp, Homo sapiens
  chr7:54732044-54732554
  hyper
tcagctttcccaggccgctgttgccgggcacaggctccgggcacacgagggggttccgtgcagcccgctttgcagagggaacggaggcgcagagagcctggcccgggcgcgcggccgcgagggtcgggagcagggaatccaccgctgcagctcagctctgggcaacgctgccacctgctgtcccgcgcagccgcacagcggcccgggcgtcccagcctccgcgagaaagactgtgcctgacctgcacggaggatgacgctgaccggccggtgatgaggaagccaccaagggaagcaattagacacaggacgtgctggacctgcaggctgcacaggccaagggagggccccaggcgcagcgggcggatctgcgggtccgcgggctgcgtccctgccctgtggccgagactgtgacagtctccgcagttggcagccgagtgcactgacacttaggctgagtccgcaaacagaaaagcaccaaatctcagtggctccacgcaacaggtgtgtt

SEQ ID NO: 31296 - DNA, 65 bp, Homo sapiens
  chr7:55086624-55086689
  hyper
ctcctctgctcctcccgatccctcctccgccgcctggtccctcctcctcccgccctgcctccccg

SEQ ID NO: 31297 - DNA, 367 bp, Homo sapiens
  chr7:55087436-55087803
  hyper
cccgcacgtgcgccccgcgctgtcttcccagggcgcgacggggtcctggcgcgcacccgaggggcgggcgctgcccacccgccgagactgcactgtttagggaagctgaggaaggaacccaaaaatacagcctcccctcggaccccgcgggacaggcggctttctgagaggacctccccgcctccgccctccgcgcaggtctcaaactgaagccggcgcccgccagcctggccccggcccctctccaggtccccgcgatcctcgttccccagtgtggagtcgcagcctcgacctgggagctgggagaactcgtctaccaccacctgcggctcccggggaggggtggtgctggcggcggttagtttcc

SEQ ID NO: 31298 - DNA, 290 bp, Homo sapiens
  chr7:56183846-56184136
  hyper
cgccgagtccggcccttgctgcgccctgccccgcaggccgggaagtcgcgcaggtagtagtagtccaggcagtcgtaaagctcctcctcgtagcttatgggtggcggcggccgagccagagcctgcagacgtggaagcgcccgctctgcgggcgcttccatcctgcccaggcctgtggccaccggcggccacctgcccgcgtctgggcgctcctggaagacccagcagccccgcctcgagttccgatgggctccgcgtgaaggtgggggtgccttcggcgacgccacaga

SEQ ID NO: 31299 - DNA, 44 bp, Homo sapiens
  chr7:56355700-56355744
  hyper
cgtctctggcgttggcgctgcagccgtgacggaggactacggcg

SEQ ID NO: 31300 - DNA, 443 bp, Homo sapiens
  chr7:63767561-63768004
  hyper
ccaaagagctgggattacaggcgaaaaccaccgcgccctgccgccctgccgccctgccgccctgcctctctttctaaagctatgcccaaaccccgagcccggagcatgccgggattgtagtcctgcagtcctgcaacctagggactgcgagaggttaagagactacatctctcagcatgtctagctaggcgcgcaccgccgtgtccccagggcttcgcaccgcccccagacttgcgcatgctgggattgtaatactgtcgccttgccaccaacgggctacgagcggttaagagactacagctcccaggatgtacggtgatggcacccgtttggactccgcccctctgcgcgtctagagctgttctcccgtgcggaggggatcctggctgttcccaaatctcgcctgcctgcgaggagccagcgtggcccgggcagctgatctc

SEQ ID NO: 31301 - DNA, 98 bp, Homo sapiens
  chr7:64349041-64349139
  hyper
cgcgtcttcggcaaagtcttcggggtgagaggtccggctcctggaggacagcgggatgggagagtcccgttcacacccagccccgcagagccggatag

SEQ ID NO: 31302 - DNA, 30 bp, Homo sapiens
  chr7:64350006-64350036
  hyper
gctgctgaccggagccgcctgggtctgttc

SEQ ID NO: 31303 - DNA, 289 bp, Homo sapiens
  chr7:64407780-64408069
  hyper
cgcatcgctctgtccctctcatgtcaggcaagccagttccggaccgcgtggcaccaggagccgccaggagccggggcgacccagaggtctccagcgacctggcgtccggcgaggacacagcccccaggaggggttagaccacgggagccggagcccgagtcccagggccgccgagccagtttagagtggtctccaggccctagtgggaaggggctccgcgcttctgggcgtccacaggagctgcatggccctgcccgctgacgcccggtcgggacgctccacaccctgt

SEQ ID NO: 31304 - DNA, 369 bp, Homo sapiens
  chr7:64700293-64700662
  hyper
gagggcggctccttacgtaggcgggcagagacagaagctggcgtggccgggctcctgctcccctattctccgacccccgccacctagcccgcgccacccagggctcctggatcgtctggctcggggcctcctccccgctgcgttccctccctggcggctgcagagccctcctgggcagcggaaacaaacttccccgagcaggaagcccgtgccccagcctcctctcggcaaggaccagcccgcggaacaccccggcccctcggcgcctgccctgtccttctggctacgggtccaggagggctggcatgagaccaatcgcgaccctgcggttccagagcctgcgtcccgcactgccgagaccacacagtc

SEQ ID NO: 31305 - DNA, 726 bp, Homo sapiens
  chr7:64712278-64713004
  hyper
ttctggctgtcccaccggcgatgctgcgcttccacaccacccggcgcacaggcgttggtagatgtggaaggtaccaagagcggcaggaggaaggggcgcgcggacacccagccccttcccgcgcacccagagcaggaagagcagcgcgcacccggtcagcgacgcggcgggctccactgtggcgcgcgcactccgagcacggagggctgcaggctcacgccacctggctccgcgcccatcccaatccgcacccgccgcccaggaaccggggctcaccctccgcctgacaattgtctcggggtgccgagggtccgtggcccgttgcccgggaggtgaccactgaggagtcgcgctgggtatcggaccaggaactcactgctttcattggctgcggaggtcagaccgtcccaccctcttctccccgccgccgcggcaaggccagggcgaaagggacaagtgcgctgctggggtcctctgcgctgtgcgggtccgggactcagggttcccggctgctaacaaggctgcgtagcttccccctcccctcctccttaggtggcaacttgtggacacacccattaagcggtcaggcgtcaggtttcctcccgagaggtgggaggcgccctggccttgattcatcgtgaagctaggcaggagatttcccagccacggagggtggaaagcttgccttgacctcagcaggtcatgtcactccgtgtgcacaaggcc

SEQ ID NO: 31306 - DNA, 299 bp, Homo sapiens
  chr7:64734473-64734772
  hyper
gctggttgaaaccagcggaaccggcctccccacggtcagctcccgggtccacagacctgagtccccgttggcgcagctgggccctcagtacccccggagagtggggtggggggcggtgcaagacggcagctgagccagcggactttgacccctcaccgtcctcttcccgcgccgcgacctgcctgaaactctctgggcagcgctgcacccgcagccccgactctctcccagattgttcagggatgacagagggtcattagagcagaatcccgactcggtgggtgcgtgggaggagctgc

SEQ ID NO: 31307 - DNA, 180 bp, Homo sapiens; identical to SEQ ID NO: 3050
  chr7:64974270-64974450
  hyper

SEQ ID NO: 31308 - DNA, 480 bp, Homo sapiens; identical to SEQ ID NO: 3051
  chr7:64974510-64974990
  hyper

SEQ ID NO: 31309 - DNA, 102 bp, Homo sapiens
  chr7:65037609-65037711
  hyper
gaaaatgcaaaaagccgcagcgggcgaaaagccgcggcagcggggggccaaaagccggacgggcagaaagccgtggcagcggcgggcaaaaagccgcggcgg

SEQ ID NO: 31310 - DNA, 79 bp, Homo sapiens
  chr7:65446028-65446107
  hyper
ccttctcccgatccccgggcccagctctgtgcagtgcatgccgctgtggccagagtgtgtgggtggctcatgccagtaa

SEQ ID NO: 31311 - DNA, 113 bp, Homo sapiens
  chr7:65508930-65509043
  hyper
cacctactttcagggcggacagactcaggcctttacagcctgctaagtcccgggtcggataccaggctgggctccacccccgcactgtgacccagaaacgctggtaaatgaat

SEQ ID NO: 31312 - DNA, 655 bp, Homo sapiens
  chr7:69062375-69063030
  hyper
gcggggcagggactgcggtttgccggtctaacgggtcctcgagctggggcggcggtcccggccccttcggccccgcccctcgcccgcggccgcctccgaggttcaagttcggcccccggctgttaggcctcgcgctcccggatctgaagccgcccgtgcgtccctaggtcccccgctggaagacgaggcgggaatcccaggggtcatccgggcgcggggtcgctcgtccacgcactgtggtgccacgtggaggaaaagtttccaactctgccagttggtgctcccactgcgcccaggcggagcaaaggcccgcgctttggcacccgctccccgttctgtctcctccagtcgcgccccctcccagggacgccccccttgtaccccttctctgaattcccttctctcctcgcagcgcaggtagccaagggaaaacacccttgggggctggtggggcttcccgagaaggcggcctcgggccggccaggggtagaggatccagggacaagtgtcccgaggaggatgtggggggcgcgcgcgcgaagtggcctgggagcaggggcccacacgcgtccccgctgcgacaggcgggatcctccggcggcttccacgccctggcgcgccaactctgcccggccgcggccgaccccacgcgggc

SEQ ID NO: 31313 - DNA, 526 bp, Homo sapiens
  chr7:69064246-69064772
  hyper
ttgatcaaagcattccgctattctgatttattgcttgcttggtgagttatttttttttcctctaaaggagacctgtgtgttcagccattactttgctcggcgctgctcccaggcatctccgaccctcggtgctgtggggagccccacacttgggctcctcgcctctcgccctcgctccccgtccctcctcccctctctccgccccttcccccttttctttctcctctctttcttcccctctctcccttctttcggccgccgtctcccccgcgccctcctcggggcggagggaagccgtgaagggggagggagggctcggtgtcaatttttttttgtgtggctgcggccgtagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccggg

SEQ ID NO: 31314 - DNA, 328 bp, Homo sapiens
  chr7:69064833-69065161
  hyper
cgccccgtcccggcccagacccccgcggaggaagcggagagagtccacctcggcagaagaggacatcattgatggatttgccatgaccagctttgtcacttttgaagcgctggaggtaagggggaccccccttcccccgggttccctttatgcacgaccccactcggctgcgcccggctctcctgcctccctcgccgcgctccgggctgtctgtctgtctgtctgtctgtctgtctgtctaggctgaggtcttattgttggtggggggagctgggggcgcgggcagacaggcagcaggagggagtcgcaaagccgtgcctggtctcgt

SEQ ID NO: 31315 - DNA, 269 bp, Homo sapiens
  chr7:70596147-70596416
  hyper
atttgaacagagcagcgggtgggcctagaagcagtgactggggaggttagaattcttgcacgcagagaacccccccaagcccgctcacgcccggcctggctccgaaggtctcagaatccgagcctccaggccagattttccctctagccattcctggccacgcagcgcggagccgcgagcacacagaaaaggatgtcttcatcgccaaccgggatggaacgaacccgcccgctcagggagtactgagaactaaagggtccctccagcgc

SEQ ID NO: 31316 - DNA, 258 bp, Homo sapiens
  chr7:70596453-70596711
  hyper
cgcggtccccactctccagaagcccccgccctgcccgggtgcgcgcgcgcacgagtcggcgaaccggggagctgtgcgctcggcagcctgcgggcggcggcggcggccgccgacagcctctcggggacagggtggcgaagagcggcggaggaggagctggcgccgccgccgctcccctcgggccgcgccccgccctccgccgccacctgcgcgtcccctccgggctcctcagctccggggctgtgtggctctcggtgc

SEQ ID NO: 31317 - DNA, 74 bp, Homo sapiens
  chr7:70598050-70598124
  hyper
ggggctcgacgcgggcgggccgggcacagggtgagccccagggtccttgcgcgctgcgccctgtgcctgggagc

SEQ ID NO: 31318 - DNA, 346 bp, Homo sapiens
  chr7:70598169-70598515
  hyper
cgtttcgggcagatggccggggctgctggaaagaacaacttgcctgattcttttctgtgccccacctgcaaatttggttttatcctggaaacatgtcagtacagttggctcccggtccccgcgtgcggactggaaatcattccctggcgactccagcccgagcgcagaaactagtggaggggccacatgggactggaggcgcgcgggcagacgtgtaggaggaaatagtcttagagcccagcgtttggtggggtaccagtagggaacctgggagattggagggcttggatgtctgcagacaaagtcaaggccccaggtcgcggagctaatgcgcttaggtagtata

SEQ ID NO: 31319 - DNA, 199 bp, Homo sapiens
  chr7:71217033-71217232
  hyper
atgcagaagataaaacgtttcgcagcaccgggtccaaggaagtgcaatacaacagcaaaatgcaatggccgcagcagctcagtgatgggccgagactcgtcccgtgtggcggagatgctggcatcccccctgtggctccaagcgctgagcttggcggcggggacctggcggccccggctcggctcgggacaggcaggtg

SEQ ID NO: 31320 - DNA, 126 bp, Homo sapiens; identical to SEQ ID NO: 3053
  chr7:71800631-71800757
  hyper

SEQ ID NO: 31321 - DNA, 172 bp, Homo sapiens
  chr7:71800933-71801105
  hyper
cgctagtccggagaaactaggaacccgagtaaacccagactgtccggggaagacggatcccacccccacctgggcgccagacccatccagctgcttggagctcagagactaggtcccagccggactgcagaggcctctctggttaccccttgcaccctggcgcccccggact

SEQ ID NO: 31322 - DNA, 141 bp, Homo sapiens
  chr7:71802206-71802347
  hyper
cgacagcaccacactcctcgctctgccggcgcccgcgttcaggagccgggcttctgggctcgccttggccgcctgcgccccagctcctccgagggtcggggagcccccaccccccaacctccgcctctccaatggctccct

SEQ ID NO: 31323 - DNA, 74 bp, Homo sapiens
  chr7:71802449-71802523
  hyper
aggcagacacgcggggggcgagcaggcgcttggcagacggtgctccttccttcccttcccaaagaggctgccca

SEQ ID NO: 31324 - DNA, 190 bp, Homo sapiens
  chr7:71802577-71802767
  hyper
cgccgccttcactacttcatcccaggtgcccacaccctagatccacgattacacctgagcccagggggaaggcggggcgccgaagtggaggggccaatggccgaaactgcggggaccagcattccgcgtgaccgcccctggagacgtccagggaggcacggctgccgcagggcatcgcccacccaccagc

SEQ ID NO: 31325 - DNA, 165 bp, Homo sapiens
  chr7:76145381-76145546
  hyper
atctgtgcacaaggccggtggttcccgtcgtcgccactcggggtcgccggtgagccgcagccaggccgcctcacggccagtgtgcatgctcgctgctattcgctgccccttctgcctccgaggcggtagcagatgccacgttggcggggtcggtgaaggtcagga

SEQ ID NO: 31326 - DNA, 117 bp, Homo sapiens
  chr7:79081775-79081892
  hyper
gtcccttcttttcttcgccagcggtggctcacggatccctaagggacagctggggacccaggcgcccccagcccagccccagaaacgctggacgcagttctccgctcaccccaccac

SEQ ID NO: 31327 - DNA, 420 bp, Homo sapiens
  chr7:79082159-79082579
  hyper
ctttagcccccaagtcgaatccccggcgaaactcacttgcactgcgggtgctctctggcccccaccccatcatcgcgcaacacacccccttcaacatgcgcggccaccctttcattgccctgcgccccgagcggtcccaccgcccggcaaaacactgagcaagccgctgctctcaccttgcttgacacacttgagccggagggggtccttgcagtgtttgatcacggccagcacgtccctgatggtgagccccgccacgggggtctcgttcacctccagcagcagctcctccgacaccaatttgctgccgctctcataggccaccttgccgggcttcacctcccccaggtaggggaactgtccattctcggcgccccccttcagttcaaagcccagctggccctccgggttcctgccaat

SEQ ID NO: 31328 - DNA, 644 bp, Homo sapiens; identical to SEQ ID NO: 689
  chr7:79083190-79083834
  hyper

SEQ ID NO: 31329 - DNA, 53 bp, Homo sapiens
  chr7:79764160-79764213
  hyper
ttggcgaggctgcggcgcggccaccggcgggagtgcagcggccactgtaccca

SEQ ID NO: 31330 - DNA, 220 bp, Homo sapiens
  chr7:79764492-79764712
  hyper
gcgccgaggacaaggcggcggtggagcggagtaagatgatcgaccgcaacctccgtgaggacggcgagaaggcggcgcgcgaggtcaagctgctgctgctcggtaagggcggccgggtcggggcccgggggtcggcgggggaccgggtgcggcgctgcgcggccctcggcgtttggaaacccggagggaagggggaggaagcgcccgaggaggcttctga

SEQ ID NO: 31331 - DNA, 61 bp, Homo sapiens
  chr7:79765016-79765077
  hyper
gtgtaggttgtgtttcgactgtggttttctcatgcccagagtgccacgtttggtgaaatca

SEQ ID NO: 31332 - DNA, 556 bp, Homo sapiens
  chr7:82072006-82072562
  hyper
ttgaagaacagggaccgcgtgtctgccgacacttagatgtttcaaataatgggttggggaggttggatcgcgtggtcccagtacctgcgagccccctgcgtggacagcacgctcggccgcggggagccagcacgcgtctaatcggaaggctgtcaagtgcatccagtaacgtgggataaaacgagtttgggcactacagcaattaaagagcatctccgaggccaagtgcgggggaagtccacgctacctcggcaagcctgaaattacctgtttgtaaattacccaaccaaaacataactttttattgaactgggttgaatcagagcgggtgagctggctggaaacttttttccccagtacggctgcactctgaagtctagagaatcccgttagagacgggctgagacgccgcgagtcgtcggcgggcgcttcccgggacagtcggcccccagtgcccggccccgtggaggcgcccgagacgccggttcgggacgcattccagcggcgagcggcgcgcaccgcctgcccggcgtctccgcatccgagcctggctccc

SEQ ID NO: 31333 - DNA, 53 bp, Homo sapiens
  chr7:82072646-82072699
  hyper
cggccggcgctccctgcccggcccgccgacttacgtgacggccgaagggaacg

SEQ ID NO: 31334 - DNA, 59 bp, Homo sapiens
  chr7:82791978-82792037
  hyper
gggagcagtcagagccggggtccgcctcggggcgtgcaggcagccgagtccctggactc

SEQ ID NO: 31335 - DNA, 34 bp, Homo sapiens
  chr7:83277925-83277959
  hyper
tccctccaggggcagcgtgcgagaggctttgtca

SEQ ID NO: 31336 - DNA, 45 bp, Homo sapiens; identical to SEQ ID NO: 9081
  chr7:83278225-83278270
  hyper

SEQ ID NO: 31337 - DNA, 71 bp, Homo sapiens
  chr7:83824239-83824310
  hyper
agctcctctgatagccggtggcagtctctaatcctgctccctgcttcattcggctccggggaagcagaatg

SEQ ID NO: 31338 - DNA, 59 bp, Homo sapiens
  chr7:84814638-84814697
  hyper
tccccctcgtctctgcgcgcccccaccccgccatcccccgctagcgcacacatgcagga

SEQ ID NO: 31339 - DNA, 35 bp, Homo sapiens
  chr7:84815396-84815431
  hyper
cgcccattcctcttccaaaacgctacaacaaaaac

SEQ ID NO: 31340 - DNA, 102 bp, Homo sapiens; identical to SEQ ID NO: 9083
  chr7:84815744-84815846
  hyper

SEQ ID NO: 31341 - DNA, 127 bp, Homo sapiens
  chr7:84816225-84816352
  hyper
ccgcgctaggacaggcggagagcaaggcaccagctggagctttggggaggagagggtggcgaggaaaggcacgctccaaacaggagggcggcttttaagtttgtggtgtgaccgcagcagctgtcct

SEQ ID NO: 31342 - DNA, 510 bp, Homo sapiens; identical to SEQ ID NO: 3058
  chr7:86273208-86273718
  hyper

SEQ ID NO: 31343 - DNA, 13 bp, Homo sapiens
  chr7:86273719-86273732
  hyper
gcttcagcctggt

SEQ ID NO: 31344 - DNA, 47 bp, Homo sapiens
  chr7:86274070-86274117
  hyper
ctacctcttttgtgtcggatgaggaggaccaaccatgagccagagcc

SEQ ID NO: 31345 - DNA, 32 bp, Homo sapiens
  chr7:86274257-86274289
  hyper
cgtggggcaggcgcagccgggaaagttgaggt

SEQ ID NO: 31346 - DNA, 39 bp, Homo sapiens
  chr7:86688488-86688527
  hyper
ggcaacttcacccctcgaagcaaacgaaagcccctgttc

SEQ ID NO: 31347 - DNA, 137 bp, Homo sapiens
  chr7:87104813-87104950
  hyper
caagtacaccctctccggcggcccggcgcacgagtcgcggggcccgggggcactgggtggaggtccggccactcccgccccgcgccccacgtcccgggtctcccttcgaggccagacgcgcccggacctctctcacc

SEQ ID NO: 31348 - DNA, 653 bp, Homo sapiens
  chr7:87229536-87230189
  hyper
tgcatgagcctcaggcgcgctggaggtgagactaacctctagtcccccgtcgaagccagagagcagtaagagggagcgcccgccgttgatgccccagctgctctggccgcgatgggcactgcaggggctttcctgtgcgcggggtctccagcatctccacgaaggcagagttgggggtctggcagcgcgttctggactttgcccgccgccagtgcgattctccctcccggttccagtcgccgcggacgatgcttcctcccacccaccgcccgcgggctcagagagcaggtccccgcaccgcgcgggctgtgcgcgctccgggcaacatggtccagtgccactacggtttgggcgctgctccaggagctcctgagtctagatctaaccccacttggtccccatggacttgccagaggacttcacactatccacgcctcaagaagcccttctcccgtgaagaccaagttcaggaaatctgaaagcctgacacttgggaactgtcccatagtagctcccagctttgcgtgcccctacctcgcgctccttggaacggccaccaagacgtgaaattttggaagaagatactccgactttagtggaaagacctaaaggaaacgaacagcggcctctgcttctttgagcttggaagagcc

SEQ ID NO: 31349 - DNA, 154 bp, Homo sapiens
  chr7:87230190-87230344
  hyper
ctactcgaatgagctcaggcttcctgtggcaaagagagcgaagcggctgtgctcagcccacgccccggcgctgttcctgcccagccaatcagcctcaccacagatgactgctcccggcccggattgactgaatgctgattcctcgagaaactgc

SEQ ID NO: 31350 - DNA, 178 bp, Homo sapiens; identical to SEQ ID NO: 3062
  chr7:87230345-87230523
  hyper

SEQ ID NO: 31351 - DNA, 135 bp, Homo sapiens
  chr7:87256912-87257047
  hyper
ctcctgcaggtaaaacggtgggtagtgagaagctctaggaagggggcgcttccgaacacgcgcgtcgaggagggcgttccaggactctgagggagcagcccagctggaccgaggccgcgtcgttcctgggcttac

SEQ ID NO: 31352 - DNA, 413 bp, Homo sapiens
  chr7:87257327-87257740
  hyper
acttaggcccaaggtcgggtgtgggagccggcgcgctgctttctaggcaggcactgaagctacggcagccacgcaaataggtatcagccgttaaagcttggctacaggcaaggggggggcaataggcccctggcgctgtggggccccgcatcccacaatccccgcggctagcctgtgtggctactggcggcagctagcgggctgcgaaagcgagcccagcgtccttgacagcagcccacgcgtcggggcggggcttgagcccgctgctttaaaaggtccgcgcggccggccccgcccctctggtgccgcgattggatccggcgggggtagcgttgatttgataggcgcagagagggtggggctgcgcacgcgaggccgggggccttgccgctgcctcccgggctggggcacga

SEQ ID NO: 31353 - DNA, 115 bp, Homo sapiens
  chr7:87258283-87258398
  hyper
gaaccagcctcccgccggggctgagagctctgggcttccgcgcgggtccttgggggtcccgggcatgatgggctgccgcccagtgcccccgcctatgttgcgccagccaaatctg

SEQ ID NO: 31354 - DNA, 64 bp, Homo sapiens
  chr7:87936120-87936184
  hyper
cttccaaggaggaagcgtccagcgccaacggtgcgcgccgcgggccgggcgggtagagggaagt

SEQ ID NO: 31355 - DNA, 50 bp, Homo sapiens
  chr7:88387737-88387787
  hyper
gaattagcgcattggcggtagcctttcaattccagcgctgaagcaacaga

SEQ ID NO: 31356 - DNA, 30 bp, Homo sapiens
  chr7:88388001-88388031
  hyper
aaacgaaataaggtccgttaaaaaccactt

SEQ ID NO: 31357 - DNA, 30 bp, Homo sapiens
  chr7:88388282-88388312
  hyper
gctcattcttgcaaccggctggggagctgt

SEQ ID NO: 31358 - DNA, 40 bp, Homo sapiens; identical to SEQ ID NO: 3063
  chr7:88388606-88388646
  hyper

SEQ ID NO: 31359 - DNA, 255 bp, Homo sapiens; identical to SEQ ID NO: 3064
  chr7:88388647-88388902
  hyper

SEQ ID NO: 31360 - DNA, 215 bp, Homo sapiens
  chr7:88389046-88389261
  hyper
cgccgggtcccctccgtgctctgtgctgtcgccgccgccgcctctgtcagagcagcagctgtcggcagcaggagccccgcacggggcgcggagcagggacgcgctgccaccgcctccccctgcgtcctgctggccgcgtcttctcgggaggtggtagtcgctgttgccgctgagaaacccgcccgctttccacggctggtcgcctggtgaggagt

SEQ ID NO: 31361 - DNA, 240 bp, Homo sapiens
  chr7:89748054-89748294
  hyper
agacgtccctcatgccgggcgcaccaccggcgggccggcggttccgttggcttccctgacatacttcctacagtcatttctttcagctgagatcttcccctttaatacctcgttaattaacgtgtaaccttttggttaaaatgtcagagctaagactaaatctgaagaaaagaatgaaaccaccgtaagttcttcagactcagtcgtcagcaaggttatggcccgaagccgtgcagaggc

SEQ ID NO: 31362 - DNA, 268 bp, Homo sapiens
  chr7:89748295-89748563
  hyper
gcgcgcggggaagctactggcagagctgtgcgcactgggggtgctgcaggcgctggggagagtgtggagaggctgcgtggagctgcgcgctcggggtgggggctgcactcccaatgaagcgcgtgaagggcaagcggtgatgggttctgcgccagtggggctgggagcgtgtcgggggctgtacgtggggctgcgcgcaaggtgagaactgcgcatctaggcttggggactgcgcgcaccaaaggcttgcaggcgctggggagggtgg

SEQ ID NO: 31363 - DNA, 20 bp, Homo sapiens
  chr7:89841213-89841233
  hyper
cgccgcggcagccaccctgc

SEQ ID NO: 31364 - DNA, 539 bp, Homo sapiens
  chr7:89950183-89950722
  hyper
tcaatttcaggctagcgcctctccctgtgcccccagccctgggtcaggtcacctgggcgcagaagagggaggccacgcgggagtcgaggacctctggtcgccgtccgaggagcgcgtcccggcgcggtgtcctgggtgcgctacgctcgttgggaggaggacggggcgcctcctgcccacgaggaaccagaggtttcagcggggacgacccctgcccagggcgccctctgcccagcggacccacttcccgaggcaggcgaactgggcgaggcagcgctgtgtcacccaccccgagcgctcaccgggcgcccaagctcgctcagcggaaccgtctcggccgcggtgcgcttcggcgctgggaggctctggctggcactggctcaccgcgggtggagctgccggttctgctgcggccacgcggggttcccgagacagacccgccgctgggaccgcgatccttttctagaggctgagtgagggggcagatcgtgggtggccgcgctctcgaggcccctccctgacctcgcccaacttcccag

SEQ ID NO: 31365 - DNA, 16 bp, Homo sapiens
  chr7:90226268-90226284
  hyper
ggttctcccctcctcc

SEQ ID NO: 31366 - DNA, 278 bp, Homo sapiens
  chr7:90226285-90226563
  hyper
ccactagtgctcgccctttcgcgcgcgtgggggacgggcgaggggacccctcggcccccaccgcgcaaggggctgcgcggctgcttgggccacttgttattttttgcgcacaggcttggatattgggcgtttagtcagtaatttagctttggaaattggtgaaacgttagactgtgccctggtattgtttaacgtatccaacctaaagggaagtgggacagttaccttgggacctattgttcggtacttcgggtcctggaaagcgagatttgggtgtt

SEQ ID NO: 31367 - DNA, 89 bp, Homo sapiens
  chr7:90894938-90895027
  hyper
cagcaaccctcagcacggcggcggagggcaccgtggcggcttcccggggggcgccggcgcgtcggagcgaggcaagttctcctgcccgc

SEQ ID NO: 31368 - DNA, 86 bp, Homo sapiens
  chr7:90895028-90895114
  hyper
cgccctcaaggtgccctcctacctcaactaccacttcctgggggagaaggactgcggcgcaccttgtgagccgaccaaggtgtatg

SEQ ID NO: 31369 - DNA, 43 bp, Homo sapiens
  chr7:91510048-91510091
  hyper
gaaaagactaacttccggcctcgggtcgcgcgcagaggtgatg

SEQ ID NO: 31370 - DNA, 329 bp, Homo sapiens; identical to SEQ ID NO: 9101
  chr7:91808202-91808531
  hyper

SEQ ID NO: 31371 - DNA, 166 bp, Homo sapiens
  chr7:92466315-92466481
  hyper
agtagggggatcctgcgactaaaataagcggcattagtgggagagagtgggacgtgtcgtcgggagtcggcggagtttccaaacccagggtcgcccagagttggggttttgacagggtgaagcggggggcatcctcactgtgtgacgtggacggatgggaaaaaca

SEQ ID NO: 31372 - DNA, 53 bp, Homo sapiens
  chr7:93203722-93203775
  hyper
ccgcagggtgaggtgcggacgtgcgcacttctccaacccgggaaggtccgcca

SEQ ID NO: 31373 - DNA, 301 bp, Homo sapiens
  chr7:93204298-93204599
  hyper
cgctccagtcagggctggggctcaccctgcgagtccgggagactaaagcgccgcgtaaacacaggaagcaggcgagggacccgagttagaccttgagtagggagggagaggggggcgacagtctggactgggagacagctttctgggagccctgtcccctccccggagaatgcaaattccggagggaggtgagtttccacaagaaccttatcccagagacattgtgaccctggcttcttcagccgccactccggggacagcactagggagcctgtggagggagggtcggtagtgggctagg

SEQ ID NO: 31374 - DNA, 30 bp, Homo sapiens
  chr7:93205084-93205114
  hyper
ctaactctgtttaggcggtgttggactaag

SEQ ID NO: 31375 - DNA, 562 bp, Homo sapiens
  chr7:93519204-93519766
  hyper
atctttccctgagtccgcacaggcactgaattatgatcaatgtcagttgggagacaggaaatgtgttagtggttgtaaatttgtgattacttttaagaaactgaaaaccatgaggtttgcttaacacttgagaaaacccaggctaaaacttcctgtagaaagcgagacgtgggaaactggcgaagctgctaccagccgccggcgcaaggagcgcgagagtcctgggtgcgcgcagggcacttactttctatcctccagcaagcatcgtcgcaagcctcccaggtgtagaaattgttggcgttgccctcgcagcccccgtacaggaactggcggcagctctgcgtgtacctgtcgtagtagtaacggagaagtagggcccggcagggtccgtagtctaggggcaggagacagatctccgcgttatttcctgaagaaggggcagaaggagagcaaaagagagggaaagtggtcaggcgtagctcctaggaggaaagaacatcccggggagttctgtccccttccgagcggaggggcctctgcagagaaagtgcaaacttgggag

SEQ ID NO: 31376 - DNA, 170 bp, Homo sapiens; identical to SEQ ID NO: 9105
  chr7:93519854-93520024
  hyper

SEQ ID NO: 31377 - DNA, 434 bp, Homo sapiens
  chr7:93520025-93520459
  hyper
tccgagaaagcgcctggcgggaggaggtgcgcggctttctgctccaggcggcccgggtgcccgctttatgcggggcgagcgtccggccgacccccgccggggcggagcctgaggggtggctgattcatgcacggggactgtcaccccgccgcccccgcgctgcaaactgtgtaagagggagaggaattccccgccaagttgaaaagttgaacctgcctcccaaactttctcctgtagtccagacggggacgccctgagggagcgtttgtgtcagtaatgggaaatctgcaagctagacggaaatgacctgctagtgattgcgctgtaaagaagccggaatccacctcttgaaggcatgaagttcaggtatttgaaaggctggtggagagaaagtgcggagttcttgggtcagagcggagcgggattcgttgcaa

SEQ ID NO: 31378 - DNA, 477 bp, Homo sapiens
  chr7:93551053-93551530
  hyper
cagccccagcccagccgtcccccgcgggcgtggcaggtcctgagtcagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggctgcagtcacatcctgcgcgggtgggcggcgggccaggccttcagttgtttcgggacgcgccgagcttcgccgctcttccagcggctccgctgccagagctagcccgagcccggttctggggcgaaaatgcctgcccttcacatcgaagatttgccagagaaggaaaaactgaaaatggaagttgagcagcttcgcaaagaagtgaag

SEQ ID NO: 31379 - DNA, 30 bp, Homo sapiens
  chr7:94024050-94024080
  hyper
tcgctccctcctctgcgcccccgcaggctc

SEQ ID NO: 31380 - DNA, 716 bp, Homo sapiens
  chr7:94284380-94285096
  hyper
gcaaatatttgtggccgaatctcggcaacccgctggaaaggattaaacgtgcggttgccgtgactaaacgcattcattcaccctacaagatttaggaaaatgtaacgttgcaagggaagcaaggtctctgtgtaaacctcgtaatcgccaccaaaagtcggtagctgggagccttcaaagcccgccaaacacactggaagcatccacagctgttttaaattggttttggtttctggaaatagcgcactcggtacggcagcatctctggcctccagccggggttaaccctgacctgaacgccctgtttagctcccagcatttcatgattccgcttccctgctccgtaaaaccgaagaaaaccgagatttccgtcaccgagaaatgcacttagcaagagggggaaattcggtgttttaaatgtcacatttttgtgttctctaccactatcaagaaaaggaaaaaagatgtgtttgtgtagcggggacgcagcttgacacccatttcctttggctcgcatcgcggtcgcagagcccaatcgcggggaaacgggccccccagaaaaacaggcaacgacccccagctctttgctacagggatcgggagaggactaccctggggctgggcggggagggggatgttgggaacaggaattggagatggaatttctgcgcccgcagagcagggaggggcccgcgggggcgcggagaggaaaaaaa

SEQ ID NO: 31381 - DNA, 153 bp, Homo sapiens
  chr7:94536847-94537000
  hyper
gccggagaggcccctcgcccacggccgagggggtggggcggcctcgcctcgggccggtgcttttcgcccttccttggccgccagaggctccctctctctccctctcccgggattttgctgccgggctccctctctctgcggccctagagttaa

SEQ ID NO: 31382 - DNA, 131 bp, Homo sapiens
  chr7:95225822-95225953
  hyper
agtcttcccaccagccgccgccgcccgaggttttatttgtctccccgcactctccccccgagtcccaaacaggaggagtcactggaacttggaaacgcgtcctgaactccaggtcgcgccaatcagatcag

SEQ ID NO: 31383 - DNA, 30 bp, Homo sapiens
  chr7:95226177-95226207
  hyper
cccttgtttacaactcggaggctgtctcaa

SEQ ID NO: 31384 - DNA, 30 bp, Homo sapiens
  chr7:95402081-95402111
  hyper
ccaggtaaactggagcgggatgtcgccgct

SEQ ID NO: 31385 - DNA, 49 bp, Homo sapiens
  chr7:95402319-95402368
  hyper
cagagaaggaagggtcgtggtgtcaccacctggtcgcccaccttgtggg

SEQ ID NO: 31386 - DNA, 184 bp, Homo sapiens
  chr7:96621715-96621899
  hyper
ctgtgattccaggagcgcgtgtgggcgcggtcctcgccgcgacgccgcgcgcgggtcaggctcaactgcgaaccttgccaccgagctttcccgcgggaggcttcgaatataaccttgcctatttctcgcctactgagatttctttccagaaaaggacattctcctgctccgaggagatggatcc

SEQ ID NO: 31387 - DNA, 242 bp, Homo sapiens
  chr7:96622107-96622349
  hyper
attgggtttggctggcgactagctttaatgcccatcgagttcctgggacacccaagttcagcacttctgcatgaaaccgaaacggccagggaggggcggagtgggccgaggctgagggagcggcggtgttgacgccctcttcccacccaggatcgatcgatcggtagggaattttttatctttgggaaggagaggtgaggaagcggacctaaaacgaggggaaaattcgaatttaatatcct

SEQ ID NO: 31388 - DNA, 159 bp, Homo sapiens
  chr7:96625614-96625773
  hyper
agctgcacgttgccccggccggcgttttcaaacaacttgaattacaggctacatcttgaatatgaattagccttccgcactggtgtgaattcgctttgaaactcaacttgtcaagtatggttttaattaaacatcttccggcctcgaaagattacatgt

SEQ ID NO: 31389 - DNA, 238 bp, Homo sapiens
  chr7:96625974-96626212
  hyper
gagcctgacaggtcccgggtcccaggtcccaggcagccccggccggggcagggccaagaccgcgtgcccaggacaagtaagtaactcaaacccgacccggcaagcgtggcccaagctgcttttgcagttggggacaattgagcggacacacaagttaatcccgcactgatttgtttcggatccatctgcaggacgcctgatgcctcccccttggctgctgcagcggacacctgcctcc

SEQ ID NO: 31390 - DNA, 118 bp, Homo sapiens; identical to SEQ ID NO: 9114
  chr7:96627308-96627426
  hyper

SEQ ID NO: 31391 - DNA, 267 bp, Homo sapiens
  chr7:96633233-96633500
  hyper
gtgtgggcaaaggctcgcggcttaggtctctaagcagatcgaaagtcggggtccagaccgagaggatcttcaggtctcgtccacccaatctcaagcctctggaagggcgggctgccggcgacctcctccagtcccgggacccggaacccgggaccctggacgccggtgcgggcgggcctgccctcctctgtgcctggcccccagtctggccctcctacctgttgaccaggcctgaaccacgcaccggggctccgctgtctctgcttg

SEQ ID NO: 31392 - DNA, 50 bp, Homo sapiens
  chr7:96634276-96634326
  hyper
aatatataagaaatacggcctgaaacggcagggaccgagccagaacaggg

SEQ ID NO: 31393 - DNA, 74 bp, Homo sapiens
  chr7:96634662-96634736
  hyper
ccggccgggcagaggcgcctccctccccaacggccccgggcgccacacagcgcggcccccggctgcagctccgg

SEQ ID NO: 31394 - DNA, 248 bp, Homo sapiens
  chr7:96635204-96635452
  hyper
ctgcagaggggagagcggcgcgagccaagtgggggagggtggaggaaacccgggagaaggctttctccagcccccaaagtttttgatgatgaccatgactacgatggctgacggcttggaaggccaggactcgtccaaatccgccttcatggagttcgggcagcagcagcagcagcagcagcaacagcagcagcagcagcagcagcaacagcaacagccgccgccgccgccgccgccgccgccgcagc

SEQ ID NO: 31395 - DNA, 104 bp, Homo sapiens; identical to SEQ ID NO: 9117
  chr7:96635486-96635590
  hyper

SEQ ID NO: 31396 - DNA, 353 bp, Homo sapiens
  chr7:96635619-96635972
  hyper
cgctcgctcgccgcctacccctacatgagccactcgcagcacagcccttacctccagtcctaccacaacagcagcgcagccgcccagacgcgaggggacgacacaggtgagaggccgctggggcagctcgcttctcccgcctcccgactgccccctaccccgcccgcccgctcacttcctcgacgcccgggcctccgccggccccctcccccaggcggccccgcgcgcccttggccgggccccgtgcgcgcccgctcgcctggcgcctgcctgccggcctctcccagccgggccccttcccgccgccgcggaccctcagcttccgacgcgcagttcgggctgagtcccgggcc

SEQ ID NO: 31397 - DNA, 774 bp, Homo sapiens
  chr7:96636033-96636807
  hyper
cgcccttttccttgctccttccctccaggctgtaacccacgtttgacccggctggggacatttctgggccggaactggggagcgtgttttgcttcccagcccacgctgggcaggcagtggcctactttgcgtggggcgccccgtgctcctcagtgactcggagggaagctggcctggctttcgctctggttaaactagtaacagtcaggctctttccagtgggctttaaagtgtccctcaccttcatccctgaccgggccccctatctagcttttcgctacagtgttggctgctcctttgttcgtggaggggaagcaaagaacctcgggctgatggttctcagcacccgagggggacaaagttgccgtgagaggcgcagcctgctcgtgggctggtctgagctgttggttgtgttttgtttgaggatttggtcctcctcaggagagtcatttcaaaacatgccgaggatgcttgatgcactgagcttggagctggtgacatcaagtcaactggccgcgtaaacacctgggtggctcaagcacagcttcaggtactgttaagccgggcacaggggccccgctccgcccggacagctgccgccttgctgcgctgcgcaccccagagagcctccggcaccgcctccgctgcggcaaagcgggctgtttgtctgagggcctctggcgctcccttggcccagacgctgcacattgttcgggccagggactgggtcaaggagattacgcagacgctgggagcacacgggcagagtggacc

SEQ ID NO: 31398 - DNA, 82 bp, Homo sapiens
  chr7:96642045-96642127
  hyper
gattggtaggaggggcgtgggcgaaaggcatcgcccagtggtggtgcctacgacgcctccccacgttcggacttctccagag

SEQ ID NO: 31399 - DNA, 809 bp, Homo sapiens
  chr7:96645617-96646426
  hyper
agatgcaacagaaaacgctgggggttggcgcgggggggaagagacagggctgcgtagaaaatatttaaccaatcccacatgtgccaccgctatttgggctatttttaaggcccagagttcgctgcgactgggctgaggttgaaaaaaaccaagcactgtgtgcaaagaccgcgggcaacctgggagcgcgagccgaggccgagagcaagccgcagcgccccctccccaagctctggagcggcgggagcctccaccggctactgtgggagggggtgcttaagggtggaggagctgggtgaccgcaggcggatccgccggcgtggcgagcttcccagaggtgcccgagggcgtctgccctctgggtgtgcctccgggagggctagagagctctaggttggcaagatcccagtgaccattgggaggcgcgcgatccaaggggttgcagggatggggcggagaggaggggcggttgggtagcctaaaggtccctctcccagaatacaaggaagcgctaagaaggaggatgtgggggcagtgttccagcaggcatcccaggctcttccggctggagagctcaggagactgagcggtgtcaaggctggagtgagctatagggtgcgctgggaggaggtgagcgcagcctggctttggcgcgctgtgggtgactcccaggacggcgcggccaggacgccgcgagccgtggggcgtccggtgggatcaaaggaaccagaggaggccagccgacgcgtctgggattgtgggataaggggcgggagagaggagattgacatgggcggggagatcctggc

SEQ ID NO: 31400 - DNA, 685 bp, Homo sapiens
  chr7:96646652-96647337
  hyper
gcacccacaggaatgcggcttctctcggatccccaggccgccccttgtcccacaaggaggtggccgccaggaaaaaggggggaaaaggggcagaaatccgcctagctcaacccgagcctcaaacaaaggccaatttatctgatctcttacaggatggcccaggaggtggtctgggcaccgaagaatcgcgctggccctgaccgcatgccccagccttcctggggtttgtgaggagctctgaaggtgggggtgaggtgttgtaagtaaggggtggggagtatgaagacgcccactgaaaagaacattaatcttagaaaggacttgattcgtcttgggagcactatactgagagctaggcaagtggaaaccggaaggggcaggcagaggggtcacccagtgcgatgtcaagagtggggccggctggtccgggaatatgctggggagtggagcacgtttatattcgacgtaggaaaaacaatggagaggaagagaaggtggaagggagggcaagggagagaaacatcacatagatatttttagactttgctgaagatctgttatttttacatccttgggctcgggacggcagggagttaaattcccctgagagaatccccatggggccagggaaagcccgctgcagactggtttaccagaatatttttgtccacggctcccagaccaa

SEQ ID NO: 31401 - DNA, 472 bp, Homo sapiens
  chr7:96647760-96648232
  hyper
ggtgtgcagtgggtgcgccctcacccccaaccttcccaaacacgcaccccttggcagggagaggcgtccgcgcaggggaaagccaggcgctggcacaccgcgggcgcgggtttctcccagtcggagtcgccagaaataaagcgctagctctcggtgtaatggaaactcccgaaatccttacaagcaaagaaagaaaagcaggaagtggatatcttcatctcttccccaatccccctattctctgtgagcgcagaaaacaaaatggggcaccctttggcttcccgcccccccccccgccccccgcaaaccttcctattgccccctcttccccgcacccagtgctccttccgagaaagtacggctggagcggactggggagacggaaatattgagtcgcggccgctgggggtgccggaggaggggtgcacaggccaggctgccgggcgtagttctgcctcggagccaggctgcg

SEQ ID NO: 31402 - DNA, 16 bp, Homo sapiens
  chr7:96650421-96650437
  hyper
tcgcccgcgccttccc

SEQ ID NO: 31403 - DNA, 139 bp, Homo sapiens
  chr7:96651136-96651275
  hyper
cgaggaggctctacattgttaagaaaaccagatagctgctctgggctgcctaggccgccctagaaataaccctccgcttgctttcaacccgcgaaattggccccacagctccggaggcccgctacggggtgggggcggg

SEQ ID NO: 31404 - DNA, 118 bp, Homo sapiens
  chr7:96651845-96651963
  hyper
ccaaatatggaaaagcgggatagcctctgattaattcctactctgttcattcagatagtttgtgcaaagcgcttcctacaacactgctttctccttggcatctgggattcagctcttg

SEQ ID NO: 31405 - DNA, 157 bp, Homo sapiens
  chr7:96652017-96652174
  hyper
cgtttccgcccctccccaggcttcaagaacaccagcccctccccaggcttcaaggaggtggccctgggccgtgaccctacttctgtcggcgtctgttcgggcgcccgcagaagccagactcttgggcagggaagacgctaaccgaggtctccaaagt

SEQ ID NO: 31406 - DNA, 368 bp, Homo sapiens
  chr7:96653452-96653820
  hyper
cctactcccttctgccgcgtgcgcccccactgccgtgaaccgctgtgacccccaatctaccaccccatctcgcgcccccagcgtcctagtcgccctgtatctgcccagccttccccctgtccatgtacctggctggttggtggcgcttgggacgcggttgtaggcgccgccgtactggtggtaggagctagcgtagctatagtcggcataagctttggctgggtagctcccggcggagccgttcacgccgtgatactgatactggtaggggttgagagctttgccataggaagccgaggtaggagagcagtagccgtgcggggctccccccgtagggctgtagtagtcagaatcggtagctgaagact

SEQ ID NO: 31407 - DNA, 191 bp, Homo sapiens
  chr7:96653862-96654053
  hyper
cggacgtctggaacggagcttggaagtcgccggatcggatgctggggacccttctgtcaaacactcctgtcatcgctcacgggcggcggcagcggctgtccttgctgttgtggcggcggcagctgccctagttggctgtggggctgctctggtctaagcagacatggctgtgggagcgagggaggaggagg

SEQ ID NO: 31408 - DNA, 83 bp, Homo sapiens
  chr7:96656775-96656858
  hyper
agctctgtgcactgccggctgctctgcgggcctgtctgcggcttcggacccacgctcaggacatacaccggccagtatcccgg

SEQ ID NO: 31409 - DNA, 418 bp, Homo sapiens
  chr7:97361005-97361423
  hyper
tgcaacttatcctgacgtctcgagggacggaaaagttaccgaagtccaaggaatgagtcactttgctcaaatttgatgagtaatatcaggtgtcatgaaacccagtttcgaaggagaggggagggggcgtcagatctgcagacggaagcaggccgctccggattggatggcgagacctcgattttcctaaaattgcgtcatttagaacccaattgggtccagatgttatgggcatcgacgagttaccgtctcggaaactctcaatcacgcaagcgaaaggagaggaggcggctaattaaatattgagcagaaagtcgcgtggggagaatgtcacgtgggtctggaggctcaaggaggctgggataaataccgcaaggcactgagcaggcgaaagagcgcgctcggacctccttcccgg

SEQ ID NO: 31410 - DNA, 261 bp, Homo sapiens
  chr7:97361520-97361781
  hyper
cggtgctggccgcggctgcccgggtcaccccgccccgcatctgtccgaggtggccgcgctgggggcgccgctgcggcgagggacagtggggagactggcttcccaaacgccaacgcccctctttgtcttccacctgcagagtttcctggtttgaaggtgtgggttggtgggttagggggctgggggagttgggattcagggagaagagggttggagaatctttgggacgcgattctctcgcctaaccggtacaggtgagac

SEQ ID NO: 31411 - DNA, 518 bp, Homo sapiens
  chr7:97362187-97362705
  hyper
aggggcactatttcccgggttccccacgggattttgtgcccacgattcaagtttcttcccgagggctgcaccgtccggcccaggaactccctgcagtagggatgccctcccggatgagcccgagatcctcacaaggcgggaaatctcgtaagatttcatcccccaggacctgggatttcgggggctccggtccagctgcactgccctagcgtctgggcacgggcagaggagggcgcctgggtcgcgggcagcagcgggcacacgcgcgagctgcagggggattggagggccggaggctggagggaagttaatttcctgccttcacgtttgttttgcggacctgaggatgtagcttgaagtctccctttagaaactcgtaggctacaggcgctggggagcgcgcctcggaaaaacggtgaaagtcgtctgtaaagcgttgtcacccttccccaccggagccccagccccagatcccacacacctgtgtgcatttagggcggtgaggactctacaaagcc

SEQ ID NO: 31412 - DNA, 586 bp, Homo sapiens
  chr7:97362706-97363292
  hyper
gcaccgagacaagacaaagtcaggtggcggcgcagcagatgagggaaggtccccgggctgggaggaaagagcggaaagcgctcgaagcttgaagacgccgagccagctgctaactcgccctggcaggcttgcggggggcgggacgcgagttcggcggggaggggcgcagagaggcagcgcctcgggagggaccccgctcagcccgagcgtggggaaggccgcctccccacgcctcggggccggagtacagcggggggaagggctcgggttgctgggtgcctcgctctggttgccttacacgccctttgtccgtgcttttgtctcccaggaggaactgccggagccctttgagcatcttctgcagagaatcgcccggagacccaagcctcagcagttctttggattaatgggcaaacgggatgctggtgagataggcgaccgtccctaggtgtcttgggcagcccgccctgtctgctcactccttcctggagtaccccagggtctctcgctctgaatagagatttccactccaagaggggtgtaattccccaggcgcgacattggcccacaccgcactaaggcacgc

SEQ ID NO: 31413 - DNA, 75 bp, Homo sapiens
  chr7:97680670-97680745
  hyper
ctggaccagtcgccacgacgagctccggggcgccaccggtggcctctctgatggcccgctcggcgaggggtcccc

SEQ ID NO: 31414 - DNA, 223 bp, Homo sapiens; identical to SEQ ID NO: 695
  chr7:98245856-98246079
  hyper

SEQ ID NO: 31415 - DNA, 204 bp, Homo sapiens; identical to SEQ ID NO: 696
  chr7:98246304-98246508
  hyper

SEQ ID NO: 31416 - DNA, 1315 bp, Homo sapiens
  chr7:98246533-98247848
  hyper
cgccccacacgccggccccctccgcccctcagcttaagaaagggcgcgcggacccggcaggccagagtgccgagcagcgcggtgggtgcggctgtgagacggcaggagacttctgccccgcggtgcacgcgaccctcgagacgacagcgcggctactgccagcagcgaaggcgcctcccgcggagcgccccgacggcgcccgctcgcccatgccgagctgagcgcggcagcggcggcgggatgctggcgctgctggccgccagcgtggcgctcgccgtggccgctggggcccaggacagcccggcgcccggtagccgcttcgtgtgcacggcactgcccccagaggcggtgcacgccggctgcccgctgcccgcgatgcccatgcagggcggcgcgcagagtcccgaggaggagctgagggccgcggtgctgcagctgcgcgagaccgtcgtgcagcagaaggagacgctgggcgcgcagcgcgaggccatccgcgagctcacgggcaagctagcgcgctgcgaggggctggcgggcggcaaggcgcgcggcgcgggggccacgggcaaggacactatgggcgacctgccgcgggaccccggccacgtcgtggagcagctcagccgctcgctgcagaccctcaaggaccgcctggagagcctcgaggtagcggcccgcggggagcgcgggggacctggaatggggacgctcccgagtcgggggcggaagactcgggaggatggggaaagggggcctggccctggggagggtgtgatcgtccgtgggggtgagctggacttgagggtgaaaggcggggatctagatcctgctcgggaactcccctgcgtggtatcccttcccacaccgctgctcttgctggaaggaaacgtttaaattccacccccgcgcgtcgggactgccagcgggatccgccgagcacttcccgaggtccgggctagcgaacccagacggccaagccgcgggcgccaaatacccggggacgcggtagcctctatcctcttgcaaatctccaaatctccgcgagccgggatgcgctcccgcaggccgtgcgggttgctgcgaggctgccgcgggaggtcagctgccccgggcatgtggtgtttctttctttaaatcaggtcaggctgagctagagggggcggaagtctgggggcggaggtcgcagggaggcgagcgcagggggtcaccggcgaccccagagcgcgcattagaggggcaacctctggttaacttcaaagactcccgtgtctgcaagttggaccattttaaggtgctcttccggattgcttcaggg

SEQ ID NO: 31417 - DNA, 199 bp, Homo sapiens
  chr7:99149223-99149422
  hyper
aatggcacttggtatcgtgtaagatcgccagaattttacaactcggggtacccaggaaaccagaaaagcccccaccacaagaaaaaccagtgggcacaactggggagcacagatatctgactggggtcattttgtccgcgcgtctttggggtaaaacaccaggactgggggtccagaagggacacgcagaccgcctctc

SEQ ID NO: 31418 - DNA, 15 bp, Homo sapiens
  chr7:99155799-99155814
  hyper
aggccccgcaatcct

SEQ ID NO: 31419 - DNA, 195 bp, Homo sapiens; identical to SEQ ID NO: 9139
  chr7:99155931-99156126
  hyper

SEQ ID NO: 31420 - DNA, 82 bp, Homo sapiens
  chr7:99156127-99156209
  hyper
ggcccagctcctcctccgagttcctcatccggggccgtcactcacatccggggccctcactcacatccgggaccctcatccg

SEQ ID NO: 31421 - DNA, 128 bp, Homo sapiens
  chr7:99156472-99156600
  hyper
agtagaaggaggcggcgtccggccgcggccgacggtagttcgcttccccgagagtgcgcggaggcccgggtgcgaggagggcctgtttctcttcagccctggttcattcacctcgcggaccgagggcc

SEQ ID NO: 31422 - DNA, 100 bp, Homo sapiens; identical to SEQ ID NO: 9141
  chr7:99156815-99156915
  hyper

SEQ ID NO: 31423 - DNA, 589 bp, Homo sapiens
  chr7:99177694-99178283
  hyper
cggaagggacagccagttagagtctaggcccacttaggcgatgaagggcaggtgaagaaatcccgttccatcttcctgcagtcctcccttggggagtccacatcctatccttctctggaccggggcggctcctggagggaccgcgatcgaaatgaggcctccgagccgcccagagactccgaagtgcgcgcagcggaccacgcggtttccatgcgccccctagggtgggtgggctagctgtgcgccccagtgcggagaacggaggaggggtcggccccgtagcggctggaaacgcagttggcggcggggcccagcttgcggggcttctgatcgcaggggcggggcccgccgccggtttctaagggcctggcagagttcctgcagtcacggtcaggggtctttgctttcgtccatcccctcctggagaaagaacgcagcttctaacgccttctcggttgggcacccttcttgggaaagctccgcctaccattgcccttgtacctgccctctctctccctttcctgaagtgactgcccgtctctagcatcgtgttgtgaatgtgtcgagattttggcgctgcagcagcatc

SEQ ID NO: 31424 - DNA, 157 bp, Homo sapiens
  chr7:99595179-99595336
  hyper
ctcccttttgactcattttgaggcccccgtcgtagggtacacgccctgggaatcgggggtcttccagtatagggaaccaccgagatgcgggccctccgaagtcctagagagggcgcctcggccgccggcacccgccacacttccggcctttgtgggc

SEQ ID NO: 31425 - DNA, 30 bp, Homo sapiens
  chr7:99595608-99595638
  hyper
ctgcagatttcaggccgaccccgctagcac

SEQ ID NO: 31426 - DNA, 54 bp, Homo sapiens
  chr7:100091127-100091181
  hyper
ggagccagcagaggccgttggggggcaagcaaggacttgcttctgaggggagac

SEQ ID NO: 31427 - DNA, 236 bp, Homo sapiens
  chr7:100167379-100167615
  hyper
actccagttcctgggcgacgtgaggattagtctcgtggggtgggggttccggagcggtcggcggagggagggaggtagtggggagcccaggccaggggcaacagtcaccgggacactcgctgtgcgcagagtccttgccccaaacttccagtcgggagcccgggagagacgctgggcatcaagacgggtggcagcctgcccggccgctgctcccggcccgccgagttcgccacctc

SEQ ID NO: 31428 - DNA, 113 bp, Homo sapiens
  chr7:100167860-100167973
  hyper
aagtttcgcgcgtgccgagcgcggctccagcgcagcctgagcctggcgggtgcgtgcaccaccagcaagtgcgcagatgcgcgccagcaccacctgatcgtcctctacacccg

SEQ ID NO: 31429 - DNA, 39 bp, Homo sapiens
  chr7:100254093-100254132
  hyper
gatcccccgctccaacggcgccgccgattggctgccagg

SEQ ID NO: 31430 - DNA, 269 bp, Homo sapiens
  chr7:100318466-100318735
  hyper
cgcgccccctggacagccgccctctcctccaggcccgtggggctggccctgcaccgccgagcttcccgggatgagggcccccggtgtggtcacccggcgcgccccaggtcgctgagggaccccggccaggcgcggagatgggggtgcacggtgagtactcgcgggctgggcgctcccgcccgcccgggtccctgtttgagcggggatttagcgccccggctattggccaggaggtggctgggttcaaggaccggcgacttgtcaaggac

SEQ ID NO: 31431 - DNA, 30 bp, Homo sapiens
  chr7:100770176-100770206
  hyper
gaatgctcttacacacgtacacacacagag

SEQ ID NO: 31432 - DNA, 169 bp, Homo sapiens
  chr7:100807589-100807758
  hyper
cctgctggcgcttggcgctacttggactgaaatctcgcagttcctggagcagggacgctagcgcctcgagctcctcggagggatcgctcgcctcgggcccattctccggagtctgagggcgaggcggagccgcgggctccgggctctccggcgccgggaggctgtgggt

SEQ ID NO: 31433 - DNA, 86 bp, Homo sapiens
  chr7:100808389-100808475
  hyper
ccatctcactgccatcgcccacgtactaagcagcagcaatatgggggaaaaaaaaatctctgctccctccccgtaggactccccgg

SEQ ID NO: 31434 - DNA, 176 bp, Homo sapiens
  chr7:100809363-100809539
  hyper
ccgggttccccaccccgagaccacgcgcccaaggacggcgtgaacctgagtgcagagggacagatctgcacgcctgcgggcgctgtccgcgaatcggcagtgcgggtggcagccccctgacaggggcagatgggtggatcttgcggttttggtaatcccatcgggaagggtccgag

SEQ ID NO: 31435 - DNA, 30 bp, Homo sapiens
  chr7:100817707-100817737
  hyper
tcttcctaagatccacgcacccgcaggtgg

SEQ ID NO: 31436 - DNA, 30 bp, Homo sapiens
  chr7:100822573-100822603
  hyper
gacaggcagggaagccggaggaggcttcga

SEQ ID NO: 31437 - DNA, 259 bp, Homo sapiens
  chr7:100823092-100823351
  hyper
ggggacaggtgggagcgacatggcaacagaggggggcgggggagcgcttctggacacctgaagcgcagcctctgactcagttttctgggtcttcggactgggaggggctgggcagaagggggcgcagccgcttggtccccctgaggggcggtggccttctgctgccccattctgcggtggaggagcacgctagccccctccccagtccccaggcccggccgcccccctacctcgccggagccggagctggagccagggc

SEQ ID NO: 31438 - DNA, 320 bp, Homo sapiens
  chr7:100823380-100823700
  hyper
cggcgggcgcagacacccccggtgccaagagagaggtccctttggagcccccaagagtcaaaggaggatgacgcgcggggactcggccgcgctgtcggagcccgactctaacgtcggtcagcgctggggcagcgccgcagctccgttggcgacgcgggccggggcgcccatcggttcaggggttcgggtggcacgcgtggctcccccggcgacgctccggcggcagcttcgaggggcggagaccccggcgacgcggaagaaacccgggacggatccggagcggactcgtgccctgctggcggggccgggggtcggggtgc

SEQ ID NO: 31439 - DNA, 30 bp, Homo sapiens; identical to SEQ ID NO: 9151
  chr7:100845392-100845422
  hyper

SEQ ID NO: 31440 - DNA, 210 bp, Homo sapiens
  chr7:100943301-100943511
  hyper
tgcagctgcagcccccgccaccccgagagtccagccccgagggcagctcctgccttgcctgcggttaccgccgccgccagctgagggccaaggagggagaggggaggccaggcgctctcaggagtcccaaaggacaaataaccccgccgctgccgcgggacccagacgcgagccagctgctcgcccgccctgccccgcctgagctttccg

SEQ ID NO: 31441 - DNA, 30 bp, Homo sapiens
  chr7:100946628-100946658
  hyper
cagcccttccctgtccgtcctagccagcga

SEQ ID NO: 31442 - DNA, 30 bp, Homo sapiens
  chr7:100951829-100951859
  hyper
gtgagtgagagaccccggggctatgcagtt

SEQ ID NO: 31443 - DNA, 434 bp, Homo sapiens
  chr7:101006050-101006484
  hyper
tcggccccggaccgccgagggttaacaaaaaagccccacgccccctttgacggcttagagcccacctcgccgaatttgaaaaggcggccccggagaggcgtgggcgccccccacacatttccagctcgcacccgggctccgaccgctcgccccgctcctctcgctgtgctcccggccggtgccgcgggttcggtccgggcgccggtgcgctcctgccggtcctcgtgcccgggactccgggtccccgcgggctgctgcgcacgatgaagctggccctgctcctgccctgggcgtgttgctgcctctgcgggtcggcgctggccaccggcttcctctatcccttctcggccgcagctctgcagcagcacggctaccccgagcccggcgccggctcccctggcagcggctacgcgagccgccggtgagtagctcgg

SEQ ID NO: 31444 - DNA, 892 bp, Homo sapiens
  chr7:103085842-103086734
  hyper
gcttcgagagttcagcgtgtcagagcctctatgatggcagagcacctgccgcgatgcctgattggtagggagaaggatttcccgggagggggccaataccaaattttagggctgttaggctctgagcagtcccttcgtgaccggataagtcagagacccggggtttgagccttgcccggcgctgagcggagggcccagtttcgggaccacagccttgctccctgggagctccgggcggccaatgccgggcaagcccagcccggcacaggaggaggcagggcccgtctccggaaagagggccagaggcagaactgagggcctggttttgtgtaattcgatttggatacaaacaggccagacccaaactggaaacggcgaagggctggattagcaccgaagggattcgaggaggcaaacgggaagtaaaaatgctgtgtggagctgcagagggcaaggggacaggggttgcaaaggaaagagcttcgtgagactttctccttcccggcgtagggaccagcagagtgcgggcaggtcagccctgtcaccggttcgtttagggaaaaagcgcgacatggggcctgggagacaggggcagaggcggtgacagcgagggcccctgctcgggtgggcccgcgggcctcagctcagtcccctcccgagggaccgcgacccccggccccgcggccgcccgcgcgcactcaccagcccgggctgccctgggcggagccgccccgccgcgctccacagccgctgcctcttcgacgcgcgcgctgcctccaggtgcggctctaggaggaggcgccgcgggcagtgccggccgcgccccgcgactcccggtaacccgagcccgccccgccccgctagggccaggccccgccgccaccctccgcgc

SEQ ID NO: 31445 - DNA, 736 bp, Homo sapiens
  chr7:103629059-103629795
  hyper
ctggctggtgagcagcgggaactttgcggtcgagcggcgcggggcagccacagacctgggcgcttcaatctgtcaccagcctgcccgcaaagcccagcgacagcccccaacgcccccccggggacccatctggggggaccgggagcaggacaaaggtctgaaatccaagtcctaggagtaaagaaacaaaatgcgcaggttcaatttaaagtgcctgcggtaagtacggggagtgagggggaaagacaccggcctccaagaattctcaggcgtttagcacaagcaccagctcattaccaggagatgcgttcggggagtggggacatggagaatgaatcccaacttgtgactccattctccactaactttattctcgctccctggaccaagcgcatcgctggggccagggttgtcatggttcttgtttccaaggccccttggaagaaggaaagggatgagaaaggtgcgctggcgggcgcacccggcggcggcgagcgcggaggtgctgcggtacctaccatggtattcttgtcccggaacgtagtaggtggggttgcccgcaatatgcagggaaatgagcacctcgccctgctccccatccccttccagctccccgtggtgggtgcacaggaaaaagaagggcgaaaagcgggggtaatagccagccgccgcgcgcgccctcagcgtcgcccccagcaacagcgctaggaggaaagtctgccgggcccagccactg

SEQ ID NO: 31446 - DNA, 30 bp, Homo sapiens
  chr7:103630053-103630083
  hyper
cgcctccgtgcgccgccgccgcctctgcgc

SEQ ID NO: 31447 - DNA, 109 bp, Homo sapiens; identical to SEQ ID NO: 9157
  chr7:103630363-103630472
  hyper

SEQ ID NO: 31448 - DNA, 279 bp, Homo sapiens
  chr7:103630739-103631018
  hyper
taaaatgagattaagcgaaagtggaattggcagactcgagtggtgcctggaaatggtgatttgtgctgctcggttgtggggaattgtaaggcaggaagggctggcggagctaagatccgacaggctctcttcgccggactgttctgttattcattgcttctgggctcttcaggcagagatgggtgttgtaattttttaaatcagtgtttatttcctttaaatgtcggttatgaccaatggccctgaaatcgggggagggaaaaacgttcaggggagatg

SEQ ID NO: 31449 - DNA, 251 bp, Homo sapiens; identical to SEQ ID NO: 3084
  chr7:103968915-103969166
  hyper

SEQ ID NO: 31450 - DNA, 355 bp, Homo sapiens; identical to SEQ ID NO: 3085
  chr7:103969167-103969522
  hyper

SEQ ID NO: 31451 - DNA, 15 bp, Homo sapiens
  chr7:103969562-103969577
  hyper
cggcctctccatgat

SEQ ID NO: 31452 - DNA, 115 bp, Homo sapiens
  chr7:103969892-103970007
  hyper
cccaagtgtgggggacgcccactcagagggacgccccggaggcagggcggttgtggggccgagtccgctcagaactaaggatggtgggtggagaagtggccgcttagagagatgg

SEQ ID NO: 31453 - DNA, 82 bp, Homo sapiens
  chr7:106684832-106684914
  hyper
atgacgcctgggaagcggggcgagtggccagcccgctcctggacgcgcggacaggtggacacgaaggcggcctcgctgggcc

SEQ ID NO: 31454 - DNA, 433 bp, Homo sapiens
  chr7:106685345-106685778
  hyper
aggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatggtgaggaccagaccccccacttcgcgcccccggatcccctcgctgccccccaccgctccccgctgtgctctcggatcttgccgctttgcgcacccacctctccccgcattctccacctt

SEQ ID NO: 31455 - DNA, 799 bp, Homo sapiens
  chr7:107300982-107301781
  hyper
ccacagggcctggcccgcccctgacctcgcaacccttgagattagtaacgggatgagtgaggatccgggtggcccctgcgtggcagccagtaagagtctcagccttcccggttcgggaaaggggaagaatgcaggaggggtaggatttctttcctgataggatcggttgggaaagaccgcagcctgtgtgtgtctttcccttcgaccaaggtgtctgttgctccgtaaataaaacgtcccactgccttctgagagcgctataaaggcagcggaagggtagtccgcggggcattccgggcggggcgcgagcagagacaggtgagttcgccctgaagatgcccacaccgcccggcccgggctccactcccggggaggcctcgagggttgcggatgggactcttaagtggtcacggatcaggtgggcagggggcagtacagctttctttctgagacgccgagagcgaacaggctgctcggaaaacaggacgaggggagagacttgctcaataagctgaaagttctgcccccgagagggctgcgacagctgctggaatgtgcctgcagcgtccgcctcttggggacccgcggagcgcgccctgacggttccacgcctggcccgggggtctgcacctctcctccagtgcgcacctggagctgcgtcccgggtcaggtgcggggagggagggaatctcagtgtccccttccagccttgcaagcgcctttggcccctgccccagcccctcggtttgggggagatttcagaacgcggacagcgccctggctgcgggccataggggac

SEQ ID NO: 31456 - DNA, 50 bp, Homo sapiens
  chr7:107642639-107642689
  hyper
tgtgagcttgggaagcgagagtgcgtgtgcgtgcacgcgcgagggtcacc

SEQ ID NO: 31457 - DNA, 72 bp, Homo sapiens
  chr7:107643722-107643794
  hyper
cccggtcccaccccccggggcgcctcttttgtttgaaagccgaatctgcgatcgctgcggggctggggcgct

SEQ ID NO: 31458 - DNA, 249 bp, Homo sapiens
  chr7:108095329-108095578
  hyper
ctcaggacagttctgcgccggtggtagccaagggctggagcccctgatgcgaagaaaagggaaggagagaggcggggtgcgaaagaaacgccaccgctcggcgccctccctcggtgcccgcggcgcaggggccacccgccagcgtacgggggacgaagatgtggccgcgggcgcgggcgggaggggaggcgatccggggaaggaagcggcctgttcgccagccccggggcccggggagccctccagcag

SEQ ID NO: 31459 - DNA, 1108 bp, Homo sapiens
  chr7:108095780-108096888
  hyper
cgctgcgagatggatgctccagggcgggtaatcactcctggctcaacacagcatcccgggcggagcggatgccagatcccaccgctaagagcctgggctgggaaagcaatctttccaggcagcccccagcccggtgcgccggccccgacaagtcccagccctcggaggcagggcggggcgcagggactcccgggacccgcacctgtaaggccgacaaagcccccgcaagcgccccacccctctgtcctccgtgtctctctcgttccgcctcgattccccgagccctctccaggcagcgactggagaagcgaagtcggcctcgcccccgaactccgtggtcagcacaggtgtacgcacttccgaacaaagcccacgcccagacgtgtccgcaggggcccgaacaggcacacgcccgtgcgctcccggcccggcccccgcgctcctcgccccgccggcactgtggcgtgacgccccgcgcctccgtgtccaagcccgggaagccgccgtgccgggcccgcaggctctccatgcccaactgcccacgagcaagagctctgggcagggcttcccggaaagcgtggggtgcgggcgcggagcagaagttggccacaggctggagggggtggtgggtgccggcgctgctggatttcagctgtgccttcacccaagcgcaggtccccctgctccctctcggcgcccgcgggagtgtcgggggcctgcaggggagaagggagttggagatctgctttgcccctcctgcagcgctgccagcccggtgagcgctcggctgaaccccgcggcggtgtccaagtgacaacgcagcagcctcgcgcgtcctcctccgctccagccgtcacccccgagcaggacccagtgtcaccgccagacgcgcaaggagctacttacgttctcgcgccgcgccctccgctcagctctggcgcgactgcccaggaccctggaccgccggtgtcctccgttctcgacgaagctatcccctctggctgctccagccaggcggcccctgcgccgtcccccgcgcccgcgcgtctgaggctcggactgcggcgcgcgtccgccagcgaccctggcgaagcgaggctggccccgc

SEQ ID NO: 31460 - DNA, 369 bp, Homo sapiens
  chr7:108097139-108097508
  hyper
ccgtcagcctgcgagcgcgtgtggcggcgggggtgggggtgcggggacggagggcgggagtgttccggggctaggatggctgggatttagctacaaaagatgttccagaaaatgggtagtttttgaatgccactctcatgggtttagctttctgtgggaggtctgtggtcttctagttttttcttttttaaaaagcactttcttcgaaattcatcagttggggtggttgagattgggtgagtggttttgggggttttgttttgtttttgcaaccgttctttccaaacactccccgccgccccccaccaccgcagaaaaaagagcttttagcataaggcggatgctatctatccgcggtagaaactgggt

SEQ ID NO: 31461 - DNA, 57 bp, Homo sapiens; identical to SEQ ID NO: 9167
  chr7:112726853-112726910
  hyper

SEQ ID NO: 31462 - DNA, 588 bp, Homo sapiens
  chr7:113722696-113723284
  hyper
ttctaatttgtcattcgcgtgcgtcgctttccttcatcttggctatacttcctctcatctgcggtgttttatttcgcgcaagatgcgctgacagaggccatttcaaacgaatttatctttcactaggaccgtactagagcagtgtctcgaattttgttgatttgtggtttcgtcgtaaaataaacttgaaatcaaataaactttcgtgaggaagctttgatgtccacttggtgaaactcctcattcacccagttgagccgttgaactttcttctggaacctctttaaatgacttttgccgatccacgtgctgcaaagaagacctgaaccgtgcctatgaccctgcgcggcgactacagggacagaatttggctttccttctctttccaatatgcagcgtttcgtttaaaggctgcctcgatccagtgggctgaccagtgacttgtgcaaaagaaaactattcgatcgctgtttgccctttcagcgttttcctcggctgcggaaacccggttttcctattattatacttcaactttttttggagtcagctagcacagagcgctaaaccccggccagttccagcagcagc

SEQ ID NO: 31463 - DNA, 245 bp, Homo sapiens
  chr7:113723338-113723583
  hyper
cgagttcaaggaattgcaaataaatatattttatgaccacccatcaacaaactacgtgccaccgtggcggcccctggtagccgggccgtgtctgcagtgtggccaggggcgggggctgaaaaggaggcggccggagaggcgaagcgagctgcgagccccgggcctgaactttcacctctcgaacccgggcccagcccattggctgcagccgaggggtccaccgagggcagcggctcctgacagga

SEQ ID NO: 31464 - DNA, 717 bp, Homo sapiens
  chr7:113724755-113725472
  hyper
ttagtgcggttcgcccgtctccccaaccaccaccacccctccctcttctgccaccggaggggttcaagttggccgttctttccccagggaggagggccgggaagcagccgggggccaggctctgttcaccacggcctattggccgcagctatttggaggaaagtttcagcgcctctcggaacgccacgctttgcgactgacttgcgagcaaagcagcgggctcagtctgcggcgcgcggaaaaggcggccggcgaagagtcgcccggcccgcgggcaggggagggaccggagggagacggcggggagggagcgctggcccccctctgggctggggctccggaggaagcccctcgccaagattccggtcgtgcgtcccctccggggcccgctctctcctccctcggcctttcccctgtcaccgccctgggtcccaagcaggccgcccagccgggtcacacccggtggatagaagccgggacccagggctggcggctgggcccgtgcatcccccacgcgggcgcctcggctttgaagtgcgcgcggagcaggctctgaccgtttcttctttcctttctttccggttacttttgctcccctcagtcactgataggacccttcccgaaaacctcagactctctaagtcccagcttggcggccccttccttccaagccgcgccccggtgacctgggctgcgcgaccacgaggaagcccgaga

SEQ ID NO: 31465 - DNA, 30 bp, Homo sapiens
  chr7:113725787-113725817
  hyper
atacggttttgttctcgcctccctccccac

SEQ ID NO: 31466 - DNA, 430 bp, Homo sapiens
  chr7:113726087-113726517
  hyper
tatcaacaacaacaacgacaataacaacgcaaagtaaaacaaaacaaacaagtggtccggcggtacttcagaatcctctgcggcgtcctgtcccccaccccgcccctccgaggagaggcagccccgcgagcagtgtgtgtacagttcgcattgccaacaacacgcgcgcgcggccgggtgcgcgcgcctgccagcgcacattcacacacacagacacacagacacacacacacacacacacacacacacagatccgggtggggggagcggctgcgcgagacagcgcgagcctccgagaaagcgcgagacacgccggcgcgtgcagctccgcggccgccgcttcgccctagctctagccccgcgccacccgcagcccgcccgcgaacgcccgccccggttatttatgcggcggccgcgtccgctggctgcg

SEQ ID NO: 31467 - DNA, 47 bp, Homo sapiens; identical to SEQ ID NO: 9171
  chr7:113726751-113726798
  hyper

SEQ ID NO: 31468 - DNA, 170 bp, Homo sapiens
  chr7:113727456-113727626
  hyper
ccgctttagagaggtcgcctggctgtttgtgggtgggtttggggtgaaatcgcacctcgcggcacttggtgaggggacgtgggaggagcgcagacacctttcggtgatagggagggcttctcacttggctgttacctggaagtccacagtggccccggcgggcaggcggg

SEQ ID NO: 31469 - DNA, 54 bp, Homo sapiens; identical to SEQ ID NO: 9172
  chr7:113727754-113727808
  hyper

SEQ ID NO: 31470 - DNA, 92 bp, Homo sapiens
  chr7:114562185-114562277
  hyper
cccgggtggggagcccgagccagcccaggccggctctggcctcctgacccagacagcgcagggcgcgagggatcgcgcggccgagcccgggt

SEQ ID NO: 31471 - DNA, 317 bp, Homo sapiens
  chr7:114562326-114562643
  hyper
cgatccggatgtgatgaaaaagagcaacagagggagaagtgtttcaggattgtaggagtggaagaggggaaagagaggcagagagggggaaggccccctcgcaggggagccggctggagtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagagga

SEQ ID NO: 31472 - DNA, 440 bp, Homo sapiens
  chr7:114562960-114563400
  hyper
ttttgtatatttttccgccagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggtgagtgcgcgcttgcaagtggcaagcttctttgtcattgttgcatttttcagtttgctcacaagtgcacagataggggtggggggagtgctgtgaggaggggctcccactcgtagttgagaacttttgcacagttcgcgttactcaggcaagttcttcaggatccttgccctagatcaacaaccgggtaagagggcgggaaccgttggtccctccac

SEQ ID NO: 31473 - DNA, 227 bp, Homo sapiens; identical to SEQ ID NO: 9176
  chr7:115117500-115117727
  hyper

SEQ ID NO: 31474 - DNA, 30 bp, Homo sapiens
  chr7:116140161-116140191
  hyper
agccaggttcctgtgcgcccaccgtgaccc

SEQ ID NO: 31475 - DNA, 16 bp, Homo sapiens
  chr7:116962550-116962566
  hyper
ctgggatgggggaggc

SEQ ID NO: 31476 - DNA, 521 bp, Homo sapiens
  chr7:116962626-116963147
  hyper
gtctgtgctagagctggagaccaggctagcacgtctctcaacaggataagaaattggctgattttgctgtcgctcagctggatccaaataaaccaaacatcggagctctcatttgagggggaatgtggttttatggagttgtcaaagctgaaatgatcttctgggaaaagagaaggggctcaccatggggcgataagagggcagtagccagggttcgggccagaatccgagactgctgcggccgcgggggaacgcagccaggaagggtctatgtggccaatgcggtccccattccgatctccaaaatcccccgcgcccgtgcgcgtggacttaccaccatgaagagttgacctcgggggtgagccaggtcaagagcagagggagccagagccagattccaccgagaggggcgttcatattaacccccttgcgtctgcatcaggtcagactccgtgtgcgggcgccatgcgtgcccagagcagaagcgctcagctccgggagcgcctcgtcacggccgccgg

SEQ ID NO: 31477 - DNA, 271 bp, Homo sapiens
  chr7:116963330-116963601
  hyper
cgtccgctctgctcccctccgggcgcagccgagggagggggtgctgcgcctggcgggggtggggagaaacgcggggttttagacacgggtgcatgaaatgatggcaagagatgtctggggatgaggtgaggcggggaagggggaacatcgctgcatggttacgagcacacgcgaatacaggaacctttagggaagctccaggccaaagagcatccgtgggctctcggagcgtgcgttccggattgccgaggccatccgctggcaaacaagt

SEQ ID NO: 31478 - DNA, 337 bp, Homo sapiens
  chr7:116963872-116964209
  hyper
agggtccatgaccctcgggacctaacccagcagtatctgccaaagcacccaggaaagatgcagtttttacgcacacccagctcctctccggagctgcggagcgcaaaagatcacatagagaggaaccgaggcagccaggcgttcgccgggggtgtgcgcccttgcacctcctgccgcctgggcgctcagcctgtgcgccttgtggaggttaagggaccctcggtcctggacctgggcccccgcccagccaagagagaggggcttgggcccgcgggtggagcattttgagcagtagctggcttgtagccgcgccgtttatcaccggaaaggaaggaag

SEQ ID NO: 31479 - DNA, 154 bp, Homo sapiens
  chr7:116964456-116964610
  hyper
cggtgagaggctggacgaggcgaagctcagagacgccaaaaacctgaaagatgctgtcatcgccacccccttcccccacgctggtccctggcaggtccggcccctcccaggctgacccagatacatccccgtttgggtccggaaagggagggga

SEQ ID NO: 31480 - DNA, 779 bp, Homo sapiens
  chr7:117119492-117120271
  hyper
aatgcaccttgcaaacgtaacaggaacccgactaggatcatcgggaaaaggaggaggaggaggaaggcaggctccggggaagctggtggcagcgggtcctgggtctggcggaccctgacgcgaaggagggtctaggaagctctccggggagccggttctcccgccggtggcttcttctgtcctccagcgttgccaactggacctaaagagaggccgcgactgtcgcccacctgcgggatgggcctggtgctgggcggtaaggacacggacctggaaggagcgcgcgcgagggagggaggctgggagtcagaatcgggaaagggaggtgcggggcggcgagggagcgaaggaggagaggaggaaggagcgggaggggtgctggcgggggtgcgtagtgggtggagaaagccgctagagcaaatttggggccggaccaggcagcactcggcttttaacctgggcagtgaaggcgggggaaagagcaaaaggaaggggtggtgtgcggagtaggggtgggtggggggaattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcaggtgagaaggtggccaaccgagcttcggaaagacacgtgcccacgaaagaggagggcgtgtgtatgggttg

SEQ ID NO: 31481 - DNA, 39 bp, Homo sapiens
  chr7:117512371-117512410
  hyper
agaggggggcgtccacgccccgctcgctccatcccaccc

SEQ ID NO: 31482 - DNA, 46 bp, Homo sapiens
  chr7:117512808-117512854
  hyper
cctcagcggcagcagcgcccacatctggacacggccctctcccagt

SEQ ID NO: 31483 - DNA, 35 bp, Homo sapiens
  chr7:117513436-117513471
  hyper
gtcgggctcgcagctcgcgccgtccgtcgccatct

SEQ ID NO: 31484 - DNA, 126 bp, Homo sapiens
  chr7:119912968-119913094
  hyper
ccttgaaccgggactcgagaggcagaagcaaggcacgggtcccctttctcctctcctccaccaaaccaccgcagcccagcacgtgaagcttccctttgttcatccgaggctcgcttttctccccag

SEQ ID NO: 31485 - DNA, 41 bp, Homo sapiens
  chr7:119913455-119913496
  hyper
cccgcccggccgccccgcagccccgccgccccgcagccccg

SEQ ID NO: 31486 - DNA, 53 bp, Homo sapiens
  chr7:120969300-120969353
  hyper
ggtgcaaaagaggagcggctgggctgggggactccatgcgggggcgatggaca

SEQ ID NO: 31487 - DNA, 201 bp, Homo sapiens
  chr7:120969650-120969851
  hyper
agagaagctgggctgcgccaatttgccgctgaacagccgccagaaggagctgtgcaagaggaaaccgtacctgctgccgagcatccgagagggcgcccggctgggcattcaggagtgcgggagccagttcagacacgagagatggaactgcatgatcaccgccgccgccactaccgccccgatgggcgccagccccctctt

SEQ ID NO: 31488 - DNA, 600 bp, Homo sapiens
  chr7:120970100-120970700
  hyper
tcttcctctttcctgcggtgccccgccagagttggaaaaaaaactctaattctcctaccccgccgaccccctcggaccccgtagcgcccccctacgtgggtgaccagctggagaaacatgatgtcggcagcggggaatgcggctgccgcatctgctttgatttaaccaactccgctgcgcaccaaaccccggacaagtggctaattgcagcgaagccccacctttattggctcctaggagcaccgagttgacagaataatggtgacttttaaagcgactgtccgcgaccacccaacgtgcggctaacctgagcaggaccacttgtgcgcttctcgtttctttggcttttctatctttccctcctcggcgcactcccgcggcgcgggaagctgcaggaaaacaaagttccacttccacgtgcgtagtgacttggtaaggataaaggtacagggagccaggattgttcctggaatatcaacagatccaaagaatgttaggactggggcgctgaaggatgcgctgtcgtttttcatgttcatttccgttccccctccgcctttgacccttgtccacgcagtccctgcgcgcacccccgccgag

SEQ ID NO: 31489 - DNA, 371 bp, Homo sapiens
  chr7:121513553-121513924
  hyper
atgcgaatcctaaagcgtttcctcgcttgcattcagctcctctgtgtttgccgcctgggtgagtgagaagagctcggtggggtttcagctccgggatcggtgggatgagggtgggagcatttcagcgtgtccgcgacttgccgccgccgccgccatctagccaggaggaaaaagggacagccaactgggctcccacggagcgggcggccgcgcggtgcaggcagctgcgtgggatttgcgcgccccctccccgccccgcgccctcgccccttccatcggcccgcgggcattcgtgccccgggccccaggagacggagctactggagacggagggctactcggatccctgccgccaccgttcttctctcctc

SEQ ID NO: 31490 - DNA, 258 bp, Homo sapiens
  chr7:121783508-121783766
  hyper
taaactgcttctccccgcgccccgtcccgcgcgagcgctcacaatgggctgcatagtcccgcaggggctgaagagttcaggaaacccagacttgcaaggcgcccaacttccacccatctccgatccttgctggagaatgggtctgtgtctcggagagtgggcagcccaagatggacaaggagagaagtttgtgatcagtttggctaagctgggcgtggggagggaagggggaaagaaccaccccgaaatctccatcca

SEQ ID NO: 31491 - DNA, 67 bp, Homo sapiens
  chr7:121784215-121784282
  hyper
tcgtccgctctggggcgccgacttgtcccccgccgcctcgaatcttccgagtcgctgcaggggaggc

SEQ ID NO: 31492 - DNA, 568 bp, Homo sapiens
  chr7:121939677-121940245
  hyper
ggagctacttagggccgcatagattcggaatccagccaactatggaattccaagaccctcgctccctcgctttccgaagtcaaatctaacatggatttggccccaacagtgggcaaggtcggggcatgaggtcaggaaaggagaaacatcggttttcgatctaataatggctgggctggagcttgttccctgtgtccaaagggcgtgcgtactagcacaagcgttgagaaaggtctggacccgatgtctgcaggaagtgtcaggacctccctgttctggggaccttcccagcccacaccaggtccgtgctctctagattcccccaacctcgctccacaacccggaaggagctcaggccggacttggcgtgagggtccctgcggggctgggtcacctacccgtccgcgatcaccccacaggggctgttagtaatctccctgcttcctaggccgttgagaagcactcaggtcacccactctcggtgaccagagcggtcagtctttccccgccatgaaatgtgagttcgggtggcagccgccgcgcccctgcagtgtcccctgcacatctc

SEQ ID NO: 31493 - DNA, 191 bp, Homo sapiens
  chr7:121940433-121940624
  hyper
cggtgtggaccgatggtggattctccgcgacaacagccctggagggagagagtgggccgggggaggggccacggggcccctgaggcctgcggggctggccgcactggccccgggcctggcggggtggtggagtccgaagcggcgaggcgaggaccccggggcccgctccccccagtcgccctcccgggatg

SEQ ID NO: 31494 - DNA, 187 bp, Homo sapiens
  chr7:121940903-121941090
  hyper
gaatggaagtatattcgtctataaacatacatacacatgtaaaaacacggaggctccgtttgccagctgtgtacaagtcagtatgtgccgtcaggatgcaaacaatagatacctgtctatctatgattgtaatgcgtttgaggagatgtacattgcatacagctactggatacgttgttcccattta

SEQ ID NO: 31495 - DNA, 320 bp, Homo sapiens
  chr7:121941881-121942201
  hyper
ggtgcatgcaagaggcgaaaggccaggggatgcagaggcttctggtcggccctgaagtgtggggcccaacatgccctggggtctgcagacgaactcggaccaggagctctagtctgccgctgcctcagcgtgggggcacggctgaggctgggaggacccttagcctcgatcactggtggccctggtggagcccgggctgcaggggccccggggttggcagcggcggctgcagaggaggcagcgtcatcggcggctgctgcggtagcgggggcggcggttcagtgcctggttcgccagctggcgtgcgggccagccccagg

SEQ ID NO: 31496 - DNA, 15 bp, Homo sapiens
  chr7:121943974-121943989
  hyper
ccgggtggcatgggc

SEQ ID NO: 31497 - DNA, 123 bp, Homo sapiens; identical to SEQ ID NO: 706
  chr7:121944176-121944299
  hyper

SEQ ID NO: 31498 - DNA, 30 bp, Homo sapiens
  chr7:121944621-121944651
  hyper
cccagcatcaccagccgaacctgcctgccc

SEQ ID NO: 31499 - DNA, 142 bp, Homo sapiens
  chr7:121945611-121945753
  hyper
caggatacacacagacgcgcgcgcgcgcacgcttccgagtttccattgagagtctggaaagagcatttctttcttaagtacctgcgctcagctagagctctcccggagcattttaaatactgaatgccgagcggagaaggga

SEQ ID NO: 31500 - DNA, 46 bp, Homo sapiens; identical to SEQ ID NO: 9197
  chr7:121946080-121946126
  hyper

SEQ ID NO: 31501 - DNA, 505 bp, Homo sapiens
  chr7:121946478-121946983
  hyper
tttcactcaaagatgcgaaactggaccttaaacgaaggaaattgacgtcaaagtattccctcctctctaccccattctcaacacatgccaggcaagctacccgggtccctccgccccactctaactttccgcgaaaatcagttccgcctctgccccaagagccaagaggggtggaaaggaagagagcttgggctgggaacgcgcctgatgtctaacagaaaggcagtggcagctgggtgagtggtgggaaagctcacaggctgaagaaatgggggagggggagtgagtcttattggaagttgaggacagccaaggggcaagatggggggagaggtctggctgaatacgacgggcttcagcagctaggcctgggagtgcctcgtttcaggcctcgaggtggcttcaggctgggacaactgatgcagcagagaagggcagagcgcccggggggagaaagcaaagaggcgctacactccaaggcggccctttggaaccgtccttggcc

SEQ ID NO: 31502 - DNA, 309 bp, Homo sapiens
  chr7:121947097-121947406
  hyper
cgcttcgtagttgtccttggaccgggcgcagacactcagtattggtcagcgctggaaattttctttccttttgctgttggggccgcagaaccagtctcctcctttcccctgctcagacaaagggcacgggaagggctttgctggggcaaaggggggtggggggttctctgtcccacgacagatgggtcgcggttaagactttaattgctgacttttgggccggatcagattccttttcctacctgccacttcccagcagcgaaaaatccccctcctgctgcactcctccgccaccgggctaggttgaaa

SEQ ID NO: 31503 - DNA, 163 bp, Homo sapiens
  chr7:121950102-121950265
  hyper
ccatgaaataaaagtcgataatagaaattaaaacaacacagagcaaagaacgagcttagtgaaatggagaagcagtagaggtaaataaaaatcctcgagctagaaagctctaagaaccgcttataaattcagttacctcctgaactccggccgatggccactc

SEQ ID NO: 31504 - DNA, 125 bp, Homo sapiens; identical to SEQ ID NO: 710
  chr7:121950428-121950553
  hyper

SEQ ID NO: 31505 - DNA, 148 bp, Homo sapiens; identical to SEQ ID NO: 711
  chr7:121951863-121952011
  hyper

SEQ ID NO: 31506 - DNA, 104 bp, Homo sapiens
  chr7:121952043-121952147
  hyper
cgagggtgggaagggaagttgaggtctggggtaaaaagccggaaaaagaaaggaacaaggctgagaatcattcaaagattaaatggggtcggctcccgttgctt

SEQ ID NO: 31507 - DNA, 40 bp, Homo sapiens
  chr7:121955281-121955321
  hyper
actccgggcaggagtcggtgctggcagtcgccctaagcgc

SEQ ID NO: 31508 - DNA, 459 bp, Homo sapiens
  chr7:121955381-121955840
  hyper
tttccgcagctggggccaccttgaagggtgtggacccctctgcctttctctctctgttccgcttgcagtttgcaagtgtatccttctgttgcatccctgaattgggacgcaggacatcgttctaggctcccataagccttggaaaatattaatgaacaccatttgcacctgaaattcccttgaactcaacgcactgaccacaacagccgaggcctgagattcctcgcttgtgatctggcacctcctggatcatccccgtcccatttcagagcccttgaccaacataatctgcaagtggactcaataacacatctccagctacctcccttcccaaccgcagccacaggggctgctgttagcgatgctggccctttctgagaccagagttcccttgcccctccccgtctcctcctctcctcccatcgggctggccatatatataaccggagaactggacaa

SEQ ID NO: 31509 - DNA, 30 bp, Homo sapiens
  chr7:121956177-121956207
  hyper
aagcttggggctctgcggttgtccaagctg

SEQ ID NO: 31510 - DNA, 124 bp, Homo sapiens; identical to SEQ ID NO: 713
  chr7:121956458-121956582
  hyper

SEQ ID NO: 31511 - DNA, 123 bp, Homo sapiens; identical to SEQ ID NO: 714
  chr7:121956954-121957077
  hyper

SEQ ID NO: 31512 - DNA, 1 bp, Homo sapiens
  chr7:121957253-121957254
  hyper
c

SEQ ID NO: 31513 - DNA, 57 bp, Homo sapiens
  chr7:121957255-121957312
  hyper
gctgagtgacctctttccctctcaagcacaccttcaaggagccggtggaccctctca

SEQ ID NO: 31514 - DNA, 305 bp, Homo sapiens
  chr7:123172939-123173244
  hyper
gcttggcgcggaaggcgccgccagtgaccggctgcggctgggggcggaggccggcagttgctcggagctccggcgggtcaggaggtgacgggaggaggaggaggcaggaggaagaaaggggggttgggaggtagcgtccggtaggtctgcgcagacagcgctgccagacctctgactcccccagtcctgccgccgccgatagccccacaaggcgacatgggaagtccgccggagcagaggggagaaaattcaaaacgagtctactcaacctcgtcttggctccgaggccccgccatgcagacccc

SEQ ID NO: 31515 - DNA, 505 bp, Homo sapiens
  chr7:123672016-123672521
  hyper
gcccataaaattgagcgggtagtgagaatagtcccaggaacaagccccgcacgtgcggagtcccagaccccaggacagctcccacacgtagatgaagatcacgtagatgggcacccgcttccaagtgccccaaccgcggctgtagtggaggtggaagtagagcttttccaccacgaaactgcagctgccgtacataaagaaggaccagagcgacgtgtggccgctggttgtcccgtccccctgccccagtacgttgaagaagaaggtgaagaagatctcatccagaaagccgtgcattccgaagaaaagaaagcggggtaggtcgggcagcccctggctgggggctcccccggcgcccctggggccacggggtcgtcgccgccgggctccggccgcagtagggacccgggcgccgggagggacggggagcgcgcccctccgctgctgctgctgctgctgctgctgctgttgctgctgccgccgcctctgtcgcccgtaccgcaag

SEQ ID NO: 31516 - DNA, 56 bp, Homo sapiens; identical to SEQ ID NO: 9209
  chr7:123672928-123672984
  hyper

SEQ ID NO: 31517 - DNA, 157 bp, Homo sapiens
  chr7:123673226-123673383
  hyper
tgcactcaggggactcgcgggccgcccggctagcggaatccccccgccgtggccccgctgcgccctcccttccagtcccgggcgaggtgccgcccgcccgcgcccgctctagctctcaccctgcgcggcctaacgggcaccgcggcccagccagggg

SEQ ID NO: 31518 - DNA, 137 bp, Homo sapiens
  chr7:124404361-124404498
  hyper
tccattctgggccagcgcccggcccgggagtgcaattgtccacccttcgtgccccgccagtccattggccgtcttggacaggggcttgtggtgggaaccctggagtttcccggctctccttggccagtaaaaaagat

SEQ ID NO: 31519 - DNA, 226 bp, Homo sapiens
  chr7:124404734-124404960
  hyper
cctgcagccgggtcacggcccggggccgccggcaggtcccaggagggtcccgcaagaaacgctgccccctgctcctccctgggtgctcgggctcgcagaacgtctcttgcagaatttcccggtccccaggcgtccctgccgcggcgctggatcactgtaggtgcacagctctcccccagacaagtttcgtttctggacgcaggggcgaccccgagggcagaagagg

SEQ ID NO: 31520 - DNA, 30 bp, Homo sapiens
  chr7:124405187-124405217
  hyper
tgggggtcacacacacgccccctataatcc

SEQ ID NO: 31521 - DNA, 671 bp, Homo sapiens
  chr7:124405556-124406227
  hyper
agctcgctggaaacacgttgcaaacagtccgaagcagcgctgatgcgccggcgaaactcttgccccacctaaccccagcgacttgcgagcctactgctgccgaggagaagcgggattccaaccccgcggccactgccaaagttgcttctcctccagctcaaagttgacgacggggcgaagcaggctgctggacggcgtgccgccgcagagaaggaaatcgtggggagaagggggagaagagggcgccgctcgtcggtggacagtgccgctagccgcgggagctagtcactgccacagcgggctcagcccggacgggaagggtggtgcctggaaccgccgcgggccaggcagtgcgcggccgggaaggggaggtggcccggcctcgcccccgcgctccagccgctgcgcgcgcccgcgaagctcgactctcggctcgttgcctcctcccactccttcgcctcctcctcggagagatactggtttgtggggagacgggatcccctggtggttcaccactcactaaacccacacacgtttcattcaagccatttgtagcggcttccactcggaggagctgggagggaacaagggcggaggcgcggagcctgcgcggctcgaggctagggatgggcgggacaggttaattccccagctgtcgaaaccagcctgac

SEQ ID NO: 31522 - DNA, 44 bp, Homo sapiens; identical to SEQ ID NO: 9215
  chr7:126891206-126891250
  hyper

SEQ ID NO: 31523 - DNA, 1050 bp, Homo sapiens
  chr7:126891563-126892613
  hyper
gcccctgtttcccagcgcaggttcctttttcttctcagttccttgggctgttgaagccgggttctgggtagatagagactggggccgtggggagagcgccaggctgcttttgcctttcccgcgccccggggcattccggcgcgctggggatgcagcctccgcccccgccgcacctggccgcccgagcgcccgcgcccacgccccgcgcggggccgcccgaaactggggccgcgccagccgcgggagctaccgaggagctgttggggtgcgtttgcctttgctttttaaacaagatccccgagaccttttctccatccccccaacccccagcaggacacggaactccggcgtttctcgaaagccacaaaagaggggcacggaaatcccaagctcgccgtgctaactcggagaacgcaaactcgaggcagagcgtgcgccgtgcggggatgtgggtgtcgaggaccccgaagcgcccggcttcccccgcgacccccatcctccctagatcctggttagacatccatccagcccacgctcagagggcgggggttaccccgactcatcccggaagccgctaacttcagaaatccctcctgttaggttcgcgaaacgaaggtacctcgtcatctcggcggggcaagtccggattccaccagggcaggtccgggaggtcacccagggcagacgatccgaggcagagcgctttaaaatcctgccgccgcacgcccagtcagagcgccgagcgcgcctgcccccttcccgtcacccttcagtctcccattcgccgactaaacttttgggggatcacatctccaagccttgggagttccgggtaaagtctccctcttttctgaacctctttactgtaatgtaatcatgggcagacaagaggggtggctgccttgttctttgcaacgtaaaatcaacagacacccaatcaagctccaatgcccggccagcccctcgccccctggtgcccactctccttctccccccattcccgtcacctccgcccgctatttctctcacagactacggacatgcagggcc

SEQ ID NO: 31524 - DNA, 212 bp, Homo sapiens
  chr7:126892895-126893107
  hyper
gcagctccatgtcagcgccgccgccgccgccgccgccgccgcgtgaggcgagcacagcggccgcacttgtggctgatctctgggctgagggggctgagctggcctagcaggcgccaagtctcttccatgtgaataacaaatactcccaccggcggccgcgattggtctgcgcccggcgcctcccgatcctccgcccgcggccattcacccgg

SEQ ID NO: 31525 - DNA, 69 bp, Homo sapiens
  chr7:126987771-126987840
  hyper
gaaaggggtttgaggcgaggcagaggactcaggggtctgcggacggctggtcggcccgtggagacggcc

SEQ ID NO: 31526 - DNA, 43 bp, Homo sapiens
  chr7:126988163-126988206
  hyper
aggaaagagcgccgacgcctctcagccccgcaagagctgcaga

SEQ ID NO: 31527 - DNA, 47 bp, Homo sapiens
  chr7:127260538-127260585
  hyper
tttccagagcgcacgcgccacctgtccaaaaccgttctctggcggcc

SEQ ID NO: 31528 - DNA, 153 bp, Homo sapiens; identical to SEQ ID NO: 715
  chr7:127744057-127744210
  hyper

SEQ ID NO: 31529 - DNA, 459 bp, Homo sapiens; identical to SEQ ID NO: 716
  chr7:127744211-127744670
  hyper

SEQ ID NO: 31530 - DNA, 46 bp, Homo sapiens
  chr7:127806561-127806607
  hyper
tgggaggaaggggaacgccaatgcccgggagcggcctttgggagga

SEQ ID NO: 31531 - DNA, 50 bp, Homo sapiens
  chr7:127807004-127807054
  hyper
cgggggcgcggcaggcgggcttggcccaccccagccgaggagcttgtggg

SEQ ID NO: 31532 - DNA, 131 bp, Homo sapiens
  chr7:127807478-127807609
  hyper
tctcaaaatagtaggcgagcgcggccggcgctgccctggcgaggggtgggggctccgcgctcgctcgcgcgagccgagttagctgcagggttacaaacagtatctccctgctcccccggcctgaattaatg

SEQ ID NO: 31533 - DNA, 864 bp, Homo sapiens
  chr7:127807816-127808680
  hyper
ggcgccccctcccagcgcccgaacccaggcaacttcccgccgcccgggcaggagtttctccgtagcccacggacatccgggaggcttgtggagggcaggcgggtaacccccactcccaccccacctttatccaggggcagccagaggagccagcaggtcgggactcgctgagggggctccacgcggggcctcccacgcacaggtacgcgctggtcctcggggtgtccccagtttgggagggagacacgcacagtcgctcccgtccacactcctctcgtgtcctggctccatgactgggagtctggggaaagaagaatgggtgtctgagacctacccctccgccggtgtcgccccgctctttctgggcgtaggagcgggctgcctgcccctctcccgcaccttcctggtctcgggctagaactggggcttcccatcggccgcgcttcccttaggggcgccatctgaggtcggaagcaaagctggaggggcgtccaggccagaggacgcgggctggggcgggagcctcggcagcctggtgggagctggtgcccactgcagggtgcgtgtacggggctgcctgcgtgtgcttggtgtgtgtcacttctgggagcgtaccccgtgtgtccacggggtgtgtatgcgcccacggaagtcctctgtgcatgcgtgtctgtgccataggcgtgggaacacctcgtgcacccatggtacttgcccggagagtaggaagccagcgagggagcggccctgctccagggtctcttccctgctcatccctccagctggcccagattacaccctactcacacccgggtcgcggcccactttccccatagccgcagcttccggcggctgcacacttct

SEQ ID NO: 31534 - DNA, 159 bp, Homo sapiens; identical to SEQ ID NO: 3109
  chr7:127841338-127841497
  hyper

SEQ ID NO: 31535 - DNA, 192 bp, Homo sapiens
  chr7:127841625-127841817
  hyper
cgcctccttcctccgccggcttctctgtctgcctcccactgtccctattctgcccttcacagatcgttgtcattatcaagtcctacactttgagagcagaaaacgaccccgtacgtggtgggtctccgacatctgtttattacgttggaccgcatgctgcatatgatccagccacctcgctctactcctgtg

SEQ ID NO: 31536 - DNA, 34 bp, Homo sapiens
  chr7:127991709-127991743
  hyper
agcagcgcggcggcacgcgaggactgcagagcgc

SEQ ID NO: 31537 - DNA, 136 bp, Homo sapiens
  chr7:127991787-127991923
  hyper
cgcccaggcgcaggcctagctggaaggcccaccagggccagggcccttccaggccggattggccgccgtagcccagggcgtgcagcacctcatagccctgcagggctccgctcagcagcccgaaggtgcccgccac

SEQ ID NO: 31538 - DNA, 275 bp, Homo sapiens
  chr7:127992044-127992319
  hyper
cgcccgccccagcaggagagcgccagcagcagcccggaaaggaaagcggcgagaaaggcgtgcagcccgcgcgaggcgagccgcaggggccgcagcgggcgatgcgcggcgctcccgagggcggcggcggccgccagccccagccccaggagcagcagcgcagccaggccggtggggcaccgcggcgggcgcggccgggccagcagcaggcaggccagccccaggccggcagccaagcagggcagcggaaggtcctgcagcagcagccaggcgag

SEQ ID NO: 31539 - DNA, 154 bp, Homo sapiens
  chr7:127992371-127992525
  hyper
cgcgtggtcccggccgacagcagcagcaggtccagcagcgccaggcagggggcgccgggcgggcaccgccagggcaagagggccagagccagcagcgccagcaaggcaaccaggccgaagagcgcgcctaccccgtacacgtgggcctcccagg

SEQ ID NO: 31540 - DNA, 115 bp, Homo sapiens
  chr7:128002255-128002370
  hyper
agcttggtagaaactcgaaccgtctccctgccggccctctccaccacctggtggttttcaacagttgcactgctacacagcagtgcctccaacacttcaccggtgaactgccaaa

SEQ ID NO: 31541 - DNA, 138 bp, Homo sapiens
  chr7:128337405-128337543
  hyper
ctcaatttcttcacccggccatgtaagcagagcggacaactctgagggcgtggctgggcggggttcttggggcagcccggcgccactgccggcatctacgcaccctgaacgcgcccgatctggtctcatctcggaagc

SEQ ID NO: 31542 - DNA, 134 bp, Homo sapiens; identical to SEQ ID NO: 719
  chr7:128337787-128337921
  hyper

SEQ ID NO: 31543 - DNA, 142 bp, Homo sapiens
  chr7:128430740-128430882
  hyper
gggctactgtgggggcgtggctcgcagcccaccgggtgtgggaccggaagggaagacagggcggaggagagggggtcttccggccctgaggcttgatggggccaccggagggctcctcctaagagggtccttggccctggct

SEQ ID NO: 31544 - DNA, 19 bp, Homo sapiens
  chr7:128430922-128430941
  hyper
cgttcgcccatccgggcct

SEQ ID NO: 31545 - DNA, 564 bp, Homo sapiens
  chr7:128470493-128471057
  hyper
gagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccataggtcagtgccggggg

SEQ ID NO: 31546 - DNA, 134 bp, Homo sapiens
  chr7:128471125-128471259
  hyper
cggggagctgagagacagggcggagggcaccccccggtatagagagaagaccctggccccggccctcccacccatcgacaagggccatgggcactgcctgcacacccctctggggacagcgagcactccctggg

SEQ ID NO: 31547 - DNA, 101 bp, Homo sapiens
  chr7:128510097-128510198
  hyper
gcccacgccccctcccgggcggcccccagctttgccaccgccggtgccgacctttgtggctcgcctttgatcatgctctgcgtcagcgtggtagtccttct

SEQ ID NO: 31548 - DNA, 374 bp, Homo sapiens
  chr7:128828130-128828504
  hyper
tggaacagaagtccccgttgacttcaggcatcccctgtctttcccatcctgagccaggagaaaagtccgcttcctgcagacgacctcagaccaagcaaggtgcccgccgagtctctccttgcaggtccggcccacgatttccactcatctctttcccccgggcgcggggcggcggcaggcggggtcaccagatccccctagcccgggcccctccaggcgccagggacgctgacgctcgcgctcttcctctctcgcctcccctccccacctctccgctccttcgtccagtccctcccccagcctcggcgcaggggggccgggcttggctccgcgaggcccgtgcattccagagagcccagcgagctagagcaaca

SEQ ID NO: 31549 - DNA, 475 bp, Homo sapiens
  chr7:128828904-128829379
  hyper
cgcggccgccgaggtcgtgcgtgtggccggggggctccgaggagcaggcgggggcgccggggcttttgctgagttggcggggttggccatggccgctgcccgcccagcgcgggggccggagctcccgctcctggggctgctgctgctgctgctgctgggggacccgggccggggggcggcctcgagcgggaacgcgaccgggcctgggcctcggagcgcgggcgggagcgcgaggaggagcgcggcggtgactggccctccgccgccgctgagccactgcggccgggctgccccctgcgagccgctgcgctacaacgtgtgcctgggctcggtgctgccctacggggccacctccacactgctggccggagactcggactcccaggaggaagcgcacggcaagctcgtgctctggtcgggtaagtgcggcggagccgggtctggggggcgggaggtgccgcggtaagatgggggc

SEQ ID NO: 31550 - DNA, 30 bp, Homo sapiens
  chr7:129142850-129142880
  hyper
cggagtcaggccagccgtctttccaggttt

SEQ ID NO: 31551 - DNA, 300 bp, Homo sapiens
  chr7:129418271-129418571
  hyper
attttctcttctttgcgtaaggccgactccagaggtcccgctaactcccccgcaggagcatgaaggggcggccttgagcggtaaagaaacgagcagtggtggaggctgccgctccgagcccaggtccgaaccgagagccgcgcggggaatgtgggggtcgaggctgagagctgggcttggggcaggttcctttgcgttcgctcaggccacgatgaggccactaggacagatttctccgaaggctcggcctcggatcagagatccgccgactcggtgcccatcggtcgggctcactgggtg

SEQ ID NO: 31552 - DNA, 79 bp, Homo sapiens
  chr7:129421630-129421709
  hyper
ggctgtctctgcacccgcgccctacctggtcctcagacccatgcgatgctgggcaacccgggccgggtgtgcccaggac

SEQ ID NO: 31553 - DNA, 854 bp, Homo sapiens; identical to SEQ ID NO: 721
  chr7:129422115-129422969
  hyper

SEQ ID NO: 31554 - DNA, 299 bp, Homo sapiens; identical to SEQ ID NO: 722
  chr7:129423125-129423424
  hyper

SEQ ID NO: 31555 - DNA, 1391 bp, Homo sapiens
  chr7:129424555-129425946
  hyper
taccaggcgacaccccggtcgactttgacccccgagcaggtgaaacataagcgtccaccccagaggggtcccctacccaagtcagaggagaaggtggcctgccaggttaaaggatcgagtccagcctcggtttcctcatctgtaaaataagccgagaacatccgcgcctctttctggagaaggctgggaggatgccagagagaaactgcgcgcaggccctggcgaggagcccctccggcccatgcggaactctgcacaggctgggtccctccagggttagaaacccagcttccccacccctacccagcagggacccgcgctgcatcccctaacgccccccaaccctctgcacccagacccaagagccggccttcgacgcaccacatgcgtggagcccgggtcccagccctgaggaccaggtttcagggctcagaagactccagcgaggttccctcgcagattgtgtctgcggtcgttgggggaggggccccgcagccttcagcagattatccaaaggtcagtgacccagatatggttttggccacgggccatgtttcacttcctgtgccccaagcagaatttagctgaataattcggaccccaaaccaaacaaaacgctcttatttccgtttggggattcttcggagttgggatttttctgtctcaaattagaataatctgcattattaaccacttaacagttatttgttggttggctgcctgacctttctgagcctcagtttcttcgtctgtaaattgggagcttacccaggtcggaggactgttggaattggaaatattcgaataaggaagtgtttttgcaagtgctttgtaagcagcaaagcgcttcttcaggggtcaatttttttttagctctgcagtcaccacccaaattcggaagatcgttgtgcctttcttggatgagaatgcccggctccagcccggggatgggacggtcttttccttgctaggagtccgctgtggagggggcgatgcgctctgtccaggacctaggagtccctttctccctccaccctcggctcacagcgggcagctcccccgacgcgtaccgcctctttgcccccagcctgaggtgcgctcttccccaggacgcctcctctgtcctctgcacgccgccggccctgctggggttgctttctgccgcggcgtcttcgcgaatatcccctcttgctgtctgcctgggcgtccctccgggttaccgcacaccgcctccgaccctcccagggcgcgggaggaggggcagggcatccgcgttcgtgtctgggccctggcggggagtcgcgtggtccaacccctcgtttttaagaggagggatctgaagcccagctaggcttctaattccagacagagccctacggagcccagttctc

SEQ ID NO: 31556 - DNA, 202 bp, Homo sapiens
  chr7:131242762-131242964
  hyper
attaaccttggaacccgggtacggcgtaaatttggctcacgtgactccggggttgctaatctggagtctatctgccagatggggctgggtggaggggttttctccaggatctagccgcgtcccgggcacaggggactccgtgagcccctcaagtcggctgcaagcaggcgatgcctgcagggcactgcgtccctggagccgc

SEQ ID NO: 31557 - DNA, 195 bp, Homo sapiens
  chr7:131514739-131514934
  hyper
cctgggcttggatcccgctgtgaggccgggggcaggtgatcatggcaggcggtaggactcctctcactctctgccccagaccccgcctgggagcctctgccgccctctcctgctccagcaggcaaggccaggaagccgggagtgcttgctgtcaatatcacatgtggagctgcttgtggccggccaggactctca

SEQ ID NO: 31558 - DNA, 286 bp, Homo sapiens
  chr7:132260280-132260566
  hyper
caggtgttcgccagccggaggcaccggggaaggcagccccatgtgcccagggagggtagggaggtgagaggggacccaagtcctgtgtctccaagtcctgtctgcttgctgctaagcaggcactgaggctgtgaataaggtcttaccttttaaggaggatctgacccccgtaccttccctagacaagcaacatacgcggcgatgctttaagccgctttctgcctgaaatctcggcgcattcccggggaagcagtgccacgcttcagaaaggcgtttgtgctgcctc

SEQ ID NO: 31559 - DNA, 89 bp, Homo sapiens; identical to SEQ ID NO: 9241
  chr7:132260852-132260941
  hyper

SEQ ID NO: 31560 - DNA, 62 bp, Homo sapiens
  chr7:132261146-132261208
  hyper
cccggccccactccccggcgggccggctccttacctggacgcgccgcgtttccctccttcag

SEQ ID NO: 31561 - DNA, 249 bp, Homo sapiens
  chr7:132261256-132261505
  hyper
cgccctcctctgaacgtgtgcgtgtgcgcgcgtgtggctgcctcctccagccccagccccgaacgcaaatactccaccgaggcacagggaagccgggagcagccgaggaacgcggagggcgccgaatcagagcctgcggggcttgacagcttctcttgcggcgtccaaggtgggcgtaatgtccaacaaaaaggtcggaaaatggggatcgattccgaacacccctttcctccacccagccccggagcc

SEQ ID NO: 31562 - DNA, 27 bp, Homo sapiens
  chr7:132261534-132261561
  hyper
cggtggcgacgccgggctgcccccctt

SEQ ID NO: 31563 - DNA, 151 bp, Homo sapiens
  chr7:132261835-132261986
  hyper
ccgccggctgctccccggggaggcgcggggctgcggcggtggtggctgcggcggctggcgctgcggcggcggagagctcggccgcgggccgagccgggcctcccgggcgcgcccccggccccccgggcgggctgctcgcaaagtttgcagg

SEQ ID NO: 31564 - DNA, 168 bp, Homo sapiens
  chr7:132262214-132262382
  hyper
gctccctctctggctcgctctcgctggctcggagctcgcggctgacatctagagcgagggagagcggccggcagagggggcagggggcgcctccctacatgctcccacccgccgccgcccggcttgccggctctcctccgcaccaacgtttgccgacacccccctggg

SEQ ID NO: 31565 - DNA, 30 bp, Homo sapiens
  chr7:132299615-132299645
  hyper
agatgtgcagagaggcggagatggaggagt

SEQ ID NO: 31566 - DNA, 52 bp, Homo sapiens
  chr7:133812094-133812146
  hyper
tctcctaggcaaccccgctaaacaagatggcgacctccgagagggctctcct

SEQ ID NO: 31567 - DNA, 601 bp, Homo sapiens
  chr7:134142986-134143587
  hyper
ggcacttctcggggacgctgtgtggtgttgaggttttacagggaaaatgctaaccttggcgcctcctgaattatcaactagctacggggtgcccagatttttctcccgagttccagacccagggcaccccgaggcggcgcctggccgaggagctccgcactgcgccttgttaacagctgggtccgggcaaactcgcgccacctaattctctgccctctaccggcttgagatgcttattcctcagggagggcaagaatcgaaacgattgagaccaactatttacaagtgaggcaaccgggctacaggtgcctcgagggaaaggaggctgggtctgcgctcccacaccttgccgacggctccacgtccctgtctgcgcccgaggtccaccggtctgtgaagcccactttccccgcctccctctcgcgttgtgccgcttggggcgcccgctaggacccaaaatgcggactggtgggccgcccatcaagggttgcccgcggtagggcgggggctcccgtgagctgctcccaaaccccactcgcaggatgctgccctgacgcccagggccaacccggggagccaaggcccccggtctctgcaaggc

SEQ ID NO: 31568 - DNA, 271 bp, Homo sapiens
  chr7:134143700-134143971
  hyper
cggagagtgtgaggcgagccccgggcccgcgcccccacgagcacctaccttccaggtacccaaccccaggatgggcatcttggcgccgttgttgagcaggagacggcttgccatggctgctgcgctccccagacccccgcccagtacggtgcggccttggccgcggcgcgtacctttaaatagcccgtgaggtcggcagaaagggcgcctgcggttggcgcgccgctgcgcgaaggagccttctgattggttgcgctgggggtgccgcggc

SEQ ID NO: 31569 - DNA, 83 bp, Homo sapiens; identical to SEQ ID NO: 3121
  chr7:134143972-134144055
  hyper

SEQ ID NO: 31570 - DNA, 76 bp, Homo sapiens; identical to SEQ ID NO: 3122
  chr7:134144056-134144132
  hyper

SEQ ID NO: 31571 - DNA, 36 bp, Homo sapiens
  chr7:136553443-136553479
  hyper
ctgctgtactaaaggcgccagggcgcaaagacctag

SEQ ID NO: 31572 - DNA, 487 bp, Homo sapiens
  chr7:136553539-136554026
  hyper
cactccaggctgcgggttggccagagcctggaaatcgcagatttcaccaggaaatcgccgaggtacccgaataggtgttgcctcccaaaactaattcctacttccccaagcactttggtgaagaaatgaatccagcccagctcgccgaggcatccaggtctccattctattttggtctccaggctcttcgtgaaagccaggtttgaaagtcttgtttgcttctcctttagtggtttggcgtggagggcgggggcagcgtcaatttaactccagtctaaaccacgaacaggtcacagactagccaagtggctgagacgagtgtggggtgcgtgactctgcctgcgcgcgcgccagccccgcagctctcgccagagccttggggtcggttctctcccgcctctcccgcctctcccgccccacccctacagtgtctcggcatcaactaatcttttccttttcttttgcaagatcaagggagaaagagaac

SEQ ID NO: 31573 - DNA, 311 bp, Homo sapiens
  chr7:136554103-136554414
  hyper
cgctccttcaagcctccaccacctcgcagccggggaggcaactggagcgaaaccagcgacaggtaagggccccgcgctgtgcagctctccgcttacccactccaagggccctggcaccagggggtctctcccttcatatccccccaagccggaggctcaggggtcggggcttgggggaattggagggaggtcctccccacgtgcagattctcaaacggaaactttggatcctggggcttggagggttgcgagcagtgatggcgggtctgaaaggaaggggcaaacgaggcacagcgcgaggcgaggtaccc

SEQ ID NO: 31574 - DNA, 283 bp, Homo sapiens
  chr7:136554694-136554977
  hyper
ggagcagcccttgggcgctggagaggtttcccattgcggtctccaggtcatggccaaggaggagaagcaattagaatgggggaaagggtcccaagacaaaggagagggaagcattctgcaatcccatcctatttgagccccgcgcaggagctggactgtccgccgtggctgggggacaaggtctcagcccgaagctcatgaggtaccagacagtgcctgggcttcgccacctaactcacaatgggtcctgaaccgcccgggcagtccccggggtcgtagactg

SEQ ID NO: 31575 - DNA, 645 bp, Homo sapiens
  chr7:136555197-136555842
  hyper
aattattgacacacacggcggcacaccctttgcctccgtccgcctccagcatccgcatccctttctctatcttcctgcccattgccgtcctcgaggctgccctgagatacagaattgtcccaggctgagtccaccgacccgccagtccctggcgatgatgccaaggctcttgcatgtacggaaataccagcagggaggttcgccaggggcagagaggctggaggagaacagagaattggaggtaaacgcgtaaagccagcagaactgtcggtggacatttcacccaggccgccctcccgcgtctttaagtcagttcaccgccacagcacgtctgtgactgcggccacccagggctccaagtctgccagcccaggcgccgcgagccaagaagagcgcggcgcctcccactcctcaagctccggaatcccccacatcgactttctatttccctgtcttcttttcttttttgtttgttttgcttttcctgctcttttcttagcgctgggtggcagtgggtatgcggcagccgtgtgatttgcccatcccctagtacacgcagccagcgacacaagcacacagcgaccagtccccacgctgtgccacacaccctccagcggtccggcgcgcagcccctgctccacagcc

SEQ ID NO: 31576 - DNA, 54 bp, Homo sapiens
  chr7:137028481-137028535
  hyper
gagggatgagaggagcgggccaggaggacgaaggctgggcgagggagggagagc

SEQ ID NO: 31577 - DNA, 627 bp, Homo sapiens; identical to SEQ ID NO: 724
  chr7:137531262-137531889
  hyper

SEQ ID NO: 31578 - DNA, 280 bp, Homo sapiens
  chr7:137531908-137532188
  hyper
cgccctgggtcctgcaccgtgaggctggggggaccaggaccggcgggcgcccaccttggtcctgagcccagctgccgacgctgggccagcaccctctccaccgccgccctccagtgagcagagctgggctcaggcagcagcccctgggcgcgggaaggtagcgggagctgcatttaggggaggggggaggtagcaggagctccgccagtgggaaccttggagtgaattcgtcggcgggtgccaagtcgaagcgccgacctcctgtctctggactggggcc

SEQ ID NO: 31579 - DNA, 68 bp, Homo sapiens
  chr7:137532373-137532441
  hyper
cgttgttcgtataagaagaggcatcccggaaggggcttcaaaccacttaggaccgactgctgaaacga

SEQ ID NO: 31580 - DNA, 281 bp, Homo sapiens
  chr7:139167546-139167827
  hyper
cggtccagggctgggcgggtgtgggggtttcggctacgtccacccgacctggcggcgtcggctgccggcgcaggtgagcactcacccgtaagcgttacggcccggggcagcttctcgtcgccgtccaaccccgcgcggggcaacagcgccgcatcctccttctccagccccagctccttgcagcggcagcacgtgggggagcccggggagccggcgcttccttccgcggggctggcccggccctctgcgtcgcagccgctctccgtccgggctgcagccag

SEQ ID NO: 31581 - DNA, 500 bp, Homo sapiens
  chr7:139168114-139168614
  hyper
cggggcagaccccgtagcccaggctgagcggcggcacgcgcggggacccggggcgaggcgaaggcggctttttcttgctcgagggctccaggcctgcgcccgccgccttctccacggccccggccggacttgggctgctttcgggaccttcaggttgtcgcaccttcgcgggcacctgcggctgctccagcgtggggaccaggcttcccacgggctccattgggagctctgccccggcttggcctccgggcgcagcctcccaagactcctccatcccgcgcgccccgccacccggagacgctgaggagcgcacctgggcccagtgcagaggagcttcgctctcctccgtccggattggtccagccgcgtcgccgaagttgtcaggccacgcccctccccgaaggaccccgctgtgattggctgtggctgaggttctgctgccccgacccccttcgggacacagccccggcctccaccaggcactgggagggagctgagaa

SEQ ID NO: 31582 - DNA, 37 bp, Homo sapiens
  chr7:139168658-139168695
  hyper
cgggagaaaagcagaacaccagcggaggcttgtggca

SEQ ID NO: 31583 - DNA, 325 bp, Homo sapiens
  chr7:139208245-139208570
  hyper
tagaaccaggtctcccggctccaagactgcgctcccagctcgacagcatccagcctccagcccaggtggcggggtcggggagccggctgtccccgctcctccgcgcctcctccctctccgcccctgccccgccccgcccgggtccacggctcccggctcccgcgcgccgcctcgcgctcctccccagcccggctgtgcgtggaggctgcggctcggcggggcaggcgctgagcgcaccgcggcggcacccggcgcagaggctccagcgcggggagccgggctcagccccggcctgccagcgccgcggtcctagcccacccgaggc

SEQ ID NO: 31584 - DNA, 196 bp, Homo sapiens
  chr7:139208614-139208810
  hyper
cgggctgggccccgcaccccggtgcaggagcgcgggcgcggcgcggcggagcgccccgcatggagccggcccgggagcccccctcgcgggcccggccgccgccgcccctcgccgcgcgccccgcgcccgcccccgccgcccccaggccgcgttcgcccgcagaggctgaggcccgcggccccgaggggctgctgcg

SEQ ID NO: 31585 - DNA, 125 bp, Homo sapiens
  chr7:139930151-139930276
  hyper
agggatagagacaggcggagaccgctggggagtttcccggtgctcagccatcgcataggggggaacggacccttttgtgggccctcgggtccccccgtggtccccgctggcgcgctcgtcctctg

SEQ ID NO: 31586 - DNA, 43 bp, Homo sapiens
  chr7:140339825-140339868
  hyper
actgcaaatgctgaccgctgtgaggggggcccggctgctcagc

SEQ ID NO: 31587 - DNA, 202 bp, Homo sapiens
  chr7:140339967-140340169
  hyper
cgcgcgcgcggacacacacacactcacactcgcgccccgagggacccagcacggcgcagggcgggggtctaccggctttctgcaggtccccgaggcgcgagacggcggcgtccgggctcagtcctgggagtcagcccgagcccgggaggaacgcctggatcgcgctctgcacagtcccgggaccaggcgggaactcagactc

SEQ ID NO: 31588 - DNA, 38 bp, Homo sapiens
  chr7:140340747-140340785
  hyper
accttctgccggactcgccccctcgcctctcggggtgg

SEQ ID NO: 31589 - DNA, 203 bp, Homo sapiens
  chr7:140771347-140771550
  hyper
ttggctcacaagccccgttgtgcaaagcagggtgtcagagactctctttttccccagggcaactctttacccggcaatgccggacctcgactttggggtgagggtgaaaacgaggggtgagcattagagtgaaaaacccagcgtttgatgccgggagggagggtcccagcctttgcggcgccgtctcacgtgagcagagcagg

SEQ ID NO: 31590 - DNA, 72 bp, Homo sapiens
  chr7:140771769-140771841
  hyper
ccattaaatttctctcgtcttgagtcgatcagccaaatttcttctttctgttcctgccgaggagggagggca

SEQ ID NO: 31591 - DNA, 308 bp, Homo sapiens
  chr7:140772281-140772589
  hyper
aagacttagacatttcgtgcctgggaaatggtgcagtttatctttaaggagactagaaaaataagagatgaggctcacgttgcacggatgacatcactagcttttggctgcgcgctcggtgttctcgtctgtgggttttagccaaggctgcagctacccgcgccggacgagagagcgcggcagcagcttcctccggcgcccgcacccgggcaatgcgatttccccagtcccctgggcgcagcctgggctctcgcgcctcccgggcaccagccgagcctgcgaggcctcggagccgccgcggctagagg

SEQ ID NO: 31592 - DNA, 1526 bp, Homo sapiens
  chr7:140772883-140774409
  hyper
tttcttcggtgcctgcggcattttctttgcacctgggcggcaggctcccggggctcccgggtgccagatgaagtgaggcggaggcgtcgcgggagagccgggtccggaggcggtcgggtggacactccaggcagaagacggcgctgggaagagctgcgtgacgctcgggggctggcggctgggccggcagcgcgccgtggcggcgtgacctgtccatggtgttgaaggcgcggtgggccgagcccctagcgccgcgcgcagtgagcgctgcctggtgcaccctccgccgcgcagcccgcccctcgcgtccgccagcagccgcccagtctccgcagatcccaggccgggtctcgtccggtaacgccgcccgggtgaacacgctgtcggcccgaggggccgcctgaatggcgatgccagaggcagggcaccggggagctcgcggggaaaggtcggccgagagcgtgcgtccgcggggagtgcgcctctgagcgcagcacgcgggtcagaaggagcaaccgacctgctggtgaccagagaacggagattttaagaggacccgacccaaagaggaagaacatttctgggtgcgcgccccaggtctttgcttgcagacggggagggggagaggctctgagccagagacccaggagggactccgagaagccggccccagcacctggaggtttctttcgcccgccggccgcatccggggcgttctacttcacccggtggtccagtggcgcctcctgacagcaccccccgtccccctcagagagacaggcgagttctgtcccgtcaccatcctgcacaaagaagccccaccgcagccgaggacacttggcatttagtttccggcccgagggcagcggcgcccgaagccgggctgggagccgaggcggctgcttcggggcagtcgcttcctgcggggcggggagggggcgggaggcggccgcgctgggttcgccgccgccggaggctgcacctgcctcagaggatgcccaggagcccgcgggagcctctccggatcagaactttttaggccgcccgcccccatccccgcagtccccgggccgtgctccggtaggcgggggccgagggggcgccgcggcgcgagtccctctcctgccccctcccccagctcggccgcccgccgctttgttccgggtgcggcgagggaaggcgaggctgcggcggatcatgcccatggtgtagccgccaagcggaggcatggctgccggaaggttactgctctacactggcctctcgctagcgctctgcgccctcggcatgctggccgtggccatctgctcggaccactggtacgagacggacgccaggaagcacagggacaggtgcaaggccttcaacacccgccgggtcgaccccggcttcatttacaacaataacaacaacttgccgctccgggcgagccgctcgcgcctggaccgctgggagggcaaactcctccgggcccggaatcgccggcagctgttcgccatgagccccgcggacgagtgcagccggca

SEQ ID NO: 31593 - DNA, 60 bp, Homo sapiens
  chr7:141211539-141211599
  hyper
ccagaccctccaccccgccaggcattcctgggtcggtgtcccagtcggtcacagtcatcg

SEQ ID NO: 31594 - DNA, 42 bp, Homo sapiens
  chr7:143042619-143042661
  hyper
tgatcctgctgggctcggtggagcggtcggaactgcaggccc

SEQ ID NO: 31595 - DNA, 16 bp, Homo sapiens
  chr7:143579649-143579665
  hyper
gggattctctgtcccc

SEQ ID NO: 31596 - DNA, 285 bp, Homo sapiens
  chr7:143579666-143579951
  hyper
atgatttctgatttcggcacacccagacccacggcgcacccatcgcgccccgcacccccgccccggcctcccgccctgccctcccccccgcagcacccaggccgagtccaccgttgctggccccttctccagcctgccaggcttttggagagggccactcaccaggtcaccctgcgatttccacgggggcaggtgggagcgggcagagcctggcgcagagaggaatgcacagggaagaggcttccctgtaccagtgactgggcgaccgagccgggatttgggagc

SEQ ID NO: 31597 - DNA, 143 bp, Homo sapiens; identical to SEQ ID NO: 9262
  chr7:143579952-143580095
  hyper

SEQ ID NO: 31598 - DNA, 290 bp, Homo sapiens
  chr7:145812718-145813008
  hyper
gaattaattacatatcgaaaacatgtgcattaacggcatctgcagtcctccctccctgctccagtcagtcgggatgtttagcaccgtcacttggtgttaggaccactcggaagacctgcctgtcggacgcctgactgtggttcccggggggccggagctccaggagcctgtaccatctttatctgaaggggaggagagaaggaaaggagaaggcatccgagcgagggtgttctccttcctgcagccgggtagggggcagccaggtttggagcagggttctaggattacac

SEQ ID NO: 31599 - DNA, 382 bp, Homo sapiens
  chr7:145813009-145813391
  hyper
gcaaatccccaacttcagcaccgcggacagcatcacctcccgcccagggagaggcgcgcgcctccttgctccgcccccgccccagctgatggaccccggccggtcggctcagtctcccttttgctttcaaacgaggccagggcagggcagaagggttttgacagccagaggggtacggtaaggaggaggaagaggaggaggaggcggaggaggaggaggagccgaggagggaaccgagaagggaagagaagggagggcttccctccgcctcgctcgccgcccgggctcacaggagctggcggcggcggcggcggcggcggcgtctcctgctctccgcggctgttgctgctgctcgcgctccgccgcccgggagatgcttcct

SEQ ID NO: 31600 - DNA, 277 bp, Homo sapiens
  chr7:145813403-145813680
  hyper
cgctgaggccgtgcgtgcgccccggctgcgctgcgcgctccccacatacacaagctctccatgtgagctgacaggcgagtggaaacccctcgagtcacgctgcccggcggcggagggagcgctcgcccgcagtggcaacagctgcaccaccgtccccgtcgctctgccttcctcttctgcagcctctgctcttctgattacctccctcccccgtcctttggtgatttttttttttcaagaaggagagggcggggtaggtgtccgttccctcccctct

SEQ ID NO: 31601 - DNA, 211 bp, Homo sapiens
  chr7:145813945-145814156
  hyper
cgccgccggccgggaggcgaaggatgcaggcggctccgcgcgccggctgcggggcagcgctcctgctgtggattgtcagcagctgcctctgcagagcctggacggctccctccacgtcccgtaagtagccgtctcctcgctctgctctggagcagtttcagtgcggcattgatgtttggcaccagggtatcaactccgaagtgcatcgcag

SEQ ID NO: 31602 - DNA, 202 bp, Homo sapiens
  chr7:149112012-149112214
  hyper
gtgtgaaggtaaagacggtcctatatttcagttccagtggggctgcagggtcttttgctatcggtgtgctatgtatgcaggtcttgctagagactgagaacctctaaaagtcattgcgcagagggaacgcggatttacccggcatggtctttggaaatcagtgtgctgtggaagcaggtcttgctagagccaagaaacctct

SEQ ID NO: 31603 - DNA, 80 bp, Homo sapiens
  chr7:149119916-149119996
  hyper
gccccatcccacaggcgccaaatggagggcgcagggttttaggagctcgcgtagggcctctcgggcggcagcaatggagc

SEQ ID NO: 31604 - DNA, 367 bp, Homo sapiens
  chr7:149411361-149411728
  hyper
ccttcccgcatcacacgtttatttgaggcctactatgtgccaggaacaactggggttaccaccccagcaaacaggcacgcaaaatgtgacacgaaggtaggtcatggctgcggcgagcgggggcgcgggcgaaagacgtgaggatgtacgggggcctggcagctgctctgtcccacccacgcccggccggaccctcgacccctttcactccaggtcgggtttccccgaccgcggcctctgggaaagatgggtccctcttcatccccaccatcagcccctggcacatgggacgcgctgagtggtggctgcgggaatgaatgagtgataagcggcgcgtacccgcgggcttgcacgcccacagccgccc

SEQ ID NO: 31605 - DNA, 575 bp, Homo sapiens
  chr7:149411834-149412409
  hyper
cgcttccgagccggcgccgcggcgccttctgggaagtgtagtccgcgtctgcgccggccggccgggccgccgaagccgggggctccgggcggaaacggcaccacccaccaagggatgcgaggcgctcggggcgggctcaacgaggccgggggcgggcccgggcgcgcccacccccgcccctccccctcggcccaggcccccggccccgccttctcctgcgcggacctgggccgccgccgacgagggtcgcgtgcgcccgcgccagggcccgcgccggaaaccgaggagtggcggggaggctgagcccggggatggcgcgccaggtaaggcaggcggacgcgcggacccctcggcgcagtgcggccccgaaggcggtagggcgagaaagagctgggacccccccgcaacttcgggatcggctgggtgaggctgggcaggcctgatgctcaggggttcgtgccgggaagttcaggtcctcggacaacctctctccagctctccgccgccggtacccacggcccagtctccacctggggaaacccccttggcgtggcttgtttcgttacaagttatcc

SEQ ID NO: 31606 - DNA, 338 bp, Homo sapiens
  chr7:149744461-149744799
  hyper
cgctctctccagccaccaactcccggccgccgcggctgcagacacagacccgctccctccgggacggcgatgaccgcgatctggcgccacggagcctgtctgggggcgcccggagagtcgtgggctgggggagggcgcctgattcccccccccacagatgcccccggccgacgcgtctcgctgcgcgctcagcccggagcccccgccgccgtcccccgcccccgagaagctcttacgtcctccttgtcaccatcgctccgcgcctggtactggaaccggggccggccatccgcgccgccgccgccgccgccgccgcgctcccggggcgccgccgcctg

SEQ ID NO: 31607 - DNA, 137 bp, Homo sapiens
  chr7:149744950-149745087
  hyper
cgcgctcctgctggctgtctttagggctttttaatattttgctttctctccggttcccactccccaccccgctccagattaaaaaaaaggcggtggggaggcagcagcagcagcaaggcaagcccagcgccggcgac

SEQ ID NO: 31608 - DNA, 15 bp, Homo sapiens
  chr7:149745575-149745590
  hyper
gcggtgggggagtcc

SEQ ID NO: 31609 - DNA, 35 bp, Homo sapiens
  chr7:149917112-149917147
  hyper
ccctgctgctggccgcgggtctacaaaacagcata

SEQ ID NO: 31610 - DNA, 74 bp, Homo sapiens
  chr7:149917321-149917395
  hyper
cgggtctcttaccttgtggcctttccccgggggatacctgacgctattggagactcctgcggtttgattcatgt

SEQ ID NO: 31611 - DNA, 72 bp, Homo sapiens
  chr7:149918119-149918191
  hyper
agacagtggagtgggcggaggaggagctgggacggcacccgggctcgttagcccaggctgcacgagctacag

SEQ ID NO: 31612 - DNA, 30 bp, Homo sapiens
  chr7:150715080-150715110
  hyper
gaaaagcagaaacagcggggtgaggagcgg

SEQ ID NO: 31613 - DNA, 443 bp, Homo sapiens
  chr7:150715917-150716360
  hyper
ggcgcgcgcgcagctcgtgcggcagctcgttgaagtggcgcagctgcaagcgcgccaggcgggaccagccgcgcgcccccagcgcgccaggctcgcgccgcagcagctccacgtggctatagaagacgtgcagaacctgccaggccagcaccagcgggctcagcgccaggttcagggcggccagcagcagcactgtgcgcccccagcgcgctgctagggcgccccgctggtcgctgcgcttgtaggcgtgcggcagctcccagcccccgcggaagagcgagaagggaccgcggaagagcagcaggtcgacattgagcgccaggccgcggctgaggaaagccgcactgcctccccagggcagcgggcagcgggccggcagcaggcctttgttggccagcgccacctggtagttggtgtagcgcaggatgcggtggtggatgtcc

SEQ ID NO: 31614 - DNA, 459 bp, Homo sapiens
  chr7:150748098-150748557
  hyper
ctaaagccatctccccggtacccgcaggcgacgtgccagtgtgcagcccccagcagtacaagaactgtgcccacccggccataggtaagggcgagcctcccccacctcccgtccgccccgctccgcccgcgggcgtctgacgcggcccggtggcccgcagatgccatgcttcgcaaggactcgtgcgcctgccccaacccgtgcgccagcacgcgctacgccaaggagctctccatggtgcggatcccgagccgcgccgccgcgcgcttcctggcccggaagctcaaccgcagcgaggcctacatcgcgtgagctgcgcggggcgggcgggctcctccgagccgggggctcccgacggggcggaacggggcaggccaggccgtagccctagtgcgcacagcccgggcggaggcagcctccgcagcctcactggctctggggctccgtgctggttgctta

SEQ ID NO: 31615 - DNA, 165 bp, Homo sapiens; identical to SEQ ID NO: 9276
  chr7:150864232-150864397
  hyper

SEQ ID NO: 31616 - DNA, 68 bp, Homo sapiens
  chr7:150864610-150864678
  hyper
cgctaccgcctccggcccgctgcatcttgttcggagctgcggccgccccggggcgctcctctctgggc

SEQ ID NO: 31617 - DNA, 148 bp, Homo sapiens; identical to SEQ ID NO: 3134
  chr7:151106418-151106566
  hyper

SEQ ID NO: 31618 - DNA, 400 bp, Homo sapiens; identical to SEQ ID NO: 3135
  chr7:151106589-151106989
  hyper

SEQ ID NO: 31619 - DNA, 242 bp, Homo sapiens
  chr7:151107395-151107637
  hyper
cgcgcgccgggaactcatttggggcgcagctccaccgacccctcggctactcgcctccaccaggcaagccaggtcctcccatgctctgagccctaaggactctgcccgaggggctctcggggacttgggggcggtcccccaatggagggtgcgacagggaaagccccgagtccgccctccctgggaaatcacgcgcacacccaggattctactttggtctggccggagtggggatgaggtgc

SEQ ID NO: 31620 - DNA, 205 bp, Homo sapiens
  chr7:151107638-151107843
  hyper
agccgctgcggggtcggtggagccgggatgtcaagttcaccttccagccgccgcgggctccctcggcctggggcgcctctaatggaccccggggtcggcctgagccctcccggagcgcccggcggctggtttccattagggcagttccggcgccgacttcgctggggacggggaaggtgacccccctactcggatcccccaggtc

SEQ ID NO: 31621 - DNA, 348 bp, Homo sapiens
  chr7:151145538-151145886
  hyper
cggttccaggagcctcgccccctgctggggacccagcttgtgccctggcgtcgtggccgccggcaggcagcaaggaagggggtgtaaagagcccggttaggctgagtccctgcccttccgagggagcccgtctgcgagtgagcccgtctgcaagtgagcccgtctgcaagtgagctgggcctgggcctctgcaggggtcgccccgccagcccgggccccctggctgcgccccgtttccagccggcgtcagggagggggctgcagtgctccgggggtcatcggattcgggcggggaaggaaaggcgggacgtctgcgccccagaagacagtccccgggtctcccaccct

SEQ ID NO: 31622 - DNA, 61 bp, Homo sapiens
  chr7:151574953-151575014
  hyper
aagtgcgtgtccccacgccgcgggaaacgtggggctcctgagactgcggaaagaattggga

SEQ ID NO: 31623 - DNA, 18 bp, Homo sapiens
  chr7:152622496-152622514
  hyper
gggaacggtggaggccgc

SEQ ID NO: 31624 - DNA, 216 bp, Homo sapiens
  chr7:152622545-152622761
  hyper
cggcggggatcgcagggccgaggggccgggcgcgcgcgggggagggacccaggccaggggccgctcgcctcggggcggggtctctggagagcgcgcagaggggacgcttcgtgaatgcctgccggcctgaaggatgtcgctgatctctgcccccttcgccaaggccgggccaggcgagtaggggcgcggcctgagcccctgcggtgattccccagg

SEQ ID NO: 31625 - DNA, 30 bp, Homo sapiens
  chr7:153445126-153445156
  hyper
cccttccccaaataccgccctggtcaagcc

SEQ ID NO: 31626 - DNA, 117 bp, Homo sapiens; identical to SEQ ID NO: 9283
  chr7:153446175-153446292
  hyper

SEQ ID NO: 31627 - DNA, 181 bp, Homo sapiens
  chr7:153583349-153583530
  hyper
gtccagggagccaaccgcgtttgtgaatggatgattgatgggaacagcgcccaggggcagcaggtggagacgggaacccaggtcgcggtcactggtcaacccgcctcttggggtggaggttagagaaatgggcgctgggatttggccccggccagtgctggggttccagggtagggagagc

SEQ ID NO: 31628 - DNA, 395 bp, Homo sapiens
  chr7:153583631-153584026
  hyper
cggaggcccggagggaagtggaggccgggaagccaggtgtgcggcggggagagcggcccctgccacccgcgctggtagccgggcgctgccattcactgcaaggtcctctgcgccctggaattgccgcggcggcggatgcagaggccaacccagagtgcaaccatggagacgcgacgtgtgtcccatagtaacctgttacaacattatttataagctgccatccctagccttcccccgcttcccctccgctccctcgccagacttgcgggcgacgggcacagccgcgtctggctcttcccggcctctcccttctctcgcgggcgcagccgatcaatagttaacacccggctgcggacggcggctccatccgcggcaatcaccgtagtgcttgtttg

SEQ ID NO: 31629 - DNA, 169 bp, Homo sapiens
  chr7:153584301-153584470
  hyper
tgctggaggagcccccggagccggggccgagccgccggcgtccccgagtgcgccccctgtgcgtgccgccgcgctgttgctcgcagtgtgctggcgccgagctcggtggacacgcgcgcagtcagagctgcctctcgccctcgctagctgggctcgcagcctcttcctc

SEQ ID NO: 31630 - DNA, 320 bp, Homo sapiens
  chr7:153584797-153585117
  hyper
taagatgcaggggaacgtgatggtgagtgccacggacagggcgcgcgctgggtcggggggacccaccgtgaggagcgatgctgggggaggtctgtccttctcagtcccgaacctccctggaaggacagcgaccccatgcccgcgcgcggcggcgcttctcccacttcccacccgagcccacccagcggcagggggatgcggaggagcaggcatttctttgcaaattgcaactttgcggctccgcggcccctctccttcgggcatgtggctttgtgttttgggcgcgggatgggaggaaggggctgcggggagccctcgct

SEQ ID NO: 31631 - DNA, 340 bp, Homo sapiens
  chr7:153749703-153750043
  hyper
aggcagagtcgccagcggagactcgcgagtggcgcgcgggaggagcggccgccggcgctgggcttgccttgctgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccg

SEQ ID NO: 31632 - DNA, 76 bp, Homo sapiens
  chr7:153750249-153750325
  hyper
cgccctccccccgcccacgactctccgggcgcccccagacaggctccgtggcgccagatcgcggtcaccgcgtccc

SEQ ID NO: 31633 - DNA, 10 bp, Homo sapiens
  chr7:154002083-154002093
  hyper
cgctgcctcc

SEQ ID NO: 31634 - DNA, 318 bp, Homo sapiens
  chr7:154861712-154862030
  hyper
gggtggctaggggaacgttttgaggaaagttcattggtcaacttgttcaacgtggcaaactcatttcaggcaagagaggcagcaccgtggacagcgccaaccctcctgctcccgggcggggcgaggtggcagcaccgcggacagcaccacatgtggtggcgcacactgggagccgccaggcgcggggagcgcagcagcaccgcggacagccccaaagccgcgcgctctgagccaggaggcggggagagatggccttatcagctgatggcttacgtagggctagatctccacttggataaggcaggtctcggtgggcgc

SEQ ID NO: 31635 - DNA, 359 bp, Homo sapiens
  chr7:154862031-154862390
  hyper
ccagcattcgctctccggagctgcagcctccgaaggggtggcgggggcaacagggacagaaggcaggtcccagaaagcaggttcccccaaaactggcttccctagcacggagttaaggctgcagccggctgcctagagagaagggtgggcagggagacaacgcggtgagagcgactgctctgacgcaccagcccctctcctgcacccacacgctgctggccgcccagcttctccccgatctgggagatgctcggctctgggcggccaaacagcctttccaccaaggcgaggagccctgggctcctgacagcttaggcgggccctggctgcgacacgcagcccctcgcctctgcttcctt

SEQ ID NO: 31636 - DNA, 2593 bp, Homo sapiens; identical to SEQ ID NO: 727
  chr7:155164445-155167038
  hyper

SEQ ID NO: 31637 - DNA, 51 bp, Homo sapiens; identical to SEQ ID NO: 728
  chr7:155167039-155167090
  hyper

SEQ ID NO: 31638 - DNA, 487 bp, Homo sapiens; identical to SEQ ID NO: 729
  chr7:155167174-155167661
  hyper

SEQ ID NO: 31639 - DNA, 11 bp, Homo sapiens
  chr7:155167833-155167844
  hyper
cgcccagggcc

SEQ ID NO: 31640 - DNA, 64 bp, Homo sapiens
  chr7:155167845-155167909
  hyper
gcgtccacgtgagggcagcaccctaggtcgggtcagtcaaaccccacagcggggtttcaaacag

SEQ ID NO: 31641 - DNA, 85 bp, Homo sapiens
  chr7:155168529-155168614
  hyper
aatcaggctgccaggcgacgtttcgtggttgtatttggcccactaaatcctaggtcgctcttcctatgtacgactgtagactcac

SEQ ID NO: 31642 - DNA, 743 bp, Homo sapiens
  chr7:155170182-155170925
  hyper
ggtgggctcctaaagcgtcccatttctccctttagatttggggccccccagctgataaaggagttgtgattgcaggtggatttgatctgatttcccctgaacaggctggcggtgggaagcaggcattggagtcccacggctcactggactgcagcagcgagcccttcacggttgcaaaggaaggaaattcctagcggggcaactcttcagcgtccgccccacagacctagcacgatgtccttttctgtctcaagatacatctggctgggcttccctaaaaccgggcttagttggactccttggacctggggatgaattcttgccaactatctccaaatatttcccctacaccatgccagtgcaattcatgtctccaaaccccctctcctccacaaaaacgaaacaaaacaaaaccccaggtccaggagctcaggcccaggccggatccaagacgcggcagccaggcagccccgccgcgagcctgtgcgggcttgagccggcttggcccccggaagccccagccccgcgctcggcagcgtgcgcccagcgcccagaagaagcagctccaggcggccgcgctccccgtcccgccgcggtgcggtcggatgcccagctcgcgtccagacccgcgggatgcagacccggatcagtcaggcttgagggctgctccgcatagaccaacgtccggggaaggcacacagtggccgagggcccgcgcgcttgggctacggctgtgatggtat

SEQ ID NO: 31643 - DNA, 98 bp, Homo sapiens
  chr7:155173869-155173967
  hyper
cttcaccttccaaaccgcagtccctggtgatcctgacttttgcagcctggctctgggtccacacggggctggagaaggggattcggtctgaatgggtt

SEQ ID NO: 31644 - DNA, 756 bp, Homo sapiens
  chr7:155174224-155174980
  hyper
ctttatcccacagaacggctctgtctgaccgggtcagacaaaagccaacttgcatcttccgctccgaggggatctgggcagagcccgggtacagccctgcgcggccccagggagaggggggagagggcgcgtgtccccagccctgccaagtggcgtggggagcgcgaggccctcctcggtcagagccaccaactctggtctccgtggacatcccccttcccccgcccgctcccgaggctctagggcggcctcctggccgctgccttctcgcacccagggtcttcggcctgggctccacacctcaggcccctcaagtaatcggcctcttggtggccgggcactgcctttccggctgctctctgcacccgtctgcccctccggcctcccctggcggctacaggcgtccggggccctcgctccccagctccaggcgtcccgggagccaggcgcgcagcggggcgagttctcgtgtccgtgtgagcgcgggcgtgtgtatgcgtgcgcgtgcacgagcgtgagtgtgcgtgagcgtgagtttgagtgtgcatgcgggtgtgaatgtgtacatgtacacgaatgtgagtgtgagtgtgcatgagcgtgagcgtgcgtgtgcgtgcgagtgtgcacgagcgtgactgtgagtgtgcgtgcgtggaagcgcggcggggagcctggctgaaggcctgctgcctgcatggctgtcagagaaaaacagaagtgggagcctgctgcgggctccgagaggacttgatg

SEQ ID NO: 31645 - DNA, 120 bp, Homo sapiens
  chr7:155241370-155241490
  hyper
ctcttccccagcaagcgggagggaggcgccgggctgaggctgcgctgagctcgagctcgccgcccgggtggacccgccctgttcaagcgcggaggggcggaggcctggttgggttgtagc

SEQ ID NO: 31646 - DNA, 818 bp, Homo sapiens
  chr7:155241491-155242309
  hyper
tggtgcggagcaggacgccgcctcgtgccatggtcactggagacgcacgcccatcttccctcccgggcccgtcgatcctgccatcttccgctcccggccgctcgtgggtgttcgtcatttagaccttccccgtgcttcatgggacgcaagccctcccccagagttcggttttgcaaaagaggtctggagccctcgctacagatcccctccctgggccacggaggatgagaagggtcaccgagccgagccgtaatcctgcgtaacccctgacctctctccttccctgcccccacggcaccccatcgtcccctccccgtctccgaggtcctccagaaaacagcgcagaattgtgcagatgtttaggagatgtgaagatgctggagatgcttaggaggcgacggttacgcgaggagaattgcttccaggtgcgcttctggaacgcacggagatcccccggcggggaaggggccggggctcgcgtcacttagtgtctgctcaccgatttccctctgaagagggggcccagggcctctgctgagggagcggggaggcggtgcgggcccctcccgggcacacatgggtgtccgctccttcctccccctcccctcccctcgcacggagagcggagagcggagagcggagagcgacagggaggcagccgaagacttgaattttgaaaggggagctggcggcgaatggtgaatgagacagctacttaggaagcgagtccagccagcccgggaggcggtggagacccacgcccggaagtaaccggattaggtctcagaatgtgatcgccccccgggtcccgggggaga

SEQ ID NO: 31647 - DNA, 140 bp, Homo sapiens
  chr7:155242379-155242519
  hyper
cgcctctgggcgttccgacggggtggcggtgggggtcgggggaggcccttgagaaccgtgcggcccggggagagcccacccattgctgagccccgacacaggctttgaagttgctgcagtggctcagcccctcccccgtc

SEQ ID NO: 31648 - DNA, 810 bp, Homo sapiens
  chr7:155242699-155243509
  hyper
cgagccacgtcccgggacccggagagcccggggcgttgggcgctgcggaggaggcccggcttctgtcgctcccttcacctcccagcccgcgagggacttgggggaagggggagcaagctttcgctccggaagaaacgttcggaaccaaggagtctgactcctggatccgggtgcctgttggatccaggctcccactcccgggccctccggtcgaaccaagggtcccgacagggcccgaggcacccgcattcctaggagacaggagctcggccagggcgcatcaccgggtcctgctccgagccagaggatgtagtgtagacacccacccccacaccgcccctccacagagctcctctccccttggggcgtcgctgggcacagggcaggtcgctaggaatccccagtaaaaccacgctcgctcagaggttcgcggcttcctcagagggcgctggggaaagagaggggacctgatttcttcgaccctcggaggaaaagtgctcggggcctcctagggacacagccctggaagctcacctcatcttagcttaggccgcggcgaggtggggaggagagttaggagagggggagaggggctctgcgccctgcagaggcctttaattctggaggaaaaagactgggacacacccaagcgagccaaggcccgagccccacgcacctccacccacccggggcggcgcacagccagctcctgccgggcgtgagcactcgatcaagggagcaagtggaatgaaaatccagctgggggggtccccatcgacacaactgtcccgcagtcgagcttctggattc

SEQ ID NO: 31649 - DNA, 591 bp, Homo sapiens
  chr7:155243755-155244346
  hyper
cggttttgttttccaggggtagtttctgcagaaaggagattctcctccgggccgaagggctaccagcctgcagtcagttcagccccggaccctgggagatgctcaccactctgcggatcttgatccgaaatcctttctggccgcccactgcggagagtgtcctcgtagagaggttttcaatcgaaggagcctgggctccacattttgtcttcaagcctgagctttcagggctgctttgcacgaggtgcagatgaacttgtgtctgcaaacaagacagaaaaccctaagtgccgcccgaccttcctcttttggggaacccgcactttgtcctgggagcgtgcccagcgccttagtaccaaactttctggccggggctggcagagctcagagtcccgcttccccctaggcgcggccccctaacatctgtaacccaaatgttgcgccgcggccaaaattagccctggcagtgcgaacagagaactaaaagcaggcagtgaatgagaacagctcgcatttctccttcctggtagacggggaggtgtaaatcccgaggaattctagggcattcgctccaaacgtgggaaatcttcg

SEQ ID NO: 31650 - DNA, 119 bp, Homo sapiens
  chr7:155246406-155246525
  hyper
ggggcagaaccaggacgtgcaatgcgactgcccccccctccccgctccccggcagagcttctgtccgcgccaacccacccaccaggctctgcccgcgccacgcgcgcccctggcaggcc

SEQ ID NO: 31651 - DNA, 491 bp, Homo sapiens; identical to SEQ ID NO: 732
  chr7:155246989-155247480
  hyper

SEQ ID NO: 31652 - DNA, 372 bp, Homo sapiens
  chr7:155247839-155248211
  hyper
ccactctggggggcccggtaccctctagttatctctctcttcatttatttctctttctcctattcctccctccacctctcaccttcctcctttccaggagagcgacccacgaattcctcttcctccagccaaccccagggcccagcccgcagaccctgcgagggcaggtctctgcccaccggcccgccaggcgccctggaggtgacgctctgcttcccagagtctctgttgcagccacgaattggggtctgggtcgcaggaaagcacagggctgaagcccagcgtcttggggccatttatactgaggcagtcagaggcaaagagtcccaagaattcagaaaatacttctcaggaagccgcctaattggcttt

SEQ ID NO: 31653 - DNA, 773 bp, Homo sapiens
  chr7:155248792-155249565
  hyper
ctggggaaggagcttcgcaaggccagggtgcaaccttcaggccccaggtggcctggcaggccacgctgcctcggagatgcttgccagactccccaagttcactcagggcctggcagcaacctgctggctgcctctgcgggggtctgggttgctgagcacggtgcagctgcccagggccaatcagccctagggtgtccgtgccaggctgcggcctccccgcctcccccgcactgagggtactcatggcgtgcaaatgctcccgcacccccagagctgccctatcggatgtttccaggaattcacacatttccataaaaatgcattttaaatgatggacaggcgagcctggggtaacaacgggtgtttggtgggtagacaagagcaaatgggaaggagcccgagggaggagggggaagagaagaggaaacagaacttccagttggacattctgacaacagctggaaggaaagtctagaaaagatgaagagagaggaggggagaaaccaactggggctcccacccttgccgttggattcctaattctcgtttcaaatgggccctgctctccggcaaaattagtttaaaggattttaaaacaaagaaaacgagatgaccggtctgggagctcctcaatcagagtagagaagttagaggggggcgggcgacttggttttgaagtcttagctgaacagtcacccctcctctccttggcaaaaaggattcctttagaacctccgaggctcctggatttctcccttcgcaaatggagccgc

SEQ ID NO: 31654 - DNA, 190 bp, Homo sapiens
  chr7:155249863-155250053
  hyper
ggaattgtgggatttcgccccacggtaaacaatatggaaatcttaaaaatagcgatcttcctgtgcgtgtccacctacgcgccccggggtgacctggcggggctgtcgccgggtgactcacacccctgaaccgcgaagcgacagggaaagcgcgggcgagcgcaggagacgcggtcgggggtctctccgg

SEQ ID NO: 31655 - DNA, 21 bp, Homo sapiens
  chr7:155250283-155250304
  hyper
tggcctggaaatttccgagcc

SEQ ID NO: 31656 - DNA, 566 bp, Homo sapiens
  chr7:155250323-155250889
  hyper
cgagggcggcggacggccggggagcgcgggcggcccagcccggcccggccgggccctggcctcgcgtctctcacccatgcgactcgggccgcggagctctgcggggctcggcgggggcgcggccgcacgccggtggggcgccccggcccgcagcggggcggcggccgcgaggagggggcctccatgtgcgtgcgggcggtggcgggcgcgctgaccgcgggcgcccggcaccctcgagggccggctagggcgtgcgggcggggacggccgggcggcggcggcggccggagccggcccgggcgggcgtgagcgccggggaacgcgctgcctgcatgcgcgcagctctcgccccgggcggcccaggcggcggcgccggagcccgaggcggccggacgcggagaggagcggggagcccgggaggcggcccgcgtccccgccggaccactgcgactgtctagaccccggctgcgcggcgaagtcgaggacttggctctgttgaatctctcatcgtctgggcgagcggggcggctcgtggtgtttctaacccagttcgtggattcaaaggt

SEQ ID NO: 31657 - DNA, 89 bp, Homo sapiens
  chr7:155251170-155251259
  hyper
cggtagcagcccgggcgaagcggacaccgggcgccggcgggctctgatgctgcccgcggtcctgcaggcgcccggcaaccaccagcacc

SEQ ID NO: 31658 - DNA, 204 bp, Homo sapiens
  chr7:155251346-155251550
  hyper
cgggaggaggaaggggcggcggagccggcggcgaaggcggcgcgagcggtgcggagggaggcggcggcgcgggcggctcggagcagctcttgggctcgggctcccgagagccccggcagaacccgccatgtgcgcccggcgcgggcgggccgctcccagccgccggcagcgactctccgggtgacggggaaggcggctccaaga

SEQ ID NO: 31659 - DNA, 48 bp, Homo sapiens
  chr7:155251661-155251709
  hyper
cggacagctcgcaagccggcgccaacctgggcgcgcagcccatgctct

SEQ ID NO: 31660 - DNA, 100 bp, Homo sapiens; identical to SEQ ID NO: 3149
  chr7:155252162-155252262
  hyper

SEQ ID NO: 31661 - DNA, 812 bp, Homo sapiens
  chr7:155252316-155253128
  hyper
cgctgaccggtgggactcaggaggatgcacacagggaaggaggaaaataaaggcgccctttccccttggctccactttgtttgccagcgccagcccgcagtggtggggctcagcccccttcctgcacacagcgaggacaagggaggcagccgtccctcccggcacctgccatccccaaatagaaaggaccttctctcagggtttcctgggggctgctgatgggaaagaggcagcattcgcaggggccctgcagagatgctggatatattttttcatagatctgcgattttaaaaaactaagtccatgtccttgtagaaatcatcaactgcattccatgcgggtctgcggctgggaaccgccattagaagtggactgtttgaccccgagctggcagcggatccccgctgcccccaaaccctcaactattttgcgggggtcatttgcccagatcacagcaggagtgagccaacccttgggccgccatcccgcagaactatgcgtgcatatttctgatgaaattcagatttctcagctagatctgaaatttgctccattgttctcgtcttcctcctttgttaatatttaattaacatacaggctcacaatgccgggcgaggagactcggccgggctttgtgcggcgcgggagttcgctgagccagcccccaacggcccgggagctgggcagcaccgcccggcccggcctggcccggcccagctcagcccagcccaagtcgcctatcttcatgggctttaaaatatccctgcaagataatgtttctgttctttggtttctccgaaagaaaggggag

SEQ ID NO: 31662 - DNA, 520 bp, Homo sapiens
  chr7:155254879-155255399
  hyper
caagtggtggaggtccgcgttgagcccatgcccagtccgaagtctagccccacatctggcggttcagcctcgagtggccttgggcgagtcacttccctcttggggccccagaatccttacccggtgcctattgggtggcacacctctgggtaacctgacttctctctgtccaccgtatctacccaggtcccaggtctcgaaaaccaaagaagaagaacccgaacaaagaggacaagcggccgcgcacggcctttaccgccgagcagctgcagaggctcaaggccgagttccagaccaacaggtacctgacggagcagcggcgccagagcctggcgcaggagctgagcctcaacgagtcacagatcaagatttggttccagaacaagcgcgccaagatcaagaaggccacgggcaacaagaacacgctggccgtgcacctcatggcacagggcttgtacaaccactccaccacagccaaggagggcaagtcggacagcgagtagggcggggggcatggagg

SEQ ID NO: 31663 - DNA, 15 bp, Homo sapiens
  chr7:155256218-155256233
  hyper
caccaagggcccaac

SEQ ID NO: 31664 - DNA, 151 bp, Homo sapiens
  chr7:155256268-155256419
  hyper
cgctgtccccagtcccaccgcagtcctgccgcaggcctaaccctcctgccctgggcactgcctccatgcagaagcgcttcgaggttctggggctaaaggcctggggtgtgtggcctaaagcccaagagcggtggggcgaccctccttttgg

SEQ ID NO: 31665 - DNA, 1008 bp, Homo sapiens
  chr7:155257856-155258864
  hyper
ccacccgtgctggaccgaggcgctttcccctggggacaggaactttttactccactgagacaaagagactctccttttcaaagtgtcatttttgtttaccttttgttgtttcccccccaaaacaaaagactttgtacaacttcctaagcaggattgggggagggatcagcttcgcctgtgctgaccgcgcctctggattccgctcatcaggaagtgtttggggtctttgagcgagtgatctacgcgttgaattgctgtttttccaaactttcatggcttaaaaattttttttcttctccctgtaaaagaaactcagagactggtgatctgttaccgaagacgactttttaggcgttttctgtttccccaggcagctgggccgttggcgttcccaggcggaagcggggcctctgggctgggcctctgccctgccaggaagcggtctgggggctgcccctcgggattttcagaaccctggaaggagagagctggggtctcaccgcggagactcccgagttctcgttgcctgggcccgagctgcgccccagggtcatcgctgatggcgcgagaccacgcattccccgcgaaccccgacttctgaacagttcagaaagttcgtagattaaaaaccaaacaaaaaatactggcacaacttctattgccgtattggcctctctcttattttaataaaaatacggtaacatgaagcgatcatttttttaaaaatctgttttcaaagtataacactgaaaaggggcaaggcacagctttgtaaggtaatgagttccccgtcctcagaggtgttcaagcagacgctaggcttacagtggcatggagagtgttctttctctttggaactggatgagtcctcagacccttgaaacgctgagtttttttttttttttttactcctatgtttattacattttaatccaacagcatataatctaagctgctccctcatggagagccgcggctgtgccacctgcctgctttcgccatggagac

SEQ ID NO: 31666 - DNA, 164 bp, Homo sapiens; identical to SEQ ID NO: 735
  chr7:155258914-155259078
  hyper

SEQ ID NO: 31667 - DNA, 504 bp, Homo sapiens; identical to SEQ ID NO: 736
  chr7:155259119-155259623
  hyper

SEQ ID NO: 31668 - DNA, 12 bp, Homo sapiens
  chr7:155259833-155259845
  hyper
cggggattcgcc

SEQ ID NO: 31669 - DNA, 112 bp, Homo sapiens; identical to SEQ ID NO: 738
  chr7:155259846-155259958
  hyper

SEQ ID NO: 31670 - DNA, 99 bp, Homo sapiens; identical to SEQ ID NO: 739
  chr7:155260038-155260137
  hyper

SEQ ID NO: 31671 - DNA, 116 bp, Homo sapiens
  chr7:155260458-155260574
  hyper
agggatggggttccccggaacgactccgaagtcccggagaccaggcgcggcccaggccctctgcccttctccagccccagccccagccccagccccagccccgggcaaactcttcc

SEQ ID NO: 31672 - DNA, 106 bp, Homo sapiens; identical to SEQ ID NO: 3160
  chr7:155260785-155260891
  hyper

SEQ ID NO: 31673 - DNA, 307 bp, Homo sapiens
  chr7:155261070-155261377
  hyper
cgcggtccgggcgcgcgctgcctgcgcggaaggagccgcctccctcctttcagcgaacgcattcggggttcccccctcccgccaagtcctttgtctggaaggggactggcaggctctgtcgtcgccgtgtgcccccctcctttccccagcctctaccccctccaactaactttcctttcttcccttctcttttcttccctctctggatgggtaatcacaggctccgctgccaagcgcgctgcgaggagccgctgcccgttcccgtcggtgcccctccccgcggcagcctggccgagtccgcccagcc

SEQ ID NO: 31674 - DNA, 125 bp, Homo sapiens
  chr7:155262418-155262543
  hyper
tccacagcccaggtgcggttttcagtagggcccttacaccttcttgcttttcccagccaatgaggcatccacgctgctgcttaggagtaggggaaaggatgtaatgcacgcgagaggcagtgtcc

SEQ ID NO: 31675 - DNA, 215 bp, Homo sapiens; identical to SEQ ID NO: 9326
  chr7:155264127-155264342
  hyper

SEQ ID NO: 31676 - DNA, 252 bp, Homo sapiens
  chr7:155301753-155302005
  hyper
aagatccgttaggaacgcctccgactgagctagggggatctaagaagaaagacagggcgaggaaacttgtcttaatgttaatgttacttcaaagaccttccggcgagtccacatggaaacgccacactctccctgaatgcaaacgtgtgccacttccctagcacgggcccagaagacggtaccgcagattgttattacaatgtaacaacgacctgctttacatcattacggggctagcgtaaattccagttt

SEQ ID NO: 31677 - DNA, 570 bp, Homo sapiens
  chr7:155302326-155302896
  hyper
ggctgcccttggctgcgcgtcccccacgctgcagccgcgcgatggcccgggctggggtggacgtggggctgggagaggaaggggctcacggacgggcgccccatctcccaggcgggctcctcggctgctttctttgggaacagctggtgcacgtccccgcgcgcccctctccctccggaattcggcgaggattcagctggaccctttggccaccacctccgccccgggcgcgggtcaaagagcacccctcgcccttggtaacggagacaaaacgttcggggccgtctagacaggtcaaggtgcaggatgcggcgtccccgcggctccttccggaagggggcgtggagccgccaagggcgccggaccgcgccgcagcccgggcctttgcgggctttttccctctccaccctctgctgatcaaagtaggaagtttgcatgacaaccgcagtgaaaggggctgaatcacaaatgaactcgatttctgcagtgttgatctatccagcctccattgtcccctttcaggcgcagtatgaacccttccggtgccagcggccgcgctacattcacagg

SEQ ID NO: 31678 - DNA, 400 bp, Homo sapiens
  chr7:155302963-155303363
  hyper
cggcggcgtccccttgaaagcgcgggcggagggtgcgcttgtgttcttgagacccaggttccattacaaaccacccagcatcgccaccggcgccccccgtttcaataaggaagccactttgtcaaaacattctaaaagaaacttgggaagaggacgcgtcagagaaataccgccgccgattaactatcagctgcgcctcccctgtgcacaggtaacatccctccttctcccccacgactcggctggagcttgattttgagctgctctcaaggcccaggcactcgaatcggaagttaaatagcttatggactatttaatagaatataccaccacacgtatctaatcactcaaataccacgcttttaaaactcatgaatgttttaatcgctaaaaatgtcta

SEQ ID NO: 31679 - DNA, 745 bp, Homo sapiens
  chr7:155325796-155326541
  hyper
gagtaaccaagcatacgccgtacagtgacaacatctgcgtggctcacaccacacaggcagccgcagaaacagcgcctcccaaacggcgcggcctcgctcaccctcaaaacccactccgcgcccgacgggaacggctggagggaggaaagagccaggcacctctcgttcggggtctgacattgtcacctggcagataagtgagtctgctcggatgtgccggctcggaacatgcccgttcgtcaaagagggaggggaaacaaaacgagcttgtgcctcattcccggtggctctccacgcaaagttaacgtttgtttactctaagcatatgcccaggtgaggcctgcacagccacctcgccgcgggtgcagggcgcgcctcagaatgacagcgaggtgcacgctccggcccgcgcagagcggggccagctccgccacccagcgcgcgggaagccccgcagcaccagcagggcccgtcgcttcgctccgtcccggtccggcgtgaaacccccgaggggaaaagcgggtatcaaatgtgaattccactcgtccacagcgccgggcgttatgaaaatctgagcacctttgaccggagaagcaatagctatgggattaaggcgaatttcttacggagaggagaaagatgtgcagtttgtaattacctgctccctgtagtacagtccgtccttcacgcctggatctaacgggacaaactctcagcggctttgctctcccggcattgtttcagc

SEQ ID NO: 31680 - DNA, 25 bp, Homo sapiens
  chr7:155579904-155579929
  hyper
ccccaaggtaagccccgaggcgtcc

SEQ ID NO: 31681 - DNA, 93 bp, Homo sapiens
  chr7:155580181-155580274
  hyper
gggccgcccctgtctcgggccctgccgcgccgcccgcccgctgcaggccaggactgcgctctgtctgcccacggcccccgcctggcacacacg

SEQ ID NO: 31682 - DNA, 156 bp, Homo sapiens
  chr7:155600567-155600723
  hyper
ttggagtctggttgtcgccatggagggacagcttctatccagggccctaactgtagcgtgggttggggggactctttcgagagggtggggcgaggacgctggccccactgctgcggcgctttaaggggacgtgacaaattgcgcaacaggaaaagt

SEQ ID NO: 31683 - DNA, 257 bp, Homo sapiens
  chr7:155601133-155601390
  hyper
cagctctgtgagctgcgccacttgggcaggcatggaggaccccgggcagggagacccgggtccagccgggccgcgacgggaggtggctgcgcgagtgaggggcggaggccgagggttgctggagttggcgcccccgccccttgcgccctcctccggcccgggctccgcgcggcctcggctggcggcctctcctccgcccgcgctgggcgggattgtcgcaggcaaagccgggaagcccaggccggttattaattcat

SEQ ID NO: 31684 - DNA, 30 bp, Homo sapiens
  chr7:155601921-155601951
  hyper
aagttccactggggacgatctcgccatggt

SEQ ID NO: 31685 - DNA, 325 bp, Homo sapiens
  chr7:155602802-155603127
  hyper
ctagccgcgggggatcgataacccgggagtaagtggggctgcaggcgtctgcctcgctgcgcggctctgtgcgcttgcagctttgcagcagggctgcaaggcccaagccctgggaaggtgtgcgagcccaggaccccttctgcggtattggcctcccgcagagcagggcagaagctgacccactctggctctgggacctcgggtatccacgcccccgccgctctctccgcagtgcctccctcctctcgggttccgagggaccctggcaaggcccctcctccgcggggagtgagggtgacgagaggatgggcgcctcgggctagcc

SEQ ID NO: 31686 - DNA, 41 bp, Homo sapiens
  chr7:155604978-155605019
  hyper
ctatataaccttgcccgccgcggctgcgggggactctccac

SEQ ID NO: 31687 - DNA, 203 bp, Homo sapiens
  chr7:156409310-156409513
  hyper
ctgcagaaaagtcaccgtcacacgcagagtccaaaactcccctttccccgctggaaccactttctccaaggagctccgccccgcgctctccccgaccccgtgcgcccccagacctcgcgtcccccgcgctctcccccgccgcgccctcctgccccgcgcccctcctcgccccgaccccgcgcccctgcgcccgggctccagcc

SEQ ID NO: 31688 - DNA, 108 bp, Homo sapiens
  chr7:156409727-156409835
  hyper
cgcgctcagccgggtgaacctggaactgtgttcctggcccagcgctttcataaaagggcgcggaatagtaagtcctagttcaaggaataaacacggatccccactggc

SEQ ID NO: 31689 - DNA, 237 bp, Homo sapiens
  chr7:156432918-156433155
  hyper
ccagaaaactgccctcgactaacagcgcagcgaaggggcggtgcgctcgagaccctggaacgggaacgaccacagccaccgcagggaaacaaccggggcccaggcccaggtgggcgggcggctgaggagcgtggctgcgcccacaaagccgccgggggctgcggactacagcgaagccggcgcggggctcggccctcactacacgaggcctgggcgcctgcacgcccccgtgcttca

SEQ ID NO: 31690 - DNA, 87 bp, Homo sapiens
  chr7:156794072-156794159
  hyper
gtgctgcaatgaactcgggtgtgcaaatgtctctttgagatctttttgttttttccaattcttttggatatatacccagaactgaga

SEQ ID NO: 31691 - DNA, 26 bp, Homo sapiens
  chr7:156794459-156794485
  hyper
gtaagccactgcgcccagcctgattt

SEQ ID NO: 31692 - DNA, 320 bp, Homo sapiens
  chr7:156795035-156795355
  hyper
acaccagggattaaccggggtctcctggctgcctctcacctggcagccggagctccaggaggggctggaaaggagccccctgggcctccgtctggggggcgtgtgtgaactgttttctcccgtcacaaaaaaggcttcctccacatgcgtttgcacgcccggcagaattcgcccacagcaaggcccccctttctaagaagggaggagaacccacattggagcaaagaaaacggtggccaagaggtgggggcctcggtagggcaaggaggcaaggctgggttccaggggacagggtcagctttgggtggggcccagagccc

SEQ ID NO: 31693 - DNA, 235 bp, Homo sapiens; identical to SEQ ID NO: 745
  chr7:156795401-156795636
  hyper

SEQ ID NO: 31694 - DNA, 205 bp, Homo sapiens
  chr7:156795899-156796104
  hyper
cggcctgctggaggcgcaggggccggcgcaggtccggggcctggctctgctggaggacgggggaggggcggccctattaacagcgtcttcctttgatgtcgctcttccccgcgtcccagaggaagcgcctgtcccctgggggtagagggacagaccctccgcggaggcctggggcaccccagctccaggccgagcccccactctt

SEQ ID NO: 31695 - DNA, 246 bp, Homo sapiens; identical to SEQ ID NO: 747
  chr7:156796494-156796740
  hyper

SEQ ID NO: 31696 - DNA, 1430 bp, Homo sapiens
  chr7:156797005-156798435
  hyper
cggacttgtttgcacagagccaagaagaccgatcctggccagccaaggaaggttctgctaacagagagggccggggtcgaggagagagagaagcaccgcgcaattcggtgcgttccgggaaatgtgcctcagtagcgcctgaggtcacagggaccccacatgctactaacgcctagtcgttttaagcttattttctgaaacgtccaaatagcgtatttccacttctggagtgccaacgaagcaacagctagcaaggaaataggaaaataaatagagtccacagctccgcttccgagggacacgtgtcccgggacaggtgtgcaccaggcagccgggcatgcgctgacacctggccacaggtatttttgccaacacttcacattgcgactccccagtagcaggcgcggaggtggtcctgacacccacttgagactccgattttcaccctcagctgccaaccgccgagtagacaccctccccatcatttctacaagcaaattgtaatgccgcgggcataatcccccaaaactcgtgcacgctgatccagtacaaaaccaatttattttacattccatcgtgggcgatgggagaagctaaataataatttagcatgcatacgtagacgtttctttttatatataaatacaatatacaaaaataaagacagtacagttttgagatttccagcagtttgaacgctcgtgacataatccccccgaccccagagacgtaagcataaacccttttttctttttccaaatactctgcagaatggcggctccagaggcggtttcaagtttcataagtcaggtaacactgtgggtttccgccttctcggacgcggggaaaggggagacaggaggcttccccttgcgcggggtgggtcggttcttctcacacgcactcgcgcctcccccaacaccaaccaaaattaattttaaaagaaccagagttcaagtttcagccccctgggtctccctctcgctgtttcttgaagagcaggtgaggcgcccttgcttaaaagggaagcgcccaggaccggagccgcggccgaatccctccagccccggcctgggcgaggggtccatggggcggcggtcgagcctgctctcggggccgggccgggtgggtgcgggcgccggggcctccgggagaagccgccggccggggcgctccgtgcgcgccgcacctgctgggccgcggggctcctactggggcgcgggctggtggctgggccgcgggggcggcgagtcgtcctccgaggagcagtcggaggaggcggcgtggacgctggcgccgttgctgtaggggaaatggtcctcgtcgtcctcgtcctcgtcctcctcggggtcactgtccctcaagtcccgcaggcggcgtccgctgcccttgtctccgggcgctggcggccccagcagctcctcggctcc

SEQ ID NO: 31697 - DNA, 621 bp, Homo sapiens; identical to SEQ ID NO: 750
  chr7:156798526-156799147
  hyper

SEQ ID NO: 31698 - DNA, 220 bp, Homo sapiens
  chr7:156799290-156799510
  hyper
cgcggccggcggcacttccccaggaggttcgactgcgcctgggctggggaccaaagggcagtgaggcccacagccggctccggtcctcgccccagcccctcccgttgctgcttgtaccactacactcaaggccccagcgccaaggcctggccctgcagagggcggggctgttccctcactatcagtgcccactccccaaggaatgcggactcaggaccac

SEQ ID NO: 31699 - DNA, 145 bp, Homo sapiens
  chr7:156800933-156801078
  hyper
ccgtgggcaacttagcgtccttggctctgggaaatgcaggtcatattggtggctttctatcagaagggatgggccctgggtcggcaccctgggtttaagcccaggctggcaggggattcgcagacgcagacgtgtctgaggtgag

SEQ ID NO: 31700 - DNA, 469 bp, Homo sapiens
  chr7:156801403-156801872
  hyper
ctttgtttgggtgttcggcggctgaaagcgttgagccatatacatctgctcggcccgactcataagtagctgaccccgatggggcgagcggggagagccagagccccagagagccagagccccggagccccagcccggagagtccgcgtgtgccaggaaagcctgaggggcccaggcctctggcgaggtgtcccgcccggatggagaggaagctgcccgaagcccagcggctctggggtggggagaacaggggctccctcggccccaccttggaggggcattcgttaccttgttgggcgcccaggattccagggcaggcacctactgttgagagtccccccatagctggttcaagccaggccacctgcctcggccatcgcaccccggatccaacgcccttccagaggagggcagcgccctggtaagagccgggggttccctgggccttggccttgcctccccgggcctc

SEQ ID NO: 31701 - DNA, 365 bp, Homo sapiens
  chr7:156808858-156809223
  hyper
tagcattggcctgggcgcccaggcactcctttagaacccacctgttccccccacccaccctagtgggaggaggagagggttacactgacagataccggcagctctgcaacccgggaacaacgcagacaacatacaactcgacagagtcacagaaggtggcgtccatcgcgcctggatggtgactactgccctgcgggctgctgggtgggtgaaacacacagggaagaagcacaaatacacacacagatgtggctcagggacatttgaatgcttcagtgtgtgaattttttagcgcattctgactcgaaattatggctgaatagtggcgcactaatgtccaagtccatgttcgataatggcaggaa

SEQ ID NO: 31702 - DNA, 485 bp, Homo sapiens
  chr7:156810037-156810522
  hyper
gggagcagcatgggccgccctctgcctcaccgaggggcaaaccggctgaggacccaggcacgaagagtgtcaccagctctgaccacaagccccgtagaccagggctgcgtccataatcggggttgatggcattagttattatattataacctccttgttgcgtgattctagtaatttattttcccacttggcctttgactgggctgggctcctcccagtggaacaacagggggtgtcgtgtttgcagcagaaacgcacactgggatcctttcttgcaacagctgggccggctgggtcttttctcttgtcttctgtacacaggcccctctccgctgtttctgcagagaccgaggtgggagggagaaagaccctccagccctctgctcccaccctccccgcagtctccggggccctgtgctgcaggcaagataatttggctaatgaactcgttaaagggcccctggtgacccgccccggcttcccct

SEQ ID NO: 31703 - DNA, 204 bp, Homo sapiens; identical to SEQ ID NO: 754
  chr7:156810597-156810801
  hyper

SEQ ID NO: 31704 - DNA, 415 bp, Homo sapiens
  chr7:156811302-156811717
  hyper
cgacattctgtaaatgagataatgatccataaacccggatgatagatgtggcgtgcctgcgatgtcttctctaaatgagctgctcgcatcgactgctaataatggtgagtttatggaagcgatttcagcgcaaactgcgagagggtcttcttactctaatcagcctgcctgagctaatggacgagggggtcaggctgagagttattgacacgcccgtgcccttaacctgtttcccaataaagctgattagtttttgtcaattcatcagctaaccactcttgctggaactgcatcaaagccttatttgctcaggggaaatcaacaagtcacagatcagctccattaaggggcccggcccggcaaggacagtcctggagccgagggacgccccgacggacctcgggcctcccccgag

SEQ ID NO: 31705 - DNA, 105 bp, Homo sapiens
  chr7:156811921-156812026
  hyper
cagggcggtggagagcgagggcatgagggagggagctgggaaccgcgcagtgtccgcggccacgaatctctcctacgcgtccccatgaggcgacctaaggggaag

SEQ ID NO: 31706 - DNA, 37 bp, Homo sapiens
  chr7:156812242-156812279
  hyper
ctcccaggtatccctcggctcccgctggcaggagtga

SEQ ID NO: 31707 - DNA, 1038 bp, Homo sapiens
  chr7:156812788-156813826
  hyper
taaggatattgtatacgcggggggtatgctttattgacaatttcattttccaattagtaattttgttgtaatatatctgcgaaccggggactcccgggcagggaggcaggattctcccggctggggcggtctgagtagctgggtctgagcctcgggctgagaagagtaaattctgcagaaagggccgcgtccgatcggcgcaaacgttcggttcgtagcaggagcttctccaggcggccaccgaacccaggtccaggactcggcactcctggagccctcctccccacgcagaccgcgggggctgatttaatagaatgtcgatagaatcattcgatgccttttagcttgtgatctttataaatgtccctctattaaattagaaaatgattctcttctcgtttaattgtattctttcgtttcttatttccaattaattagtcctatcgacgttgcaatattttaagtgacttgagtccgtttccagttagaatatatgggtcagcacatgcaattttatacccgacaggactatataatgtgggttttaactactcgttcctcatctgtcttaaacatctggccaggatgcgccacccggcctcctcgcagatccttcctggggcaggtgggcaccacgcgggaccctcccgggggctcccgcaggcgcctcttgctgcccggggccaagggtcgggcagcccatagcgtccggcctgggcctttacttggaattctttctgttgaagacttggtcccagcccagtggttctgggataagaagaccccgcagaggggcccagcgccgcgttcctacgagacacctgagctgcactgtgtttccacgggctaggagagcggtgactccccagcctccccgtaggcctcgctcgcaccgcagagggatggctggcccgtgccgctccgcggttcccctccccgggcggatccgcgcagggagagcccggcgggcctgggcttgggcctgggcctggttcgggggtgcaggccaagaggggcgccaggccgggctcccctacc

SEQ ID NO: 31708 - DNA, 244 bp, Homo sapiens; identical to SEQ ID NO: 757
  chr7:156813986-156814230
  hyper

SEQ ID NO: 31709 - DNA, 114 bp, Homo sapiens
  chr7:156871039-156871153
  hyper
ctgccctcccttcctcgcgtggcttcccgggcgcgctctgcctgtctgcggggactccaggcgtccttgtgttttcagctcccggctcttgcccgcgcgtgtggcccggctggg

SEQ ID NO: 31710 - DNA, 28 bp, Homo sapiens
  chr7:156871282-156871310
  hyper
cgagctccagaggcgggggatctgaaca

SEQ ID NO: 31711 - DNA, 138 bp, Homo sapiens
  chr7:157129147-157129285
  hyper
ttgacaagcgggggccggcgccttcgcccgccttcgctggccgccgcttggtttgttcttcttctccttcggggacttctccgcccgcgcccgcgcccgcgccccagctttcgtcccgctgtgcggagatgccaccca

SEQ ID NO: 31712 - DNA, 49 bp, Homo sapiens
  chr7:157130967-157131016
  hyper
gccgccttactcctccgccagtccacccgtcccgcgttctctctgggtt

SEQ ID NO: 31713 - DNA, 34 bp, Homo sapiens
  chr7:157476555-157476589
  hyper
gtgaatgggggagcacgcccggccttggtcctgg

SEQ ID NO: 31714 - DNA, 95 bp, Homo sapiens
  chr7:157476879-157476974
  hyper
ttgccttcggtgcagcggattagctggtgccgggactgagttaatggaaacgcgggttaaatgagaaaagacgcccggattttcctgcctggatg

SEQ ID NO: 31715 - DNA, 495 bp, Homo sapiens
  chr7:157476994-157477489
  hyper
cgaggttctccagcggcgggaggcggtggagccgccgcggagagggagggaggctttggagagggagggaaggaaagggggagggagagggaaaggggggagagggagaggaggcgcggggtgggggaggggagtgagcagggagccgggagagggaggaggggcgggaaccaggggagcggcccgaaccccgtttggtccggaccccgcagccaccgctgggtctcgccgccgggtcgcccttcgcgtggagatccggtccgcgccccctccccggtctcctcccctcccctcccctccgcccccctccctccggcccacacagcctcttccagaaagaagtcactctagagccgcgcgacccagccccagagtccgccggggtccgcccaccgggtctcctgcgcgcccctccccgcccctccccgggcacagcccgttcacgaaacctaaggcgccggccacgcgccacctcccccgggccggggtctcctc

SEQ ID NO: 31716 - DNA, 110 bp, Homo sapiens
  chr7:157477710-157477820
  hyper
ggagccatacctgggcgggagggcttttcccgggggcccggcctgcgcccctcgccgcccctcgcccctcgcctctcgcctcccgcgggtcccgcctggccttggccgac

SEQ ID NO: 31717 - DNA, 17 bp, Homo sapiens
  chr7:157481533-157481550
  hyper
cgtccctcccccctcgc

SEQ ID NO: 31718 - DNA, 315 bp, Homo sapiens
  chr7:157481759-157482074
  hyper
ggcgctcgcagcccccgggcggcgcagccgccaccgccgccgtcttctctggagcgcagaggggtgtgcttgggagggggcgggagggcactttcctctgtgtcggtgaaaggaagagcttccagctccctcctccgcacaaaccttcacttcctctcttgttcgatcgcgtcctaaaatctgggatcggcgacgcaaggacagcctggtttggcgaagacccctcggacaccctgcgctccggactccaggcgggtggctccacggtgccggccgggacgcgcagctcggggggcgggaccacgtccgggaccc

SEQ ID NO: 31719 - DNA, 131 bp, Homo sapiens
  chr7:157482200-157482331
  hyper
cgggagactctctccggccctaaaaggcaattgtgctgagattttaactctaacttgggggttcgcccgattccctggagcaacgcttctctaaaaccacggagcaggccagtgttcggaactgcacaggt

SEQ ID NO: 31720 - DNA, 244 bp, Homo sapiens
  chr7:157482557-157482801
  hyper
gatactcccatggctcggaggcgcgctcccggaccctggtgaggagggtgaagagcgccccaaaatgggctgagaggaaaatgcgcccacactggcgcctctccatcctggctgctcgccccttccctcctcctttcccacacgcctcccatctccgtgcctgcacccccccacccccagcaccctgcaatggtcggaactgcagggagtggggagcaacgcgaaaggccgagagaagagcgct

SEQ ID NO: 31721 - DNA, 1188 bp, Homo sapiens
  chr7:157483055-157484243
  hyper
gttagagcccccatgcgcgccctccagccttcgaaagctctcttcctcgccccaccacctacgcgcctggtgatgctctcgtgggcccttcctgctccctccgcccccatcccagcctctctcgcctcttccagggcccacccaaccgcactacgagcgcccgcgccccgcccggcacccctggttacctgcagctgggccggcgcccagcgcccgcgcgggaggaggtgggggcgtgcgccgggccgagcggcctcggggcgcagcagctgcgggtagcggcagcgccatcatcacagccagctgcttccctgcgctggagccacagactagcggggtcatccgcttctgaccacaaacttctagggcggccggaggagacaaaggtgccgcgcgtcgctgctccagcagcagcggctgcgcggcggcacgggctcggagcccgcaggcgccggagctctgcgcggccgctcggcccagctccgcgtgctccgccccggcccggcccccgggctaggcacgctgggccggggcgcggcgcgggcgggctcagggcgggctccggacggtcccggtagggccgccggccgcgcgcgtagcaccaaccagcgcggccgccgcgccccgccttatatccggcccggcgcgcacccggccggcggcggcgcggctcgcggcccagccaccggttgctatagcgatgtccccccccccccccacatgttgctgacagcaattggctaaggggccgcggctctccaaacaccctctcccgcccgagactatgaatggacatcagctttgtcagtcattggtacaacgccgaagccagggccttcgccttttctttcttttcagtgtttctccctttcatcgttcatactgggcaagttcagggtagcaccgaggggagagagacctcggccagaaaagtcaaggcgcgcggctctgctgtgacctttgtcctgggaggggtgggtggggtgcgtcgccactcttggcaagagaaaattgcacggcatatcgttcttcccagttaccttttccagtgttgccgttcgggcctttttgctccctttccaaatggaagcaggccaatgattcagggcgagtagacgagagcccctctgctcactttaccagggtcctcccgagtgtttaggtcccgatgcgcgtagaaagtgtctt

SEQ ID NO: 31722 - DNA, 25 bp, Homo sapiens
  chr7:157484461-157484486
  hyper
tgcccacataacccccggcccctgg

SEQ ID NO: 31723 - DNA, 598 bp, Homo sapiens
  chr7:157484507-157485105
  hyper
cgagaagagctagggtctcggggcgactaggaccactgagcacctcccccccgcgcctcccgcccatgctctctctccccaggccctggaccccgggccacagccacaggttggggcaccccggtgcgcggcgcccccgcggagctggcgagagccggagagctgaaacccaacatctgtgtgtacaatgcgctctccgaggcccacagctgcaggaacaaggagaagaaaggaagaggggggcgcagatcttgtcacacgcagatgacagtctgcggagggctctttagtttctccttttctggaaaccccagcggccccctcctaggcccccctctcccaccgcctggccattgttccctgcgcccgggacagctggagacggcggcccgcgccactcgacgcccctcccgccgcacacccggctgcccgcggcgcccgctcccggcccctccggggccaactcctccacaccccccacctccccaggccaggcccaggcggcgcttccacagtctcccctcccctcccttgcactctggcgctgcccctagacctgctcggtgcagagggccttgcctggcgcttttctctcaca

SEQ ID NO: 31724 - DNA, 99 bp, Homo sapiens; identical to SEQ ID NO: 3186
  chr7:157485503-157485602
  hyper

SEQ ID NO: 31725 - DNA, 433 bp, Homo sapiens
  chr7:157485649-157486082
  hyper
cggttcctgtccctccccgccaccctcctccggtgcctcggcgtccccagccaggctccagggcgaccccaggcccggccctgggcagagacagaggaggggaggggaggtggcgctggggggcggggggccggagacggcgggaggaggactcgggagccggggcgggaagaggggaagacagcggagagaagggacggggaggggagggggctcggaggaggggacctgctgccctcagcctggctggtaaccggcctctccatagcaacggccagcgcgcgcgtctgtgtgtgcgcgcgtgtctgatgtgtgtgtgcccgtggtgttcccgggactccccgcgggggctgggaggggatcgcagaaccctagggtggcgacagagcaaacccctccaggactggaggcccgacctccgcggtgctgggag

SEQ ID NO: 31726 - DNA, 211 bp, Homo sapiens; identical to SEQ ID NO: 3189
  chr7:157486204-157486415
  hyper

SEQ ID NO: 31727 - DNA, 128 bp, Homo sapiens
  chr7:157486475-157486603
  hyper
cgccctggatcgccggagcctcatccaggctggggtctccagcaggcggccgggagctctccgaggtggccaggagtggccggtagccgtctccctcggccaggccgtgtccagcccctcagtctcca

SEQ ID NO: 31728 - DNA, 144 bp, Homo sapiens
  chr7:158379278-158379422
  hyper
caggaaaggaggtgccggggactggaggttttatgggtttaaaacaggggcgtccgcctgggaaagcagcggcttccactccctcgctgccgtgaagctgccgccctccctttcctcccgcggctgccacggaggaaaaatgtc

SEQ ID NO: 31729 - DNA, 36 bp, Homo sapiens
  chr7:158380360-158380396
  hyper
tccccgcggcctggccggcggcgctcagtccatggc

SEQ ID NO: 31730 - DNA, 236 bp, Homo sapiens
  chr7:158380974-158381210
  hyper
ttaacgccttccaaccgtttctttaatttaaacgtaacgggccacttgcgcatcggggcgcgcggaggtggacccagtcgacctcccctgcagcgcgggcggcgcccaggctcggtcccaggaaagctcccggagggcccagggcgtgggctggggccaggcgggctctggggcagagcagggtgaggcctgttgcgggcctggtctcctcgccgccgtcccgcccggggtcctgg

SEQ ID NO: 31731 - DNA, 336 bp, Homo sapiens
  chr7:158823329-158823665
  hyper
gcaggaaggactgggcgcgggagccgcggtggaactgcagggcgccctccgagccgttgcgggagaaggaggaaccgcagaccctgtaatcccggctcgcggacggggtcgggcaccggcttcgccattttcgcttcagctcgcactgcacctgggaggtgagggcagcgggaacgcccgtgagcctgggcaggtgcgggcggctgctatgggaagcgcggcccgcgagcctccagctctccctcccgcctgctcccgtatctgtgttgccagcagatggacagaaacagaaacggccttgggggcagaggctggagggagcgggaactggacggc

SEQ ID NO: 31732 - DNA, 235 bp, Homo sapiens
  chr7:158936522-158936757
  hyper
tactttccaaggacccgctccgcaaagcgcccaccctcgagggaggaaagccgagctgcgcctccgcgcaaggccagggagtgtggctcgagccccgctgcagaccgggcgtcgccggttaatcaatgacactgtcgggtcagcagcgcagcctcccagctgcggaggggccgcggatcgatccagacctgcctcggctgcgacgcgcacgaaaaccgcgcgcaccgcaaacccg

SEQ ID NO: 31733 - DNA, 173 bp, Homo sapiens
  chr7:158937202-158937375
  hyper
cgagtcccgcaacccggcgggaccggagctcagcgcttcacgctctccgggaggaagctccggaccccgggcgaccccgctccctctcccggaccccgcccgcgctccagcacccgggaggaaggcgaagaccggcgggaggagcgctcttctcggaaggggagaaccgggtc

SEQ ID NO: 31734 - DNA, 40 bp, Homo sapiens
  chr7:158937902-158937942
  hyper
cgcccccctcccggccgcgcctccccgatctgtgggcgga

SEQ ID NO: 31735 - DNA, 208 bp, Homo sapiens
  chr7:158938210-158938418
  hyper
tttggtggggatccccgcagcctcaaagaggacatcaggtcgaacagaaagctggagaaaaacgcagacgggggtataggtgggtcccagcctcagctgggtggcgggttttgtgtcctgcgtttgcaaaacgggggtcattctctccccgcaaacgcggcggcgggtggggaacgctgggcggggactcacgcggtgccactggggc

SEQ ID NO: 31736 - DNA, 143 bp, Homo sapiens
  chr8:495720-495863
  hyper
cccagccctggtgggcggtggggccgctggggcctggggcgccgcgggctcggcccggactgacggcggtggggggcggggatggggccgtggtgccgggccgcgcagaacccttgggacccccgcggcgcccaggttggggc

SEQ ID NO: 31737 - DNA, 171 bp, Homo sapiens
  chr8:686714-686885
  hyper
tatgcggtttgttttcgcatcttttacctcatttaaatgccgtagccatgcaggtggaaagcagaaatccatttctgcgtttatgttaaactggggctgagagacttgcccagggtcggtgaccgcccagggatccccataccagcgcgtctagctcccgcgttccgatcc

SEQ ID NO: 31738 - DNA, 56 bp, Homo sapiens; identical to SEQ ID NO: 3192
  chr8:687162-687218
  hyper

SEQ ID NO: 31739 - DNA, 129 bp, Homo sapiens; identical to SEQ ID NO: 3193
  chr8:687513-687642
  hyper

SEQ ID NO: 31740 - DNA, 139 bp, Homo sapiens; identical to SEQ ID NO: 3194
  chr8:687837-687976
  hyper

SEQ ID NO: 31741 - DNA, 43 bp, Homo sapiens
  chr8:688697-688740
  hyper
ctgggctggactggacgcctctccccgcccggccctccctcag

SEQ ID NO: 31742 - DNA, 35 bp, Homo sapiens
  chr8:1772635-1772670
  hyper
taaaggagaagaatgcggtccgcctcaggatgcag

SEQ ID NO: 31743 - DNA, 122 bp, Homo sapiens
  chr8:4849141-4849263
  hyper
cctgctgcttgcaagcgcctccggtgggccctggagcgcgctgccgagccccggggcccagcgccgacgcccccggggggaggcccgaccttggtcacccgggctttgctaggcaaggggaa

SEQ ID NO: 31744 - DNA, 495 bp, Homo sapiens
  chr8:4849296-4849791
  hyper
cggcgactccggcgctggcgtcaccagcccccttcctgcctgcagccccttcccaggccggtacaggagctcgcacttgaccccgcaggcgtggaggagacacggtccctggtccctgtggggttaatgaaggagctccacggacccactgcctcgtgggccagacaatagcgcagtgagagctacgtccgagcgtcctggaccccctccgcgcgcacacacttgcgcacagcacctctccagctccatgcacgccaggggcctgggaccctgggctccacttctcggcttctacagccaggttctgggacctgcagcgcgcaagaggagctctcttccacggggctgccccgcagggcccgaggcgcccaggactttgcaacccctgccctgttcgccccagaatcatccagagcagcccccgcccactacctggccctccacaccctccctcccgcctccgcctcagcctcatcctagcgctgcagcccaccc

SEQ ID NO: 31745 - DNA, 91 bp, Homo sapiens
  chr8:4850232-4850323
  hyper
gccctgctcagcaggcgctgcctccgcagccggcaatgtcagaggcaccggccaaggcatccggactgagccgggcgggtgggcagagggt

SEQ ID NO: 31746 - DNA, 281 bp, Homo sapiens
  chr8:4850418-4850699
  hyper
cgcagacacccccttgtgagggtggatgccggtgaggaggagctggtgctgagcggtcagctttcacggagccctggacgccccgtggaggcaagtgcagggaggggaagcccaggcggcacgtctctcccccgctctccaggcagatctggagtttcctaatgaaccagatacagtcctccttcgccctgccaatcactcttccatctggaccactggaggaaaaggaaatgggtggaaaagaagatggaagaatctagagaggacggggaaatattatg

SEQ ID NO: 31747 - DNA, 33 bp, Homo sapiens
  chr8:4851342-4851375
  hyper
gcgaggaggccgggccggcggagacctttgcct

SEQ ID NO: 31748 - DNA, 30 bp, Homo sapiens
  chr8:4851581-4851611
  hyper
gacaccctgtactgccgagaaaaagagatc

SEQ ID NO: 31749 - DNA, 336 bp, Homo sapiens
  chr8:4851862-4852198
  hyper
cagtgaggagcctcgcgcacagcaccagcagcccgagaagcaggagcagcgactggaatctcctccacgcagtcatgtctgcagatactccacacgcacgcgacaccgatggctcctccgaggaaggcagggctatgagcggagccaaataatcacccgagggcaaggcgagccggagagagagcccggtcccaagacccgccgcgcatccgacgcctcctgaaggtctgggcgcccggctcgcttccctctcatagcatcgggtcccgagccactgcagggctgagctgctccgagcgcggagacccgggctggcggggccggggccggggacga

SEQ ID NO: 31750 - DNA, 77 bp, Homo sapiens
  chr8:4852501-4852578
  hyper
gacagagcccagcctcggggcctcgggctgcccgcaccgtgctgcgcttcattcggcctcagcgcagcagcgcgcag

SEQ ID NO: 31751 - DNA, 182 bp, Homo sapiens
  chr8:6692272-6692454
  hyper
gcactgaaggagttacgcgttcaaaccagaagggcgcgaaaaatggggccatcttgctccgccgcggctggcgggctctgggttccccctgcgacggaggtggcctcgaagggccgcgtcccgccccgtcctaaaccccgaagcggagtcgccgtcctacagggccgcgtggatgcggagcc

SEQ ID NO: 31752 - DNA, 468 bp, Homo sapiens
  chr8:6692702-6693170
  hyper
gggaggggggggaaccgagcatgggtggaggaaaatcatgcatccttggggggatggtgcatgcgtgggcatctactaaggacgggaggacgtgctctgcaggtgggatggccaccaccgtgcgtcaccggcgcgcagtgctgggcgcaggctggggcagtgcccgcccgggcataggcagcctgtgcggctcccggcgccggggtggggttaggggctgcaggggtgagcacagcctcgggctgccgcactcacgcgcgctctgctcggccgcctgcagcagggccgagagccccaggagcctcgcgtgcatcttccgtgccgaccccgcagcctgcgcccgccccttcccctgcacgcggccccgcgtcggggaggtttccggcccggggcccgactgcgggtggcatttctggctaagccgttaggcgcgaattgtatgtctggtttattcgtagtggccagcag

SEQ ID NO: 31753 - DNA, 233 bp, Homo sapiens
  chr8:9756051-9756284
  hyper
gaggatgcactgagacggaccccccactccagcaaataaaacccaacccccaagcgctttcgcggcggggtcctcttcccaggctgcacctgccagcccctctttcttgcaagttctgaggctttccgggatgcacggtggggtcctcgaggccgcaggtactgaagtggatcagagagaggcccggagccgcactgcgggcgccgggcgcacaggctgaccggctgcacggc

SEQ ID NO: 31754 - DNA, 29 bp, Homo sapiens
  chr8:9756486-9756515
  hyper
cgctagagtgaaatcgatgtgcatggaaa

SEQ ID NO: 31755 - DNA, 247 bp, Homo sapiens
  chr8:9760735-9760982
  hyper
cacctccccaccccacgggctccggtgcgggacaggcagccggagggagctccagacccctcccctcgcgcccgcggccgctgcgcggaggtctgcggagggcgcctggctcggtcggtcgctccttccttggcgggccctcgccgacccacggtgctcagccagccccattcttggcattcaccgcgtgccttaattgtatggacatttaaatcaaggtccgctgtgaacacggagagagaggcct

SEQ ID NO: 31756 - DNA, 272 bp, Homo sapiens
  chr8:9761450-9761722
  hyper
tgtcgccctctgcttcgcccaggaaactgaaggggactaggaggaggaagaagagagcgaaggacaaggagagcagcggggactcggcagcggcagccggggcagggcgcgcggccgccgcctctttacctccatcgctgagtgggggcgcagccgggccgggcgtgccgcaggggcgagttgccgcggtccggggctgggacctggggattcagccttccggaactcgcctgctgcagtcctctcgctcaggtcccaagtggtggaggggg

SEQ ID NO: 31757 - DNA, 42 bp, Homo sapiens
  chr8:9761782-9761824
  hyper
aagaagaagaaaaaaaaaccataagagcgaggcccatctggc

SEQ ID NO: 31758 - DNA, 253 bp, Homo sapiens
  chr8:9762041-9762294
  hyper
caggtaaagggtggacgtagatttaaaaggtcactcgtgtataatgcggctggatccccgggtcaaaaaaagggggcgagacagaggatgagagtccctaaagccaaaaggacaataagacatcattttaagcccccacccccatgccctcctccacctctccacactgtttacacacaaatcctgtcgccgcctcatgcatgtgcacggacatgtcaatttctcatcaatttctcagcgctcctatcgacag

SEQ ID NO: 31759 - DNA, 104 bp, Homo sapiens; identical to SEQ ID NO: 3195
  chr8:9762586-9762690
  hyper

SEQ ID NO: 31760 - DNA, 566 bp, Homo sapiens
  chr8:9762751-9763317
  hyper
cgccgaacccaaggtgctttgtcccggcggccacacaaggtcttcggctttttgttctccttttttaagagactggccgcagtccccagcgattcagccggcccaaccaaaggcagtggatctactgaaatgaaaaggatcgagataatacacaggcagatgaataaggggggggatgctggaggtgcaggaagcatcctgggagcggccgccacggccaagcccgaactgcttgctgccttcgctggggaaggcgcaggaggcgagccggcgctggtggtcgctccacctggcaggaggaaatgataaccatgataaggaacgtgatgatgatgatgatgatgatgatgatgatgatgagcatgatttaaaaaaaatcagtctccctcttggtgaaccagagcatgcgtgccggagggactgcactgctggcggcggcggccgggggaaggagagcggcgcaggaggcaaaggttgaggaggcagcaccctcggatgaataataacaccgcgccgcgcaagttgcggagccgcctggaaatccagcccttcgcgtgaactcgcgt

SEQ ID NO: 31761 - DNA, 226 bp, Homo sapiens
  chr8:9763536-9763762
  hyper
agccgcatctgctgacggttccgaaaacaagaggattaggagcccgtccacagatccaggcccgcagacccccaccccctctgcaccagcacacgtcattctcactgcccccgggtacctccctctccttcgtgctcggggagagctgtgccaaggaaaatgcggatttggggaaagtgagaagtgggagagctcggaagagcgggaaagccaaggccggaggtgg

SEQ ID NO: 31762 - DNA, 263 bp, Homo sapiens; identical to SEQ ID NO: 3198
  chr8:9763787-9764050
  hyper

SEQ ID NO: 31763 - DNA, 757 bp, Homo sapiens
  chr8:9764195-9764952
  hyper
gggccgctgcggcgacctgagcgccggtgcagcctcccccaccccgcctgggcgggcgtctgggcaggacagctgcggggggttgggagaggagtcggggagagggggacgatcgccccatcccccgcccccccgcagtcaaggtgaacatgaaggagagccggcgcgcgtgcccgcgcctgggaggcgcgcggccccgcccctcccggagccctccagcgcgcccgggccagatggacgcccgagattagaggcgcagaagtgcgctccacgacgggcccacccgtcccgcggacatcagacctacttcggggaggcgccttttgttgtggtggccgtggcggtgtttgtgtctttccgggagcacagggtgagcttggccttcaggaatgactcagaatgaatccgcctataagagccaaactaaagacgaccccccgccccagccccccaaccataacccaacgcctgccatgagaaaccttcggactttccaaggggtcagtgcctcagccacgaggggcagccctgacccgcgcggttcacgcacacgcagggcccatctgcttcccctactccggcttttcttctctgatgacttaaaagagagtgagtgagggagagagggagagagagagagaggtctaagtgtttcttgggcactgctggattcagggcaactagagatggggagaacaagccccgccagctaaaagcagccctgctgaaaccacacagcccgcgagggtcgcagcag

SEQ ID NO: 31764 - DNA, 181 bp, Homo sapiens
  chr8:10587422-10587603
  hyper
ccccgccccctggggcgccgatctccgctcctgtcccagcagaggagcctccctgcccgccgcgcggtttcactttggaccgcgccaagtgcccccgctctgaatcctgggcaccgcgagcacccacgctcgcgcagatggccagccacgcgggcacgaagagggccctcgtcccgcgtgc

SEQ ID NO: 31765 - DNA, 115 bp, Homo sapiens
  chr8:10587893-10588008
  hyper
gggcactcgagaccctcgggccaagggtaggctcccagcagcgaagccatggccgcacgcgggtcgcctcgcttcgcctggcggggcaggcgcggacctggccctcgcacgggtc

SEQ ID NO: 31766 - DNA, 109 bp, Homo sapiens
  chr8:10588184-10588293
  hyper
cggagggagggagtgagggagggcctcctccccgcgcctgcccccggcccgcccctccgccgccagggcccgcccggggatctgcgcccggctgccccgggccgcctcc

SEQ ID NO: 31767 - DNA, 30 bp, Homo sapiens
  chr8:10590903-10590933
  hyper
ctggaggagaaaggtcgaggcccagggcta

SEQ ID NO: 31768 - DNA, 39 bp, Homo sapiens
  chr8:10916999-10917038
  hyper
cggagccatctgctgcgcgggcggcgccgctccagtgtt

SEQ ID NO: 31769 - DNA, 283 bp, Homo sapiens
  chr8:11058266-11058549
  hyper
gcccagcccgccgcccgtgtagtcctgcacgaaccagcggaagctcaggctctgcaccagcagcgacggcaccagcacgaagaagagggtcagcccgaagtagacgtagtcccccttgcggtagtagtcgagggccagccacaggtcggtgcccacgtccccgaagaacaccagcagcgccagcacgatccacaggcagtcgagccacggccgctccacctgcggcggcggcggctccggccgcgcggccgagggcgtcgggggttggcggccggcgccgggg

SEQ ID NO: 31770 - DNA, 35 bp, Homo sapiens
  chr8:11058764-11058799
  hyper
gccgccgctgcccaccgcctcgtccaggttgtgca

SEQ ID NO: 31771 - DNA, 47 bp, Homo sapiens
  chr8:11204479-11204526
  hyper
gattgcaatatgcagcggagtttgagaaccagcgccttggacccagc

SEQ ID NO: 31772 - DNA, 383 bp, Homo sapiens
  chr8:11204783-11205166
  hyper
ctgggccagctacaccgcaaacctttccagctgtctctcctgcgccctgcgtttcttccccacgtcacttgccagggagccgctaaacagcaagaccgcgcgctctgcggctccagagtgcggatttcggtcgcgtgcggctctgaccgcgtcgccccatccctggcggggccacgcacggacgccatggctggcgccgcggagccgggcgatgcgcgcggactctcccggggccctgactgtccctgagtcctccctgcggggggcgtgcgcggcccgccccccgcggcgccacgcggcccctcctcggccggggattggtgcgccgggcggggcggggcggggcgggataaaggcgcggggtctggctgcgcggggtctgc

SEQ ID NO: 31773 - DNA, 255 bp, Homo sapiens
  chr8:11205167-11205422
  hyper
ggcagctccaactctgggttcgtagtttgcgctgggtgcgcaggaaggtcagtgtgggggtcgcccgacatttcccccccgcggaggtgggagccgagccacatcttggagtggggactggccgcggagcgggttgcccagggccggccgaggtcggggcgagccctgcgcggcgctggagactctgcattcccgggcgcgcgcagggtccccggccgtggtcgcagagtcaggaggggcggctccggagcccgg

SEQ ID NO: 31774 - DNA, 257 bp, Homo sapiens
  chr8:11205445-11205702
  hyper
cggggttggcagggcgcgacactcgctcccctccacttttgaaagggcttcccacgccgagaagaggggcgggcatggccggcccggcgaaaccggtttgtacagactttgggaagccatcgcctgcggagggtgggaccccacagcttgtccacctgcccaggctgagacctcgtgtcctagtcctggatgccccacgggtttctcgtcccgggcagcggcgcacgggaggagaagactcccggtctgcagtcaga

SEQ ID NO: 31775 - DNA, 61 bp, Homo sapiens; identical to SEQ ID NO: 9392
  chr8:11206007-11206068
  hyper

SEQ ID NO: 31776 - DNA, 52 bp, Homo sapiens
  chr8:11536805-11536857
  hyper
gaaggttctcagactcggggatgggggaggaaggggacgtttctagaagaaa

SEQ ID NO: 31777 - DNA, 127 bp, Homo sapiens
  chr8:11537156-11537283
  hyper
cgcggccttaaaagtatcccggcgagccctgagtgggccgggtgctgggcgaacagtcctagccctgcactgaggttggaaaagcgaacggaaagtgacatttttacaggggcgaggttgggatcgg

SEQ ID NO: 31778 - DNA, 30 bp, Homo sapiens
  chr8:11540426-11540456
  hyper
agctagtttccacaccggggacctgctttg

SEQ ID NO: 31779 - DNA, 46 bp, Homo sapiens
  chr8:11550050-11550096
  hyper
ttgaatctgatccttcgggccgcggcggctccgcctgggagggcgt

SEQ ID NO: 31780 - DNA, 50 bp, Homo sapiens; identical to SEQ ID NO: 9395
  chr8:11550672-11550722
  hyper

SEQ ID NO: 31781 - DNA, 15 bp, Homo sapiens
  chr8:11555152-11555167
  hyper
cctttcagaggaccc

SEQ ID NO: 31782 - DNA, 17 bp, Homo sapiens
  chr8:11555473-11555490
  hyper
cgcgggtgtccctacca

SEQ ID NO: 31783 - DNA, 180 bp, Homo sapiens
  chr8:11560067-11560247
  hyper
gtgctccggagaccgcttttccgcagcgccggcctccgagatccccagcaccccttcagccttaagttcccacgtttcgggtccgtggcgccaattctgctaagtagcaggctaggaattgggggaagtcggagaagaaaccctaagtgtgtcgcccccagcttccgggatgcaggcccg

SEQ ID NO: 31784 - DNA, 43 bp, Homo sapiens
  chr8:11560468-11560511
  hyper
ccttctacccagccccgcgtcctggcctcgtccttaacccccg

SEQ ID NO: 31785 - DNA, 184 bp, Homo sapiens
  chr8:11560711-11560895
  hyper
agcgtgagagccacccgccggctgttatctggggctgaaggctgcggtaatcgatgggttatttttacgcggtaatagggccctgtgattgctctattaacctttagacctgtctgagggactctccggctcgcagccccgctgcgctggggcctccaggctctgacgccgactcccaactcag

SEQ ID NO: 31786 - DNA, 30 bp, Homo sapiens; identical to SEQ ID NO: 9400
  chr8:11561116-11561146
  hyper

SEQ ID NO: 31787 - DNA, 333 bp, Homo sapiens
  chr8:11561391-11561724
  hyper
cacaggaagggggggcggggagggagaaagggaactcattaataaagctgaccctgggcaccacagcgaacccaatcgacctccggctgggttgcgggtgattccccgctccctggcggtagcacttgggcattttccgcggagaccccagagcctggactttgcctgctgggggagctttccgcacagtcccgcagcctgcgcccagcggaggtgtagccggggccgcgcacccccgccccgcccttgcacgtgactcccacaggccagtcagcgccctagggccgagttgctgggccggggacccgagccgcgagctggggacttggaggc

SEQ ID NO: 31788 - DNA, 471 bp, Homo sapiens; identical to SEQ ID NO: 3202
  chr8:11561725-11562196
  hyper

SEQ ID NO: 31789 - DNA, 682 bp, Homo sapiens
  chr8:11562235-11562917
  hyper
cgcccaccagcgactccggggacgcagggtggcagtgccaggcagctccgctgggcctcaggggcccccgggagccgctctgaggtgcggagaggctgctgagtggcggaactattcatgccctttctggccggcctcctcgccctcggggctggggtccagggactgaatgctcctctggaagctcaccaccccacctgcccgcgctgcttctacctgaaactggccaagggcccgagcccggaccggagccgtgacttccctccgccggccacggggctgcccggatccgccgggttatgtcgcttggctttgggctcaggggtcaccgtgggcagaggggggtgccggggtcgcggactgccaccaggttgaggaaaggaggggccttttggctggggaaagagcgtggtgggggacccgcggccgatggaatccctggggcagcgcggcccgcaccgtggaggttggggaagcgcctcggggaagtgtttcctgtgttcccagaaaaggaagacaaccgagagcaggtttcaggcttttaaagaaagcctggggtgtggaggtgatgctccgcacacgtctgtgtctcctcccctgctgcggccggcttggttgtgccggctagcgtgcgaccgtcctcctcgctgcaggccgagagcggaggcgtaaacccaggcca

SEQ ID NO: 31790 - DNA, 53 bp, Homo sapiens
  chr8:12808858-12808911
  hyper
cgcgctaaagccaagcgtcgtcgtcacccaaggtactgcgctgatgcgctgcg

SEQ ID NO: 31791 - DNA, 59 bp, Homo sapiens
  chr8:12809671-12809730
  hyper
agagctgctgccagtcgccacaccgtgcggaaagcgccggcgaccggagcactgacaat

SEQ ID NO: 31792 - DNA, 267 bp, Homo sapiens
  chr8:12989381-12989648
  hyper
gccccaggggctgtgcgctgaaggacgctcgcggacgcagcaaactacacgcagcagggtgctgcagagaggaggggtgcacctccttcggagggatcaaaggctcgccccaggactctggaggtggggacagcgacatggagtgggggcaggcttccaagaagctgtcgccttgttacgaaaatagtcgggtcgggaggcgagcttccttcctctctccggcccaggaactcgctcctcggcctccttgtccgggtcaagggggtg

SEQ ID NO: 31793 - DNA, 73 bp, Homo sapiens
  chr8:12990075-12990148
  hyper
aaggaaggtagaaggcggtgtcgccgcgcccctcgagccagagccgcgagcccccgcccggctcaaggaggaa

SEQ ID NO: 31794 - DNA, 176 bp, Homo sapiens
  chr8:12990659-12990835
  hyper
gggttttctaaagatcgaaacgagggagcgctcagggagttgggcgagaagtccgtgagccggcgctcctgatgcggagaggtgcggccatgtcctggctgggagcgaagcgccctcgctcgggcagtcggagcgaactgtctcccgcgcgctccgccagccgggccctcccgctg

SEQ ID NO: 31795 - DNA, 262 bp, Homo sapiens
  chr8:12991064-12991326
  hyper
gccccgcgcctcctccgccgaaggctggaatgtttcccccacgggcctccacgttcccagcgggaagcgccgaaaagtcgccaactattggccccgggtgcaaaggcaaaggtcacaaggcatttacttggcggaggtgtccggcctggaccctagtgtgccttgagcgtcccttctttttcttggtagctctgcgtactttttacctgtcttttatcctggcgggaaccacgtaaatttgcgggaacggaggggaagcgga

SEQ ID NO: 31796 - DNA, 67 bp, Homo sapiens
  chr8:13133827-13133894
  hyper
agtccctgatgtgatcgctaaaggacctccggagaggggctcgcagggggcgcgccatcacgtgggc

SEQ ID NO: 31797 - DNA, 42 bp, Homo sapiens
  chr8:13134283-13134325
  hyper
agggaaacgcagcgccgcaggcaagcacgcaggggaggtggg

SEQ ID NO: 31798 - DNA, 85 bp, Homo sapiens
  chr8:13424168-13424253
  hyper
tttgcaaggttttcccgttgactactcgactttagcaccaaagagaagcaggagtgcagaagacagggcaaaatcgccaacccgg

SEQ ID NO: 31799 - DNA, 8 bp, Homo sapiens
  chr8:13424344-13424352
  hyper
cgttgcca

SEQ ID NO: 31800 - DNA, 201 bp, Homo sapiens
  chr8:15094366-15094567
  hyper
cggccggagcctccgcagatgccgcccctaccagcccggctcccgcctccccgccccctgcccgagtccccggacctgctcccgcgcctggggctagggcaggctagccgtccccggcagcgggggtacctctccagcccctgcactgcaactgcgggaggaaacactgcccgcgggcggtgggagggaaaaggggtctca

SEQ ID NO: 31801 - DNA, 42 bp, Homo sapiens
  chr8:15094645-15094687
  hyper
cgtgccgggctggggcacaggcgggatcggagccgggaagag

SEQ ID NO: 31802 - DNA, 51 bp, Homo sapiens
  chr8:15095356-15095407
  hyper
acaggtgatctctaccgcggtgcaacacagctgagtcgattgaaacagggg

SEQ ID NO: 31803 - DNA, 102 bp, Homo sapiens
  chr8:16859352-16859454
  hyper
gatgccgtgcaggtgcgccagctgcgcagcccccggcccgccgcgcgcgctccgctccgccgcgctcctgcgctcgcccagcagcggcggccgctccccggc

SEQ ID NO: 31804 - DNA, 41 bp, Homo sapiens
  chr8:16884323-16884364
  hyper
ctgaggtcaggagaccgttagggaatgtgagtgtcccagac

SEQ ID NO: 31805 - DNA, 322 bp, Homo sapiens
  chr8:16884365-16884687
  hyper
ggcgctgagcccagctcggagacccaccccgcccgtagcagcggcgcgggccccagagagccccgcactcggccgcgcctcagttacgctgactcggctgtgcccgcagtgtcgcgctgtcgcgtagccaggtgtcgccgggctggcgcggttatttatgactgcgtggttgggctgggggttcggggccggggagcagccgggatccgccgcctcttccatgatcttcccgggccgaaccacgggaccgctacgctgaaggtggcgtcgcgggtccccggggccgcgcgagtgtaggggtcgctctcggccggccgcgaag

SEQ ID NO: 31806 - DNA, 81 bp, Homo sapiens
  chr8:16884908-16884989
  hyper
cggcccttctcctcccgagaggatgaggagagggctgtggcggaggcggcatggaggcggcggcggcgctggggggagctg

SEQ ID NO: 31807 - DNA, 30 bp, Homo sapiens
  chr8:16885322-16885352
  hyper
ggatccggtcacccacgtattgggaagacc

SEQ ID NO: 31808 - DNA, 450 bp, Homo sapiens
  chr8:19614007-19614457
  hyper
caggtgcaggaagtgcgacggaaacaaacaactttgcctccgcttcctacagctttcctctcctccccgcccttctagcccccatcccaccccaagatcatgccctcgaacagcttctgcccaccgatcgcacgtcccctgggcatgttcgggcagcggtgaccctcagccacatcccccactagcccggtcccgggcaggcgagcgcgctgcccaccggccaccctcgtcacgccccctccaccctctccatcccagccacaataatacaataaccgcagtcatcgcgcggcacgtggaaaggctacttttcagtgggttttgcagaaagcaatcagacagcggaaggccacgagaaacgctggtgaagccaaaccgaccccgggagcgcagcggccccggaccctccctggaagctccctccgcgtccccgcgcgcccacctggaggc

SEQ ID NO: 31809 - DNA, 277 bp, Homo sapiens
  chr8:19614987-19615264
  hyper
gtgcgtccctgcgcccgtcggagcggcgccctggccgaagcctgtcactctcggaaggggccgcgctcggacaccaggggcggtttacgcgtgactggacaccaagagccggagaagtttagagactaggacactgtggcgtggcccgagttgcaggagagaggtgtccaatctccatggggtccttactcttgcaggacagagttccccatccccctgctccacccgctctgttcccttggctgccctccccgccgagcgccgacttccatgcaaa

SEQ ID NO: 31810 - DNA, 34 bp, Homo sapiens
  chr8:19797566-19797600
  hyper
cagccgcacggggtacgctcgccctcggcggggc

SEQ ID NO: 31811 - DNA, 213 bp, Homo sapiens
  chr8:19797806-19798019
  hyper
ctgtggtcgccgactcggggggttgccaggtctgcgtttggccaccctttctgtcctgggggctgaggtcagctccgggcgcccggccccgccgcgcggctgcgagcacgtggggttgacgggcgccgcgtggaggcagcgagcacaacggtggtcaccgccgccagggaaccgcccgctcgctggggtccaggcgttcggggccaaatgaga

SEQ ID NO: 31812 - DNA, 661 bp, Homo sapiens
  chr8:20160990-20161651
  hyper
cgaagacaaagacaggaggacagacgcacagtcacctcctctgggccgggccggagaagcggcgcccaccctgcagaggggagaccctgacagctccacgcggagacaaagacacctcgacagccacggacacagacagacaaagaccgacggacgcgcggacgcacggacggtccggcccggcgaggggaaagcggtttcccgcagccagggcagcagaccctccaggggcgaggagatccccggccaccgcaccttacctgccccctgcgcctcgggcgcacttgagactttttttttttcccagtgtttcccggtgtgttcccgtctctctttttccagagctgctgagcgggccgggccggtcccactgcgcgggatgcagctcccggctcccactcactggccgaggcgggcagagaaactttcggcctccccgcccggccgctgccaacccgccagctccaggcgcgccggcctctgcgcgggtcccggagccggggcggggcggggcggggcggggcggggcggggccggcccggggcggggccagagccggcgccgctgattggcagcgagctgccggcagcctggtctgtgccgctcggcggcctttgttccgggctgacagctggggctgctcgcgacctcgcggctcctt

SEQ ID NO: 31813 - DNA, 32 bp, Homo sapiens; identical to SEQ ID NO: 9415
  chr8:20161666-20161698
  hyper

SEQ ID NO: 31814 - DNA, 260 bp, Homo sapiens
  chr8:21881767-21882027
  hyper
ggtaggctggaagaacgggctgtctgggccttaggaaaggcccatgctgtataaggcatggggaaaggaaaggaagaaaggcaacgaacaagaaggagggcttccaactgcagcttcctgccggctgcaggcctcccttcctaagctgagctgaggcttcctctccatgggctggggagggggcgccaggaggcctcggcgggtccgcaattggccgggacagcttctcacgaaaggtcctgggccggcatcatcagcct

SEQ ID NO: 31815 - DNA, 30 bp, Homo sapiens; identical to SEQ ID NO: 9416
  chr8:22613837-22613867
  hyper

SEQ ID NO: 31816 - DNA, 208 bp, Homo sapiens
  chr8:22722223-22722431
  hyper
tgtgtagcaccttctcggcagagctcaggaaagggcggaaggggtgagaaaataggtagccagaggtggaagtagctgaccaagtcctagcgggtagtacgcaccacagtaaaacaccacgggggccgctgggcaccgccgagcgccaggctggtgaactgacccgcagcgcaccccatctgtgtgggaaggtcggggcaggggaccc

SEQ ID NO: 31817 - DNA, 36 bp, Homo sapiens
  chr8:22723325-22723361
  hyper
gagggacccccaccccgggctcgaactcccgacaag

SEQ ID NO: 31818 - DNA, 263 bp, Homo sapiens
  chr8:22960583-22960846
  hyper
ggccgaggcagggtgcgacccaggacccaggacggcgtcgggaaccataccatggcccggatccccaagaccctaaagttcgtcgtcgtcatcgtcgcggtcctgctgccagtgagtcccggccgcggtccctggctggggaagagcgcacctggcgccgggagggggcagggagacggggacacggcagggatgcctggccctggtcacctgcggccgggcatgtccgggcaggacgaactcgccgtcggagtcaggggaag

SEQ ID NO: 31819 - DNA, 323 bp, Homo sapiens
  chr8:23021267-23021590
  hyper
tccccagccagggaccgcggcggagactcaccggcagcagaaccgcgacgatgaagacgacgaacttaaggatcttggggtccaggagccatggtctggttcccgacgctgtcctggctcctggatagcgccctgctcgagcgctcgaggcggtcgggacgctttgtccccaaagtcccatgagaagggaggagggtggatcgaaagcgccaaaaatcaatcagaaatcgtccccgtagtttgtgcgcgtgcaaaggttctcgcagctacactgccagaatagaacgtgctcctccgcttttataccccggaaaaaaggcgtg

SEQ ID NO: 31820 - DNA, 175 bp, Homo sapiens
  chr8:23260829-23261004
  hyper
ggagtgcatacctggcgtgccgagagcgcctctgctcccgcaggactcacggcgctcccgcgctcccaacagcctttcgagcaggctgggggttgaaccgggttcaagcagtggacgctacagctcccgggcgcagcccccggggtccccgcccccactccgtcccagcccagca

SEQ ID NO: 31821 - DNA, 415 bp, Homo sapiens
  chr8:23261393-23261808
  hyper
gagaccccatagggacgctcccgctttctcgcgaaccgcttcggggagggggtggcgcgggaagcgctcttacttggtttcagggatccgcagtggccgggctgggaccgcgctctccacggtggtccccctccgcttccgccgccgctgagcccctttctcgagcagagggggcggctctggtctccgatggctggagaaagcaagcaccaagcgtaggtagccgcgcgctggagtcgcgcgtttactcttttcccccttacttttaactagaggaggatggcaaacccctccccggacccacccccttccccgaaggcggccgccgcagcaggcccggcctccggcctcttttgttgtaattcgagagcggccactcccagggccagagggagctccgcgggggaggccaagg

SEQ ID NO: 31822 - DNA, 50 bp, Homo sapiens; identical to SEQ ID NO: 760
  chr8:23559552-23559602
  hyper

SEQ ID NO: 31823 - DNA, 1238 bp, Homo sapiens
  chr8:23559665-23560903
  hyper
cgcgccttagtactgctcccacaccccaaactgccagccagccttggtgttcttcagtccctgtgttgcttggtgggtgaccggtggaggggtcttcttttgggggaagaacgtcccaggcggggcctttaactgggtgactgtggtgcagatcgcagtttcagagatccctccggaaagaagcgccgttgggtagcagcttccttccagcgccgcgtcccctccttgtcacgacctgcgggcggaggggaagggaacgagcatctggccctggttggcagagtcaagccgaggagcctcaccaggccctgacaccctgcagcgtggctgccagatggccctgcggggtggcattctggccaccgtgtccgaagcccgcgctggccagtggtgtgtgtggcgcaggacccgagggcgcgcccgcgtagcaggtgccgtagcctgcgccgtagggtgctccgctgtagcctccgtagcaagagtagggcgacactgctgcactgtaggggctggggaaggcaggtgcgccgggcccggggcccaggcagggcttgccatcgcgcaccaggacgggcacagctactcggcgcggcgttagagggtggccagccagttccagcgacttgtcctggcgctgtctcttgcatttgtagcgtcggttctggaaccagatcttgacctgcgtggacgtgagctgcagcgcgctggccaggtgctcgcgctcgggcgctgacaggtaccgctgctgcttgaagcgccgctccagggccagcacctgcgcctgcgaaaagagcacgcgcggcttccgtcgttgccgcgccttgggctgctccgagcggccaccccgcacgctgtcgccgctgttgccaacgccgcgctctggcaccctggtcccgccgccgaggggcgaggccgcgttcaggccgggctctaaaagcacaggaagggacacatcagcgcccagcctaaggctcacctgagcggttcctacttagttttcaagactttcctctccctggcagccttcactctgcgcaggctcctcctccctcctactgcccccgaaccctgtcccaggacgaaccctgtcccaggactgtctccatgttttttccctccaagctctgtcacctttatatgttactgctggaacataaattgtgacaacctatggtccctcgtgtgtgcgtccttttcctaaaggtagactctagataaagagttaaggcagctccatt

SEQ ID NO: 31824 - DNA, 15 bp, Homo sapiens
  chr8:23564009-23564024
  hyper
cacccgcggatgtgg

SEQ ID NO: 31825 - DNA, 193 bp, Homo sapiens
  chr8:23564192-23564385
  hyper
cgcagacagacccaagctctgggacagacgcccagcgtcccagacagcgccttcctctgggccatgctggtaggcccgggtccagggccgggtgacgagaccgtagccccccattggttctcgcagaaaccacgtgctagctctgcaccttcctcccccagcgctttcttcccgcgcccgtcgaatcctctcc

SEQ ID NO: 31826 - DNA, 293 bp, Homo sapiens
  chr8:23564781-23565074
  hyper
cagaatccaggtctgcggagtcccgacccgccacttcctaggagcagcttctcagccccaggaccgaggaatgggtgtgggggctacatgtggggagccctcgacctcttaaagggctccgcgaatggtgggggagactggaaggcaatctctgcggcccgcgcaaagtggtcagaggcgggagtgggggtgggggggggtgggcttccgtcgcccttggcgtccccacgttctttttcttcctctcctttatcctccttaaagcggattgcctggagcgtgccagcttgtgt

SEQ ID NO: 31827 - DNA, 15 bp, Homo sapiens
  chr8:23566840-23566855
  hyper
aacttagaatatttc

SEQ ID NO: 31828 - DNA, 308 bp, Homo sapiens
  chr8:23566900-23567208
  hyper
cgctgggttctcgccttccaagtgctggaggggggaagtagggccacccggggtagaaacctaacgccagaaaccttccagcgccttatcagttggtggaattttcgtggcagacagtcgcgctctacctaagtcgtagaagaaaagacaccttgtgggggacttggcgtcggaagccttgagttcaaatcgtagccctaggtccccagccttgcccttcctggcttgctgcgaggatgaaatgagatttttgtacgtgaaaatgctttctaacccctctcgaggggtggaaacgtctccattcgacc

SEQ ID NO: 31829 - DNA, 147 bp, Homo sapiens
  chr8:23567436-23567583
  hyper
ttcagcttcttcgctcgcttgggtctctctcggtcacctctcggaggggcctggagtccctcctccctcctcctacttcagcgccagaagcattgaaagccgcccgcccgccgagagtggaaccggtacctcgaatctcgctcattc

SEQ ID NO: 31830 - DNA, 58 bp, Homo sapiens
  chr8:23567657-23567715
  hyper
cgctggcgcccaggaaagccggggaggaaactaggaagggaggcgacagcagaaaagc

SEQ ID NO: 31831 - DNA, 353 bp, Homo sapiens
  chr8:23571643-23571996
  hyper
attaaggatctgatacgatcttttcctaaattgctatgctgaggcctttttgacggtttgtccgccatcactttcagaggcgctccgcgcgaaccccgaaaatctgtgcaaaattctcagggttaggggaagagcatgggtggagagtaaagtgaagcgggccgagagatttcttgcattaaatgtttagaagaaccaaccagttaaaggaaataaaaatctgccggtatgtaaccgctgggtgggcttctccatttctccgtgtcaccctcccccagccggcctcttagcttctcggctttgggtggcggagaccgtttagttctgggacagaccgtcgggggctgactccg

SEQ ID NO: 31832 - DNA, 249 bp, Homo sapiens
  chr8:23572413-23572662
  hyper
ctctctgtcccactgcgcggcgggatggcagctgctcttttaataaactagcagtcggcggtctgagccctacaatatccccaaagcctggtgtgcgatggaacacatggctgcgtccccagaccccgagaggggagttgcacacacattgctgaccttgagggtcagacagaccctttctcgtctagtttttagcatcagatgtaacctcagcttgggcttctatgatctcatcgatgtccttttgag

SEQ ID NO: 31833 - DNA, 46 bp, Homo sapiens; identical to SEQ ID NO: 3213
  chr8:23583971-23584017
  hyper

SEQ ID NO: 31834 - DNA, 308 bp, Homo sapiens; identical to SEQ ID NO: 3214
  chr8:23584093-23584401
  hyper

SEQ ID NO: 31835 - DNA, 236 bp, Homo sapiens
  chr8:23584581-23584817
  hyper
cggcgccagggcgggtggtggagctccgcgcaggccggggggaaccgcaagaggagccggggcgggcggcggccccgggcgggtcaggggcggcgcgagcccacacagagcggtgaaactaccaggggccctcccactcttcccggactccggaggagctaagccggcagggatcgctcgcccaccctgagcactttacctgcatggtggccaagacccttcgtccggaccctact

SEQ ID NO: 31836 - DNA, 41 bp, Homo sapiens
  chr8:23585244-23585285
  hyper
ccacacccggctgcgcgtgcctttctcgcttggatccctgg

SEQ ID NO: 31837 - DNA, 69 bp, Homo sapiens; identical to SEQ ID NO: 9432
  chr8:24770293-24770362
  hyper

SEQ ID NO: 31838 - DNA, 168 bp, Homo sapiens
  chr8:24770413-24770581
  hyper
cgtcccccaaacgttaaaaacgccatatcccactttttatacaaataactaccccggcctgttctctttgtccccttcccgaagccttcaggcagaccgttccgcaaagtctttttttttgttttgttttgtcttctagacccagctcctcggcgctcatctccagct

SEQ ID NO: 31839 - DNA, 232 bp, Homo sapiens
  chr8:24770893-24771125
  hyper
aggggaccactgggtcggggaagcgctgcctgaacggcgggacagtgacaaagaaagggcgctggcgatattcgcaccaagggtgcgaaacgcaatcgggaggtgagaaatggaaagaaggcgaatgcccggctacaagtagcctgggactgaaaggggacctgggggaggggctgggcccagggcagaaaagtccaggttcccatgcggcctgggcccacgtggagcgggc

SEQ ID NO: 31840 - DNA, 226 bp, Homo sapiens
  chr8:24771349-24771575
  hyper
ggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacc

SEQ ID NO: 31841 - DNA, 41 bp, Homo sapiens
  chr8:24799514-24799555
  hyper
cgcctcccggtggcctggtgctgggccgccctccccctctt

SEQ ID NO: 31842 - DNA, 324 bp, Homo sapiens
  chr8:24813140-24813464
  hyper
cgtcggtgttcttggcggcgctctcggtcagcacggtgaagcggctcttgaaccattcctcagcgttctgcatgttcttggcggccagcttctcgtactgcgcgcggatgtccttgagcgcggcggaaaggtcgggcttggtcacgtccatctccacggagatctgcgcgtactggatctgcgcctgcagttcggcgatctcctcttcgtgcactttcttcagaaaagagatttcgtccatcaagctgtcgatgcgcttctcgagctcggcgcgagcgagcgccgcctcgtcggcgcctttgcgcgcttccatcagccggccct

SEQ ID NO: 31843 - DNA, 276 bp, Homo sapiens; identical to SEQ ID NO: 3219
  chr8:24813618-24813894
  hyper

SEQ ID NO: 31844 - DNA, 418 bp, Homo sapiens; identical to SEQ ID NO: 3220
  chr8:24814010-24814428
  hyper

SEQ ID NO: 31845 - DNA, 353 bp, Homo sapiens
  chr8:24815060-24815413
  hyper
cttgctaccaccaaccgcagcacatttaaagtccgctttcctctttttacacatgtgtagcacacgacctgatgatttcgataagccttgcagttggctgattttcagggaagccgctgcggccagccctgagcgctgggtgtggtctctggggaggagaactcggcacccaggcttcttcaggaacggatagaaaatagccatagccgcgtgactcttcccccgatacaatgtaataacccgaaaacagatgcagtcaggaatgcatggatttccttcaggaagcacccagatgcttgaaactggcgcacgcggtagcgcacgtggatacaaccctacggtttgcagggcat

SEQ ID NO: 31846 - DNA, 16 bp, Homo sapiens
  chr8:24816379-24816395
  hyper
gcggctcctccctgaa

SEQ ID NO: 31847 - DNA, 15 bp, Homo sapiens
  chr8:24816694-24816709
  hyper
cgaatccagccgggg

SEQ ID NO: 31848 - DNA, 609 bp, Homo sapiens
  chr8:24857431-24858040
  hyper
cgagaaacagctacacgtctccagggcctttcttctggaaaaacttttctggtcccctcttccctgaactggtgcaggcgtgcaaagaaagctccgtgccacgcccggcagcctccattctttggtagaacgcagcgcagcaatagccgccaagtcccctcctgggtacagtacagctccacagcgcccctgctggtggcttgggaagggcgcgcaagcagagaaagcaagtgtcagagccgggactggcctcccagggcatcgcctacagcttgtgctctgagagtcggggtcatcatagctgcgctcttcgatggacactaaatgcgggacatctgttttacactcaccctccctccccgcgtggcaggagacctacactctcccgctatgcgcgctccgcggcagctgccgctgcaccattcattctctcctgcagaagttcaatattgctgcaaatatcgagaaaaaaaaaaaaagcgctgagagggggagggagggagggaggaagggagggacagcgagccagcggccactgcaaaggggcgaagggcagtcccgcggtcagtaagggccactgaactttctgcccaccggtcatccggagct

SEQ ID NO: 31849 - DNA, 1240 bp, Homo sapiens
  chr8:24858286-24859526
  hyper
ctgctgagtcactcccgcctgagccacggccgcccccagccagccacgcgattggcgggttagcccgggcgcagcgccctcttcccagctcccgcacccccagggcttcccgcaggcagagggtgggagccccggcgagcgaccagttggggcttggtaggaaccccctaaaaatgcgccccacttgtgcattcgtgcatgggcgcattttgggagtaaacaatacataaccttcttcgcattcaaagggtctggactcaaaagagggctcagccttgctcctcgggagcaacccctgttttaaatctgggaaatggtgatgccagtggggaaagggcttctccgggcccggggctcccgagctcctggtgccagccgtgttgctctggcttttgtattttaactccgtgggcttctgtccccatccccatgtaaggccagtgcccccttccgcgttttgccgaaagtatcttcaatgcccgtttaaaaaactatgtctgcgatttctccatctctgctctttcccagttcctctcttttctcttcttcaggccccctcctgtccttcctcatcctttcactgagcgggttcaggccctagttactaccgcaggcaccagccacacccggggagatgtgtgctgttttgtgcaagacgctgcggtcacccagtccggaattctgctggtctacaccgagtgccgcaacaccaccaccacctccgcacacatacgccctccttgaacctcttccccatgaatgctttggcttttaaggaactttgtggcgtttctgctctttcggaggcagctgcccgaggcagcttcccaaggcagaacagggactgactgctgaggttccgcggggtcggggaggtggagaagccagttcccaagtggctcgtcgcgggtgttagagtccctcgttactaaggacgccgccgcccgcgcgccaggcttggggaccagggtgactctgccctttctgggcggaatacgggtgaaggctgtctttggggatccacaggtgatctgtgccgttctcattgtattctcaactctcatcccttccaggttagcccgatccctttaatgcaaggatcggtgccgggaggaaagagagcgtgggccactctggaacggaggctggtgttttgggggagcggggagagcctgtagcccacacatctccacggctctggcccaatttctccactttttcacttcgatctaattggtct

SEQ ID NO: 31850 - DNA, 175 bp, Homo sapiens
  chr8:25041746-25041921
  hyper
aacaaatatttattgcgcgcccgcttagtgccaggcaccggaggtgccccgagcaagaagccgctctcgctgatccgtttccgctccccaagtgtccggcgcgcgccgtgggagcgcagcccgcatccctcgcccaccggccgcccggcctgggcgtgcccggctcctccagcgc

SEQ ID NO: 31851 - DNA, 43 bp, Homo sapiens
  chr8:25042737-25042780
  hyper
ccagggaaatgtcaacgcgaggggggcgcgcctgctgctcttt

SEQ ID NO: 31852 - DNA, 100 bp, Homo sapiens
  chr8:25899320-25899420
  hyper
aactagtccaaggggcgtttgctccgccgtcagtccataaccaggcgctactaaggcctccaggctcggtgcgcagagccgggagcgctcctccagctcc

SEQ ID NO: 31853 - DNA, 285 bp, Homo sapiens
  chr8:25900408-25900693
  hyper
gggacagagacagggcggaatcctcgcgaccagccccggggatcgctggccaccacaaatgagatgaccgacatagggggccctccctcccagaggtgctaggtggggaaaagccaaactgttaaaaggcgagaacctcctttcctggggccaacgcgatccccactcatgctgcgttttctggcggcgccagccgaacccagtgactgtgaaacccaagttgggggacccggaaggcgccctcgagcgtgctgagtgtgtgcacacgcttcccagccaaccggt

SEQ ID NO: 31854 - DNA, 237 bp, Homo sapiens; identical to SEQ ID NO: 3223
  chr8:25900780-25901017
  hyper

SEQ ID NO: 31855 - DNA, 187 bp, Homo sapiens
  chr8:25901018-25901205
  hyper
ggccagtcccgaagcgctgcggaaagccgcggccgccgcgctgtgcggtctgccggagggaaatccgcgctccccgggccacaggagggagggaaccgccgccggcccaagtcccggagcgataaaacttctgctttctccgctccaagggtagaggccggttcgctctacccgggacacctggcca

SEQ ID NO: 31856 - DNA, 645 bp, Homo sapiens
  chr8:25901540-25902185
  hyper
gcctctttcttcttccgcaactctttctactgtgactcagtattttctcttcttttaaatctcttcttttctccagttccctagctccgttcgtctggctcactgttttatctttgagccgggaccctccagcctgtcccccctcccagagctcccggccgcctcgtcttcccgggcagccgctccggcttttcccgctcccctcgccgccgccaccctctggccgccggcctcccaggctccaggaatcgcccagcaagatgcgggaggtaggcgctcgcaggcggcgtggcgaagccaagagtggccaggaagccggctttcctcccgcgccgccactgccagcgccggtgttcacgctccgttcggggccaggccggctcggcttgcaggactaggggctgagctgggagatgttgggggctactttatttttccttgcaaagagtggactgtggtaaaggagagggagagaaacgcctacgacccaggcagttcaggaactcgagtgccggctgccgggtgagcgttcgcctgactgcagcgatctgcttgcccgagggcgagccccagcgcgcagggcctgggcgacagatggggggacagggagagagaaaggcacggggtgcgcggggggggtgcaca

SEQ ID NO: 31857 - DNA, 50 bp, Homo sapiens
  chr8:25902919-25902969
  hyper
ctacggccctggctgcgggaggcggagctgcggcccgataaggagcctca

SEQ ID NO: 31858 - DNA, 235 bp, Homo sapiens
  chr8:25903631-25903866
  hyper
gccggggagtattcccgcgggtcctccggttccctccccacctctccgttcccgaagcccccggtagtgggcggggagggacgggggagtcgtggaaacttcgcccaccgcgcgcggtcgccgcggtgctggccgcgggctggtggccggcaggcggtggcagcagcctcaccgaacagctgaaaccctagacggttttttaactgcgcggggctgctcgcggtgcctattaaac

SEQ ID NO: 31859 - DNA, 210 bp, Homo sapiens
  chr8:25904157-25904367
  hyper
ttaggtgtaggtgagcgctcgcaaatgaactgctagagtttgccgctagaggacacagcgccttgcaactggtttgcctaggctgacaggaagcttgcacttcaagaaaactcggctctctcgagaaagggaccggtgcgcgcctccacctccccaagggacaaaccgcggcaccacgctgcgtgcgcgggattgcgactaggaagtgct

SEQ ID NO: 31860 - DNA, 122 bp, Homo sapiens
  chr8:25904898-25905020
  hyper
agagtgtggaacagccgtgagcccttcaagacatgcctatgagcccggtgatttttttttcaagggggctttgatcagctgtacctccacgttgccccggaaaggtgcgcagggcacccgga

SEQ ID NO: 31861 - DNA, 378 bp, Homo sapiens
  chr8:25905251-25905629
  hyper
tcccagccaaccccccgagacgcgctcaggggcctcggtgccccgctgggaggcaatttgggggagccgtggtcccgaactttgacagagtggggcttccccactacttgccggctgcgctaagggcgccccccgcggcagtgctgctgggagctccagggatggctgtgtggctcgctgcgggcgttgaagttccctgttggccaggctgaagtgcctgcgcgagcgtgaggggacaaggactgccttgggcccagcgtggcggcgtttcggccaacccagttggggttaattgcgtctgtataggttttgggtaggaatgctcgcggagtccgccacccgcgcgaaacatgcgttggttgggggaatgagcagcgg

SEQ ID NO: 31862 - DNA, 130 bp, Homo sapiens
  chr8:25905695-25905825
  hyper
cgatctcgtgcaacacaaaacctgccccgagctgtgcgggggcctggcaagcgcagctgcggccccgggaagcccaatcccgcgggactgcggagcccacgcgctcctcaggctccggccaactagctcg

SEQ ID NO: 31863 - DNA, 57 bp, Homo sapiens
  chr8:25907271-25907328
  hyper
tgtcatcactatttacggtgcagcgatcagggcaagttgacccgcattaaaaggcct

SEQ ID NO: 31864 - DNA, 10 bp, Homo sapiens
  chr8:25908415-25908425
  hyper
gcaatcattt

SEQ ID NO: 31865 - DNA, 402 bp, Homo sapiens
  chr8:25909197-25909599
  hyper
gcacagggactggatcgctcagtgggtgataagctttttgtttgttccgcatggaattgcatgtgagaaaagcgctttggaagctgtttggtgcacgcgggcgtcagagggcaccgtaggtcactgagcggggtctcacccagggagagaatgcgacttcattcctaggaggctgtgctgggggctccgcgctgcgcgcggcagtgagtagggcgcaccccgaatgcaagtgcggttcgctgcgtggccgcgtgctgggatggatcgcggaactcgctagataattgaagatctcgaggagctctgaaatggatcttcggtttctacgacaaacccccgtcgatgagtggttcacagagagcttggggagcccctccccgccctgcgccctcaggaagagac

SEQ ID NO: 31866 - DNA, 47 bp, Homo sapiens
  chr8:25909600-25909647
  hyper
cggctcgcctgacactactggtctctgtctcccgagagccagagccg

SEQ ID NO: 31867 - DNA, 36 bp, Homo sapiens
  chr8:26306055-26306091
  hyper
gctgcgcgcttccagcgccgtcggtctggggtttct

SEQ ID NO: 31868 - DNA, 145 bp, Homo sapiens
  chr8:26370760-26370905
  hyper
accccgtctttaagtcgtggccctgggctggaattcccgactgcactctttgctacacccccatagaccgcagacctgcgtctctctctatattcctctcccatctgctacgcccctctgaatttcttcccgccatgttgtgtgc

SEQ ID NO: 31869 - DNA, 159 bp, Homo sapiens
  chr8:26372761-26372920
  hyper
cccttgactcctgctcgcagcgtgagaagagccaggaaggctgtggagtcacccgaggaaaccgagacgctcctaaatagcctatgtggggaacaaagttccaataagtgtctcagccggggcttcacagagcgctccccaaaccgctatgtgggaggc

SEQ ID NO: 31870 - DNA, 74 bp, Homo sapiens
  chr8:26723005-26723079
  hyper
gcgctacaggttgggcgctgctcctggcccgcagttacctacattttgagctgccccaccgaaggctcctgctc

SEQ ID NO: 31871 - DNA, 264 bp, Homo sapiens
  chr8:26723320-26723584
  hyper
cttcggagctcatctcgcgcccccaccactgggaacctgcctagcgcactctactgagtcacctctgcccgagttcaggatccgaagcgaaaaacaaacaaaaaaacaaatccccaaaaccccaggctccagcgctcgaagtctggatttcgagcgcaggtaccacgaaattaaaatcctcgaagccccggaggggcgactgcggctggcgagtgtgtcgcacggatcctagccggggaattctggaggatgtactcggtttcc

SEQ ID NO: 31872 - DNA, 855 bp, Homo sapiens
  chr8:26723585-26724440
  hyper
ttagaacaggttgcctcgcagtcacctggagggggcggcctgggagagggaacagctgcgacccagggacctcagggccaggaccacgagcacgctcactctcacgccggtggaattcgcactcgggtgtgcagagcgcaccggtctgtccaccagccaagctggcttgagagccaggtcccgagcgaagccgggagggacccgaagacagaaagcgacccaggtctgtccacgacgcctttccaagcctcactgttggccacccgaggggctccagctgccagccgtagcgggactggcgggggacggggtggggaggacgtccctctgcagagggagctttgcaagtgacagtcactgcggattttgcaggcgtaaacattaagccggcatgccagcgggcaggggccgccttcgattttctgggctgggggccaccatctgcgtaagaaacctgggtttccacaactgcgaacctaccgcagggactcggcaggacagcgcggcgtgaggaagtgcccaccttgccttctggggttgggccctgaggtgggacctcgggcaaagactcttgttaaaatcgcaagttggagacctcacaggtggtattaaaaacgtgccactgcagaaacccttttcctcctacctcgagggtgataaacacagggttaaaaagacacttgttcagtagaaggcaacttcgcagaagatgtaagggaatcgggggtggggtagaggggccggtataaaacctggtggaaaaagcgggaggcgctgggaaaagtgggggttccgtctcaccagacggcgggggaggtctgccctcacccactcggccctgcgggacgccggccc

SEQ ID NO: 31873 - DNA, 169 bp, Homo sapiens
  chr8:26724484-26724653
  hyper
cgcgggggatgtggacccggcttcggtcccgggagctgcctgcctgctcttctctggaggcggagaggggaccgtgtctccgaggcaccaaatccttgtccttttgcacccgctgactcacccctccaccactgatgtctttaagctcctgaaccgctgtcactttacc

SEQ ID NO: 31874 - DNA, 77 bp, Homo sapiens
  chr8:29209803-29209880
  hyper
tcccccactgggccccgaatgcctcgacccccgggccctactcggatgagctgtaggggcaccgcttgggcaaggtg

SEQ ID NO: 31875 - DNA, 33 bp, Homo sapiens
  chr8:29387334-29387367
  hyper
aaacaacaaaccacgcggcgttctctggtggct

SEQ ID NO: 31876 - DNA, 30 bp, Homo sapiens
  chr8:29387658-29387688
  hyper
ttcattatttatctccgaaagccctgtctg

SEQ ID NO: 31877 - DNA, 35 bp, Homo sapiens
  chr8:30243388-30243423
  hyper
aaagttttgtgactgcggagcgttccttcggtgga

SEQ ID NO: 31878 - DNA, 572 bp, Homo sapiens
  chr8:30769168-30769740
  hyper
aaacttgaagggaaccgtggtatcttcaaagtctccgagttgccagcgacctcagcctctccactttctcgaacatcatccctgggcactgtctcccgacacagccagcgcggtggccatgcgcctcaaaccgagcattccaaacgcggaaactcaaccccgagcgcggagaggatggaaactgcctgaaaggatctgtgcagggctgggcttgggacgcggctcacacgaaactgaggcaggagtctcttcctgcacccgcaccacgccgggacccgaggggtttcactcccttcactgagccgagccaggaagccaagagccaccagggcgaagcagccctgcaaaacctccactcagccttacaacagccacagcgccgggacacgcggcaccgcatcccgggcgcgccagtcctcctgcagtcgggggacgctcccctcaggcgcccgcgtcggagcccagctacccccgcgccgccctcacctaccgaggctcccccgcgtccaccggctcctgcagcgagacagccggcgcaggcgggcatggtccgagcgcgggctctgcagggg

SEQ ID NO: 31879 - DNA, 59 bp, Homo sapiens
  chr8:30769987-30770046
  hyper
accaccaagttgtggcgctctctcctctcgctgcctcagagcagcgagtttctcctcag

SEQ ID NO: 31880 - DNA, 129 bp, Homo sapiens
  chr8:30890252-30890381
  hyper
cgcggccgcggccgccgccgcctccccttcgcctggctctttccatcttcagctgcaagtaacaaacagacacacgggatggggtgggggaggggtgttgagaacaatcgcagacgcccctcggcctga

SEQ ID NO: 31881 - DNA, 411 bp, Homo sapiens
  chr8:31496433-31496844
  hyper
cagtaaaagaaaaggcgggggtcatgaagaccgaaggatcaaaggagcatggagtagaggaggcgtcacatctgaagtgcacactgtgtgtgcgcgctgcaaggagagagagcgttataaagttgttgttttaatcgctgcttgtcgcctgcgaacatgttgctcccttttaagtgtcaagcaacgggttcacccaaaacttttctgcaccgaggacccgcacgcccggggtcccacctgcccctctctgcctgcctcccaccggcgcctgggcatcctgcgccggctacaggtccttgctcactgaagcgtcacctctcactccccagtaagcctccgcagcccactcggactgcagcctgtttgccgcccgtcctcccattgcagcactcggggcgacagagagggagg

SEQ ID NO: 31882 - DNA, 513 bp, Homo sapiens
  chr8:31497448-31497961
  hyper
gagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcc

SEQ ID NO: 31883 - DNA, 158 bp, Homo sapiens
  chr8:32404798-32404956
  hyper
aaggagtaggtttcacgcgcagttctgagtaaagtttgaatctgagaaaccccacattcacgaattaaggatctccagttctgtgtctttattctacccctccctgcctgcttttccactcggcagaactgagtgactttcagcggctgcagtaattt

SEQ ID NO: 31884 - DNA, 60 bp, Homo sapiens
  chr8:32405453-32405513
  hyper
agcagccctcccaggcgctgcctggctgcggaggggagcgggcagcgagagcctcgggtc

SEQ ID NO: 31885 - DNA, 30 bp, Homo sapiens
  chr8:32405729-32405759
  hyper
ggccaggggagggtgcgaaggaggcgcctg

SEQ ID NO: 31886 - DNA, 217 bp, Homo sapiens
  chr8:32406020-32406237
  hyper
gagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctc

SEQ ID NO: 31887 - DNA, 419 bp, Homo sapiens
  chr8:32406509-32406928
  hyper
cgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctac

SEQ ID NO: 31888 - DNA, 53 bp, Homo sapiens; identical to SEQ ID NO: 9466
  chr8:32406929-32406982
  hyper

SEQ ID NO: 31889 - DNA, 213 bp, Homo sapiens
  chr8:33371806-33372019
  hyper
gcctgtagccacaagcgtttgaaaattcaaattctagcgtcaaggtagaagcccccagctggcgtctggggcagccctgagggaggtgggtcgtcgggttggcggatccggcttgggcccgccccgccagtgtcggcgccgggtgcgcagggacagcagagcgctgtcttgggcatgggtcgcaggcggcgcccggaacgggccaggggagct

SEQ ID NO: 31890 - DNA, 272 bp, Homo sapiens
  chr8:33457107-33457379
  hyper
tcgcccctagctgggcgcctctccccagcgtggagagccagctgaaaaggcgaaggcccgccgcagcccctctacctctttgcaagcgctgcgctgggcctcagtccgaaaggcggatcgccggcgcagacagcgccacggccatgacgctcctgctgctgtcgccgccgctgtttctgcccaagacaggttgacagattagcagctatttttaagccatgacacacacgtcgaagcagggttcaaatcagcgtgtgcgctggtgacataaa

SEQ ID NO: 31891 - DNA, 30 bp, Homo sapiens
  chr8:35092643-35092673
  hyper
actgagttaggcaaccgagatgcccacata

SEQ ID NO: 31892 - DNA, 124 bp, Homo sapiens
  chr8:35093036-35093160
  hyper
cggcggggactgcgggcgactccggcatccgcgctggcggcagcggtcgccgcgccgtgggaagctatggggacgcgccctttctcggggtgcccattcagcggcggctcggagctccctgccc

SEQ ID NO: 31893 - DNA, 79 bp, Homo sapiens
  chr8:35093225-35093304
  hyper
cgggaccctcatcgccgaccctttcccgggctcccggagcgtgaagaagagccgccctccggaacgcggcgaggagcat

SEQ ID NO: 31894 - DNA, 23 bp, Homo sapiens
  chr8:35093951-35093974
  hyper
gccagccctggagctcgggagag

SEQ ID NO: 31895 - DNA, 278 bp, Homo sapiens
  chr8:37552317-37552595
  hyper
aagtgctttttcccccggagtgagaaggatgggggggcggaggggttgtgttgccgagcagcgcttagagagagatccccctccagggacacccgcctcgcccgtgatctcggtctctcctcgtagcagctgggcgcggtacagtgaggaacttcacgcccctcagcaggacacggtaagaagcctgtaacacaccagacaccgagcctctaacgcagggcgcaggcacagcgcgcacagcctggggtcccgcgcttggtcgccgaccatgtcactcc

SEQ ID NO: 31896 - DNA, 63 bp, Homo sapiens
  chr8:37655313-37655376
  hyper
gtgaagtggagagcacgcctgcagggcacccacgccccggatttccagcctggactagggttg

SEQ ID NO: 31897 - DNA, 516 bp, Homo sapiens
  chr8:37655475-37655991
  hyper
cgtcccggactgggctggaggagtctccggatttacctggctggccttgtcccttcaattggggtcatcccatccttgccccctggcctgccagcgccgcttccagccggtctccttagggcaaggggaggctgggctcagaaaagtcggcccttggaataccggcgctcctgggctgcaggagaccctggcgtccccatccctctagaggcccctctcccacggcgccgtttgtgcagtgagctctgtgctgggtcccgcgtccttgcctctcctttgcctctcctggaagtaactcgagctttggctgtttctccattgacttcgcgcaaagattgcgaagaaagaaacgcggctggggaagcggggttccctcaccgcagcccacccgggcctccttccgcgacttccctcttagtcagggcctcagtacgcctttgctttgctggcagcgagcgctgcagcgccgcagcccgaccccaagcctcctacaagggggtcgcaagtcccagcagc

SEQ ID NO: 31898 - DNA, 165 bp, Homo sapiens
  chr8:37656049-37656214
  hyper
cgcagctccacgcacgccgtggatttgagggtcgggcccccgcggccgccgcttcctttcctgtcccaaatccagcctaagagccgcttccctttccctgtcctcctgaccccagtggcaaccgtttctccaccgccccttgcccgcagtcggggctggcccagt

SEQ ID NO: 31899 - DNA, 692 bp, Homo sapiens
  chr8:37822717-37823409
  hyper
gacccacggacacatcgcatgcttcccgaccctgagccgccggtccctctgccccggttacctacccgtcgagccgttggcaaagcctgggctgcgctgggctgctccgggccgcaggaacgcccgaggggaagagggccgggcgggcggcggcgcagggctccggaggcaggcgacggccgcagcggcacagaagacggcggaaggcgctgcgaaagtccgggctgcggcagtagatgagcgggttgaaggcagaattggcataacctagccagttcagggcaaggaaagccgggcccgggactagagaggggccccccagggcgcgcagcacgttggccagaaagaagggcaaccagcagagagtgaaggtgcccatgatgagacccaaggtgcacagggcccggtgttcccggagaggcaggaggcgcgcgggccgccggccgcaggcgggcaccccttcgggcggagcgcacgtccccaccggggccggggccagagagcgcgacggcgccggcggagactcctcgggcggaaagcggcccagctccccgcgcagcaagcgcagctggcgcgtagccaccacgaaaacccgcgcgtagacgaagagcatcacgagaagaggaaggtagaaggagacggaggaggacagcagcacgtagggcatgttggaggcgaaggcacagcagcgc

SEQ ID NO: 31900 - DNA, 65 bp, Homo sapiens
  chr8:37823410-37823475
  hyper
ggttggagtggcagcgctgcgcctcggcgtcggcccctacgcgccaccactggctcatgatgggc

SEQ ID NO: 31901 - DNA, 56 bp, Homo sapiens
  chr8:37823476-37823532
  hyper
caaacgacaccgcggccgacacgacccacaccaggaccacagctgtccgggcgcag

SEQ ID NO: 31902 - DNA, 389 bp, Homo sapiens; identical to SEQ ID NO: 769
  chr8:38008209-38008598
  hyper

SEQ ID NO: 31903 - DNA, 328 bp, Homo sapiens
  chr8:38323407-38323735
  hyper
tcaccttaattaccacgtctagagaaagtgcgatttcattacagcctccaaaactaccgcccaaagaaggaaaccagagaagtgttttcaatttgaaagaggctggaaagaagcgggtaagacaccgactctccccaccctcccggcaactttggaccacaaggcgctttcctgcctcaaagactattaccaaacacaactcgaaaatccaaccccgctttcaaacctgtagccgttatttaaacggtaaaacaccccactttagtttccgggggatgcggcccaaatcagtccttaaaaacacacagagagcgcctctggcagcagc

SEQ ID NO: 31904 - DNA, 400 bp, Homo sapiens
  chr8:38323755-38324155
  hyper
cgcaccgggcttgctccgggaggggcgcgtgacgccaccgcggggcagccgagaggggaccgcgggctccgggcagggcaggcgctcccgcagctccagctataacacaagggagagaaagcaacgctttggttccagaaacttccatcgtcaaggccagttctggccagacgcacagccaaagagcccccctagtctagcggatgaaccgttcgcgagtggcaccccctaaaaccttggccccatctcccaagatgcctctttactgcgcaatccagaaagcacccggaccgccgccacccaccagcggcggcgaataacttggtgagatcttaaataactcgggatccaagggaactttcttttctcccccgaatctcaacgccgcatctccaagtct

SEQ ID NO: 31905 - DNA, 61 bp, Homo sapiens
  chr8:38324661-38324722
  hyper
gaaccagattgggaccgaacggtccttccgcccccatcccacacctcggcttaacgaccgt

SEQ ID NO: 31906 - DNA, 279 bp, Homo sapiens
  chr8:38325771-38326050
  hyper
ccccctcctccagaacgcagcggcggcgcctcactttccttgcagaccgggctccatcgccctgcggaggccccggcgccgcggcgtgcccgactgcagcacgggtaccgtgcgccctgcggggcgccccgagctcggaccggagaaaagtccttgggttccgcggcttttcaagcagcggcgcgctcgcggccggggaaggcgaggtcgccgcaatgcgctacgaggggtctcggtcccgtccggacgtggccgcccagctcccggcacacccgggtt

SEQ ID NO: 31907 - DNA, 33 bp, Homo sapiens
  chr8:38326276-38326309
  hyper
gcgggccgagctgtccggcgctctgcccttctc

SEQ ID NO: 31908 - DNA, 45 bp, Homo sapiens
  chr8:38614816-38614861
  hyper
aggagggtgcagccccggccccaagttctgcgccatgggaggctc

SEQ ID NO: 31909 - DNA, 26 bp, Homo sapiens
  chr8:41165893-41165919
  hyper
cagagctgccgctcccgggccagccc

SEQ ID NO: 31910 - DNA, 152 bp, Homo sapiens; identical to SEQ ID NO: 3231
  chr8:41166000-41166152
  hyper

SEQ ID NO: 31911 - DNA, 414 bp, Homo sapiens; identical to SEQ ID NO: 3232
  chr8:41166266-41166680
  hyper

SEQ ID NO: 31912 - DNA, 244 bp, Homo sapiens; identical to SEQ ID NO: 3233
  chr8:41166745-41166989
  hyper

SEQ ID NO: 31913 - DNA, 332 bp, Homo sapiens
  chr8:41167025-41167357
  hyper
cgcgcagccaatcagctcccggcggggcgagccgcactcgttaccacgtccgtcaccggcgcgggagccaatcgcctccctcgcgagcgggttcggtttactagaaccagacgcggctcaacaccccttaaaaaacaaaaccaaaaatacataaataaaagggggaggaggaaagagacaaggggagaaaaagaaggggaatggatcacggcgtggggtggagagagaccagggcggacgctgtaattaactcgcattggcttgcagagaagcggggagcctggatcatacttgcaaacccatgaaattatgaagactttttttttttgaga

SEQ ID NO: 31914 - DNA, 197 bp, Homo sapiens
  chr8:41424669-41424866
  hyper
ctacctctgctgcagcgtacctcttccgcagccctagcggcctccccgaggggcgccgcggcctcggctgtccctcccctgcctggcacgaccacctgacccccagcgacccaagaagcaagttgtgtttgcagacgcaaaggggctgtcgttggtatcggtgcactggtttgaagccactgcgggcacagcctgaa

SEQ ID NO: 31915 - DNA, 467 bp, Homo sapiens
  chr8:41503858-41504325
  hyper
aagactcagtccctgcgcccccaggagcgtggggaaggggaggggaaggtaggctcctcggcgtccccccgcaggctgcagccaggatcccgggcctggacggcgggcgtcagacgctgtgcgctcccaggctgagcaccgagaaggcggcgcggtgcttgcgcagcagcaggcggatcttctcgtcgtccgagtcggggtccagcggcttgttgtactcgtcgtcctcgttctccgagggtgcgcggtccccgcctgcgcctgcacccgcgccgcccggggcccggggcgtggaggacgagggctccagggcgctcttcttccgccacttggtcctgcggttctggaaccacacctgcgatgagaaagaatgtgaagggcacaggggcacagcgcgcacgggacgcgagaacagccatcctgcttttacagctaaacaaatggctcaacaacggagtgactgtcac

SEQ ID NO: 31916 - DNA, 55 bp, Homo sapiens
  chr8:41511052-41511107
  hyper
tggagctgcggggtccgcgggggcgctaagggggctactgggttggctgcagcag

SEQ ID NO: 31917 - DNA, 84 bp, Homo sapiens
  chr8:41511147-41511231
  hyper
cgagccctgagcccagcttccttgggccgtcaccgaatcggtcccagccgcgctgtgcggcccccctgccgtggcccccgggat

SEQ ID NO: 31918 - DNA, 63 bp, Homo sapiens
  chr8:41511489-41511552
  hyper
agcagggcccctctccgctcacaggccccgcggccagggggcctctgacgtggagggggcttc

SEQ ID NO: 31919 - DNA, 15 bp, Homo sapiens
  chr8:41624546-41624561
  hyper
gcggctccacgctcc

SEQ ID NO: 31920 - DNA, 451 bp, Homo sapiens
  chr8:41624633-41625084
  hyper
cgcagccttcaggccagaggaattttcctctggatcctgctagaagcctcggcagcagaagggcagccccagcgcgcgcacccgcacccgccggggaaagttggcgccgggcagccgggcgcggagccacaacccgcaggacggacgcagagccccggccccggccccggccccgatccccgcgccccggccccggccgggcaaccgcgacagctcgtgcactcaccgcagggtctggcccggacctgccctgtcgcgctgccatcgtccggcgcccgcgctgaaatccgagcccggctcccgctccccctcccggttatctgctgggcggcgcggggagcgccagcaagttacgcggcatctggctaaaaatacaggcgccctccactcgccccggcccggccctggccctgcgctctcccgcccgccagcctgccgctaatgggatctc

SEQ ID NO: 31921 - DNA, 30 bp, Homo sapiens
  chr8:41625311-41625341
  hyper
tccctccctgcctcccgcctccccgaatgc

SEQ ID NO: 31922 - DNA, 30 bp, Homo sapiens
  chr8:41655464-41655494
  hyper
tgcttgtctaaaagtcgctgggtgcagggg

SEQ ID NO: 31923 - DNA, 144 bp, Homo sapiens; identical to SEQ ID NO: 9488
  chr8:41686308-41686452
  hyper

SEQ ID NO: 31924 - DNA, 239 bp, Homo sapiens
  chr8:41733415-41733654
  hyper
ttgccttcatttctccggctgcatccgaggctccccagaggggccggcgcgcgcccgggcgcacactcgcacacctgcccgcgcgcacacacccgcgcctggccccgcgcgcgcacgtcccgcgacctcgcaggttcgcggcccgcaaccggcagggcaggagcttccaccaatcccctcgcctcacgcctcctgcccaaatatagaaaccgacttccttgtcctagagctcggagcgg

SEQ ID NO: 31925 - DNA, 92 bp, Homo sapiens; identical to SEQ ID NO: 9490
  chr8:41733684-41733776
  hyper

SEQ ID NO: 31926 - DNA, 428 bp, Homo sapiens; identical to SEQ ID NO: 3235
  chr8:41753325-41753753
  hyper

SEQ ID NO: 31927 - DNA, 411 bp, Homo sapiens; identical to SEQ ID NO: 3236
  chr8:41753770-41754181
  hyper

SEQ ID NO: 31928 - DNA, 1026 bp, Homo sapiens; identical to SEQ ID NO: 3237
  chr8:41754182-41755208
  hyper

SEQ ID NO: 31929 - DNA, 30 bp, Homo sapiens
  chr8:41755524-41755554
  hyper
cacaggacctccccccgccgccccccccaa

SEQ ID NO: 31930 - DNA, 129 bp, Homo sapiens
  chr8:42009878-42010007
  hyper
gggaccactcaaaagcgtatccaagtcctgaggtctccaaagcggtggagagacccgcccagcccctcactccccggctgggaactgagattgtggagggtgggcgccctgccgcggcccagtggggct

SEQ ID NO: 31931 - DNA, 88 bp, Homo sapiens
  chr8:43102486-43102574
  hyper
cgccgcagaggtcgagcgccgccagatgcgcagaagccgggacttgtacgcccgcgacaggaaagacaggcagcggggcctcagctcc

SEQ ID NO: 31932 - DNA, 527 bp, Homo sapiens
  chr8:48100170-48100697
  hyper
gctgcagccgctgcacgctgcacacacacggcacagtccctgggtccgggagccagagcagcgccactcggagacgggatggttccgtgggttgtgtaggagcacaggaaagcggaggccgggccacacagcaccgcgaacccagcagcccaagcccagcggaccaagcagccacccccgggagccgccactgcctggagcagtcaccggcgggagcctccatttccaggagccgccaccgctgggagctgccacagccgggagccgccaccgccagaagcctccatctcccgggagccgccatcgctgggagccgccacctccaggagccgccacggccaccgggagccgtcaccgcagggaacctccatctcctggagccaccaccgctgggagctgccacctcaggagcagcggcagcactgggacccgccgggccccctcgcacccagcggctctgcaggtgccctacacccgggaggggccgagggagcccacgccgccggcgggaccgcagggatttgctg

SEQ ID NO: 31933 - DNA, 659 bp, Homo sapiens
  chr8:49292866-49293525
  hyper
aaaggttgacaagagcggggctgggctccggcatgggcgcaaaaacaccagtgcggaggagttctcgggaccccccggggctgcggggccttgcggggacagccccaggcccggagctgcagaaacacccagaccccgcgcctcccggaaccacgcgtctctgtgcacagacattcctgggggcaggctcctgtcctttaacacagtctcaaaggagtcttcaaaaacaaaaagtttacaagcactgatagggaaaacagaaggatgataacaccaagagggactttcccgggagaggacggcttccagggactgagaaaggatgggcaagtgggcggggcccggcgccgtgcgggcagggctggcgccgggagtccccagactcccccgcagtgggaagcacctctcccattcacgccgggcaggacacctggccgggcgggggaggcagcgcaagggccggccggggagtacgggactcgagccggggacctgaggcaggagccaagcatcgtcgcagggcaaccagcagaacggagagggaggcgcgggggcgaaggctggcgggagccgcgctgagggcaggagcccggagccccctagggcagcgccgatccgcccgccccgtcccgccgagctgggcctccgtctgtggcctg

SEQ ID NO: 31934 - DNA, 37 bp, Homo sapiens; identical to SEQ ID NO: 3239
  chr8:49293580-49293617
  hyper

SEQ ID NO: 31935 - DNA, 99 bp, Homo sapiens
  chr8:49309361-49309460
  hyper
ttgggtgagagtctccgggtgactccccgcagctccccctgctctcacctccaccggcctccccccgccgtggttcccgcggtgcgccctccccaagtc

SEQ ID NO: 31936 - DNA, 160 bp, Homo sapiens; identical to SEQ ID NO: 770
  chr8:49468668-49468828
  hyper

SEQ ID NO: 31937 - DNA, 362 bp, Homo sapiens; identical to SEQ ID NO: 771
  chr8:49468829-49469191
  hyper

SEQ ID NO: 31938 - DNA, 36 bp, Homo sapiens
  chr8:49647817-49647853
  hyper
ctcagttactgatctcgtgcgcggccctaacagacg

SEQ ID NO: 31939 - DNA, 189 bp, Homo sapiens; identical to SEQ ID NO: 9502
  chr8:49782697-49782886
  hyper

SEQ ID NO: 31940 - DNA, 148 bp, Homo sapiens
  chr8:49782922-49783070
  hyper
cgacgggcatcctgccctgcggaacacccacccgagccctgcgcgggaggggcggccgggaggcgcgcgggcatgcggaggggaaacagggctgcagcttcaagcccaggcaggacgcccttagtcaccttatcggaaagtgggcagc

SEQ ID NO: 31941 - DNA, 185 bp, Homo sapiens
  chr8:49833801-49833986
  hyper
ttgaccaggaaggagcgcggcatcttgccagcgggtctggcgggcgcccggcgcggataacggtccggcgggaggacacggcggtccctacagcatcgcggcgggccaggctcgggcaggggccgtgctcaggtgcggcagacggacgggccggcgcctctgaagtcacccggctcctttacgaa

SEQ ID NO: 31942 - DNA, 49 bp, Homo sapiens
  chr8:49834319-49834368
  hyper
cggggacacagtgtccgccaggagaaggaagggccgccctgcaccacac

SEQ ID NO: 31943 - DNA, 88 bp, Homo sapiens
  chr8:49834627-49834715
  hyper
aagtactcatgtcaccgtgttagctatggtggcttgaaagaaatgctttgtagccctctaaaggcaggctgatcggaagaactggaag

SEQ ID NO: 31944 - DNA, 281 bp, Homo sapiens
  chr8:50822066-50822347
  hyper
cataaccttaagcaacgttttcacatggactgaaaagcaaaagacccccttaaaaattagcctcaagcagcagatactctctttttaggtttgtgtgtctccgtgaggtcagatggattccccaaacacggttttagagagaatcacaacctttaatagatcctctgttaaaaaagactgttagagaaagttgaccaagggcttcgttccacggcgaccgtttcctgcgtgtgcagctccacacagcgaccgcggcctgcaatgtgcggagcacagcgcgg

SEQ ID NO: 31945 - DNA, 30 bp, Homo sapiens; identical to SEQ ID NO: 9506
  chr8:50822561-50822591
  hyper

SEQ ID NO: 31946 - DNA, 323 bp, Homo sapiens
  chr8:50822821-50823144
  hyper
gagaaattagtgttgcgccccgcccctcccggacccccgtccccaccacacacaccagcgcccctcaccagtctttctcgaatttcctctcatgtctatcaataacctccttgtgcagaaatctacactgcacaagttaggagtctgcaagggcgggcggtgttacagtctcgctctttccattttccccttttactccacatagtttcaaaggtccacatggccctggttttgaccagttttccaacagtttcaacgttatgtatttcaacttcccgtctcagttcactggcgtctgcacccgttgccgagtgtgggtggct

SEQ ID NO: 31947 - DNA, 126 bp, Homo sapiens
  chr8:50823361-50823487
  hyper
aaaggcagagattgtcgagccctctgactgtctttgtgccttctttatcccgtcctttgtgaaataagccgttttctgcccccactgcaggagcctaggctgtgggcgactcgctagcactgccct

SEQ ID NO: 31948 - DNA, 174 bp, Homo sapiens
  chr8:50824134-50824308
  hyper
gaaaaaaaaaagaaccggaggggagaaggctagggcggaagacaaggaagctgctgcttggattcgctggtggaggaaagtgcgacctggacctgcgcttaggggctcccgtccccttacttcagcaccagaggggatggacagcgtctccggactgagctgcagccacaggga

SEQ ID NO: 31949 - DNA, 20 bp, Homo sapiens
  chr8:50824352-50824372
  hyper
cgccacgggcagctgggcta

SEQ ID NO: 31950 - DNA, 49 bp, Homo sapiens; identical to SEQ ID NO: 9511
  chr8:53477121-53477170
  hyper

SEQ ID NO: 31951 - DNA, 304 bp, Homo sapiens
  chr8:53477433-53477737
  hyper
tacttaactctcaaccgtggtaaatctaattcgcttacgacctctttccgagagctgggaatctgcagagatgctctgttttctgctgtactaatctcaggcttcccaaagcgagtgcctcgcccagctcctaggggaatccacggagccccaggcgcagggcaaaggatggggcgggatggggacatcgtacctgcgctccgggagccgctgggagtccggccggccccggccgcggggaggaaaagcaacggcttgggctccttatccgtgacgcgcgctcccctgcgcccccggggcctcc

SEQ ID NO: 31952 - DNA, 301 bp, Homo sapiens
  chr8:53477944-53478245
  hyper
cgcgcctgcccttgtctacgtcccgggggtcggctggagctgcactgggactcggtcctcagtgtgccgaagcctaagcgctgcggggcgcggggcgggaacgggaggcggtgcctggggccacggggtcgtcccccaggatgagggcgtgtcccagcgcgcgggaccctcggaagtccgcgctgggccgggcgggcaccagcctcggactcagcgggtctcagggctccctgcgcaacgcctgcctcggatccggaccccgggctcgctctctggtcgccgtccccgggaggacccagta

SEQ ID NO: 31953 - DNA, 5 bp, Homo sapiens
  chr8:53478449-53478454
  hyper
ggtgc

SEQ ID NO: 31954 - DNA, 185 bp, Homo sapiens
  chr8:53478455-53478640
  hyper
ctctgctgccgagcccctgctcgctcaggaacactggccacgccgtcacgccagccgcccctgccccaggtctggaggcccgacctgctctcctaggcgcagcaccgcgttctcttccgcgtgggggagcggcgggcggaagaggtctggggctgggcaccggggacacgcgcccagctcccctg

SEQ ID NO: 31955 - DNA, 48 bp, Homo sapiens
  chr8:53852136-53852184
  hyper
acaggtagcagagagcgctcacgtggaggaggtttggggcgccgcggc

SEQ ID NO: 31956 - DNA, 715 bp, Homo sapiens
  chr8:53853744-53854459
  hyper
ggtattgctgggaaccgccccctccctgccctgctccctgctgccccacccgagccctggcagtctggaacctggctggagtcggaactctccgcgccttcgaagggaggcccgaggacgctgccggcgcccccaggcgtcggctccgcgcggcccctgctgtagctggcgcacagccccggcgggtccccttgtcctccgcgcgctctgggaagacggtcaggcgcgcgcgtttggcgcccacccctgtgagacccgcttggcctggcgccgcgggcggggaccgctgccgaggccgccagcgcctcttcaactggggaaaacacaacaactcgggatgccccatcggagtgtgtatacacctgtgtgtgtgtgtgtgtggtgtgcgcgcgtttgcggaggcatgaaatgcggggaaagaggctggcgcttggcagtgactgcctagaatatgatacgaatagtgatccttctttctgtctgcccctactccttttctttgccttttccctttcctatccgtgatctcccctgaaaatgtcagactcccggagcaaggaacccggagtagcccgggcgcgcggttccggcgccccctggaggagccagcggccgagtgcttagcgtcggaggatcgcggggctttgtggtggagcactccggctgagcgcgcttcacagcgctgtggcacactggtcatcgttgcttatagagg

SEQ ID NO: 31957 - DNA, 15 bp, Homo sapiens
  chr8:54163335-54163350
  hyper
ctcaccggatgatca

SEQ ID NO: 31958 - DNA, 185 bp, Homo sapiens
  chr8:54163673-54163858
  hyper
cggagaggcaaactttgcccgcgccctggccagcggcgctggggacccggagcctgcggactcccacccgggccgcaagtcgccgggggcaggacagggagaacggacttctcgctgcctttccggccagcaggcgcgccgctgggtgccagagaggggcgaagagcgctcgctccttctccccc

SEQ ID NO: 31959 - DNA, 8 bp, Homo sapiens
  chr8:54164119-54164127
  hyper
cccggccc

SEQ ID NO: 31960 - DNA, 30 bp, Homo sapiens
  chr8:54164557-54164587
  hyper
cttatctgcatagttcgcagtcaggaacta

SEQ ID NO: 31961 - DNA, 39 bp, Homo sapiens
  chr8:54570523-54570562
  hyper
atcagaaagagaaagcgctcagcgcgtgttgcttagcag

SEQ ID NO: 31962 - DNA, 211 bp, Homo sapiens
  chr8:54789099-54789310
  hyper
tgaagtgcagcccttcgggcagctgaaggtctttctgcagataacttttctcagatcgaattttttggctacattgatactcttcggctctgtccttgccagaagttcggaaggattccagcgccccacaccttgcttgattcaccctcatcccctcccctaactggagaagccgctgggtcccgcgccaggctcgcggtggcttcagagt

SEQ ID NO: 31963 - DNA, 240 bp, Homo sapiens
  chr8:54789566-54789806
  hyper
ggagaaaggaggttacgagttcgcacgttctcacaaaaccatttgaaaacatgagctggagacgccaaattctgggacccacgaaaggctttggagctcgctcgggctcctcgaagttgggcgtgcgtcgcagaacagtgctgggcgctctctttcagcattttcggcttttttcaagcccttgcgtagggtcgggaaggccgtgggtgggctcagtcaggctttaggtcgccaggaacc

SEQ ID NO: 31964 - DNA, 785 bp, Homo sapiens
  chr8:54790022-54790807
  hyper
ggaggggcgcgtcccctgtcctcctcccgagcgagacgaacgctcagcagctcgttccctgggcgccaagaccgatttccaagtcgcccactttccccctcgagggagctgttggcgcttctccagaagcctcctcggctcccagctccagcccctaaaataaaagcaccttgccagagagcgggggaggggagcagctgaacgaggagaatgaaaatactgggagaacgaccccattctccaggaaaaggtaatgaggggaagtgaaacagtgtgaacttactcggaaatgcaaaccgagttcaactcacccaggagcaaacaaacgacagcaagacaaatcagccaccgcactcgcggcttcccagaaagggcctcatgaatgagaatgggttgctaggtttccttccctctctcctgacaatcgcttcccacaagacttccaccgccgaaagaatacaggccgggcctggtgactgcggagtgagggaaccgcgccaggcccacgaggccgctcgcgaccgctcccgccttcaggaccctggagagcggccgccgcgcccctgggacccacgcccaacccagaacacccgcgctcgcctcccgcgcctcaccaccccagcactttattcgctgcttcccgcctccaccttcattttttttggcaaccaccgctcttgtttttcacagacagattaaattgttttttgtttggcatgagggggtgtttggattggccgagctacattccggtttgtaactacactaaacgttagtgtaccaag

SEQ ID NO: 31965 - DNA, 15 bp, Homo sapiens
  chr8:54791767-54791782
  hyper
ggacaccacagtaac

SEQ ID NO: 31966 - DNA, 49 bp, Homo sapiens; identical to SEQ ID NO: 774
  chr8:54791897-54791946
  hyper

SEQ ID NO: 31967 - DNA, 487 bp, Homo sapiens; identical to SEQ ID NO: 775
  chr8:54792184-54792671
  hyper

SEQ ID NO: 31968 - DNA, 427 bp, Homo sapiens; identical to SEQ ID NO: 776
  chr8:54792701-54793128
  hyper

SEQ ID NO: 31969 - DNA, 1432 bp, Homo sapiens
  chr8:54793349-54794781
  hyper
ggtggagtgcgccgccgctggagggaggcgagacgtgggattgcccggccgggtaaaaggagtgagggggcggggaggaggcagagcaaggggaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctcgtgagtatcccagttcctcgaactctctttcttcgtctcgggctcgccctgaggcttcgtgctggaaagtggccgaggctgggaggggcgcgccgctcgtccggacctcagggtgtcgccgttgctgcggggcgggagccggtgcgagtcgggggttccttcccgcagtgcgagtttgggggagtggggctgcgagtgcgtccgcgtgcgaagaggggcatcgcgccaccaggatcaatatgtcccgggcctgccagggcgtccgcgattccacctctgcggcttcgcgtcggtgtcttggtggggaacgcgggagtctagtctttagaccctagaaatcgcattgaccacccgaagcgtatttcggaaagaccaggcgggtggaagcgtcggctttctcacgggatagggagaggacaaggaaggggttgggcgcccggggctggtggtttgagcgccgctgggaagggtaaggagacagagcctcctggaatcgtagcgcctccttttaggagaagtgcaaccagggcaggggcaccgaggggcagggtgaggaagtggacgccccacgcgtggaccctagaagaccgactaggtatgggcgttcactcggagcctctgttcacgctcttgaaaaccgaatgaacagagaagtgccctccacccttcgcctgcgccagggcagttaacgtgcaggcgccgccgggattttcctggaacaaacccgggcacttgatcttccgcaccctcggagctgccctgggaagtcgaaacaagtctgggcgcccggactgcggagactggaaagcagggggcggagggcgggagactgggggcgggaagtggaggtgcaggctgcagctggggaccgcggtgggcgttggaggggagggtctgtgtgcgcggctgtcctccagcgctgggggagcggacgggccaggggcctctagggaagcggcgctccgggaccggggtggctttcccgtctctgtgtgcgcggcgatccccacacccagctcgggcggaggagccctgagagaagcggctagctgagagtggggtgggcgttttggggaaaggtttgcgtgcgctgcggccctaccgctgctagagaagtggaagagagagagtgggcgc

SEQ ID NO: 31970 - DNA, 124 bp, Homo sapiens; identical to SEQ ID NO: 9528
  chr8:54794826-54794950
  hyper

SEQ ID NO: 31971 - DNA, 42 bp, Homo sapiens
  chr8:54795139-54795181
  hyper
cgtaacttggcaaaagctcgcgccactgccctccggcctggg

SEQ ID NO: 31972 - DNA, 232 bp, Homo sapiens
  chr8:55366136-55366368
  hyper
ctaagaaacactccacggatgagtttctgaagagggaagtggaccgggaacagcgcatttcctgcttcgcctgtgcaaatcccaggcggggccaagcgggaacggggacacggtctaagagtcgcccgctgccagggaggggttggggggcagcctcgaggggacaccgcggaaccagggagggatgcgcatggagggagtgggagaaggcgtccaagtaaaatgcatgctc

SEQ ID NO: 31973 - DNA, 690 bp, Homo sapiens
  chr8:55366951-55367641
  hyper
cgcccccacagacttgctctccagcgccaacccggatctgcctaggtgcccacgggtccttcccgatcgacttgagtgtccttcctccagcccctgctttcccagcatcgaaaacacaaaagcctgccggaaatcacccagcctttgcctggtcactcaggggcccacggataagcgtggctctgattcctccaggtcagccccacggttcgccacctacccgagttaatttctgcgcccgctgaccaaaggccccaactggcaacgggcacagcttcttggtgcgctagtcgcttccttgcccagcctttagagcctcgggtccggcccaaggacccggggacgtgagcgcaattagtagccaggagccctgcgaccctggaccgtgcagtgctaacgcacccgaacggctatgcgagcggtgtactcggctcttacttgtgaaagttgtttcccccaaccccctgcgtaaatctcttgtgttgagaaaagcaaggcttgcaggaagccactccggatgtttgctgctttacatgtggcatctgtggctggctctgataacgtcccggggcaccacgtattaaagtgaagagactgaaatagaaggctccacacaccgcgcgcgggtcagcgacgtcgccgccctccacactgccccccgaaatataagacaagcgaatgatcagaaga

SEQ ID NO: 31974 - DNA, 223 bp, Homo sapiens; identical to SEQ ID NO: 777
  chr8:55370113-55370336
  hyper

SEQ ID NO: 31975 - DNA, 86 bp, Homo sapiens; identical to SEQ ID NO: 778
  chr8:55370337-55370423
  hyper

SEQ ID NO: 31976 - DNA, 9 bp, Homo sapiens
  chr8:55370424-55370433
  hyper
ggaccggcc

SEQ ID NO: 31977 - DNA, 147 bp, Homo sapiens
  chr8:55370567-55370714
  hyper
cggcttcgggccgggagacccgcgcagccctcggggcatctcagtgcctcactccccaccccctcccccgggtcgggggaggcggcgcgtccggcggagggttgaggggagcggggcaggcctggagcgccatgagcagcccggatg

SEQ ID NO: 31978 - DNA, 198 bp, Homo sapiens
  chr8:55370835-55371033
  hyper
cgaggcgccggcgaacagcggagcaccggccggggccgcgggccgagccaagggcgagtcccgtatccggcggccgatgaacgctttcatggtgtgggctaaggacgagcgcaagcggctggcgcagcagaatccagacctgcacaacgccgagttgagcaagatgctgggtgagtccgagtcgcagacccaggcggc

SEQ ID NO: 31979 - DNA, 204 bp, Homo sapiens; identical to SEQ ID NO: 781
  chr8:55371172-55371376
  hyper

SEQ ID NO: 31980 - DNA, 286 bp, Homo sapiens; identical to SEQ ID NO: 782
  chr8:55371439-55371725
  hyper

SEQ ID NO: 31981 - DNA, 75 bp, Homo sapiens; identical to SEQ ID NO: 783
  chr8:55371993-55372068
  hyper

SEQ ID NO: 31982 - DNA, 122 bp, Homo sapiens
  chr8:55372416-55372538
  hyper
cgtgtgcaagcctgagatgggcctcccctaccaggggcatgactccggtgtgaatctccccgacagccacggggccatttcctcggtggtgtccgacgccagctccgcggtatattactgca

SEQ ID NO: 31983 - DNA, 29 bp, Homo sapiens
  chr8:55379202-55379231
  hyper
ctcttagcttggtgccggggcccgcccgg

SEQ ID NO: 31984 - DNA, 162 bp, Homo sapiens; identical to SEQ ID NO: 3261
  chr8:55379295-55379457
  hyper

SEQ ID NO: 31985 - DNA, 108 bp, Homo sapiens; identical to SEQ ID NO: 3262
  chr8:55380036-55380144
  hyper

SEQ ID NO: 31986 - DNA, 24 bp, Homo sapiens
  chr8:55380175-55380199
  hyper
cgtgtttagcgattctcatattta

SEQ ID NO: 31987 - DNA, 14 bp, Homo sapiens
  chr8:55383182-55383196
  hyper
ggtgccgacttcaa

SEQ ID NO: 31988 - DNA, 252 bp, Homo sapiens
  chr8:56013641-56013893
  hyper
gagtaagggaggtggcgcctgctccgggctccgccactccccgcccgcgggccgggggtggggtggcactcggtttcccgcggctgccggccgcgccccgcgccgccgccaggggtgctgcgcttcccacctgccgcaggacgcctcgagggccggtgcggtgcccactgggctgccgctcctcccggctcagagctttccagccgccgagaacgtgcgagggaccccggcgtcgggcaggggcctgggccg

SEQ ID NO: 31989 - DNA, 58 bp, Homo sapiens
  chr8:56014127-56014185
  hyper
gcctccgagcccgggcgcccgagttacacccattctccccaccatcgtcggccagagc

SEQ ID NO: 31990 - DNA, 368 bp, Homo sapiens; identical to SEQ ID NO: 3264
  chr8:56014376-56014744
  hyper

SEQ ID NO: 31991 - DNA, 19 bp, Homo sapiens
  chr8:56015034-56015053
  hyper
ggtgtggaggcatcatggc

SEQ ID NO: 31992 - DNA, 172 bp, Homo sapiens
  chr8:56015185-56015357
  hyper
cgaggaggcggccgggggcggctgctgcccggacggcggcggctgctcgcgctgctgctgctgctgcgccgggagtggcggctccgcgggctcgggcggctccggcggcgtcgccggcccgggcggcggcggggcgggctcggctgcgctgtgcctgcgcctgggcagggag

SEQ ID NO: 31993 - DNA, 102 bp, Homo sapiens
  chr8:56015560-56015662
  hyper
cagcaccgaggacagcgccacggccgctgctgcctccagctgcccgcagcctggagccgattgcaagacggtggtcggcggtgggtctgcagccggggaagg

SEQ ID NO: 31994 - DNA, 50 bp, Homo sapiens
  chr8:56015749-56015799
  hyper
cggggctacccgggccagtggcaagcacaggtctgcgtcctgctccttct

SEQ ID NO: 31995 - DNA, 30 bp, Homo sapiens
  chr8:56792024-56792054
  hyper
tggaagggatcagagcgcacctcctccgct

SEQ ID NO: 31996 - DNA, 22 bp, Homo sapiens
  chr8:57025598-57025620
  hyper
ccccaaggcgctgcccggggag

SEQ ID NO: 31997 - DNA, 547 bp, Homo sapiens
  chr8:57025775-57026322
  hyper
cgccctctcctttcaggagctccggggcgcggtgggtgtatgtgcctcctagagggtaagagggtgtctggaagcacagcagatcttccaacttctcagagcaaccgaagtcactaattttacagacatcctgctcactgatcaagatgttcgcgggcttcaggtccaagtgcacaatgctttgcgagtggaggaagagcaggccgttcacaacatctagtgagtacttgagacactttcccaaacttaactgtcctccagtgcggcagtgaggctcccctgcgtccccctcagggtggccggcggcgccatagatgacttggtgtaaagtgacgttgccaccgaactccatgatgatggtccctaggctattggaccctgcgggcgtgcgcgtgctggcagccaccacgcgcacgatgttatcgtggcgcagccttgctacgttgagctcagcccagaaactccgccgagatgctagtcggttcttggtgcacttgttcacttgctttatggccacaggaacaccgcggtaagtcgccttgtacac

SEQ ID NO: 31998 - DNA, 55 bp, Homo sapiens; identical to SEQ ID NO: 3269
  chr8:57026501-57026556
  hyper

SEQ ID NO: 31999 - DNA, 185 bp, Homo sapiens
  chr8:57069553-57069738
  hyper
aaaaacctatgtggacgcatcaacagatgctgaaaaggcatttcctagaagtcggcagccaaacttggtaattcttgcgtgtgataaaggcagccgtctgttctgctcagaaggggtttcctaacaggaggggccgaatgcaggcgtcacatccacgccgccccaggtcgtacacctaggccgtc

SEQ ID NO: 32000 - DNA, 163 bp, Homo sapiens; identical to SEQ ID NO: 789
  chr8:57069850-57070013
  hyper

SEQ ID NO: 32001 - DNA, 143 bp, Homo sapiens; identical to SEQ ID NO: 790
  chr8:57070014-57070157
  hyper

SEQ ID NO: 32002 - DNA, 275 bp, Homo sapiens
  chr8:57232591-57232866
  hyper
caggaccgacgacctcggcaacttacccaggacactctccctagctgtccgcggagaagccggcctcgtctgccccaggcacccgagtccctggctcggagctcagtcaggttcaggtgtttatccaggcgccgcccaagtccaagggcgggactgccgcggcagcgccaggggtggggccggccgtagccccagtgcgcgacgtgggcagcactcccatcttctttttctggacctgcagatttaagaagctggaaattcggtggtggaaactg

SEQ ID NO: 32003 - DNA, 70 bp, Homo sapiens
  chr8:57358077-57358147
  hyper
acttctcggggttcccgaattcccagggttaaaacaaacttggtttgtgcggcgacaccgctacccttac

SEQ ID NO: 32004 - DNA, 198 bp, Homo sapiens
  chr8:57358464-57358662
  hyper
ggggccgagcaacagcagccaagtgcaaagtgtcaggaaccgcgccatggactgcgaggagagagggacgcgtgcttcgagcctgcctgggcgcagaacggggtccctcggcaggaccctcgccgcgacagcctcagcaggggatcgtcgagcaaaagcccgcaggaatgctcctttctggggccccgccctcccggc

SEQ ID NO: 32005 - DNA, 286 bp, Homo sapiens; identical to SEQ ID NO: 791
  chr8:57358806-57359092
  hyper

SEQ ID NO: 32006 - DNA, 408 bp, Homo sapiens
  chr8:57359259-57359667
  hyper
cgccccaatcgccggcgggctgcagctgacgcaggccctacgccagccccgcgccgacgccttcgcgggaggggtcggtcccccagcacccgcgcgccgctccccccgccgagctcgggtgggggccacagggggcgctcggtggctccccacacggccaggtgacaaacccaaggcagttaggaagtttggggagagtgagataggatcaagtttctccgcataaagtcactgaaattgcaccgtgggatgcgggctccagggagggaagcgaggtgggggcgtttggaaggatagatggactggcttagacttctggaatgtgctggagacccagcgggccggtgaacctgcccctttcccgcctcctccctgggccccctcgcgggtccccgtgggcaccaagca

SEQ ID NO: 32007 - DNA, 86 bp, Homo sapiens; identical to SEQ ID NO: 793
  chr8:57360540-57360626
  hyper

SEQ ID NO: 32008 - DNA, 37 bp, Homo sapiens; identical to SEQ ID NO: 794
  chr8:57360769-57360806
  hyper

SEQ ID NO: 32009 - DNA, 270 bp, Homo sapiens
  chr8:58907149-58907419
  hyper
cgggcccttcgcggccgcgcgtcctgggcccgttccgccagccccgtctgctctctacccgcggccccgcggcggcgaccgtgaacactcggcggcccctacagcccgctctcggcccttcgtccctcgcgggccccgactctccctccttgcagtcccccggagcctggctcccggctcgggccgcaccgccagggactggggtgagcggcccaggtaagactgggccgtgggggccgggagagagactgctgggcgggggttgggatt

SEQ ID NO: 32010 - DNA, 338 bp, Homo sapiens; identical to SEQ ID NO: 9561
  chr8:58907483-58907821
  hyper

SEQ ID NO: 32011 - DNA, 119 bp, Homo sapiens; identical to SEQ ID NO: 9562
  chr8:58907822-58907941
  hyper

SEQ ID NO: 32012 - DNA, 561 bp, Homo sapiens
  chr8:60030202-60030763
  hyper
atcaggtaaaaaagccgtttggtgatgactcgccaccaggcaaatgttgggagtcccaacgatttttcccgtggaatgcaccgagggtcgccatggatgtgcctgcaggggctgtgagtatcaggcagatttatcaccaagcgagagttgggcgtctaaaaggcccgcccagcgttttagagaactcaattctctctgccaacgttcatccaacgggactgcttagacacgtccaactagccctaggcgtgggcagtcgtgcccctgcgaccactctgggggaccggtccctgcgtgtcctccctctctgggatgagagagttcgagaagccgggagagtaaccccctccctcgtaccccctgactgtcctataggtggacccagccgaactccgcagcagcccaggccagcgccccacctccgggtcaccggcatgatccgcctctccccgggcccccgcggccctggcacccgaggtcagcgggccgtgggtacagctcagccgcggaccctgctccgcgagtgcgggagctttggacttgaacgcgacgtgctcgccc

SEQ ID NO: 32013 - DNA, 144 bp, Homo sapiens
  chr8:60030764-60030908
  hyper
gctcccaacaaacttgcaatttccgcgcgcaccccttaaacaggaactgttccccaaaccttgacccagctaccccgctgtgctctggcccgcggacctgtgtccgaacccgggctcggctgccggaaccggtttgagaaaaca

SEQ ID NO: 32014 - DNA, 548 bp, Homo sapiens
  chr8:60031146-60031694
  hyper
tattatttttttaaacgccccccggcaaacctaggcagggatccttagccgcgaacagcaggaaggaaagaatccgagcaaatcgtgtcactttccgcacaatcgcggtgtttggcaagcccccggagctactccacaatatttactacccaagcgcacgcaggctgcagcgggctgcgagccgagcgcgcccgggaccggcctccgccaagccggccccgccgcggcccggccaccgccgctcccctcccaggatcaagcagcaagaacacggtggaaacaaaagcagagcgttcaccttgttgcaatagtaggggtccaggcagggagaaggtcccagacagggagcgtcgggcgcagcggcgggctgggctggaggtggataaaatcttacgtccatttcactctcacatcaagcaactccttttctttttccttttttaaaaaaaagtgttcagcaaaacaagcttagacggaacagagtgaggtgtctgggctcaggagtaaaagaaacaccttccttccctcacatccgtttgtggtttgtt

SEQ ID NO: 32015 - DNA, 125 bp, Homo sapiens
  chr8:60032140-60032265
  hyper
ccagaggccggggaccggagaaaggaggagcggagaaggagaaggaggagagcacggcctggctgggacagaagcggtgggaccctgggaggcctccgctgtgcccgtgccgcgctcctcgggac

SEQ ID NO: 32016 - DNA, 269 bp, Homo sapiens
  chr8:60032490-60032759
  hyper
tcccctccctactcccggcccgtagtggaggtgactttcctgcgcagcgccgcttctgagggcggagaacccacagggagtgcgacccctttgcacgctgtgagtgggcaactgtccgagggactcgagccgatcgaagggtgaggaccagctcgcctgggggtggacggcctggaaaagccgcccctctttggcttccctctgccgcctgcagcccgcacccctccgagattcgtgccccactggacggtttgcgaaggctgaggctg

SEQ ID NO: 32017 - DNA, 512 bp, Homo sapiens
  chr8:61193203-61193715
  hyper
tctccaagccaaaaacgaattcttcacgctaacactgtcttcctcaggtgtttagtaaaatgtaccgctgctcttcttgactactcagaagacataaaaggtacagccacggcttggaggctagcccgccctccggaccgcagcaggtgcgaacgccagccctgcggaaggctcccgggtgagagcgcaggcggcggaagagcgcaggcggcgagcacgcctccctggagcgcctcccgcccgaaacgcaccaggggagtgggaaagtggcagagacccccgtgggaaagagggggcgtgggggtgctcggagcgcgcagcggcagcaggactcgagtcccgcgctcggcgagacactgacgccgccgcgggaccccggacaccccgactcgcggccacttaccttcctcgtagccccactccacaccctcctcttcttcctcctcatcctcttccttctcggggaaggcgacggtatcttcgatgaagctcaggtccgccatgggaaggcc

SEQ ID NO: 32018 - DNA, 49 bp, Homo sapiens
  chr8:61193716-61193765
  hyper
cggggcccctcggcgctctcggcagcagtgcctgcgccttcgctgggcg

SEQ ID NO: 32019 - DNA, 44 bp, Homo sapiens
  chr8:61573279-61573323
  hyper
cccggtgtcagttgacgcccttctccaatcgcccaagagaagat

SEQ ID NO: 32020 - DNA, 292 bp, Homo sapiens
  chr8:61822378-61822670
  hyper
ttggcgggctgggggcggcgtgcgccgagctgggcgcgagtggaggggccggcggctttgtgcgcccccgccagtgcccgcccgcagccccgccgcagcgtttaaccttgacttctccctcctcgcttctggcacgggaggaaagcctgtccagatgggcgtcctgagtgtgacgacgtcccctcccgcccccgcgctctcgcgcagatgtcgcacgctgccctgggtcccgccacaccgcccaccaaggccgcgggccctgcgcgcccggggcaggcgggcacatcccgca

SEQ ID NO: 32021 - DNA, 224 bp, Homo sapiens
  chr8:62200760-62200984
  hyper
tcgatgccatggctgcggcgtttcagcacttcggtatgtggacagctcccatctgcaatccctctgcactccatccctcccgcaccgcaccccgctccccgccgcctccgcggtccatcctcctcccggcgcccgctcagcctgcgcccccttacacatcagcacccccatctccaccatcaccgtcatcatagccaccatcaccagcgcggtaactatagtca

SEQ ID NO: 32022 - DNA, 793 bp, Homo sapiens
  chr8:63160462-63161255
  hyper
tatttatacctattccggaaaccttctccatttctagaaaaagctacgcatcttcttcttcctcgacttctcttttctccctcccggtgaggatttcaaagggtatgtgagaaaagaaccttaagccaggtctccccgcggcgtcctggctagtcccggcgccctgggcgggtgcatcgctccgccgcagcgccccttgccacccaactctgtccaactttccctttcagactccagcaggggcgccctccaggcaaccggctgtggcgggcagaagcaagctcggatgggagacccccgagctgcgtgcccagcgccggctcaacagacttgcccgcgcagcgcccgcgggccccctcgcatccgggcaggttccggagctgggccttgcgctccccggcgcccgcccaccctgggtgtctcgcgtcccggcccttcctccccggaacccaagctaacccaactcccatcctcgccacctctggggcagctcaactaagccgtgtcccctcccttgcaaacgcgtccgaccaccctcccaacccccagcacaaccctcagcaagaaagcccagctgggtctacccagttacaccggtcaacgagggtctccatcgccgccggccgccctaattcacgctcattcatattcattctcttttctctctgtccctcttcctttctccccaaagactcttaactagacaggccgatcctccccagcggcactccctttcattcttcccttcccaccacacacacacacacacacacacacccggacccagacagcc

SEQ ID NO: 32023 - DNA, 258 bp, Homo sapiens
  chr8:63161631-63161889
  hyper
catgggctgctgcaccggacgctgctcgctcatctgcctctgcgcgctgcagttggtgagtgccccgagggcccctgccccaggacaggtccctgctccaggaccggcctctgcgactccctctgcggttccgcagctcccggcaaggggcgaacgggtgaacagggcgctccgcccgcctcccaccctccccaccgcctggctgggctcgcactgctctccagccgcgggcactcgccaggtcgcccctgccctgca

SEQ ID NO: 32024 - DNA, 51 bp, Homo sapiens
  chr8:63998517-63998568
  hyper
agagtggtccggtagcgcgttgagctgcggccccgccgagggctgggatcg

SEQ ID NO: 32025 - DNA, 448 bp, Homo sapiens
  chr8:65281329-65281777
  hyper
ggggcctctggtcagcgctgattaataagtgttttttgttgtgaagtgttgaataatagaggatggccggtgacccagtaaggactaaaccttgcgctggtttattgtggcaagctgagaaaggggctttaggcccgggaccccaggcactgacccgcacacatcccgcggatcgcctattcattcgcacagccctccagtcgcccaggctcccattgtttgctgagcaacaatggagatttcgcagggaaagtaaagctcttttcagattcctctctgatgttttgcatttagggaaacaccgacctccactttttcccccgacattttccctcctggcatttaaagctgttcgttttcggggaaacttctgtgagtttcgcgcttgttcgaccaacaccagtgttaggaggaggcgagaccggtggaaaaaggagagccccagaga

SEQ ID NO: 32026 - DNA, 168 bp, Homo sapiens
  chr8:65281837-65282005
  hyper
tttagaggacgggagctgcctctagggagaaaggggaggggggaggggagaagaaaaaggaaagagcgcgtttcctcgccggggttaccggggtggcgcgggcttcgcggccgaggggctgccggcccggcccgcagctcctcgcggccggctgggaagtggcgggtc

SEQ ID NO: 32027 - DNA, 109 bp, Homo sapiens; identical to SEQ ID NO: 3277
  chr8:65282332-65282441
  hyper

SEQ ID NO: 32028 - DNA, 282 bp, Homo sapiens
  chr8:65283799-65284081
  hyper
ggtaaagtgcccacccggggtggtctaaagtcgtcaccccacagagcagattctgctgctaaccagagcagagagccgcaccttcccagcggcgggccccagtgcgcacagcgtgactttgcctcccccaggctcagcaagtcgttgacgatctttagcagtcccgcatcccaggtcaataaactggaaacggatagaatgagaatcatggatgagagataaagggcagcggggtgatgcgcatttcttgtagtgcctccaaaaaaccgtggtctctcgccg

SEQ ID NO: 32029 - DNA, 765 bp, Homo sapiens
  chr8:65286370-65287135
  hyper
cgtcgcgagcatgcttgagagccgccggctcagctccgggctgtaaggttggttcctggcaatggatggaaatcaggtcacagagatccctaagcttgccaggctctcagacacgcttgggagacagaatggaattggaaggagggatctgaagaggagggaggggatccgtgttcccccaccccgggcctagaatggagccccggccagccgcgggccgggccccttggttttcaggacttattcttgccggggttggctcgcacgccagcatcgcgccttcggtgcgtcttttatctccatctcaaatatgggatcttcttgggacgaggactgaatgagggtgggagagagggtgtgtctcacggcgcccaggagggagaaattgtggttctgagaaggtattttttggcctcttgaaaatgtgcaagaattccgcgggcccaggctttctttgtgtggcgggcagcgccaagcgctttgtgcttcacaaggagaaaatggcgagtcctattgtgtttaggccattttcttccggtactaggattttcccaagttcgaaatacttcttgagaaagtagccttctcgtgcccaagaaagtgtgaatcgctgaggctcggccccatggcctggcgtgggtgctgacctcagtttaaaaccaagggcctgttttcttaccgttggggtacttgtatcaaagcacagatatgaccggtttgtgcggatcggtgtcctccaaagatcaacagcggctcttggggttt

SEQ ID NO: 32030 - DNA, 304 bp, Homo sapiens; identical to SEQ ID NO: 9581
  chr8:65289049-65289353
  hyper

SEQ ID NO: 32031 - DNA, 759 bp, Homo sapiens
  chr8:65289592-65290351
  hyper
gagaggctggaagctcgacgtcttagggagctgcctgcgggcactgggttgacgccaagaggttgtcggcaagggcagggctcttgccctctgctgtacctaggctctgcaactgggggctgcgagccttctgcggctctttggtttcaaggacacagcgagctgctcaggactttgggagccaacatctgtctgactggtgacgtcagcagcccgtgtaatcctcttgtgctgaaggcagatgccttatttgtttggctggagcgagccattaatccctaattctggatcagcaagcgagggggaaagaccggaccgctccgacccaccccctccctacccccacctcccaccttaaagcaccttataccacggaaggctctcagcctcttctttcctctgcgaacgcgctgagcagcgattgaaaacgttttggtcctctgcaggtttgaacagggctagcaggtctctctccggatttctagggctatgggtatatgtaattctttctctcatcgatcgtttcgattctcttgccggtcttgcagtttgcagggtcctaaacgaagaggggtggagattcgagagtgcgggtctggcgtgtggtccaagggagggggtgaggctgggaaagggggtgcagaatgcgggaacggctgggactgcacagaaggaccatctgcggactcgttttcactgctccagctcccgaaatcgtttctctggacgcggcagtatccgcagcgcatgcaccctcct

SEQ ID NO: 32032 - DNA, 27 bp, Homo sapiens
  chr8:65290655-65290682
  hyper
tctctctcctttcctcggactctggag

SEQ ID NO: 32033 - DNA, 185 bp, Homo sapiens
  chr8:65290897-65291082
  hyper
cgctgccctgagcctaatccctcttccgggcccagacccgaggtccgcgctcctgggcagtggggaagctttagtgagcaggcttttctctccgcagcaaacttgtagccagaccagatgggccgcccagctctctcgggactaggcaggtgcggatgagttaatttttccgcattacaaagaaa

SEQ ID NO: 32034 - DNA, 33 bp, Homo sapiens
  chr8:65291410-65291443
  hyper
attaacttggatccacgccgtcatttgaaaact

SEQ ID NO: 32035 - DNA, 254 bp, Homo sapiens
  chr8:65291758-65292012
  hyper
catacaattaaggcacgcggtgaatgccaagagcggagcctacggctgcacttgaaggacaccaaagcatctcagggtcagaaaggggaaaaagcaattgcagggaatttagggggtagtaaaaggaacccatctcttgccgcataaatgccccccacccccacccaggactgattctggaagcaacctagtgttcgaaagggaaaggctcctacttttccattacagccgcggaaatccgcaggcaaatctcc

SEQ ID NO: 32036 - DNA, 268 bp, Homo sapiens
  chr8:65292608-65292876
  hyper
atgcaccaaagtagccgcgccctccctgcctggcgctgtccgcggtgctgaccgtggcccttttctctctccgtaatcaaactggaaaagcaataggaccgtcccgtccctactcaaaagaagagtaggatattaggtaatttgaaaaataacatttaaaaagagaaaaaggtcacatacagcaaaacaatattttactgaaatcgttccctcaagctggttgctacccttgcctgacactttttggtcttcacgtaggaatgcacac

SEQ ID NO: 32037 - DNA, 15 bp, Homo sapiens
  chr8:65293179-65293194
  hyper
ccaggccttgcagcc

SEQ ID NO: 32038 - DNA, 108 bp, Homo sapiens
  chr8:65293265-65293373
  hyper
cgcatcccagccggcgggaggcactggagggccaggaggcctgaaacccgcactgcggaaaaaccgacctcagccacatcctcatagctcacgcgacggaaagaggca

SEQ ID NO: 32039 - DNA, 152 bp, Homo sapiens
  chr8:65488217-65488369
  hyper
agtggggaaagaccacgcaggagccaggtgagaccctcgcggtgggctcggggacttgtgtgtgcacctcgcgctgagaaggctgcctcccggggctcagggtttgtcttcaaggtctgttcaaatttaggctaactcgtccccaaacagta

SEQ ID NO: 32040 - DNA, 43 bp, Homo sapiens
  chr8:65488704-65488747
  hyper
taatctctctgcctccgagtagatcccgcgctcccaaatccgg

SEQ ID NO: 32041 - DNA, 16 bp, Homo sapiens
  chr8:65489049-65489065
  hyper
ggttggattcttcctc

SEQ ID NO: 32042 - DNA, 63 bp, Homo sapiens
  chr8:65489066-65489129
  hyper
gttggggaagcacagctggcggagaattcccacggctctcagtggattcgcttttccagagct

SEQ ID NO: 32043 - DNA, 30 bp, Homo sapiens
  chr8:65490463-65490493
  hyper
gcttttggctcctaccgagtaaaatgaagt

SEQ ID NO: 32044 - DNA, 803 bp, Homo sapiens
  chr8:65492776-65493579
  hyper
aactattcagacttgcggccagatagcgcctgcgattgtttgttaccgttttaatcctattaattaaaacgttaacctgattgggtagaaagcgctgtcccaacaggcgagtcttcttcataataacctactcagagataatgatgtaaaagactcccccgtctgtggcggcggctgtttgatgggtccggaaatctcttgaaggtgaatccaagcaagataaacggtgcggagaggaggcgcggggctgggctcagagcggcggcggcggcggctccactccctccgcgcccaccctcccaccatgcggggccgcggcccatggtgagccccagcagccagcaccatcggctggagacgaagaagaagaagaagaggaggcggcgagcgcgggggaaggcgaaaaagaaaaagaaagaaggggagagggctcccggcagcaccaggaccgacgcgcgcaccagctccggagcccagctcgcgcgcgtctgtggggccgcctgactccggggccgaggcggcggcggcggcagcgggcgcggcggcccgggctgcgcgccggcgcgggaccatggagcgcgggatgcacctcggtgcagcggccgccggcgaggacgacctcttcctgcacaagagcctgagcgcctccacctccaagcgcttggaagcggctttccgctccacgcccccgggcatggacctgtccctggcgccgccgcctcgggaacgcccggcgtcctcctcctcgtcgcccctgggctgcttcgagccggctgaccccgagggggcagggctgctgttgc

SEQ ID NO: 32045 - DNA, 149 bp, Homo sapiens; identical to SEQ ID NO: 3283
  chr8:65493806-65493955
  hyper

SEQ ID NO: 32046 - DNA, 25 bp, Homo sapiens
  chr8:65494076-65494101
  hyper
cggcttaacatcaatgcccgagagc

SEQ ID NO: 32047 - DNA, 149 bp, Homo sapiens
  chr8:65494102-65494251
  hyper
ccggcggatgcacgacctgaacgacgcgctggacgagctgcgcgcggtgatcccctacgcgcacagcccctcggtgcgaaagctctccaagatcgccacgctgctgctcgccaagaactacatcctcatgcaggcgcaggccctggagg

SEQ ID NO: 32048 - DNA, 87 bp, Homo sapiens
  chr8:65498465-65498552
  hyper
gaagggttagctttgcgtgtacgactgcaggaccagcaaatgatcatcttcgatagagctctctagttacccgtgcttctccctccc

SEQ ID NO: 32049 - DNA, 86 bp, Homo sapiens
  chr8:65498612-65498698
  hyper
gcacccgcacgcagtctgcaatgccctcaccagtccccgcagctgggcaacccctccaagaccctgtgttacgcttaaattcctct

SEQ ID NO: 32050 - DNA, 201 bp, Homo sapiens
  chr8:65499739-65499940
  hyper
accaaatgacgtccacgcagcactcgcgcccaccgcgctgtttttgcttgcgcagtgctcccgaagggattcgggatccgcatccggagggattcgggatccgcatccgaagagcaccccttctctcaggacttcccctgggaccgacgtttccagtcacccctgcgggcgcaattgtccttcaaccgccaagctccttgg

SEQ ID NO: 32051 - DNA, 351 bp, Homo sapiens
  chr8:67024934-67025285
  hyper
ctgtctacagaaccccgggcttcagtggcgtcttcctaacccggcttgcctgccgggggcgttccgagaccctcggggccttcccttcaccccgcgggagttggaccggtggcgctggtaaggcctcccgggctcaaagtgcaacggacactgcagaaatccaaactgctggcattcgcggtttggggacgccagaggaggtaatgatttctggtttgttaacctcaagtgacaataatgccgagccaggcaggagctggacctacaatcttctgatgcgtggtcagacacgttatcccttgcgccactggcctaccacgctactccttcagtcgccgttggattactgtg

SEQ ID NO: 32052 - DNA, 492 bp, Homo sapiens
  chr8:67089544-67090036
  hyper
gggctgctcggactgcggcggcggctggaagaaatccaagggctgagggtgctgcggcgcctgccgagctcccgggaccggcccgcggctcaggagcgccctgcatggcgggcagggcaggagagccaccagcaggactcccgcggacacaagcagcggcagccgcatgttaggggcactcgctgcggcacagaggtgggcggagggcggaatgagagaggggaagagagaaagaaagagttggttagagttcgctcagctgggaggtgcacacggggtcttcctacgggactgccttagacgtgctgggctttggcctcagtgattcggatgggcgctgtccgcggtgctgaagcgcctggggagcggggaaagggggcgcctgcagggctccgcacctaagctcatgcgctcaccggccaggagtgacccttctttctagactctgaaaggacggtccctgcgtcctcttcctaacgatcctcaaaacta

SEQ ID NO: 32053 - DNA, 156 bp, Homo sapiens
  chr8:67344509-67344665
  hyper
agcagttaccttctacggcaatttcaagggtggatggtgcgagcgccgctggggcagctggcgttctggttcttactccgtgggaaaatggccctgagcccgactggcttgaggcttagacaggtgaccccgcgaagcgggtgggcaggcgcggcc

SEQ ID NO: 32054 - DNA, 27 bp, Homo sapiens
  chr8:67344666-67344693
  hyper
aggggcgggaggcgggcagcctccgtg

SEQ ID NO: 32055 - DNA, 95 bp, Homo sapiens; identical to SEQ ID NO: 795
  chr8:67873327-67873422
  hyper

SEQ ID NO: 32056 - DNA, 1 bp, Homo sapiens
  chr8:67873798-67873799
  hyper
c

SEQ ID NO: 32057 - DNA, 251 bp, Homo sapiens; identical to SEQ ID NO: 797
  chr8:67873800-67874051
  hyper

SEQ ID NO: 32058 - DNA, 509 bp, Homo sapiens; identical to SEQ ID NO: 798
  chr8:67874164-67874673
  hyper

SEQ ID NO: 32059 - DNA, 103 bp, Homo sapiens; identical to SEQ ID NO: 799
  chr8:67874755-67874858
  hyper

SEQ ID NO: 32060 - DNA, 402 bp, Homo sapiens; identical to SEQ ID NO: 800
  chr8:67874859-67875261
  hyper

SEQ ID NO: 32061 - DNA, 179 bp, Homo sapiens; identical to SEQ ID NO: 801
  chr8:67875262-67875441
  hyper

SEQ ID NO: 32062 - DNA, 255 bp, Homo sapiens
  chr8:67875442-67875697
  hyper
ggaagcgtgacttgcagcgaggcaggacccgatcccaggcttctttagaaagcggacgctgcgccccaaggcctgttcagagccgccccaggaagccgtgggtccccgaccgccccaaaccgcagcggtttctgcaggtcctggacccgtcgccttcgtaggtgaaatctaagtacttttcagcaacataattagaacacactcgaaacaatgcctgcagttctccgagtaggacattttctgtttttgtgtttg

SEQ ID NO: 32063 - DNA, 314 bp, Homo sapiens
  chr8:67940696-67941010
  hyper
cccacgcttattccccgcgggcagctcaccgctcgcgggacagtccggtagctaactccagtttggtcggtttcatcggcgccgggtccctacgcagaccagcggcggttgctgggcgaccagacgcgctgtccaagcgccgctcacgagaaatctcgcgacatcgcaggctgctccctccccggtgggtccttcccctgtgaggcggcggccgggcgctgatgggcactgacggtggtcactaggccgactccgactagagtcctgttagcttgaagaggccgtgaggcatcggtcaccgcattgttttagtg

SEQ ID NO: 32064 - DNA, 306 bp, Homo sapiens
  chr8:68864545-68864851
  hyper
cgccgccgggggccgggcagcagcgggcgcgcgggtcagcgctcagcacggcgggcagcgccgcgctgcgcaccgccgccgaccatgagcgaggacagccgcggagacagccgcgccgagagcgccaaggacctggagaagcagcttcgcctgcgcgtgtgcgtgctcagcgagctccagaagaccgagcgggactatgtgggcacgctggagttcctggtgtcggtgagtgtccccggcagacgcagggggacgtccgggcggcgcggggcgcgggtcccggagtggctgcgggaaggacgcgcg

SEQ ID NO: 32065 - DNA, 42 bp, Homo sapiens
  chr8:68865398-68865440
  hyper
caattccctcccccccgccccccgccccggcttaaatctgtc

SEQ ID NO: 32066 - DNA, 71 bp, Homo sapiens
  chr8:69242905-69242976
  hyper
cattggctttttaagcggcgctgtcgctagggagcggctggtagggcgagcagcctcggggagcagcccgg

SEQ ID NO: 32067 - DNA, 202 bp, Homo sapiens; identical to SEQ ID NO: 3297
  chr8:69243284-69243486
  hyper

SEQ ID NO: 32068 - DNA, 329 bp, Homo sapiens; identical to SEQ ID NO: 3298
  chr8:69243487-69243816
  hyper

SEQ ID NO: 32069 - DNA, 140 bp, Homo sapiens
  chr8:69244370-69244510
  hyper
cagtagaaggaagagcgcgaggacacgagaaaatgagaacaagagattgaagcctggcaccagcaaagcgtcccgcgggttgccagggtgctgagcaggggtggggcgtgcggaccgtagtcagaagtggaggcccttgc

SEQ ID NO: 32070 - DNA, 125 bp, Homo sapiens; identical to SEQ ID NO: 9614
  chr8:69244511-69244636
  hyper

SEQ ID NO: 32071 - DNA, 84 bp, Homo sapiens
  chr8:70404780-70404864
  hyper
gggtgctcagggagccggaaccacatgcctggaaaccctgagcccctgcccgccgccgtccaagccggccggctgcagcgcagt

SEQ ID NO: 32072 - DNA, 49 bp, Homo sapiens
  chr8:70405100-70405149
  hyper
tcttggggccggtgtcgggccggggcggcttgatcggcaactaggaaac

SEQ ID NO: 32073 - DNA, 406 bp, Homo sapiens
  chr8:70744839-70745245
  hyper
agcttctgcagtggccggcgcctccagctgctctcccgccccgggctgcagtccagtgccttcgtccatggcgcttagaattcagatttgatagctgatggcacccaagcactccggcacgtttcatccaccggcacgaggggccgaagccgggcccagtcagtcttgcccacctgggactggggctgggggcgcagggccgcgcagcagggcatcctcaccagctgcgaggcgcccagtgcatcctgatcacagacacggcttcaaggctccgcagccgcgtgccacagggggcaggggtccgcgcggtactgcgatgagccctactcggcgtccctctccgggcggtagcttgaggcaggcgcctcgcgcgtcccgggctcatcccctccgccgccgccgccgc

SEQ ID NO: 32074 - DNA, 30 bp, Homo sapiens; identical to SEQ ID NO: 9617
  chr8:70945287-70945317
  hyper

SEQ ID NO: 32075 - DNA, 229 bp, Homo sapiens
  chr8:70946686-70946915
  hyper
tgaaaagagaaaacacgtagacataatctggatggcggagactgaagagtgattatctctaggtggctggatgctgggtataggttggccgcaatgttatttttgtaaggctaggagaaaaacgttattttaaatatacggaatttgctcctctccaaatccactctccctttcgcctccctagaggttgtcaggttcaagaagcggcccggagttgcaggaagggcgc

SEQ ID NO: 32076 - DNA, 568 bp, Homo sapiens; identical to SEQ ID NO: 3300
  chr8:70947090-70947658
  hyper

SEQ ID NO: 32077 - DNA, 166 bp, Homo sapiens
  chr8:70981714-70981880
  hyper
ttcactgctggcacccgcgtactcgtggctgctgctcaggaagggcggcacttccctggggacgtggggaattgggtaccacggtggcagcttgctgtaccagggcagatcgtagagaggctccctctgtaggcccagacccgggctcagcaagggaggcgccatc

SEQ ID NO: 32078 - DNA, 23 bp, Homo sapiens
  chr8:70982262-70982285
  hyper
cgctcccacaattaagacaaaac

SEQ ID NO: 32079 - DNA, 281 bp, Homo sapiens; identical to SEQ ID NO: 804
  chr8:70982286-70982567
  hyper

SEQ ID NO: 32080 - DNA, 1020 bp, Homo sapiens
  chr8:70982850-70983870
  hyper
cgtccgccacattccccgggttcctcggaaactccaatcattctaccaggactattggggcctggggtagcccctcgggagccgcgtggacgagccctggccaggtgggagcgaagagcctcggcgactgccagtcctcccgcccccgcaccgccgggaaaggatggcgttttaatagacaggcagcaagttcaccgaggctgaagaatgaagccccttcagggccggcgggtcttgagatcaatgagcccaataagaaaaccaagcagggtcatgactcagaaattaaagaacacggggtcaggagaagaggtcagccacgacacaggcagcggcccgtctcctcccgatcctccaaaggcgcccttctcctagcctcctccgacctcagggatctgcaacttgggattcaaagcccccgagagggcagaacgaccatccaaaacgaactgcgccagcgagtgctgccgccctccccaacggccctggaagaccaccgccccgggccccaggcgcgtcctgtcccgtgcctacctccgacaccacctccaagagcgccaccgcggagcgggcgcctcctggacgctgcggggccactcgggctcggtaggccactcgggctcggtagacttcgggcgggccctgagggctgagccaggcttaagagggcgggcggggccgcggggcatcgacaggtcgagggtagggaattgacccggcccacgcagatccccgcgtcgtcttctccccgcccaccgcagccattggccgactctcgactcgccctctgtcccctggggtcgctcacttaactcatcagttttccaaaccctccctgggaccctagtggcgagcactcgccgctggccttctagggcaggcagtattgccgctccaggcgtgcggagtcggggagaaaaaaaccgaacacgtgtgctacccagggcccccagataagcccctccgcgcgcacacacaccctgaaccggagtccagaaggccggactcgcgtcccggggt

SEQ ID NO: 32081 - DNA, 277 bp, Homo sapiens; identical to SEQ ID NO: 807
  chr8:70984016-70984293
  hyper

SEQ ID NO: 32082 - DNA, 319 bp, Homo sapiens; identical to SEQ ID NO: 808
  chr8:70984343-70984662
  hyper

SEQ ID NO: 32083 - DNA, 250 bp, Homo sapiens; identical to SEQ ID NO: 809
  chr8:70984744-70984994
  hyper

SEQ ID NO: 32084 - DNA, 226 bp, Homo sapiens
  chr8:72273908-72274134
  hyper
tttaatgtgttccttcgaattttctgggttagcaaacctccattcctgacatagttttgctcctggatgggtacgcgcgggggctctcaggcgctctggtgcagccgcggcgcttctgggagtggagcgcctctgcaggggaaagctcggcgcagggggcaggcgcctggccgctgccgcaggctcgggctgccgagcgactgagcgaaaacgtgttccccaggaa

SEQ ID NO: 32085 - DNA, 103 bp, Homo sapiens
  chr8:72460433-72460536
  hyper
cgcccctccgctctgcagccggagcctgggcctggtgcccactgccccgcggggtgtctcggacgcctggcccctgcagcgttttctacggagaggcctcaga

SEQ ID NO: 32086 - DNA, 638 bp, Homo sapiens
  chr8:72468569-72469207
  hyper
cgggcgcctaagctgcggatcactcctgcgggcgctcgctctctccacgccgccgcccgcgcgcccgcggcagccacgagcgtcccgggcggggaaacgcgttgcctcccggcggcgcctattactagcagctgcttctgcttagcccttcgaggatcggtttgccccaacccacggcctctcccagggttcggtcttctcccgcccctccctcccttccccgcctctcccccaagctcctcagtggccgcggcccgtcaacactgtcgcgcagtcactggcgcaggttcccagctctcagctgggggtttcggggggagggagcagaaggaatgagacagaaggaacgggaggctttaagcccaccgagggaggttagaggaaggcgctgtggctgtgggattaggaggccacagacgggaaccgcgccgagctagactagctgtagaaggctgtctctccaccccgccacagcgctccgagaaggagcgggaggcctgggcaggggagaggcgctcctgcccccacccgcgccctgctggccacctgtggcgtcggggagaccacctgcggagagggtgcagggatgctgctgccctgacgaggggcctcccggggactagcgaaacgtttcgcct

SEQ ID NO: 32087 - DNA, 76 bp, Homo sapiens
  chr8:72469461-72469537
  hyper
gcgggagtgggaccccgggccacagcaagagtcgccgggtgaggacgggcccggcccgtggcgcctagctgtaaag

SEQ ID NO: 32088 - DNA, 192 bp, Homo sapiens
  chr8:72470594-72470786
  hyper
ccccccacctccagccgtaagacccaaaccaattcttgcccttagcggaggcctcctagaatttctggggccgccactgctctgggggaatcgtgggacacagtccggggaaagaacaaagctaggcgccaggaagggccgaccagcccggacgggtcagccgggtcctagccgtctcgggttctttccaag

SEQ ID NO: 32089 - DNA, 30 bp, Homo sapiens
  chr8:72471116-72471146
  hyper
gccattgaatgaatgcgggaccgtttgcgt

SEQ ID NO: 32090 - DNA, 775 bp, Homo sapiens
  chr8:72754490-72755265
  hyper
cgcgaaaggccggggctgtgtggaaccgtcccgcacgtgtgcgatgaatctggctccgctgagaacggatccgtgggctgtctggcgcgggctggggcagcagccgagagttagtctacagagctagggcccgagggtggacctgcgtccgcgtctcgtcacgaaaggaagctctttttggagaggcaaaacgtggtcgcccagatccggcgcagctgtagccgtgggcgctgtgcagtgacagccacacccgccacctgtcacgatcacagttccagggaaaggggaagggtcaaggagaatccagcggaaacttcttcccatctcacgagctctcccttctctccgtggcccccaaacactcgcatttaacgaataatcccatcaagtgagttccagtccgatttaagcggtggttccacatagtctgttggctgcggaaacttctttggtgtcagagtccggtcttcccgagaccacgaatggccatgtctgtaaatcaaaaagaacgtgagatattagagagaaacgattgtctcaaaccgaaacagctctcctacgcgaaccccagatattcctgacttggagtagctaagattttatcagcattctgggaatttgcatgtcctctctctgaactaagattttcattttactggaggttgataatccgagacttgccatatccgttcacgcttcttcctggactttgcccgcaggataatttggtgaaactcatctgactttgaggttctgtcgtttagttcccttcccc

SEQ ID NO: 32091 - DNA, 490 bp, Homo sapiens
  chr8:72755325-72755815
  hyper
ctccaagctccaagtaggaactgggcttggacaggatttttcccaagccgggagagctggcagatcagagagggactttccagataaatcccatctggggaaacgttactatcttccacaagcaatttttctaaaaatgcaaatgctcttttatagagctcggccttccctcctttaagaaagggcttgccgattcaaacctgcccgactcagctggattaagttgggcaagggagatttgccgtcagtctgcaacctggtggcagatggagatggaaccaagatttaccctggaagtaggatattagtcaatggctgtcactggggtacaatgttcagaacgatgcaaacagacacggagggttgattcttcttcagggaaatggctggccactcccttgatttgggagaaactaaactggccttctcgttcccagtcccagaacctccacccctttcgaattcttcccaacgggctgaccctgcccgg

SEQ ID NO: 32092 - DNA, 157 bp, Homo sapiens; identical to SEQ ID NO: 812
  chr8:72756655-72756812
  hyper

SEQ ID NO: 32093 - DNA, 102 bp, Homo sapiens
  chr8:72756813-72756915
  hyper
ggggaaggggacgtctctgcagagccgagatttgggctctgaagcccgacggcccttcaacatgtctgcgcaggataagtgagctttcggggagtgaagggg

SEQ ID NO: 32094 - DNA, 30 bp, Homo sapiens
  chr8:72917399-72917429
  hyper
gagaggtccggactccggggattcctgctc

SEQ ID NO: 32095 - DNA, 316 bp, Homo sapiens; identical to SEQ ID NO: 3313
  chr8:72987600-72987916
  hyper

SEQ ID NO: 32096 - DNA, 119 bp, Homo sapiens; identical to SEQ ID NO: 3314
  chr8:72987917-72988036
  hyper

SEQ ID NO: 32097 - DNA, 164 bp, Homo sapiens
  chr8:73163497-73163661
  hyper
aatagataaagcaggcgctgtgtgggcgcgtcattagcggggtctcctcttggactgtgaacacaccccaaagcttgcaaccccctggccactccacgctttctccaaaccaagggctgcccgcaaggaaacctcgagccgaaccgcggccggacttcagaacc

SEQ ID NO: 32098 - DNA, 149 bp, Homo sapiens
  chr8:73163859-73164008
  hyper
cgagagagcgctgtcagccggccaggcgctggggtccgcgcgagcccgagctctccctcgctgcagctcacaggcagcgaaaatctcgctccgcgagagccctggagaacttctggaaggagttctcaggcccgcgctacttacagtgc

SEQ ID NO: 32099 - DNA, 46 bp, Homo sapiens; identical to SEQ ID NO: 9640
  chr8:73448786-73448832
  hyper

SEQ ID NO: 32100 - DNA, 30 bp, Homo sapiens
  chr8:73449084-73449114
  hyper
gtgggagctgcagagcgaagcaggtgggtg

SEQ ID NO: 32101 - DNA, 38 bp, Homo sapiens
  chr8:73449394-73449432
  hyper
gcggccgctccagcccgcgggtgcgcggagcgcgggag

SEQ ID NO: 32102 - DNA, 292 bp, Homo sapiens
  chr8:73449663-73449955
  hyper
actcccgggctggcgcggctcgctttctggctccttccgcgcggcgagctcagccccgctcgatttttcctcttctgttccagccctctcttgtctgggtggctgtggcggcggcagggggatggggaccccgtgtggggaaggggttgaagatcgatgaagattattgttcttttaaaggatgccttagcttcctcccgccgcctttcctctgagccttcctactagagaccgtgaaccagagtcagggatgtaaagacagggggaaagcacgccgggagctccagccagc

SEQ ID NO: 32103 - DNA, 136 bp, Homo sapiens
  chr8:73450026-73450162
  hyper
cggggagaggctccccggagggagcggggaatcccacagccctttgtggtgcccgagcccgtgccgcctgctgagcggggtctgtgggagctaggtaagtggcgggggcattgctgctccccgaagggggtcttcc

SEQ ID NO: 32104 - DNA, 51 bp, Homo sapiens
  chr8:73450520-73450571
  hyper
attcttcaagcggtgcgcggtctccgttctgtagcacgattcctgagaggg

SEQ ID NO: 32105 - DNA, 30 bp, Homo sapiens
  chr8:75232938-75232968
  hyper
gtcagatccagccctcgcgccccagtccgg

SEQ ID NO: 32106 - DNA, 262 bp, Homo sapiens; identical to SEQ ID NO: 3317
  chr8:75896574-75896836
  hyper

SEQ ID NO: 32107 - DNA, 460 bp, Homo sapiens
  chr8:75896837-75897297
  hyper
cccctcgctcctgcagctactgctcagaaacgctggggcgcccaccctggcagactaacgaagcagctcccttcccaccccaactgcaggtctaattttggacgctttgcctgccatttcttccaggttgagggagccgcagaggcggaggctcgcgtattcctgcagtcagcacccacgtcgcccccggacgctcggtgctcaggcccttcgcgagcggggctctccgtctgcggtcccttgtgaaggctctgggcggctgcagaggccggccgtccggtttggctcacctctcccaggaaacttcacactggagaggtaagggcgattctaaaatgcatcgctgagtcgtcaagctgccaccctttcctatctccctttgccttcttaaactgtacttaaaaaaaaaaaaaagccaactgtacagagtggttgggcgcgatgggtgggtgggctaccc

SEQ ID NO: 32108 - DNA, 39 bp, Homo sapiens
  chr8:75897298-75897337
  hyper
gaaagcagcgacgatagaaattagcgggagctctagttc

SEQ ID NO: 32109 - DNA, 134 bp, Homo sapiens
  chr8:76316422-76316556
  hyper
gcagctttagagctccgacaatctgtgccctcgctttgggctgcgccagggagcaaaaaacctctgcttttttgaaagaggccggggcaacaaggtagagagccgcggccagaagcagccccgggccataaacc

SEQ ID NO: 32110 - DNA, 276 bp, Homo sapiens
  chr8:76316614-76316890
  hyper
cgagccctcccccctcctagccacagtgaccggaatcccagacttcccttctgatgcataaaacattcagtggcctccagggagtttttgaaattctggcggaggctgctttatccgttgtttcgccccctgggtcaaacactggtccactgggtgagttggaggagcgagtagctcagctatagattaaatttaacctgagccccggtggccgcgtcccgcccgcggtcctttctatacgagtagctttgaaggtgtcaccgagctgtgcccaaa

SEQ ID NO: 32111 - DNA, 322 bp, Homo sapiens
  chr8:77585073-77585395
  hyper
gccactctgctcttccgcccagcccactcctgcctgcagtgttgctgctgtcacgccagccggtgatttgataggcttgtcgggttgccatggtgttgacttcttgcctctgaggagctgcccaatgactggaggtctgggattaaagcgggaagaggcagcggccacagcgaatttcagcggcagctgcagcagctagaaacaagaagcaagagtacgaggtctttaggctgcgtccccctcccgcagtcagggctgccagtgagggaaagagaagaaagggtggacggttgaaatggtgatcactcgaagtcagaagata

SEQ ID NO: 32112 - DNA, 237 bp, Homo sapiens
  chr8:77585603-77585840
  hyper
tcacagatgcaaaggcgctgtacggtgaactttatatcgtggaaactaacttaactccgagaagagaaagtgcaattagacggcaaccgagtataagaaaatagttgccttggacggaggctggcggggcggggggagcgggggcggggaagtcagagagtgcatgtgcaatgcacaaccccagacggaaattgtaaactaggaaatgaaagggaaagaaaccgcttctgttataaa

SEQ ID NO: 32113 - DNA, 517 bp, Homo sapiens
  chr8:77586100-77586617
  hyper
aggaaagaaatagtccgcgattcacccaagggactgggagattcagagagattccaggagaaggaaaggaacataagttcaggctcccagcgtaaggaaaggaggaaacgacaagaatccctaagagaaaaagaggaaaaagctgtgtgctgctgaggcggggcgtgggaagacaaccacagtcaattggaaggagcccgagtcagggagcaattgctaggacttcggacagagagggcagaagattgtgtagacaggcggtcaaccagagcagcgcggggcaggacccacgagcgcgaagccaggtgccgcgcggtccgcgccccggctccgggcgacgcagggactttgctggcaatgagaaggctgctcgaccagcctgccggagtcacgattccccgcgagtcccaaacacacgcttcactaactactttacagccacttccattgattttctttaacaaataaacataatacccgttacagcaacacttcctcttgccgccacagctagaat

SEQ ID NO: 32114 - DNA, 434 bp, Homo sapiens
  chr8:77590098-77590532
  hyper
tctagggaaagttctcggagcggcagggaaacctctactcctttcactttgaaataaaaagtggcccaacgttccgtgagggcggcggcgggttcgcgcagagtttagggacagtggaatgggggtggggcagggagtgggagtcagggtcaaaggcgtccgcggagacccgagaggagcagctgggtttcctggcgctgggagcccagaagtagggcgcaagcggccgcggcacagcggagcagccaggtccagccgctcggatcgcgctcgcgccccatagcggcccgcgggctgggctcgggctcgcccgcctccccgctcccctgccagcggcgccgcgctccgcgccccggggcccaccccacgcagtcccgccgccgcttcagcccaacagccctcctcacgctggcgcgctccgaggccaagccctg

SEQ ID NO: 32115 - DNA, 425 bp, Homo sapiens
  chr8:77593310-77593735
  hyper
gggagctttggaagccgtgaggctccggagctgctctgagtccgggctgcgcgtcatttgcagtctggggaatgttgatcacctcactaattacacctctctctcccccctctccctctccctctccctcgctctcctctctcattcccagagtgcatatcgggaatagacacacaaagacatgcgcactcaacttaatcagccatttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattatttttt

SEQ ID NO: 32116 - DNA, 609 bp, Homo sapiens
  chr8:77593986-77594595
  hyper
tctctacccctacctcgctcgctcctgctcgctgtcgcacacatcccctcatcccgaccatctcttccgctctgccccccttttctatctctttccccttttttttggctcaaggttttgctccgctgagggagggagggggcactgagggacctgattttccactttctttaggggggctgcgtttttccggatttaacttttggattaagtggcggaggatcatctacgtttgcttgggcagttttctctccttttccctgtcttttcgggttttgccttccccgcgagccccgggcattctagtggctgggggaagctgtcagctccgcaacggcgcgggcactgccaggggtctccgctcgccccgcgcccctgcaccccgatcgggatgactggtcctccgcactcatcctctgaaagtttggacgttggtcggtggggctgggagcccctctctccctgctctttccctgctttaccctccaccccccaccccaccttattcagcctcgtttttcttcctccttttaccacccgcccctcttccccttctcaagttccccgaaggtcgcttagtgtgcggggctggcggaggcccgggggttc

SEQ ID NO: 32117 - DNA, 79 bp, Homo sapiens
  chr8:77594596-77594675
  hyper
tgagctctggggaggggattccaagaggctggggtgaacgctggggctggggctgcaggtagacacccgcccaccggag

SEQ ID NO: 32118 - DNA, 168 bp, Homo sapiens
  chr8:77594757-77594925
  hyper
cgggatcgcccggcctctgggccagggacccgcgaggcggcggctgcttgctccgaacggaacgccgccgggtgtgcgttagaccagcggatagacgcccgcggcttggggtcaagaatcttttcctttttagcaaagggcaaggggtgtgtgcgtgtgcgtgtgcgt

SEQ ID NO: 32119 - DNA, 305 bp, Homo sapiens
  chr8:77595189-77595494
  hyper
ataaagtttctctgccgatgtccaagttacagaaggttccctattctaatccccttcccctagaagacggtgcactggtttctatttcttttgttacctgtgatccgggcggggggctcctttcggccgctcgggctggggtccggcccagagaggaggcttctgcgggcgcctttggccgcgacttctcacttccgcgcggttctggtgaggttttagctaccgttcggtgagacaccctccttgtaggtaccaaaggttcagatcgcaaacacggaccccccccacctcgacccctacacaca

SEQ ID NO: 32120 - DNA, 658 bp, Homo sapiens
  chr8:79428289-79428947
  hyper
aacagtccatgcagccggggtgacgggggagcgctcggaggaaggacgctatgcagagaaagcccccctggctcttctctctcaatccataatccagcgatgctgcagctgtaaaagcattaatagaaaatcaatccacaacctcgcggggcagcgatcgtcgagcgccgtttccaggctgccttccctggggtcgggagcggccccgctccccccgtggctggcgcggaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaaggtaagcagcccggcaccggtgcgccctggccgcactgcgtggagctttccgcttggttaataatggggtttgcagcacggagggaagaaggggagaaccccgctgcattctgcaatgagaaaaggagcaacaactaggatggaaatgttgggcggccaagtgcagaggttggaggagcagtgttactgggcaaacaaagaaggcgttcttgcctctatactcttttgaacgtgatctaccattt

SEQ ID NO: 32121 - DNA, 578 bp, Homo sapiens
  chr8:80523889-80524467
  hyper
attgcaaagtcaaagcggtcccatcccgctgtttgaaagatgggtggagacggggggaggggatggagagaactgggcacattttacggtattgtctcgtcgaagaaaccgctagtcctggggtgcggtgcagggaggtaagacggcgggggacagggtgggggtaggacctccgctcctttgttttagggcaagggaggggaaggagagaggaagtcgcggagggcgtggagggcgcgggtgggcagctgcaggggcggggaagcgcgcggcagggaggggtggagggacagcggcttcgaaggcgctggggtggggtttctttgtgtgcggaccagcggtcccggggggaggcacctgcagcgctgggcgcacaatgcggacagccccacccagtgcggaaccgcgcagccccgcccccccgcccggtgctgcatcttcattcgaaagggggtcgggtggggagcgcagcgtgacacccaggagcccaaccctgcggggacagcggcgccacgccccgcgctccccgctcccgactccccgccgcggcttccaagagagacctgaccactgacccc

SEQ ID NO: 32122 - DNA, 13 bp, Homo sapiens
  chr8:80524468-80524481
  hyper
ccctccccacgct

SEQ ID NO: 32123 - DNA, 928 bp, Homo sapiens
  chr8:80524845-80525773
  hyper
tgccttgagtgcccacggttctggcgctcagtggccccggggtgaaaaggcagggtggggcctggggtcctgtggcagctggaagcacgtgtcccccgggacttggttgcaggatgcggagacagggaaagctgccgaaaggactccatctgcgcggctccgccctgccctaccctccccgcggagccggggagacctcaggctccgagactggcggggaagaggaatatgggaggggcagttgagctgtatgcagtcctggaacctcttttttcagccccgcagtccacaacggcccgagcaccccttgatgtgcgcagacccccggcgtggctctcagccccagcaccgagcccctcccagccaagcgggtggctctgcagaaaagctggctcgagccccgcccggccacacaaaggcgcggccccacccagcccgggcgcgagaccgcagaggtgacccccttcccagggattcagggagggctgtctcttctcgcccacccacggtccgcggagctcggggctttttttcccccagcccaagccccccgcccaccctctgttctctatgattttccagaatggagaccccgcgaggggcttctctaagggagaccctcgctcctccagcggggcgcggctcggccccacccctcccagctgaggcccagagccgcctaccgctggccgggtgggggcgcacgtggcgactgggtgtgtggagcgcagccagccctgcagagccccgcgccgcgccctgcgctcccctccccggagttgggcgctcgcccccgcggtgcagccggggagaccggtttctgcgcagtgtcctgagctacccccgctttccacaattcgcagttcactcgcacgtccagaaaggttctgagaatgggtggtgggggcgatctcgcctcgctttctgc

SEQ ID NO: 32124 - DNA, 345 bp, Homo sapiens
  chr8:80803548-80803893
  hyper
gacagaaaaccgagccctatttgttattagtatttttttttttatactctcaaatgccaccggcacattcttttaaaaaaaaatgaaaggaaagaaagaaagaaaaagaaaataagagaggaaaaggtcctgagaaatgacggacgcttgaacctcgggcccgggaagaccagcgccctttggcggctaggcctcgggggcgtgcggagggcgggcccccgcgcggccgccgctttcccaggccgccaggggtgaggaggtgacgctgcgggcttggtggcggctggtttttcacacaggaatcctcctcgccaccgctccctcgaaggccgccccccgctccac

SEQ ID NO: 32125 - DNA, 101 bp, Homo sapiens
  chr8:81400332-81400433
  hyper
aaaaggctgactttgcggtaaaaaaattttattagctgtgattttagagaagctggtctatgctcacagacgtttagtgtgctggtcgaagtcaaatcggg

SEQ ID NO: 32126 - DNA, 324 bp, Homo sapiens
  chr8:81478141-81478465
  hyper
ctgcgtgggtgttctcgtctttcctcctatcgtatgttacggttacctgcagaggctggcgtcgaaggagaggtgctatgcgaggatggccccaagttaaacagtgacagcctctgccctcccagaccccaggcgcgcgggggcgggcgcggaacaccggttccaccgccaccttcaggcctcccggtgtggcgcggttcgggacgtcacacaaataccagggcacccatgtttctgccctgggaaactctcacgtcagccggccccccaattctgctaaaggagaaaacaaaatttccctcccatggacgcagctgggcactt

SEQ ID NO: 32127 - DNA, 672 bp, Homo sapiens
  chr8:82192624-82193296
  hyper
ctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctaggtgaggcacccggcctggcagcgcctgcaacgtggcgtgttgtgcggtcgtctgtccctaggtccccgtcagcgtgccagattctggggcaggagatgctcggcggcctacccccatcccctcccatcttccccaccacgcggccgttgggtgcagcgcgcgcagcaccacgcgggcaggcggcgaggagcagggagcgtgcgcgcctcttgcccgcccgcgggccgcaagattccggaggtggtccaccccgtggtccacctacctctgcttctttcccttcgcccaaacggcagcccttccgcattgcttcctgtcctttagcgcgcgcacccgtcacctcacgctgcacttctttcgaccccctccaggcgaccctgtatttcc

SEQ ID NO: 32128 - DNA, 165 bp, Homo sapiens
  chr8:82193521-82193686
  hyper
ttcctctgtcagccccgtctcccccaggtcctctgctcgcccttaccagttgagccgaaccctttggattggtaccccatggaacaccagggcccccgagaagcgtggcgctggcggtgccgacctgctgctggcactgccgggccggggcgccgcagtgggcgg

SEQ ID NO: 32129 - DNA, 42 bp, Homo sapiens
  chr8:85094795-85094837
  hyper
catgcccccacccaccgctccgcaacccgcagaaagaaaccc

SEQ ID NO: 32130 - DNA, 191 bp, Homo sapiens
  chr8:85095307-85095498
  hyper
cacacactcccaatgcgaggcggcggcggcagcaacagaggcagcagcagcaatcgcggcagcagcggcagaggcggcggcagctgcgcgcctcgggcccaaccccgctcggctccccctctcgccggcgccctgcctgtcttgcgtgtgcgtgtgcgtgtgctcagcctcagcgtgaggggcacctgctc

SEQ ID NO: 32131 - DNA, 180 bp, Homo sapiens
  chr8:85095499-85095679
  hyper
tctgggctcacagcgaaggcagcctcgccgcgagctgccgctgccgctgctgccgccactggtgttgccgctctcaggcgccaggctccccgtcgccgccgccgccgcctcgccagccagagttgggctccgtgggcttcccccctcgcagcctcggtccttccccgctgcctgcaagtc

SEQ ID NO: 32132 - DNA, 117 bp, Homo sapiens
  chr8:85095999-85096116
  hyper
gttctgtagacaaggcgctgtgtctcggagtccgcggcgaccgtgcccgctgggagcgtctcccaagtccagcaaaatgtgcaactggttttatggaaaaagcgatgtgaagtatgg

SEQ ID NO: 32133 - DNA, 139 bp, Homo sapiens
  chr8:85096583-85096722
  hyper
aaaaaaaatgaagtgcggtttggtttccttgtcaacggaggatgaagtgaacagctgagcagctcgcagagagcaggtacttggtccccttggaggcgtttcccgggtgtgcagtggcaacactggtcctagcaaagaa

SEQ ID NO: 32134 - DNA, 151 bp, Homo sapiens
  chr8:85096852-85097003
  hyper
cgttttctagatgtgcgcaaaatacagtcccctccccccacccctcccacggtgagctgcgcccaggtcgtctcccggcggggcgggtggcgtctgcgctgcgggccgcgccggccgggcactaggcggccggcgggccctgtaagttctc

SEQ ID NO: 32135 - DNA, 158 bp, Homo sapiens
  chr8:85097062-85097220
  hyper
cgggctagaggggaccctcagagcacccgggagatgggggtagaagcggcagagaccgcatattccggaggggctggctccaggccacgcgagccggagctggagacatttccagagccttgaggatggcaccggccctcgcacgctcaactcctgct

SEQ ID NO: 32136 - DNA, 53 bp, Homo sapiens
  chr8:87081803-87081856
  hyper
cagcgctggtggccccgggaccaccttcctgctggcgccgcaccccatacccg

SEQ ID NO: 32137 - DNA, 941 bp, Homo sapiens
  chr8:89339042-89339983
  hyper
gtgaaaagcatggaccggctacaattgtgtctttgagcgcgcagcatcgtgctttgtgctgccggggataacggattctgggtctcacacgcatccgtcacctaaaacacccttaaactgaaccagggtctccacagctggaagggaaacaacgtgctgggacccaggctgctctgagctacaaggatcccaggagtgaaggaaatgtttcagggagcagcccaggcagcggggggaggaagaaagccctcgcactcttacctccacattgaaatactgctccgttccgcagactgtagcacataaaatccaaagcaaggtttgcaagaaaaacacccccgaatgatgcacgaaatccaaccgtcttccagtgctgaatgtgagtaagatcatagtgaactgtgcttcaatggatggacgagctccccttcgttttctccctctctccctctccctccctccctcgtttcctttcaaaaaaaagtcctccgggtgggtaaggagcctgcaggttcacccacagccgggcaaggggaggagacaggggccccgcgctcggcagcccccgagaggcagcggcgaagacagggtcagcagtagttcctgttcaccatcctccggggtcagtcaccgggaacgtggcgcctaagttcaccggcggttccggctcaaagagcctagtcgcagccgcagcagcagcagccgccgccgccgccgccgcctccagcccgtgcgtcctcctcctgcactgcctactcctcctcctcctccgccgccgccgccgcccccagctcctgcgggaagggcctccgccgctcctcactctctcgcctctgcttctccttccctcctctcctcgctcccctccagaatgttcatccgtaatctacataactcctccttcccggggtctgcctggctctcggggcccttggcgcgcg

SEQ ID NO: 32138 - DNA, 10 bp, Homo sapiens
  chr8:89340043-89340053
  hyper
cacacacgcg

SEQ ID NO: 32139 - DNA, 156 bp, Homo sapiens
  chr8:89340081-89340237
  hyper
cgcgcgcttcttaaaggagacggctcataaaggattccccactacggtagggcgcaccggaggtatccagcccgcgacaagggccctggtttgagcacagctcttcgacagtatctcccatcccgcatccccgaggcaggcacccaggaacttggg

SEQ ID NO: 32140 - DNA, 711 bp, Homo sapiens
  chr8:89340273-89340984
  hyper
cgcatctaaaaacgagtgcgcccctctccagccatgagctgggtggggctcaggctgcggaccctagtggggcctggggagcggcccaaccctggtcctggagagcggtcggcattcctgaggaagcggccctggaagaataggggcgctgggaatcagaggagcgcctggtcactgagcgcccctgggtggctcgggtcggtggccggggctgaccaagtttgggaagactgagatagcaaatcccgaacgtccaaaactttgttggggtcccgagcctgtggcctggtgtcttcctgaatcccctctaccatagctacattccgccttccaggcttgaggagtaggcacagggttttggtggcggactagacaaatacagaagcgggatgaaaacgctcactttccaagtgaacggtggacacacgcgcacagtgggacccgggagagatggtcctgggtgttaacaaaacatccgatgagagggatgggggcgctggaaagaaaccggctgcgggagccaggggaagggttggggaaagaaggagaagaagcagcctgaggaaaggcgagtaaagcagctggcaagggcgggaggaagaggctgctcgcagaccgagcgggggagaggctggcgggagctaggagagctgcaggcaagagggggaggcggctggcaagaagcacgggcgaacgcgggcagggaacttc

SEQ ID NO: 32141 - DNA, 32 bp, Homo sapiens; identical to SEQ ID NO: 9668
  chr8:91094254-91094286
  hyper

SEQ ID NO: 32142 - DNA, 33 bp, Homo sapiens
  chr8:91095051-91095084
  hyper
gccgggcgctgtcctcggtgctgctcagctcag

SEQ ID NO: 32143 - DNA, 15 bp, Homo sapiens
  chr8:91095141-91095156
  hyper
cggccccaagccggg

SEQ ID NO: 32144 - DNA, 189 bp, Homo sapiens
  chr8:91804064-91804253
  hyper
ggtgcgtccgcctagccccgctccgcctgaggccgtcagggctcccgaggatggaagattcccaggagacatcgccgtcctccaacaactcctcggaggagctcagctctgctctgcacctgtccaagggcatgtcgatcttcctcgacgtaagtacagatggtgggagctgggcggttgcttcccagc

SEQ ID NO: 32145 - DNA, 463 bp, Homo sapiens
  chr8:91997046-91997509
  hyper
tagctccttttttggcgatggctttggtctcggccacttgcccctccgtcgggctcccctggccccctacactttctttcccctcatccgacgctctcgctcccatcccactcccattcagggtccacagggtactgaaggggccctgagagatttcccgacccacctcagagcttctcttcctcgcctcaactttcccggggtcgggcctgggagacggcgcccacccgcctcctccacaccacggggcccgacttccgtcccccagtgtcgctcatcctccctagccacttaccgactcaaaatccacggggatttcggggcagcagcgtcgccgcgctcagcccacacgcggaggccgagcgccctgctgcccgtcggggaacggctcctgccgctggtccgctggctgaccgcggtggcggcggcggggggcgaggggcggggggcgaggggcgggggg

SEQ ID NO: 32146 - DNA, 479 bp, Homo sapiens; identical to SEQ ID NO: 815
  chr8:91997527-91998006
  hyper

SEQ ID NO: 32147 - DNA, 401 bp, Homo sapiens
  chr8:93114306-93114707
  hyper
cgacgggaacacccaggagggccggggcggctgagtccagagcgcgcagaggtcgggcggggacgactctccccatcggcccctgactgcgaagcccgggaccagcctcgggcgggagccgccgtccgcccgctcacccaggagcttcccagtccagcaccccaaacggccaggagtaacaaggaaagttcgcaggcaggcgcagagcgcctgggtacctctaagcaaacccccaccctagttgcagccgggtcccaaagttaagatcccgcctctttactccttagggctaagttttccaccatcaaaacaagtctttgcttccagtttacagaaaaagaaaagaaaaaaaaaaaaaagaaaggaaaagaaaaaaacccacgatgcgggcatagggccac

SEQ ID NO: 32148 - DNA, 30 bp, Homo sapiens; identical to SEQ ID NO: 9673
  chr8:93115382-93115412
  hyper

SEQ ID NO: 32149 - DNA, 167 bp, Homo sapiens
  chr8:93115692-93115859
  hyper
gcaggggggaggacccgcggcggggcgtgggggaggtggaggtgggagacatctgtgttgtgcgggggtcacggaggtcaagtatatgttaacaatgggcaggcccggcacgctagggcgcgcgggctggcgggcggcctccctcccggcctcgccctctcccatgc

SEQ ID NO: 32150 - DNA, 30 bp, Homo sapiens
  chr8:94712418-94712448
  hyper
gggcctctggtttcacgtctccctcctggt

SEQ ID NO: 32151 - DNA, 300 bp, Homo sapiens
  chr8:94713129-94713429
  hyper
gggtccccacactgccgcgggcagtgcggaagcctaggaggcagccgggcgcccaggccgcgctgcgcggagcagccggagcagccacctccccagttaaggccaggcccacccggcctgggccttttcctgtgcctacacagtccggatagtgaggtcaggaccccatggagagcagtccgcgccgggagacgctgggtcgttgatgggtttacgccttcaaagctgcagaatgcccggggaatgtttgcatgttaaattaacgtgaagccttctcatctctaacgagaatgttttgcc

SEQ ID NO: 32152 - DNA, 30 bp, Homo sapiens
  chr8:95246973-95247003
  hyper
cttccagcttcatctcggggcgctctgttt

SEQ ID NO: 32153 - DNA, 30 bp, Homo sapiens
  chr8:95651480-95651510
  hyper
gtagctcggagttaccggggctggggagga

SEQ ID NO: 32154 - DNA, 229 bp, Homo sapiens
  chr8:97156981-97157210
  hyper
agcgcagcgggaagtcgcatacaccctcgcagtgataggcctcgtactccaggggcgcgataatccagtcgtcccagcccagctccttgaagttcacgtgcaggggcttcttgctgcagcgtagcctggacttcttgccgtgccgcttgccatggcgactggcgaaggccgtgcgccgccgccggcggccgggcgagggcagccaaggcctggcatccggggcgcccga

SEQ ID NO: 32155 - DNA, 232 bp, Homo sapiens; identical to SEQ ID NO: 817
  chr8:97157666-97157898
  hyper

SEQ ID NO: 32156 - DNA, 134 bp, Homo sapiens
  chr8:97158021-97158155
  hyper
ggcctaccgggttttccccccaaaaggcttcgtaaccactaatgtgccctttgtggtctcaagcctgggccgcgtttcccctagacctcctctgggctgggctggctcgttctcgttgacgtctcaaatgtcac

SEQ ID NO: 32157 - DNA, 163 bp, Homo sapiens
  chr8:97165633-97165796
  hyper
ccaaaccgaagctctcgtactgttcccgcgctgagccctccctccccatctcactgaggcgcgcacgcggcctgcccttcccctggggccgggacctggggggttggctaggggcggccttccctgcactgtcgaccggtaagtcacccgggagcccagggga

SEQ ID NO: 32158 - DNA, 30 bp, Homo sapiens
  chr8:97166425-97166455
  hyper
ccctggcctctttcacgcccactctcgggt

SEQ ID NO: 32159 - DNA, 45 bp, Homo sapiens
  chr8:97167178-97167223
  hyper
cgggtccaggtgacacgcatcctctccggtcggaaagaggagctt

SEQ ID NO: 32160 - DNA, 212 bp, Homo sapiens
  chr8:97169708-97169920
  hyper
cgctcctccccttgggggacccccggctccaccgagccaggccagccccactcgacggcgatttaaacatcccttaggcaaggcgccaagttagcgctgctggcccagctctaggcgggccgctgctctttcctcctcgccaggccgtccacgcgttgggggaggggaccctaggggggttggcgcggttaagagccccacgtgagaggggc

SEQ ID NO: 32161 - DNA, 35 bp, Homo sapiens
  chr8:97169921-97169956
  hyper
gaagtccttgccaggagccggggatgcgcggctgg

SEQ ID NO: 32162 - DNA, 285 bp, Homo sapiens
  chr8:97170053-97170338
  hyper
cgatgctaagcaagccccggaaggtccagcctgaggtcaccgccggtgacacatcaaatcaaaatcagtgagagggaaagtgaggctttccctttatcaagctggggctgcagccagcaacgcaccccctcctctgcgcacccctcccgcccgtggctccgcactccttcacccccgcgcggcgtgcgacaagccgcaccgccttcccagtcaacgaactgcctttcttcgcattttctgagaacccggagacgcggaggagacagcgcctttgaagatgctgtc

SEQ ID NO: 32163 - DNA, 824 bp, Homo sapiens
  chr8:97170377-97171201
  hyper
cgcatccccagccctccaccgcattccggggttgtagcggtacttgtggatctcggtcctgctagtctggaggccttggctcgggaacagaggcctccccagactgggtgcacatgcaatccctcctctatctccaggatcgggggcatacagcgcagtggcggggatgggggtggggaggctacagggcaaaccagggtaaagtgatttcgcgtctacgccggattggggcccccaagacttttccccaacccttgtctgaatgccacaggcttccggagacacctccgaacagcccgcagggtcttttggtcctgtgccaaattcacagggcgcagcgaaccagttatggtgcccacttgggggaggggcagagattcttgccacttcattcccgggcaaagaaaatccgcgcccaaccgccggccagcctaggcctctgggacttcttctcttgaggaagggcctcttgagcagtcttctctgagcttccttagcctccttccgcaattgtagtagagaaagtgcacgattaacagaggactttgagggacagaaacaactgtagcaaggcgtgcgtcgtggggagggttggcgagctgcacgggcagcacggaggccagggactcagttgcactactacgaagaagccacatgtctttgcaaaggtgactttagtagccctaaaatcatcataaaatacctggcgttaatttgccctctggacctttcagcagctcatgaacctcgctgacctcgggctgcagcggcgagaccctcgagcaaggaacgcgactatgagtgagaggcggggactggagccg

SEQ ID NO: 32164 - DNA, 374 bp, Homo sapiens
  chr8:97171585-97171959
  hyper
tgagggcactggccacgctgcagatcaacgccggtggcaagaaggggccgcaagggtttccgcagacacccacacatgcaggcgttcccacagagggtaccagggatttcccagacccccaccagccctcaggaatagcgtagagagaggaacgtcgcctggctgagaaaggtggatgggcatacccatgtacctttgtgtattaagtacccacaacctccgaacttagccgtccctgtcccggcccgcccaactgctgccgccgcatctgcagaaaccactcgtgttgaggcctcggagcagccgggagcaccacgctggagcaaaaaagccggagggcgcagggctccagcccggctgaccatcccacccag

SEQ ID NO: 32165 - DNA, 722 bp, Homo sapiens; identical to SEQ ID NO: 824
  chr8:97172018-97172740
  hyper

SEQ ID NO: 32166 - DNA, 140 bp, Homo sapiens
  chr8:97172821-97172961
  hyper
cgacgaggaggatgagatggaagcctgctggaaaccgggcaaatcccacagaaaactgatgaggaagacggccgagagcaggaccctgggagtatccatggcgggcaagtggctgcgtctccccaggaggcggtggcggc

SEQ ID NO: 32167 - DNA, 564 bp, Homo sapiens
  chr8:97172962-97173526
  hyper
gcgcaggacgcgcggggcacggagcggctggacagcggccggggcccggctcctcgggcggactcggagtgcgaggagccgggtcccagccacacaaaccccggccccgccacgccccctcccgcccctcgccgggaggggaggaatggggagggagggcagaggaggggtggggagggtgggaggagagccgggtggtgcgggccggaggtgtgggggagaggggccgcggtgcgccggtgtggcaggaagacgcagcgcccccgcgggacgcgcgcggggttgccgggcggtgcgcgcggcgcgggccgcaagcgctgaccgggggaaggcgggcgctgccggcccgtggccggggagcaaaggctggcccgccgcgccagggtccccctcgaactcccggaggtgtggtccctccgcagcgcggccccggctctcggtcctcgccagccgcctccactttcctgggagcgagcggccccggaggagggaagcggcggcggcgcccccaagagacagcttggagcaggcgcctctgctgcaggctgcgtgctgcctcggggc

SEQ ID NO: 32168 - DNA, 32 bp, Homo sapiens
  chr8:97173527-97173559
  hyper
gtggtaccctccctcctcggccccaaccgcca

SEQ ID NO: 32169 - DNA, 42 bp, Homo sapiens
  chr8:97173822-97173864
  hyper
gctgctccacttcttcgtctgctcccgggatcctctccctct

SEQ ID NO: 32170 - DNA, 30 bp, Homo sapiens; identical to SEQ ID NO: 9688
  chr8:97505645-97505675
  hyper

SEQ ID NO: 32171 - DNA, 231 bp, Homo sapiens; identical to SEQ ID NO: 3340
  chr8:97506177-97506408
  hyper

SEQ ID NO: 32172 - DNA, 157 bp, Homo sapiens
  chr8:97506447-97506604
  hyper
cgttttgccctggttgcaagcagcggctgggagcagccggtccctggggaatatgcggcgcgcgtggatcctgctcaccttgggcttggtggcctgcgtgtcggcggagtcggtgagtgggccaggcggaggatgcgcgcgccgtttagggtgtttg

SEQ ID NO: 32173 - DNA, 46 bp, Homo sapiens
  chr8:97506848-97506894
  hyper
cggcgggtcttgctgcgtggtctgggaaggacggaggggaaagggt

SEQ ID NO: 32174 - DNA, 580 bp, Homo sapiens; identical to SEQ ID NO: 3342
  chr8:97507115-97507695
  hyper

SEQ ID NO: 32175 - DNA, 219 bp, Homo sapiens
  chr8:97657861-97658080
  hyper
atggggaagctgtgacgtgggggtggtggagggtgctgcgggacagcagcgagcacggccctcagccgtccttcccaacacggtttcacttcccctcagctccagggctcagccccaagccgcccccttcatcccccatctgcaaacaatcctggtccccctgagcctccaatatgccttatgcagttcttttggggttcctttcgcattttaccgtgt

SEQ ID NO: 32176 - DNA, 50 bp, Homo sapiens; identical to SEQ ID NO: 828
  chr8:98289818-98289868
  hyper

SEQ ID NO: 32177 - DNA, 455 bp, Homo sapiens
  chr8:98289922-98290377
  hyper
cgcctgggtgtcttccccgagactctggtactgtgaagggtccgggtcgcgcggggcgtcgtccggagcagggcggactcgggctttggcgcggcctttgccccggtttttggcgcgggaggactttcgaccccgacttcggccgctcatggtggcggcggaggcagcttcaaagacacgctgtgaccctgcggctcctgacgccagctctcggtcgggaccgagcgggtctctccacggcaaccgccgacgtcacgaacgtacaactgtaccgtcgcgagaggacgtgatgcgcccggtgattggcgccgccgctgcggctgcgcaggagacgacccccgcgggcgctcccacccccatctcgcgcggactcgctttaggtctcggcgagtttctctgatatgcgctcgcgggggtgctgccatttcatctcttccgcgcgggctcatcgtgct

SEQ ID NO: 32178 - DNA, 129 bp, Homo sapiens
  chr8:98788308-98788437
  hyper
caccatcctgctcggcgtctggtatctggtgagcgcggcgcgcccggcccgggaccctgcgttgcttccgcgcccctagctgggcttctggcccggcctcgcggtggggtgaggcgtgcgctcatccgc

SEQ ID NO: 32179 - DNA, 30 bp, Homo sapiens
  chr8:98788975-98789005
  hyper
gcgtttccatctgcccggggaagccatttt

SEQ ID NO: 32180 - DNA, 94 bp, Homo sapiens; identical to SEQ ID NO: 9694
  chr8:99076589-99076683
  hyper

SEQ ID NO: 32181 - DNA, 253 bp, Homo sapiens
  chr8:99076759-99077012
  hyper
cgcgcttgcgctctacgcccaagggagccgggctgcagagctggagaaacttccgcggctacgggtgcagttgccttcggttcccggttccgggccgacacccgcgcagggctgagacaggtgtctgcgctccccgcaatgggctgctccagcagcgccctcaacaaggccggcgacagcagcaggttccccagcggtgagcagggtaccggcgccgcccgcgcccgggctggggactcgggtgggctaactc

SEQ ID NO: 32182 - DNA, 40 bp, Homo sapiens
  chr8:99077254-99077294
  hyper
gttgaggccctaaggcggttagcctcggcattgccttaaa

SEQ ID NO: 32183 - DNA, 561 bp, Homo sapiens
  chr8:99438813-99439374
  hyper
caacaaccccacccccgggcttcgggaaacttttcttcaggtccctaaaaggggacacctggagttcctccggtcccgccctgtccccggacacgcgcaagccgccctttatttcccagcccagctcccgccagacccagcggggaaaggtcaccgtaggcagccccctgcctgcgccctgggggtggtgataataacagctgtcaccgggggatggtcggggggaagggagaggtgtcggccccgcgccgagccgggggcgcaaggtggtcgcggtgacgcgccggggaagcgcagagaagcagcggcggcggcggctgcgccttccgagcccgggcggcggccgaggcacgcggagctgtccgttcagcaccaccgcgccgcgccccgcgcagggcgggcgccccgtcacacccgctctgctcccgccccggctcacggggcgaatgcggcgcgggttcctgcctctctgggtgggtgaggggcgcgcggatccggagagggggctccgggagcggcgggaccacgcagccacctgtgagccttcggcagctgcgggcg

SEQ ID NO: 32184 - DNA, 729 bp, Homo sapiens
  chr8:99439648-99440377
  hyper
cagggagacctgggccggggacgcgggggctgcaggcgtgggatctggacccaggggaggccgggccgcccccctcattcccgcggcccgggtttccagactccagcgcatcccccccaccccaccaaagctacgcgccccccgtgtcggcccggccctgcccgtgcgtatctcagctccggtcccgcctgtctgcggcgagcgggcgggggcgtctcccgggcctgcccatggacaaggtcagcatgcagccccctgggcgctcagagccgcggggacgcgaccccgcacgcgcaaagcgcccaccgagacccctggggtggagctgtgctaatagaaacatacccacccccagcctttcctgggaggggatcagacccctcaaactcttgccccagcccagcccttcagcacccaagacccaccaggaggcctgggcccgccagtaatgggtagggagagggggccccgccagggcgcacggcgctctcgccgacgctgttccctccgcttccaggtgtagcgcccccgcgcggcgcgggcggccggcgcctccagcatgaccggccagagcctgtgggacgtgtcggaggctaacgtcgaggacggggagatccgcatcaatgtgggcggcttcaagaggaggctgcgctcgcacacgctgctgcgcttccccgagacgcgcctgggccgcttgctgctctgccactcgcgcgaggccattctgga

SEQ ID NO: 32185 - DNA, 59 bp, Homo sapiens
  chr8:99951404-99951463
  hyper
atgcgtgcattctctcgagtgaaggaagaaggaagaggtagggacggaggaggagagag

SEQ ID NO: 32186 - DNA, 308 bp, Homo sapiens
  chr8:99951836-99952144
  hyper
cagccaactcactgccgcgtaggaacggaggtcatcggaaatcaagatttccgtttgaattttcccaaagtttaagcgttggcaagtgcgttgaaaaacacacacaatatgaaagcctaataaaaatataggtttgcagaccgtgccctagtcttttccgaggatgttcttttctgtcatccatcgtctacccacgttgagcacgacagccgggccagtcccgccctgggcggttggggccttcccagaggggcccggtgcggagagcccccctctccccggatgtgtctggggcctgtccttcactg

SEQ ID NO: 32187 - DNA, 106 bp, Homo sapiens; identical to SEQ ID NO: 832
  chr8:99952198-99952304
  hyper

SEQ ID NO: 32188 - DNA, 401 bp, Homo sapiens
  chr8:99952532-99952933
  hyper
gccggctctgggctccgccgctgcggcagccgagggcctcagctgggaaatccaaacccgggctggacctgggctcaaggaggtttctgtccccaggctagaccaccacggccacggccacgcaacttgccctgagaccccgtgctcggccttcccactgagctccccttccctgtgactcagtgcctcgcaggctggtggccggaagggtgcctgcggctggctggcccggcccgattccgggtggcggggttcctgcagtgaggaacgaccctcagctcccgcagacgcgggaaggcccccgcgccatccgtgggagtggggcagcctgtctgcacgcggtcccctgggaaacccctctgcatctcccgcccggacaaggtccccggccttggaatctg

SEQ ID NO: 32189 - DNA, 96 bp, Homo sapiens
  chr8:99952968-99953064
  hyper
cgctggggtcagaactggtatctttctcctcctctggggaagtcagggcagcccggagtggcgtcgtgggtccgaaaaatccgtctcagaaaccca

SEQ ID NO: 32190 - DNA, 335 bp, Homo sapiens
  chr8:99954228-99954563
  hyper
ccctctccgcacacccgaaacccacaactcgcccgtgggccgcgtggcctttctgcgccgagggctgctgggggcgggcggcgagcctggcgggtgacctgctcttgggtgggccccgcaatgcctgcgccctagacgccggccgggacgaggggctggctgggtctgagcctggagaaacacaagggtcagcccccagtgggcgcagaggtggcccaggagggcccgcggacggtgctgcgctgcgctcagcctccgggccgctccccgcgttcggcgcgcacctgcccatcgaggcggcagggccagcaggcggcctaggcgcggccgggcca

SEQ ID NO: 32191 - DNA, 84 bp, Homo sapiens
  chr8:99954678-99954762
  hyper
cgtggacgaagtaaacacatttatggaaaaaccccggggttaggaggtttgcggaaagagggagcagctcgtggggttggaaat

SEQ ID NO: 32192 - DNA, 100 bp, Homo sapiens
  chr8:99955180-99955280
  hyper
aggatattaaacactcgaatctccgtttcaagctcactttttaatctttgcgaacttaaaattggaaagacagaaaaaaaatctgcgacccctgttatgt

SEQ ID NO: 32193 - DNA, 30 bp, Homo sapiens
  chr8:99955993-99956023
  hyper
gaaatgaacatttgccgattaaagcttaaa

SEQ ID NO: 32194 - DNA, 30 bp, Homo sapiens
  chr8:99957393-99957423
  hyper
tgggtcgacttgtcccggggcagccgcggc

SEQ ID NO: 32195 - DNA, 30 bp, Homo sapiens
  chr8:99957679-99957709
  hyper
ttgtggagggagccccggatctgtcttcct

SEQ ID NO: 32196 - DNA, 450 bp, Homo sapiens
  chr8:99960048-99960498
  hyper
tttcctctccctccccggagcgctctcctctctcctctcccctctcttctctctcctctctcgtctcctggggcatcccgggtggagggatgtaggggtcgctcctcggtgccaggccgggaagcagctcaggcctcccaagagcttggcgctcagtctgggaaaaggggttcctctggcctcagggacgttctccgcccccaccccaccccctgggagcctgaaccatctggaagggatcttagtcgggggttgggaggagagcccgtggataggaggagggggcgattctaggccgaatccagcccctgaggtgtcacttttctttcctgcggcccgtcaccgctgatagatggggctgagggcagaggaaggaaaaagaaaacctccgaggtcagtgcggggcgaggtgagcccctcccagggccctctggcccaggaggatgaagc

SEQ ID NO: 32197 - DNA, 34 bp, Homo sapiens
  chr8:99960921-99960955
  hyper
gcagtcccctcacggctttcggggggtcttggag

SEQ ID NO: 32198 - DNA, 15 bp, Homo sapiens
  chr8:99961568-99961583
  hyper
cgcctaagatgggag

SEQ ID NO: 32199 - DNA, 65 bp, Homo sapiens
  chr8:99961792-99961857
  hyper
tgccacaaggccttccggaggcaagatcacctgcgggatcacaggtgaggcgggcaaggaggatg

SEQ ID NO: 32200 - DNA, 199 bp, Homo sapiens
  chr8:99985845-99986044
  hyper
ggcctaggcctagttcgtgtccatgaagcctctccacgtggccgacttcccttagagaagtcccacaagccctcagccctcacagcctcgcccgcgacgccgtgcccacccctcccctggcagccccgagactctgggcgtgtgcttcccgctccccgagggccttaggcccagcggacgcccggccggagcctgatgc

SEQ ID NO: 32201 - DNA, 302 bp, Homo sapiens; identical to SEQ ID NO: 835
  chr8:99986225-99986527
  hyper

SEQ ID NO: 32202 - DNA, 165 bp, Homo sapiens; identical to SEQ ID NO: 836
  chr8:99986791-99986956
  hyper

SEQ ID NO: 32203 - DNA, 486 bp, Homo sapiens
  chr8:101118005-101118491
  hyper
tctcatgtctgggagcggggataccgctaggagggcaggaggtaaagtccagaggctggcgcgtggtgcggccccgacgccgcgggctgatcctctgtccctgtggggccgccacctacccgcggtgagcctcttctcgggcatgccgtccccgctgcccgcgcctggagcccgcgcgggccgtcagggccctagcgcgcgggtccagcgcgggtcagggcctgagcgacgcggcgacggcgcgcgggctccggagctacgctggctagcgtggccggcgccgcgccggggttgctatggagcttagacaatacggccgcccagggaggccgaggccggccactcaggtgcctttcggggttcccaagctgcgacgggaacacccccgccgccccctaccctcccttcctcctcctctgggcagggaccagcgcggcgaacgaaggctgggggcggacgcgcgtgtggacccccagcgcggtcacc

SEQ ID NO: 32204 - DNA, 79 bp, Homo sapiens
  chr8:101661840-101661919
  hyper
ccacgcgactcagagcgaaccccggcgcccgctctcgccggccggggacatctacaggtggggccggggccgggccgcg

SEQ ID NO: 32205 - DNA, 173 bp, Homo sapiens
  chr8:101821973-101822146
  hyper
tgattggtgcagagacgctgtaaacgcacctttgcggaacacagacgacacaggaaagacgtttggcagtaatactacgacagcgaggggcccgggaagcccgcggaaacgcaggaggcggccaggagaggcagcgctacgcacatcccccccaccttcggagccctgtccta

SEQ ID NO: 32206 - DNA, 446 bp, Homo sapiens
  chr8:102505540-102505986
  hyper
gtgggcgtgagtgcgcgcccgcgtgtggccccgatgggaggcgaggcgctgggaggccggggggcgcgggggcggccggcgccgtcccccactccctcgacatcccgccttcctcccccctcccccgcctccctcccccgggtccgcccccgcattgtttggccaccttcctcaggtgcccggggggaaaggacggttcgcgaactgggggaactcatgtgaggcctcgagttagggcctcggcggggcgcgaaggggcgcctgccactgagcgattcacccgcgcccccgacggcgtctgcacgcccctcgagctcgcggccctccacgcagttggccgccacctcggacgcggcaggcgggactgcgtggggcgcgccgagccttctcggggtgctctcgccgtcaaggccgagggctcggggcggcgggaacgctgggctcgc

SEQ ID NO: 32207 - DNA, 276 bp, Homo sapiens
  chr8:104152711-104152987
  hyper
gccagagactgggaacggtaatgccggccagacgggtccgagcgcctcgggagccccagccctcctccggctgcggggccgctgctcctgctcccgggccgtcacggagccctgagggagggggcgggcgagcgggggccttggggcggccagggcgctgggagggaggactgggcggtggggaccggaggggagggagggccttggaggcggagaggagggacgggctgggagagggcccggactaggggcggcgggcaccgcaggagctccgcg

SEQ ID NO: 32208 - DNA, 295 bp, Homo sapiens; identical to SEQ ID NO: 9713
  chr8:104153267-104153562
  hyper

SEQ ID NO: 32209 - DNA, 30 bp, Homo sapiens
  chr8:104310870-104310900
  hyper
gtggaggtggcttcccggccccgcagccgg

SEQ ID NO: 32210 - DNA, 355 bp, Homo sapiens
  chr8:104511157-104511512
  hyper
cattgaacccatctccgtgcttcgaaaatctgactctaacccgatctcttcgcgtctccgcctcttctttctagagtgagcgccaaaaagggcctgacagacagaagcctttggccccagcaccggcccagcccgtctctagacgattcttgctcctttcaccctcacagcctccagtggtcgcttcatcttcgcaccctcccggccaaccctaactctcctcgtctctcctcgcgctgtctcgcgtcctcccctcaggatccttccgcacattctcagcgtccagcgcggtttcccacaacttcctcacgccccgctcccctcgccctgtccccgccctcgacaccacctgcgt

SEQ ID NO: 32211 - DNA, 1150 bp, Homo sapiens
  chr8:104511983-104513133
  hyper
ctccccgcccggccccggacccagcctggagatcgcgctcgggaggggcggctgccgcccgcggggcgcccgcggtgcccgggcctgggcagcgaggaggtgacgccgcccccgcgggatgagcccgggaggcggaggggcggaggaggtgctggcggcggcactgagcggcggcggcgcagggcgcgcgggccttccgcgccgactccatcgacccaaggggcggcggcggtggcggcggctgagcgaccctgggccgggcgcgtgatgaggaggggccggcgccagaccccgctgcacgtcggagctcgcctggatccgggcgttggcagccgaagggccctggccccgggactctccgccgctagcccccgtcatatcttctccgctttcgcttctccactctagccgggggtggggtgggtggggttggggtctccgcgggggtttccggccccgcggcccgctcccgggtgtgcctggaggagttctccctctgtggcgcgcgggagccctgtgatgcgtcagccggcgggacggatgagttgcttctccgggaaaccgtcctcgcttcctcacgaccctctcggctcccgcctgggtgcccctcgggccggcagtactccgcctccgggcgctcgaagcgagttccccgggggcttgttcgcaggcaccccttcccctccgaggcggcgcgcgcgctcccggccctgaccgcggccggacacactcgcgccccggtccgcctgtcgccctcccgcctgctccctccagtcaccccacccttagctgtccccgccaccttactccaccaccctcccccgcctctccgcgcactccgcgtcccggcctccagttcccctttcccttgaaccgctcacttcacagcccttcgcccccgggaagaagaaacatttcccgaagcgcactcctcagccctccttccccacgcgctcgccctcccctccccctgcttttcttgggggaggggggctgtcgccttggattgaaggccattgatttgtatgtatttgtcccagcgctggaggctgccccagccgccgcgccggtgccgccgctgccagtggagttgcctccccgcttccctagggtggttcggctccaccaaacatgtcggctcctgtcgggc

SEQ ID NO: 32212 - DNA, 527 bp, Homo sapiens
  chr8:104513382-104513909
  hyper
cctccctcccgctggcggcgcccaggccacgagggctgcggccagcgccggccgcccgggctgttttaggggtgtctgagagcaggggtgtgtgtcggggagggagggcgccaaggccggctgaggtgagggtggcgagccttaggcggtgtgattttccttggcgcctttccggatttcctcgctggtcatcttggctccggggccccagcgggactggggctgaacccaggctctgtgcgtaccctctcctttcccgccgcgctgaggcagtgactggggcacagaatccaatatggccgtgcacaggtgctccctggacggacccgggcgaaggcgcgctggcaggggatgcggacgccaccctggtcccacgcctccgcggggcggctctaccagcaacgcgggacagagcagggctgcccacagtggctgcgagcagcgggcggcggcgcgggctaggggcctaagctctgtcgcggtcgggtgggtgtgcgtccgccgccatcttccagcccctccccctc

SEQ ID NO: 32213 - DNA, 16 bp, Homo sapiens
  chr8:104513910-104513926
  hyper
gcgagtgctaacaccc

SEQ ID NO: 32214 - DNA, 253 bp, Homo sapiens; identical to SEQ ID NO: 3356
  chr8:105235249-105235502
  hyper

SEQ ID NO: 32215 - DNA, 161 bp, Homo sapiens
  chr8:105235643-105235804
  hyper
cgccaccgcctccatctcctcctctggacccctctccaataaattggaggtcccggcggccaggaaagccacgtctcctccgggctgggtcagggaggcaggggccagagcctcagggtcccgtggcaccaacctggcttctggcccactggtcccggaac

SEQ ID NO: 32216 - DNA, 191 bp, Homo sapiens; identical to SEQ ID NO: 9719
  chr8:105235863-105236054
  hyper

SEQ ID NO: 32217 - DNA, 187 bp, Homo sapiens
  chr8:105479247-105479434
  hyper
cgacagcccccgagctctgcctcaggctgcaaatccggagcccggcggcctgacgggtttatgacctggccgcatatgcggctcctccccccgggaaggctgggctggagcccaaaggccgggattgaacaggtccgcatggtccttgcacactcagaccccaagtgttctgcgccctgagttgagg

SEQ ID NO: 32218 - DNA, 155 bp, Homo sapiens; identical to SEQ ID NO: 9720
  chr8:105600526-105600681
  hyper

SEQ ID NO: 32219 - DNA, 266 bp, Homo sapiens
  chr8:105601010-105601276
  hyper
gttcggtcagcggggcgcggggacgcggacacttaccgtacaccccagcgaggaaaagcaagagcaacgcagacctccaccgcggagactcttttgtgctccagcgacaggccataaccacagcagatggagagagagaggaggagacggaggaggagggaggagaagctggaggtagacgacgccgacgccgccgccgccgccgccgccgccgccgagccaccggctgctccctgcgctctccgcggctgcgggagggggaaggg

SEQ ID NO: 32220 - DNA, 58 bp, Homo sapiens
  chr8:105601510-105601568
  hyper
ggcaatcccctggcccgcctgcctcggttccctccccgcgctccgctggactttccaa

SEQ ID NO: 32221 - DNA, 115 bp, Homo sapiens
  chr8:105601944-105602059
  hyper
cacgctcaaggtgcccggaatgagtcgggcaaggcttgtgcagagcccctccagtctggcgtggaagcgccaagaggtcatttgacatctcacgctgggtcgggtgcagctgggc

SEQ ID NO: 32222 - DNA, 38 bp, Homo sapiens
  chr8:106330435-106330473
  hyper
ggccctcctccaagccgtccccacgcctcccctccaac

SEQ ID NO: 32223 - DNA, 63 bp, Homo sapiens; identical to SEQ ID NO: 9724
  chr8:106331011-106331074
  hyper

SEQ ID NO: 32224 - DNA, 174 bp, Homo sapiens
  chr8:106331083-106331257
  hyper
cggcggcggcggcggcgggagccgagggagcggcagccgcgaccgcgggcaccgcgggagccccagcggcagcagccgccgccgagatgtcccggcgaaagcaaagcaaaccccggcagatcaaacgtaagtttgcgcgcggggccgggagttggtgggattattgcccaggag

SEQ ID NO: 32225 - DNA, 114 bp, Homo sapiens
  chr8:106331860-106331974
  hyper
ggcgggtccggctcacgccgccaggacgctcagccgagcggggattcgggtggtgtctggccctggtggcgcgcggagtcctccctgggaggggccgccagtcacttcccagcg

SEQ ID NO: 32226 - DNA, 30 bp, Homo sapiens
  chr8:107281960-107281990
  hyper
cagaagcttttttatcgctttaacaaaact

SEQ ID NO: 32227 - DNA, 196 bp, Homo sapiens
  chr8:107282301-107282497
  hyper
cggcgtggtagcctccggctcgcggcgccccacggctcctctcagtctcccccgccgctgccggctcttggtagcttccacgcgggcaggtccggaaactgagcatgtctgcaagcgctcagcggcgccggcagcagcggggctagagctgggctgcgtcaggctgagcccattcacctcgcggccacaggagctc

SEQ ID NO: 32228 - DNA, 57 bp, Homo sapiens
  chr8:107282838-107282895
  hyper
ggaagaaggaaagaccgcgcggcgagggaggagaccgggcggcgagggaggagaccg

SEQ ID NO: 32229 - DNA, 720 bp, Homo sapiens
  chr8:107283112-107283832
  hyper
agggacagtgggctccggaggggcgagtggattcggataatttggggaatcagtaaaaggctagggggcacatcatgatggagtcagcctggaatctgtctcccgctagagtacccgaggccacatgttgggaactggctggggaaaggatggatgtagaaagtggcctggagggccgactggaaaatcgctgagggatttgggtgaagagggggggagctgtgcagtatcgggcggaggaactgggctgctggtagggcctgaaaggttcaggagagggttggaggcttccccgtgccgccccttgaatagtgatttagtactgttatctgaggttcactttcacccctggctcctcctccgtctactacccggcttggacgcacctcggctcgctgtaggcgagctttaggagatttaaatagacattaggcagtggggaaggtagtcgtttacggggggagctgctcgggcttccgttcagtggttcccggcacgctcagggtgcagtgtagggtctgaatgtgtgtattgcgggggtagggggagtggtgtcagttctaggccacaggaattcgtggtctggccccagaggtgcggtgtttttggccgggaagtcaggcagaagtctgcagcgtgcaactcgcagcggggcgtgtgtgtgcgtgtgtgcgcgcgcgtgtgcatgtttccggcccggggtcgcgtgtgtggctgcag

SEQ ID NO: 32230 - DNA, 22 bp, Homo sapiens
  chr8:107284032-107284054
  hyper
ggaggactcagccgccggctgc

SEQ ID NO: 32231 - DNA, 167 bp, Homo sapiens
  chr8:107284055-107284222
  hyper
accaccgtggactccctctatggaagggaatcctgggagtcccggccgtcagaggggttcccaaatccaaagggtccatctccaaggcgtcactccaggggtccgcggttcactttgctgccccttgcaggtgatgctgtgattgttgcctgcggactgggaagcac

SEQ ID NO: 32232 - DNA, 454 bp, Homo sapiens
  chr8:109093726-109094180
  hyper
gggaaggggctgctgcgcgcccttcctgcgcgggtaattcgatgtgcgtgtggtgagtggtttatgtttaaatccacccagaaaattgaatcgtgtctagccgcccttcttctaaaatgcagttggattagttgcatctccagcggactccgagacagaaatacgcactaaatctgcaggaaagcgagttccccgaaacctttctggaggcttccacccgccttctccgctacgcacaagtgatggagagggagggagcagttaaaaagccgcaagtgaatttcattgagaacagaagcctccaccggtgtggctgcttttgcaaagcaaatggagagagcgaagtggggcctgttttaaaaacaaacctctggaggcgaggactccccagaaaaccagcgcgggaattgctgcttaattcagaaagttcccatctcgtcgcagtttccagaaa

SEQ ID NO: 32233 - DNA, 1040 bp, Homo sapiens
  chr8:109094397-109095437
  hyper
cagagagaagaacaacgacgacaaaaaaaaaatgcatgtcagataagaaatacgtcctaaagagacaagtttagatgaggaggtggggcggcgaacatgagtgcggaccgcacgacttagccctgagcgcccgattggcgcccggctcgccgagctcccagcgcgtctcgctccggctccccgcgcctccagggtacagaaaacagagtgttttgtagagctccagggtcctaaaggtggggactggggacccgcaaaagctggggtggagagcacagccctgaccatctgagcccccggagccagggcgtgagtgagcgcctccacacgccacccctgaagcccaccacgcacctttggcagagagggacccacctcgcttactgcgtctccatcggttgccttggcagtggctgtaatccatgcagttcagaatgatgagggcaaaggagaaaaggcgaaactgcatctgggcggtcgggcgggggagagacgcctctcaaagtctaggaactggagggttcgcccaaagagccggcgccggccgcgctgctggggaggactcagagggagactcgccactcacccccgggccgcaccggtcagttcagcgcgatcagcatctctccgccacgaacctgagagacaagaagcgaaaacagggtgtgtgggggatggagagagccccggggaggcagctgcgccttcgcacgtcccaatttaaagaagagagggaaggaggaagcgaacccactgcctagcacgagccgcggagcggcttaatccagagcgggcagctgcggacgagttggagaggaaggtgattataatcagtgaattagcaacctctgccgagccctaagctccgacccagcggcataatgcgttgtgccggcgctccggggaaaggaaagaactctaaaggcactgagagcgcagggctaaaagaacgctcttaggccatttggagtccacggcggtgtacccaagcgccgcagctgcggctgccttggtgtgggttgcctaccgtgcgcacgtct

SEQ ID NO: 32234 - DNA, 63 bp, Homo sapiens
  chr8:109095505-109095568
  hyper
cgtgggctggggaaaagtttgccgagaccggctgggagcgcctggcagctctggaattccagc

SEQ ID NO: 32235 - DNA, 405 bp, Homo sapiens
  chr8:109095569-109095974
  hyper
gccgccgcggggttggcgacgccaggcaggagcgcggagcggcgggtgcagccactgggatgctccgtccccgcccgcgagcgcggtccccaggcaaggggtgcgcccgctcacactctctgcctccctaaccaattgtgtcgcttcctgcgctttctccacggtcacttcacagctaagatttctttctttccgagctgtagaaggcagaacgctctcgggaggacgaagtgatccgaagggatgtggcaagcgcactttccgatggagatgcagaccggctgaggcttgggatgcttctataagtaggtggtgctgtggtccaaggcatctaagtctaggctgcctcggagttcctgggtcctaaagccagaaacgtcccggtttccctgaggtcctaaagaa

SEQ ID NO: 32236 - DNA, 170 bp, Homo sapiens
  chr8:109799570-109799740
  hyper
aggtacggatgtgtccgcctagtactcggagacgaaggagagagagcggggatatgcgctccagctctgctaggctccagggctctcacccttgcattcaaagcctccaccccatcccactccccgccactcaccttctgcttcggccacccggtgcggctccagcaccg

SEQ ID NO: 32237 - DNA, 15 bp, Homo sapiens
  chr8:109799888-109799903
  hyper
cgggagttgtaggcc

SEQ ID NO: 32238 - DNA, 345 bp, Homo sapiens
  chr8:110703537-110703882
  hyper
accgcataggcgccccggtcttaccctttctcgcccagaagggccccatcgcgctgtccaggaggaggcacctacgtgcgcccgggagaccgggccccggctgggccgggtgccggtgcggacgggaccccgcgtcgctgctggtttgcgctcaggcccggggagccgggcccggcccgctccgcccgccttagcccggcttggacacgtggtgccgcggaatcccttgcgctccggtgccctcggcccctcggcctctgcagccagccgggcggctgctggggctgaggacaaaatggagagaagggcgggggaccaaagggcaggcaccgctgggtggggcgc

SEQ ID NO: 32239 - DNA, 65 bp, Homo sapiens
  chr8:110704189-110704254
  hyper
gcacccttgtcctcacgctggagaggaagagccctgaacactgacttcagcgtgaacctaaggtg

SEQ ID NO: 32240 - DNA, 52 bp, Homo sapiens; identical to SEQ ID NO: 9735
  chr8:110986212-110986264
  hyper

SEQ ID NO: 32241 - DNA, 691 bp, Homo sapiens
  chr8:110986328-110987019
  hyper
cggggttggcatcgtcgcaaagctccagagggctgggcacggcggccagggccccggggcggcggtaggaagccaccaccacggccagcttgccaaggcgcgtgtgcgggaagcaggacagcgcctgctgcgagagcacgaagcggctgccgcccacgttgaccgtgaagcagtccccgagcgccaagggctccccttcaccctcgctgcagaagacactagagtccagggaggtcagggagccgctgtccagcggcgagtccagcagcgctctgccgctggaaggcatctctaacccagtcgccgcggcctgagggcgccacaaagttggggacacgccggaagctttggtcccgcgagggcggtggcacggcccctggtggcggccgggattccccgggctcccgaaggggttacctctccttggcgcaccctctccacccgctgtgcgccttcctcctcctgccgctagggagccgggagtgcgcggaagcagcgcacaagtggcagaaagaggagacagggagcagaggaagggtcgcgctaagagagaggatcaggtgaggtccaagcccgacacagtccctgtgcacactgccggtcgccctggcccttcccaaacgttgtcaccccgcctcccaacttcgcaattgcgattcccagcccaggaggtgtacagattgaatgactc

SEQ ID NO: 32242 - DNA, 202 bp, Homo sapiens; identical to SEQ ID NO: 9738
  chr8:110987020-110987222
  hyper

SEQ ID NO: 32243 - DNA, 146 bp, Homo sapiens; identical to SEQ ID NO: 9739
  chr8:110987765-110987911
  hyper

SEQ ID NO: 32244 - DNA, 15 bp, Homo sapiens
  chr8:114444379-114444394
  hyper
ccaaccagatgattc

SEQ ID NO: 32245 - DNA, 34 bp, Homo sapiens
  chr8:114444481-114444515
  hyper
cgttcaagccctgtcagtccggtaaattgggtta

SEQ ID NO: 32246 - DNA, 408 bp, Homo sapiens; identical to SEQ ID NO: 837
  chr8:114444784-114445192
  hyper

SEQ ID NO: 32247 - DNA, 500 bp, Homo sapiens
  chr8:114445521-114446021
  hyper
gttgggaaagactgtcgccttatgggcgaggactgtgggtgtcagtccccgggacacacgcggggctgaaagctccggacatggccacctgggcgggcgtctgtaaaaggtgctaatgagtgcctctggcagctcttccccctcataagacacccgcgcccctctccagtagcaactaactgcgggagaggatgcgatttccacttttccaaaagacctctgtggcaggagtagtatctccttggagtctcagagcacgcagaaacgtggatccttcgcgaagtcgctctggcgagaatccctggaaagacgctctggcgtggggtgcgcgacgccgcacccggtctcccacctgctgcctacccagagatctgtgccttcgcggtaccttcgctgcacggtgtgtgttcccctgggatccactgacaagcagcgtgggaaaacatcccatggatgtctctttacatgggcgggacgcttaagcacgacttggagattca

SEQ ID NO: 32248 - DNA, 388 bp, Homo sapiens
  chr8:114446958-114447346
  hyper
tccaaagtaaattaacgcgcctttcctttctatcggcgcatctcattcggaaaatacggtaggtgcgggcagccggggctctaattgcaggcggcgcggatcagcgttagtcaggctgtaatgctcgccccgcttcggagacttccctccccctcatctgcccccgaatgtgttttggctcaacaggtatcacatgaaaactcgcacttaaaccctggtcatcttctcacaggagccacccttacatttttctgccagggctgctgctggctattcgcgcctcccccacgcgaagcgcgcgtctagcaggcagccccagggccatccattaaccaccaactcccagtggcaggcgaactaagcataaatgtgtggctcctcacccgtc

SEQ ID NO: 32249 - DNA, 101 bp, Homo sapiens
  chr8:114447347-114447448
  hyper
agccagcgacaaagaaaccttgtaagcaacctgagccgtgctttgtacatttggcagtgtagttgtgccacttaggacaagcttttcggctcagagctgct

SEQ ID NO: 32250 - DNA, 32 bp, Homo sapiens
  chr8:114447789-114447821
  hyper
tgttgacagccctggcgcgcctgggccaaaac

SEQ ID NO: 32251 - DNA, 73 bp, Homo sapiens
  chr8:114448753-114448826
  hyper
ctgagggggggagaacgagctgtgaatcaactcctttagtattatcagattattttatcggtgcaaattgcaa

SEQ ID NO: 32252 - DNA, 67 bp, Homo sapiens
  chr8:114449039-114449106
  hyper
ttggattcctttgctcggctttcccctttgcggatccctttcatattattcgcgagctcctaattcc

SEQ ID NO: 32253 - DNA, 200 bp, Homo sapiens
  chr8:114449402-114449602
  hyper
cttgctttttttccccgaatagatcaattctgcctgtaaaagcagcccaagaaataatgttagtgagctctccgttgcaggctgcgaatacagaagcatgtcaaaggaatattttaatcggaggatctgtgttgcttttggggaaaccgtgacgataatgaatcgggctccatcgatgcccacgtcgttataatgggaca

SEQ ID NO: 32254 - DNA, 34 bp, Homo sapiens
  chr8:116660538-116660572
  hyper
gcaccgcgcagcagccgaggatgagagaggtaac

SEQ ID NO: 32255 - DNA, 86 bp, Homo sapiens
  chr8:116660615-116660701
  hyper
cgataacacgcccacagcccgggcgccgagcacgcgtggtggcggccgcaggcccggggctcctgcgagagcgaacgccagcgaca

SEQ ID NO: 32256 - DNA, 639 bp, Homo sapiens
  chr8:117950319-117950958
  hyper
ctgggagcaaaggagcgtctctgaatggcggggcagttgcagcatcccacttggcaagggtccttgaattacctccgcccccgccctgaccccgccctaaacatcaaacttagaaactcatctttcagcagcagcggtagagcagtgaccaggcgtctccgcgatgggccccggggacttccgccgctgcagagagagaatttcccaggggctccagggactcccaggtagagcggagctttggttcccacctcgtcccgcgtgcgacttcttcggggacggcaggagcacggacatccaggaggaggccctcgccgccagcccgctgctggaggacctcagacgacggctgacgcgcgccttccagtgggcggtgcagcgcgcgatctcgaggcgcgtgcaggaggcggcggcggcggcggcggcgcgggaggagcagagctggacgggcgttgaggccaccctggccaggctgcgggcggagctggtgagagagcgggctaggcggacggctcccagggctccctctcccgggtcctctcctccagctgcagagccgctggccgcgtagcccacccgacgccttggggggcccctcaggtctggacacggcgttgacgcccccgcctccccagcatc

SEQ ID NO: 32257 - DNA, 107 bp, Homo sapiens
  chr8:120428615-120428722
  hyper
tgcactgcagccaaccggcttgtgcgcgtcccaggagcgcgctataaaacctgtgctgggcgtgatcggcaagcaccggaccagggggaaggcgagcagtgccaatc

SEQ ID NO: 32258 - DNA, 39 bp, Homo sapiens
  chr8:120429017-120429056
  hyper
cgggccggtgccctgcgacgccgccgacctgcgcccccg

SEQ ID NO: 32259 - DNA, 30 bp, Homo sapiens
  chr8:121135998-121136028
  hyper
aaaggcgccttgctgcggccgcgccctgtg

SEQ ID NO: 32260 - DNA, 601 bp, Homo sapiens
  chr8:121136826-121137427
  hyper
gcatcgctgctttggcgttttagagcccttggacttgttcacaagaggaagagggagaagaggaggctcgaagggggcctttatagtggatacctgtttcactcggagctcagggtctttgacgcgggaaggcaaagtctgtcttttggaaatggggaagtgggcacacagcacctgagaacaggagggctcgagacctcccaaagagagcagggggcctggtttgggagcttgcagtagcttctgccccagtggaagggaaagagcctggctcgctctcggcgcgccacatccggctgccgcgcgcacctggggggaccgccaggttcggggtaggcgagcgcgtgagcggcacggggctggcttctccacatctccggtagggcggggatgggggagaggaggaggagagaaagtgggggcgttatgggcttaggcctgcctcccacctccccacctcccgcctccgcggccaccctccgctctataattggctgccggcgggccttcctttcctcttatctgatcctgggctcccagctggagaggcggaggcagctccagggggctggaagtggaagcgcagcggcagaaggagagg

SEQ ID NO: 32261 - DNA, 81 bp, Homo sapiens
  chr8:121137638-121137719
  hyper
gaaaagtggaggcagcgagccacctgcagacgcaatgcagttccatggactttcttttcacgcgcgcgcccagaatggact

SEQ ID NO: 32262 - DNA, 42 bp, Homo sapiens
  chr8:122651743-122651785
  hyper
cggacgtttgggggacggagggagaggcgctaggggaactgg

SEQ ID NO: 32263 - DNA, 373 bp, Homo sapiens
  chr8:122652029-122652402
  hyper
cgggaactgccgtgacgaattccccccaaggtgttgattatccatcccaacccagcctctggcttccctcccacctccaccccagctcccacaggcccctcgccccgttcatcggctgggcgctcgagacggcgcccccagatctcccaccgggcagtgtccccagctgcagctgaggagagaagcgccggcgtgcgcggtgccacgtcggaattggctctggggacgccgcagctgccgaagcgcagcgcgcggtccccacgcacgccctgcctccgggcggccggcgggctggcccggcgaggagaggagggatgcgcgccctcctcccgctcctatctgcgggtgccaccgcctgcgtcagggacccctg

SEQ ID NO: 32264 - DNA, 323 bp, Homo sapiens; identical to SEQ ID NO: 9754
  chr8:124173095-124173418
  hyper

SEQ ID NO: 32265 - DNA, 30 bp, Homo sapiens
  chr8:124934797-124934827
  hyper
ctcagagaccattagcgagagaaggcagcg

SEQ ID NO: 32266 - DNA, 30 bp, Homo sapiens
  chr8:126400946-126400976
  hyper
gtgagactatgagaacgtaggattccatct

SEQ ID NO: 32267 - DNA, 164 bp, Homo sapiens
  chr8:131455233-131455397
  hyper
gggcctgccaagcagcgccgggtccgggtaggggccgggggccgcggggaactttcctcggctgcaccagagacaatgccgggagggcgccccatcggcggggtccgggccgccaagcacgtcgtcccgggccctcccccggagggggacgcgaaaccccccag

SEQ ID NO: 32268 - DNA, 476 bp, Homo sapiens
  chr8:131455603-131456079
  hyper
cccggcgcccttcttcgcgcgagagactgggcagggggcgcccgcgactgtgggcgactccgcccggccccgccgagcgcgcccgagcgccccgcaactcaccgggacctggcgggccgctgggcattattccatcgcgggttcggccgggcgctcgcggctctcgggtgggaaagcgaactgcgaccgggaagcgccggctgggcgggaggcgcgggcccggggctgcccagcgcacagtgctcgcccgcggcagcggccaggccaggcgaggcgcgggagccgagcgcggcgcaggaaggggcgggcgaccatgtgccgagggggaggaggccgcggcgacgcgagcggctcgcacgatcccgctcggcggcggagggcgcgggtttcaggaaatccaaacacttcgacaggaaatcggaatcctgactaagcattcccggccccgagccgctccgcgccgggggctcccgcct

SEQ ID NO: 32269 - DNA, 366 bp, Homo sapiens
  chr8:132051934-132052300
  hyper
caggatgcccttgagcgggtccatgggggccgaggccaggctcaagtgtaggaccaagagagtgagtttggtcagcacgtccagcacgttcatcaccacttccgatttgcgcctttggcccaagaaatagcgctggtagaggcgttccaaatcccgagatttgaaggagttgcgcagggtggggaaaatgacccctcggtagctatagcccccattaagaaagaaatccgagttgctaggggcacagtcaaggtgcaggaagcccaggtcgcccccgcctccgctgccgctggcactgccgctcccgctgcgttccgggaagactttggtgccgcaggtgctgtgcgctcgctctcccgggcccag

SEQ ID NO: 32270 - DNA, 118 bp, Homo sapiens; identical to SEQ ID NO: 3368
  chr8:132052398-132052516
  hyper

SEQ ID NO: 32271 - DNA, 409 bp, Homo sapiens
  chr8:132052589-132052998
  hyper
cgcagggaaggaggcccagaaccttggggaggcagccggaggaggggttcctaaagactcaaaggcggcctggtaggagcttggcaaggatcctttttatcctaggctgccccgttgcaggagccctgcgctagggctccctgtaggtcgggtcatactgtgcccaggggcaaagggcacctggaagatcgcggcggacctcggcgtccttgcgtgctgctctcccgccagccggcgcagcttgggtacgcagcggcagtggctatttgtcctcaggagccgcagcgctgtgagccacgcagccccttcctgggctcaggctccttggttgattctaggctcagcgttttggcgcagcctttgctctccaagagacgcctaagcgcctgggcgccgtgcttctgctgcg

SEQ ID NO: 32272 - DNA, 324 bp, Homo sapiens
  chr8:132053217-132053541
  hyper
tggcggggcgccccgcgacagggttggagaggtggtagcctcggcgctaacaattcaccaaatagttaatttggaggaaggggtatgctgaggctccctcctaggctctttcctagttcgggagcaaggactgacagcgcagcgctggctctggccagaagcatccctcccggagggggtgtggggactctcgctccagggtcccagcctgagctataagacgaggtcaacgctttcagctgtgctttcgaagggtcgcagcacacagttctcatcccctttatttcgttctttggagtccatttggctcggagctaggaggat

SEQ ID NO: 32273 - DNA, 838 bp, Homo sapiens
  chr8:132053746-132054584
  hyper
cctggagctctgaaacgcaccgcgggcgccaggcgactgggagaaatttggagacctgtcagagtggtcagacacccgcggtgacttaaacccgcccccgcgccaagccacgcccccggaaccgggccgggggtggcggagggacctgccatccagatctggccaggacgccccaggtcttgtaggcagaggcacgcgcgggccggcgtgggagaggaccactgagggctagggccggcgggcgcccccggccttccctgggcgcactgcgatccagcgttccagctggccgcgccagccggttcctccgctgttcttttttaggcattggctcttgtcctctgcaggtgcggagccaggactcgtaggccgctttgcgcacggactcggagagcccagcgcgacggaatacagggtttccttttcgcccttcctacccgtgcgtcttttggcaaagccaactttcgggctaaacgcaaaatcccccaagaggccgcaatcatagaggcagtcagtttcctacaggagcctctttactacctcgatccgaagggggtggagggtacgggacatcaaaatggggacgtcccctgcctgcctcgcacactaagtttctccgcttacaatagggtcgaggaggcggacgtggagaaaggcatgtccaggggccccgcctcgccctagcccaggtttcccgcccgcccagactcagccgagcgctagcggacaaagcctgcggcggagcttgcggcggaccaagtcgctgagcggtgggagcttagtgccggtgctaatgacagatgagccgcgtcccggggtgcagggtctgcagggcaaa

SEQ ID NO: 32274 - DNA, 205 bp, Homo sapiens
  chr8:132054593-132054798
  hyper
cgcagtcccgcagccggatgcaggtggaggagcggtggtggtcaccacctcctccaccaagactgcggctgcagccagtggagcccgggcccagagcacagtcagctgatggccaatgacgtcaggccctgggcgcgttcgcggctccccgtggcgtcccatgaaagcccaaatgaccgccttgccttgccgccccctcagtccc

SEQ ID NO: 32275 - DNA, 312 bp, Homo sapiens
  chr8:133492319-133492631
  hyper
tctcagctccagccccgaccccaagtccccaagcgcgccgccgccgagggcgccccgagcggccgggtactcacaccaacgcgtggtaaagcagcgcccagccccgcggtctctccagggcgtcgtagatcaaagtttggatgcgccggtacttggcgttgtttctcttgactgggcggctcagcggggtcttggccaggagcccgatgccctgcggggtcctccgctgcccctcgtcgcggccgccgccctccagcagcagggtcccgtctttgtcggctccggccccgagcgccaaggtgacttgctcca

SEQ ID NO: 32276 - DNA, 182 bp, Homo sapiens
  chr8:133492712-133492894
  hyper
cgcctccgccgcccccgtcgccgccgccgccagccgcccccgccgccctgcgcgccttgagccccatctgcctcgcccccgccggccgcttcgccttctccgctgctgctctgggaagaaggggcgctcggggtgcgtgaacgaggcggcggcggcggctgcaagcccgggaactccaatgc

SEQ ID NO: 32277 - DNA, 135 bp, Homo sapiens
  chr8:133493617-133493752
  hyper
ggactggggggttgtcgcccaccaaacattggctctgtggttgcagctttgtgaatttccctcaccccctacccctgctcctcggcttcagaggtaaaagccaagttgtcgggttggtcaaggccgggcgcaccg

SEQ ID NO: 32278 - DNA, 30 bp, Homo sapiens
  chr8:134581243-134581273
  hyper
tcagaaggcagtttccgcctgctgctgcag

SEQ ID NO: 32279 - DNA, 190 bp, Homo sapiens; identical to SEQ ID NO: 9765
  chr8:139508757-139508947
  hyper

SEQ ID NO: 32280 - DNA, 230 bp, Homo sapiens
  chr8:139509693-139509923
  hyper
cggggctcccctctcgagccaagaccccaggcctcgggcaggaaaagggtccctgcagatatccgggggcggggcgcggcggagaactggctgggaggggactgttgaacttggaagagaagcccaggcaacaagtagatgcctgagaaagggtaaaagcgctgagcaacccatacctccaatgcgaagtcagcagtggccttcaaccagccagccggcccgtcatccga

SEQ ID NO: 32281 - DNA, 30 bp, Homo sapiens; identical to SEQ ID NO: 9766
  chr8:139926700-139926730
  hyper

SEQ ID NO: 32282 - DNA, 65 bp, Homo sapiens
  chr8:140643383-140643448
  hyper
tcatctgggaaaagtcgctaatctttctttctcatagatgagatgtcatgcgatgaatgttttct

SEQ ID NO: 32283 - DNA, 307 bp, Homo sapiens
  chr8:140714570-140714877
  hyper
taaggctcagagccccgcgcagcccagcccgcgccggggcggtgggtgggtgggtgtctgctatgggattattcttagcgctccactctcttcgcaaaagtggcgcctccgccctcccggctcaggcacactcgctcggggctcgcacgcccggcccagacaccagcgcggtggagagcaccgggtggggtccccgaagggtgaggctcggaggcgccgcggagggggggctccctagagaggagggggcgctgcgggaaggcccccaagggaggctgcgtttaaccctcgacgccctgcacccagc

SEQ ID NO: 32284 - DNA, 369 bp, Homo sapiens; identical to SEQ ID NO: 9768
  chr8:140715219-140715588
  hyper

SEQ ID NO: 32285 - DNA, 323 bp, Homo sapiens
  chr8:140715699-140716022
  hyper
cgggaaccggagccagaaagcggccggagggcggccgcggggcccggtacccctgtgggtccagctcgcgggtggcggtgcccagcaaggagcctgcaggtccgcgcgcccagcggaacctgcttccccttttacccctcctcgccccctctcggtggtggggaggaaaagtttgcgaagtggcggtgtctctggagtcccctgcaagcggggagggggccgagcaggtgcagcgggaggggcagcccgctccccaaaggtccgcgcgcccagcgcccacccgggcgcgcgggtgcgcagcggggtccccgccgggcgtcggc

SEQ ID NO: 32286 - DNA, 14 bp, Homo sapiens
  chr8:140716339-140716353
  hyper
cgaatgtgtgtgtg

SEQ ID NO: 32287 - DNA, 498 bp, Homo sapiens
  chr8:140716681-140717179
  hyper
gggtccttctagccccgctccccaagagcgcaagcagccctggcgggtggagagtttgagggactcggggttggaggaggaaaacgggattcagccagagatggcaggctgacagcttcaggcagattgggcagagagtggggagcagaaggggagggggccatgggcacacaggagagcggcagcagcggttcacgaagtcttccccaccccccaccccccacctagccacccggcgcgggagcgtgtcattggccagggacatggcctcgtggagtggtggggtcccgagggctgcctcggccccctcgcctcccagcggcacagcccgcttgggccagcacctgcagacccgagtcgtttccctggagagcgctaaggacagcatgggccgccacttttggagtcaggacagcggggaaagacatcgcaatcccccgacccagtaacctctctgttgctttactgaaggaaaaaaaaaaaatacacacacacaca

SEQ ID NO: 32288 - DNA, 137 bp, Homo sapiens
  chr8:140717239-140717376
  hyper
cactctttgatatatataatcactctttggttccccacagctgggcgcaaggtgcgccgtggatgcagccctgagccacgcgatagccccctcgagaccacctggggtaggaacacgaggctcgggctggggcgcac

SEQ ID NO: 32289 - DNA, 153 bp, Homo sapiens
  chr8:140717707-140717860
  hyper
gtcccttctgtgggtcgccccctggagcggtgctcgggctccctggcctcagggaccccgggcccagagggtctgggaccccagtgattcaccgaggcctcccagctgggacgctctgcaccccactttcagggatcacgggtgcccaccagg

SEQ ID NO: 32290 - DNA, 191 bp, Homo sapiens
  chr8:142528212-142528403
  hyper
ctggccacctctcttcgcgcccggcctcctggtctcccgcctgcgcgggccgctcccggccctccccgccctgccgggcgttcactgtcccctccgcccgcaggtcccgcggcgcccccggagcccgccttcccggacatctacggcggggacgcgcagctctgggaggcgcatttccgcggcatcgggcg

SEQ ID NO: 32291 - DNA, 153 bp, Homo sapiens
  chr8:142528454-142528607
  hyper
cgagaacttcacgctgcccttcccgttcgcctggccgccggggtccgaccccgcctgcgggccgctcttctacgacccccgcgaccgcgcagacttcgacttcctgctgcgcggccccggagcttcgcccccagcgctgctgcggcccctgca

SEQ ID NO: 32292 - DNA, 112 bp, Homo sapiens; identical to SEQ ID NO: 9773
  chr8:142528670-142528782
  hyper

SEQ ID NO: 32293 - DNA, 128 bp, Homo sapiens; identical to SEQ ID NO: 9774
  chr8:142528834-142528962
  hyper

SEQ ID NO: 32294 - DNA, 15 bp, Homo sapiens
  chr8:142529027-142529042
  hyper
cggaggcaggccctc

SEQ ID NO: 32295 - DNA, 235 bp, Homo sapiens
  chr8:143530528-143530763
  hyper
attcatctgtgtgtccgtcctgccgtccaccatccatcatccagccagccagtggggccactcccctgctcctggagaaggccgagagcaggaacccaactcttggcttctctgctgcgcggggcaggcaccgggctctcctaggtgtgcgcgcgtgtgtgcattttatccgcccccccttatctcgctcccctccccccacacccccgccccccgctagcgctccccctctaat

SEQ ID NO: 32296 - DNA, 751 bp, Homo sapiens
  chr8:143531020-143531771
  hyper
ggcaggcgagaggagcggagcggcggcggcggccggagagggagcggcgggcgcaggcggcggcggcgggcgcggcgttggcggcggccccggcggagcgagcgcggagccggagagccgggagcacaggcggccgcgccgcgtcctggcccggcccgggcccgcgcgccagcatcgtccgcagcgcgggcatccggaccctccgggcgcccggggggctccagcaggcgcgggggaacgggagggggcctgcgtgcgccggcgggtgctctccagggggcgtcccggcgaggcccagagcgggccgggggcggcggcggctggaggagccccccccacctccggtcgggcgcccggctcagccgccggcgacgcgaggcgctcgcggggatttgcaactcgccggatcgagtcctcgccggcggggccgctgctgctggggaaggtaaggaaggctccggcggggggctgggggcgcggcgggtgggggcgcagcgagggtgggagggggtcgggggaggggcgggcgcccagacttcctaacttcgccgtttggggcttcgcagctccgaggttttgcgctcagagctcaggagtttggacccccaccccctaccccctcagccccctgccttctccagcggtggcgatggaatgtggcaggtccccgcgagcccgcattgggcaggctgaggagggggcgaccctggacgcaggagaggctcctcggcgccgccgcctcctccccatc

SEQ ID NO: 32297 - DNA, 514 bp, Homo sapiens
  chr8:143531996-143532510
  hyper
gacgtcctccccccacgcacagagctcggggcaggcaggagaaaaccccagactccttctcgaagccctcgctcgtagaagccctcgcctgtagacctggcattggcagtggagactccctggaggtactctcccccacttcgggcggagggctatttttgcgccccccacccccacgcgaacgcctggctcttccctccttgtctacctttccactgggtcggacaggccgcgcggataagccgctctcaactttgggccggccctatgccgtctccgctccaagcgccgagcactcccgggcgccgagcactcccgggtccgcgtcgccggtgagcagaggccgccggccctccaccgtcgccgcgctagcttggagccgcgcggagctgcctcgaggaacgagcacggcccccgccccctcctggggaggctgggagctctggacccggccaggagccctctccctaggtccccgcggccccctgggcgaggtagagagctcctccggcct

SEQ ID NO: 32298 - DNA, 958 bp, Homo sapiens; identical to SEQ ID NO: 3374
  chr8:143532541-143533499
  hyper

SEQ ID NO: 32299 - DNA, 141 bp, Homo sapiens; identical to SEQ ID NO: 3375
  chr8:143533500-143533641
  hyper

SEQ ID NO: 32300 - DNA, 497 bp, Homo sapiens
  chr8:143533708-143534205
  hyper
cgggcgcttgttcctgccggggtcccgcgcaggggcggatagagggcgattcgtcgcctcggcctcaggcagcactcatccggatcccgggctagggagggggcgcagccaagttgtggagccctcggaggcccttccctctcccgcaggctccggcccctctcggacctcggtggccgcgtccgtgaaatggggacgcgggctctgctctcggatcccttccagcccccgaccctccgcacttgtcccgagatccaacgtgcccggtccgcagcgtgctgggtctgcggcgtcagggtggcccgagtcccgagaccatctgcgcttgcggacacagccgcggggcctggcatgaagggccccagggagggcctagcaagcgcccggggtccgagcagcctcctgcggcgtcctccgcccccggtcggcccgaccccgcctccgggagtgggtcgtggggcgcggagcccgtcctccggggacgccgcggggctcca

SEQ ID NO: 32301 - DNA, 304 bp, Homo sapiens
  chr8:143534453-143534757
  hyper
gcctcgcgtctcggccggagcccccctcgccggcccggcccggtccccgtgtgcggtgcgctggcgtgagcgcgcgtttgcgtgctggtgtccatgtgtggcgcgcatgcacgtgcgtgcccgtccgggaggctgggggcacgtgtgtgcaggcatgcagacttgcacatgtgtgtgcgtgacgggggcgggtctcgcgccggtgtggccccggatggcaggatttagtcaaaccccgttttaccgtcggctctggctctgggctgcccccgggtctgctctgtgtgcacgggatggacccctg

SEQ ID NO: 32302 - DNA, 255 bp, Homo sapiens
  chr8:143591552-143591807
  hyper
tcctgtgcttaaatgcgtgctcagatgaaaagcggggcagtcgcggcccgtagacagcgggcggctgggtcagaccgcagagggaagtttccagcggcaagcctccccgcggggaaggctgtgtctgtcccaggagatgagccgcaggcaccaggggtgatgaggcccgggggaggtggatgtgggggatggagcggtcccaaggtcgtcagctccagccggcgccctgggccgcggggccggagagctccggag

SEQ ID NO: 32303 - DNA, 156 bp, Homo sapiens
  chr8:143591888-143592044
  hyper
cgcgcccctccgggcctccccctccttcccgcgcgggccgggggcgcgggccccggaggagctgggggcggcgggggcgcggggcgggcgactgccgggccccgggccagctctcgccccccgccccgcccccgatcgctcggctcccccgcccgg

SEQ ID NO: 32304 - DNA, 178 bp, Homo sapiens
  chr8:143592101-143592279
  hyper
cggcatgggcgcccgggccgcggggcctggcggcggcgggcggacgggcgcgcggctgcgggcgcaggtgcggggcggcgggccggggccggggccggggcgcggagccgccgctcgggggccggggcgcccgcgtccccgccgccgctgacgctccgcctgtctccctcccgtgtcc

SEQ ID NO: 32305 - DNA, 221 bp, Homo sapiens
  chr8:143592358-143592579
  hyper
cgacgccctccggacgcgctgcctctgtgaccggctctccaccttcgccatcttagcccagctcagcgccgacgcggtgagaccccggccgggccggcgggaggggcgccgggcaggggcgcgggcgggggctgccggcgggcctgcgggtggggagggcccgcacccgtcctgtcccggaggggtcgctgtggcccgcagccgccgtggcctggcccggc

SEQ ID NO: 32306 - DNA, 24 bp, Homo sapiens
  chr8:143592663-143592687
  hyper
cgggacccccggaaagtggctgat

SEQ ID NO: 32307 - DNA, 200 bp, Homo sapiens
  chr8:143695463-143695663
  hyper
cctgcttggacacctcggccagcaggtgccggtgcgtccgccgcacgtgctccagcatctcggcccggcacttcccgatctgcaggatcacgttgggcttggccacctgcccgccccgcggcccggggtaggcgtggagcccgccgctggtccggtggtccagctccatctgtgcgcaggtgctccggcaggcggcaaac

SEQ ID NO: 32308 - DNA, 39 bp, Homo sapiens
  chr8:143858697-143858736
  hyper
ccagcgcgagctcaccgcaggccccgccccaggcctgcc

SEQ ID NO: 32309 - DNA, 45 bp, Homo sapiens; identical to SEQ ID NO: 9788
  chr8:143859143-143859188
  hyper

SEQ ID NO: 32310 - DNA, 56 bp, Homo sapiens
  chr8:144099611-144099667
  hyper
tccaggtgtcagtgacggtcaccccgacctggtcccctgtccggcctcgccaggtc

SEQ ID NO: 32311 - DNA, 184 bp, Homo sapiens
  chr8:144241250-144241434
  hyper
gccccttctccagagcgtccgccgtcacagcatccccgccgggagacgtctggcctctggggcgaggtgacagctcgagacgcctccgccccgcgccggcacctgtgtgggggagcggatggggggcgtcctcttctccccggggagctgcaggtgcgtccggacaggaatgagcggcaggggc

SEQ ID NO: 32312 - DNA, 87 bp, Homo sapiens; identical to SEQ ID NO: 3378
  chr8:144241435-144241522
  hyper

SEQ ID NO: 32313 - DNA, 120 bp, Homo sapiens
  chr8:144241583-144241703
  hyper
cgcgggcctcggggtcggggggctcactcacatcccgggggtgtccgcactccgggctcgggcggcgtgcgcggcgcggggagctgtgcccttcggtctccctgcggaccggaatccggg

SEQ ID NO: 32314 - DNA, 482 bp, Homo sapiens
  chr8:144241757-144242239
  hyper
cggggcggagccggggcgggggccgcgcggggggcgggggcggctgggagacgcgcggggcggggggcgcccggggctcgcggcccccacgcaggtagctggcccgggccctccgcgcccccttgctggcgcgcgcgctccctcgggttcccgctccctccctcgcggcgccccctgctcctccccagcctccgcggccccctacccaggcgtgggcaggatcccttccccctctgcttggctgagatccccttggaatttctcggaagaacgtttactgcgaaaggaagcaaaatgcacaaagacgcagagagggggaggtacccggcgcggcgccacgcgcaggtccgggttcgcagacccctggggtcagactcccgccctggggccccgccctccccctcctccccgcccctccccaacctcatacccgtttccccgtttccccgtttccagtggctccaggccgttctcctcccctg

SEQ ID NO: 32315 - DNA, 406 bp, Homo sapiens
  chr8:144328190-144328596
  hyper
gctgggagcacatcccggaggggctgcctgcggcgggaggagcggcaggggccacgtggtgggggacggctcgccagggcgcgcacgcggtggcggcggcggtggaggcgttgcccgcctagctaggggcccgcggcctggagaggcgtcggttctccttccgcgctgaaggcggagacagcgacttcccgtggaggcaagccgtgggcgccgcggaggcgggggctgggggtcggcggaggcgggagctgggggtcggcgggggctgggggttggcggggagcgtcctcagggacaagtctcccagcacgcggccgcgacctccccgttgggggtctggagccaggagcccacgcgcgtcggatccggagagtctggtgggcgcagcctacgtgacagggtcggc

SEQ ID NO: 32316 - DNA, 49 bp, Homo sapiens
  chr8:144490051-144490100
  hyper
ctgggggcgggagaccggagaagaagcaggtgcacggggaggtgggtgt

SEQ ID NO: 32317 - DNA, 112 bp, Homo sapiens
  chr8:144503380-144503492
  hyper
tgcaattcatcttcccgtctctcttcccatacctgagcctcgtgccgcccgggattgcggcgcccgcgccaccacgctggggtaatggtcccagcaccgctgccctgcgtcc

SEQ ID NO: 32318 - DNA, 50 bp, Homo sapiens
  chr8:144509068-144509118
  hyper
caggctgccagaagtcgctgggtcctgtactttctcggccagggaaaggc

SEQ ID NO: 32319 - DNA, 2852 bp, Homo sapiens
  chr8:144509520-144512372
  hyper
tcctccaggtctctccgcttgaaacgataaaacaaactcaggagactcactcacagaggattccgtcccgtccccagaaagaacctccgcttacccccgatggaaaagcagcacagccccctcccaagaaaggcgagtttggaagcccttgcaggccagaagccctctctccaaatttgcaaaccacggaccctcgcctgcctctcttccggcagtgaagggagggaaccatcaacgacgtgtcctgcagccgccctgggccctgtgaactgagatttctggggtactgcctcctcccctgtgctcccagtccatgcccagccagccgttcagaggagcaagggtaggctgcgccttcaggtgggagacgggcagactccgagggctggggacagttctggccaccaggatgcagcggtgtgtcccaccaaggacacctcctgccctgcacccccagcctgcctcagtgactctccccaaaagcccctcggccttctttgccgagggcagacgcagagggcacaggtctgcggggtgcaggccggctaacgctgcctcgctgctcagtttctccctggtcctgccgtcacccagggcccgtccgtcacccagggccagcacaaagcccaatgcagggccctcctcttccttcaattcagggagaaacacggcaaaactgaaagccaccgaccaaccagccaggctgcggtgacttggatctgaacagatttattttgtgtatttttttctttttctcagtttcgtagcaaatgaaaaaagaactcaacgaaaaccaactacacaacaaaactttcaacgagtcggcgcgccttccactccgagtgctcaggggaggggtgtggagcggctggaatcccactgatggcccctgagggcctccgaaaacgggcagatcccccaggcgcctggcccagcctacagggcctggagcacccgcctcctcgccctctctcccggctagtccaaagagcgacgaagcattaaagaaagattccacaaacaaaacgaaacacaatttaaattaaaataaaaacactttctccacccgccccatgccagaaggctctggcccaagcctcctcttaaaaaaaaaaattttctgctagaaatactgtgcattacttttttctttcacttctcttgaaggttaaaacaagatgtatttccccaggagttacagatatgttctggtgcatagagagacagcagctcgggatccgggccagcccccacccgactgagcacaggactcacccccctccccccacccccggttgagcatagtaggacagcaggcctggacacagcacgggtgacgtccctggcttcgacctccaaggaacgccggtagcagggtcgggggcaagcggggagggggcaggcaggggccgggcccctcctggcgagcgactcatgctgtgactcgcgactgagggcggaccccggctggggaaagaaggggcttcctccaaggttttcttttctaatcaccaagcataataattataaatacttcgaaaataagaccgattttaaaacggggaggggaagttaaaaaaggcaaggaaagggaggctgagaagagaacgaaggagggcgggggcaggcaggggccacccgggaagggacggcagcgcggtccctctaggctggcagggcgaaggtgggaacggagaaccacgttcaacgtatgtacaagcggacgcttggaaagaagttagacctggctcaagtttccttagaaatcaccgttctccgctcaacctcaggacggcgacccgggccgacgcgcgcgaacggggaccgggagcgaaggggcctccagccccgcgcccgcagacttggcaccggggccagcacggccgggccgggcctggtgtccacgtcctgtaccgcggagtccgagccgaggccccgagaggcctgcgcgaacttgtccccggcgacggcggcgcgggctcggggtccggcgcctacaggaagaagtcggccgtgcccttggccccgccgggaccggcctgcggcggcgaaggctcccgcgggaaaccggccccgcccgcgctcccggggccgccccggcccgccagcttctcgtatttctccttgtacaggtcccgctctttggccaggcgccccacctccagcttcagctgctccacctggctctggagttggcacttctcgctctccagaatgtgccgctgctgcacccgcttgaagcggcaggactgcgcgtagccgcggttcttgagcgtgcgccgcttctgcttgagccggatgacctcctccttgctgaagccgcggagctgccggttcagctcgcgcaccgacatggacaccagctggtcgtcggagaagcgctcctccaggcgcacgtggtggcccgcgccaccgccgtgtcccgcgccgccatggtggtggtggtggtggtggtggtggtgggcggcgtggtgatggtgggcggcgtggtgcgcgccgtggtggtggccggcgcccatgtcgtccgctccgccgccgcccgcgaagcccgggccgcggaaagcctcgtaggctgcggcggccgccgggtggtgcgcgccgtggtgcgcgccgtggtggccgctgccgatgagcgcctccaccgcgtcctcgggcgtcaggttgagcgcctcggggttgaggtgatgctggtagccgctcatccagtacagatcctccagcgccggcttccccgaggtgcccccgacggcgccggggcccccgctcggcggcccgggggcgcccccggcctgagacgagccgccgccgccccccgcgccgccgccgccgccggtgcccgggctgggcgcgca

SEQ ID NO: 32320 - DNA, 226 bp, Homo sapiens
  chr8:144650887-144651113
  hyper
gtctgcgtgggagggcgcagtcagggcaggcggagacagagaggggctgcaagggtgggagggggcggccagcgcggagcgaggaagcggcgggtctagggaaggctgctgactcggtgtgatctggggacagggaacagggcctggagctggacctggttgggaagcctggagagcccctgcagggggtggggcttgaagggatggggtccggaaggaaaagtcg

SEQ ID NO: 32321 - DNA, 210 bp, Homo sapiens
  chr8:144651759-144651969
  hyper
gcagcagcgtgctcacgtgccgcacctgctgggactcggggtcagcctcttgcagacctcgccgcgaccgggccaagcccctctccacccctccccttctctcacaccttcctgcgattcagcgcgaggtggcccaggcccagcaggcccaaccagcgcacagtgggttcggggtctccctgccaggtgaggagtcgctccaggatgacc

SEQ ID NO: 32322 - DNA, 154 bp, Homo sapiens
  chr8:145700252-145700406
  hyper
gccggtatggccggccgtgcagcacgtaggggcccaggtccttggcgaaggctccacgcgcacctccgttctgccagcgccggcacagggcggtgttctgcagccggagcgcctcagctgggatcaggctcacgtcgaccgcccagaagttgcc

SEQ ID NO: 32323 - DNA, 194 bp, Homo sapiens
  chr8:145700607-145700801
  hyper
tgaagaaggggaacacggcctggacctgacggatgatctgaaaccgccaggcggccggccggcgccgtgagcccagacggggagggggtagcgccctacccctcccccactaccgggctcaggggcgcgcggtgccggcccctgctgtccccgaagaaggacatttctgcgcggaagcgcggcagagagggcaa

SEQ ID NO: 32324 - DNA, 62 bp, Homo sapiens
  chr8:145806186-145806248
  hyper
ccattcacctggccccgcccatagcagctgcccccgccctcacctgccgctgtcctccttca

SEQ ID NO: 32325 - DNA, 131 bp, Homo sapiens
  chr8:145925298-145925429
  hyper
acagaactctttctccgtgaatcgcatccttttctgtgcgggatgatttacattctgggaacaaacggggccgtatctcacagtgctgcaggatgccagtggtgcaaacagtcggcgacccggccatttcc

SEQ ID NO: 32326 - DNA, 187 bp, Homo sapiens
  chr8:145925458-145925645
  hyper
cgctccccgttccctgtccgtcacctcctcgttctcctacgaaggcgcgaacgttccagactctcgccggtcctcgacagcactcattcagtctcccccctggagatcccaggctgtactctgggacagaaaagaaggcgggtacgaccgcggtgtcgggtcctaccttagccgctccttctcctga

SEQ ID NO: 32327 - DNA, 83 bp, Homo sapiens
  chr9:73223-73306
  hyper
tgcggccctgacggtcgcgcaggccgacggacgacagcgcgctccggatgaagttgggcgggtagctgcgctggccctggaag

SEQ ID NO: 32328 - DNA, 111 bp, Homo sapiens
  chr9:113402-113513
  hyper
accttcgccccaggccggcgcagcccagcttcccgggcaggctccacgctaccggggtccagtgcgcggcgacgaagcggagagctgtgtccagactccggagagaaactc

SEQ ID NO: 32329 - DNA, 605 bp, Homo sapiens
  chr9:113549-114154
  hyper
ggagctgcccaactccgccgcctcgggaaggcggcttcgggcccgcagggagccccggggagggttcccggttccgccggcagcggcgtcgaggggtgcctgggctcctggggaccgcgagaggaaaaagaacggaaatcgcaccggggaggaaggacgcgcagaacgcccccgtgaagcggggtgctccggtcaggcgtgcgcgggagcgcggtccgggggagtccggcggcgccgtcgcgcgcactcggcagaggcttcgcgggagaacgcgcagcccggggcgtggggcggggaactgcccgcgcgaggctttcggcgcgtctgggtctcggcgagagcaaagcgcgtcctggcaccgggggcggcggcgcagaggccgggaggaagaaatccgggccctggcccaggtcgggcttccacccctgcgacccgcgagaggcccaggcgggaaaggcggcgagtggcgtcagcggttccgaaagcaaacctggcccggtgctactgcccgagggtcgccgggcgcgtttcctaattcccccgagtctggaaaacggagacttccgtagcgtcttcttcagtgcgtgctgcgagtgctgaaggag

SEQ ID NO: 32330 - DNA, 130 bp, Homo sapiens
  chr9:114722-114852
  hyper
gcaacccctgcgggtcgcgcccgaaggccggacccctccaagccgcctgggagcttccaaacaggtggacccgaagctcctgtttgatcggagaataacgttcaatttactccgccgctgaactgatggt

SEQ ID NO: 32331 - DNA, 88 bp, Homo sapiens
  chr9:117872-117960
  hyper
caaactctgaggggtcgctcgggccgccgccgccctcgatgtgctctcggggaagcgcaaccccgccccaccgggccacctgcagccc

SEQ ID NO: 32332 - DNA, 277 bp, Homo sapiens
  chr9:214944-215221
  hyper
gaccctagaagccaccgaaccgccggcgggccatggccactctgccgagcgcagagcgccgcgcgttcgcgctcaagatcaacaggtaagacgccccccgcggcgcgcaggttgcggccggacagcccagcgctggtgtgaagcggagcttcgctgcaggggccgaggccggacgagtccattcgcgtccgcggcggggcgcgcctgagacctggggcgcccggttcccgaggctgcggcggtggagccgctggacgcgcggcggctcctgcgctgg

SEQ ID NO: 32333 - DNA, 39 bp, Homo sapiens
  chr9:841367-841406
  hyper
gcttcctcggtgcaccgtgctttggcaaccgggtcttgg

SEQ ID NO: 32334 - DNA, 401 bp, Homo sapiens
  chr9:841449-841850
  hyper
cgctctgtatctctcggtgcgcttgcagggaccctgcagcaaagccctggatgcttgcagccggtgcaagtttgcaagcagctggagagcggtggctggagtcggggggcggtgggcgtggccacgctccctcccaggcagtcccgggaatgttctgaaaagtatccgaaagttctgagtcgcgcgcgcgccaaaagaaaaggcacaaccccccaccactccgggcgtggcgtgcccagacctcgccactccagctgcgcctccggctgcagcgcacacgtctcctgcgcctcctcctccggagcgtcgctgtccgtcgggttcatccctcgcagcagtctccaggcgagagagggggccagagtgctcgcacttctcctaggggcaccatgcccaacgac

SEQ ID NO: 32335 - DNA, 181 bp, Homo sapiens; identical to SEQ ID NO: 3384
  chr9:841851-842032
  hyper

SEQ ID NO: 32336 - DNA, 19 bp, Homo sapiens
  chr9:842207-842226
  hyper
cgggagcccgggttcagcc

SEQ ID NO: 32337 - DNA, 7 bp, Homo sapiens
  chr9:842526-842533
  hyper
ctcccgg

SEQ ID NO: 32338 - DNA, 138 bp, Homo sapiens
  chr9:842610-842748
  hyper
cggtacttgccgacagcggcggcgcttggggtcctgggctcccggccacgctacatcgccggtctgggagcgccggagacgcgtctgatcccgcccgccgggcagagttgcgggcttcgctcggctcggggttcccca

SEQ ID NO: 32339 - DNA, 186 bp, Homo sapiens
  chr9:842779-842965
  hyper
cgggggttccctctgctcccgggtccctgagatccctgatcccgctctcagggcagggaattccggggttcgcccctctgggcttccccgcgatcccagagcccgcgttccaacagaattgggagggtttattgcgctagaggagtcttcaggatcttcgctcccgccctccgaggtgaggctaga

SEQ ID NO: 32340 - DNA, 518 bp, Homo sapiens
  chr9:843202-843720
  hyper
cgggaaagggaggctcggccggctgctgcttacgcgggtaacctgtcggaaagccttgtttgtttttctggaaaagtcgctgcaatggacacagcgttgcgcggtttccctgcgcgcctggggcgctttttgtcttcgccctccgtggatggaggctgagcgcctcagccattttgagagctctggaaattttattagcattttaaaatttgcattctcgaccgaagattaaagtgcaaattactttgaagatgttttaaagcacgcttaagaattttaaagaatatgcgcaggtggaaaaaagcgcgccagggtttgagatttggtccgtctgtggttttgtttttttgaaggttcgtaagtaggctggtaatttaacattttaacggaaagttaatgtctttagtattctaaaaggatttttggaaggcagtaatccacgttatttccagttaaaagttgtttcatctttttaagacaggttatttaaaatgaaaagataacgaagaaatgtttgc

SEQ ID NO: 32341 - DNA, 59 bp, Homo sapiens
  chr9:969556-969615
  hyper
ctgtagctgttgtgacggctacggcggaggctgcggccgcgcggggaatggagccggac

SEQ ID NO: 32342 - DNA, 438 bp, Homo sapiens
  chr9:969667-970105
  hyper
cgcgcccaccttgccggcgtgttcgcgggcccctgcccactgccccccctctttctttaggtctggcttttgaggatcccggagtcttgcagctcccgccattccgcagataacctccgcacacttaattgtgacccgcggggtggtcggagaagctccgcacgcgtcctcagtgggaaagtgtcccctctcagcactgcccccttcagtccccctgcatttctggaaagtcaggcaaggcccaggtaggctgccagtgcactctcagccttgactgagcacctttcgggcctctggtgagccccgagagccaggtttggctcggcagagcgggcttgggctgcgcaagcaatgcgcatcgtggccgcctgcaccctgggaactaggcctgtccagtgggcagcatcctcatttttgaaaaggcccttctaaacccac

SEQ ID NO: 32343 - DNA, 40 bp, Homo sapiens
  chr9:970185-970225
  hyper
cggggcccgggacctgcgctggccacgcagggtctcaagc

SEQ ID NO: 32344 - DNA, 417 bp, Homo sapiens
  chr9:970495-970912
  hyper
gcccccttccgcgggcgggatccatggtgtgtgcagtgtaagagtgcgcagaacgcgtgtgttcaagtgtgggcgtggcaggcgtcgtgtgctcgccccgcgcactgtgcggatcgcccagacagccttgacaggtttttgcagatgtttgggtgctacggtgtggggaaacccaggcaggagcgccaggcctaattctcctggactcttggtgagcggccgctactccacgaggggctagaagcaaagggggcacgcgcttttccccaggccgcctcttgctgccgcagtggctgagggcgctgatgacccctccccgcttccagcggacttgacccgcgggctgacaacccaccgcgacaagcaggcggctgggttcgcgccgccgccccggggcccttggctcaaatttcacct

SEQ ID NO: 32345 - DNA, 187 bp, Homo sapiens
  chr9:970992-971179
  hyper
cgtcatacccgcagccggggctccctccgctaaccacgcttggagaccccaatcggggacagaggtgggagtcagaccccccctggcctgcactgccgtttccctcgattcttgcggaaacaagactcccgcccacacataaaaatgcagctcccggccaccgggcgccggtggctcacgcctgtaa

SEQ ID NO: 32346 - DNA, 142 bp, Homo sapiens
  chr9:971939-972081
  hyper
tccccaccccggccccggtccaaaaaaccagcaaacggaacttttccacagttgaaagccgcggcccgcgaggccgggctgggaggggaaagcggggcgtgtctggggggcggggccccgagcactccggaagttgccccgc

SEQ ID NO: 32347 - DNA, 714 bp, Homo sapiens
  chr9:972307-973021
  hyper
tccgcttgctttccccgcggctgggctttgttcagggacagcaaaggaggaggcgggaggctggtgaggttttctggaaaaggggcttgtcccgaggaggaagtgccccagatccctgagagccaacgctctggggagaagaaactttccttctcccttgaatgttgctcagattacctaaaattattttttcagcccttgtgttctaaagtcgcagggtaaaggttatcttaagacttaacatcagcgctgctcatttgtacgttggtggagacgtgccttttttcctttgcacttaaggtggacagggtctgcgacgctcccttccaggacggtgtggggaagcggccgacgtccccagccggactcacgccctcctactactgggcgtcggctccgccgcgggcgctcccgacagggagctggagtcggacgagcggctgcccccagggcctccaggaaccgcggcccagcggggagcgccccaggctagcgcttttccagttcccttcgaaagcgcggggctgaggtcgcggcgctgggccctcggatgaagccgtgctgtagctacacctgaaccccgcgaaaggctggcgcggtcgtgtatccaggctgggtctgaggaatccgcaagcgggagagcgctaactcctaggcgtgagccgctgctggcttcgagagttcgagaacatgaaggacctggcttctcccgcc

SEQ ID NO: 32348 - DNA, 106 bp, Homo sapiens
  chr9:973183-973289
  hyper
cggtatccccgggccggtgaccccggggttcagtcgtctccccgaccccaagcggcctctgctttccacccctcgccccggagggcggcttcggggatctcatggg

SEQ ID NO: 32349 - DNA, 43 bp, Homo sapiens
  chr9:973762-973805
  hyper
tgtacacacacccagcgattgtgtgtgccgagaaagacccaca

SEQ ID NO: 32350 - DNA, 907 bp, Homo sapiens
  chr9:975783-976690
  hyper
ctggcgcaagacctccgtttgcttccagtagctgctgggagcgagggaagaggatatcggtaactttgggggcgccaatgtggcttctgtgtctgccccttgaaagtttatacccggcgcttaacaaatcctttacaggagcacgtacgtccctgacctttcaggatactgttttatattaaaacatggacaggagggtagaaaagtaaaattcgcctgcaaaatggcttgtcatccttgggccggcagatctccaaaaccattttcttctaaagcaacaaaagagaaaaaaatacgttctaaaaggaaattacgaaaagagcctaactttcctaaaccaacatcacttcactcccctatcctaaactccacccaggtccggggtgcaaccgcaacactcccgtaggttcgagttctcccggagctgagcttctgcggccaaatgtcgggataaaagcggccttgggctcggaaaaacgcggccagatctggactggagggaggagaagagagagaagcggagcggccacctcactcgcttacaggcacccccaccctcactcccgctggtcctccccttctccgccccgcgagcaccgccgcgttctggagcgccgcagtctccagccgcgggctggggtagcggagagggcttggaggagggggccgcgagcgcccccgcgagagtggcctggctgcaggtggcaaggaaggtgaagtgcaggcacccgaggggcgcaaaggaggaggaaggcgtggggcggggagtgcaaggagacagggaccccaggggcgggggtggcggtgggaaggaggaggggttgggggagggcggcggaggtgttgggtccggccggctcacgagggagctgcagaagagctggctcagaccttaatcagagctgtc

SEQ ID NO: 32351 - DNA, 40 bp, Homo sapiens
  chr9:976911-976951
  hyper
cgcccctgagcgggcctcgcagccccgccgtccagcgctc

SEQ ID NO: 32352 - DNA, 34 bp, Homo sapiens
  chr9:977171-977205
  hyper
gtgcatcctcatcatcgagcggcagcgggtcatg

SEQ ID NO: 32353 - DNA, 159 bp, Homo sapiens
  chr9:977422-977581
  hyper
ccggggctctgcaggcgcagctcgccaagccaggtaagagcgtctgaggtgcgggagtttggccgggcgcgggggcaacttcggagtgccagctgcagctccacttgggaggactggaggcaaagttttgggacgtgggcctgtcggggctttccttcc

SEQ ID NO: 32354 - DNA, 46 bp, Homo sapiens; identical to SEQ ID NO: 9824
  chr9:981797-981843
  hyper

SEQ ID NO: 32355 - DNA, 175 bp, Homo sapiens; identical to SEQ ID NO: 3388
  chr9:1042326-1042501
  hyper

SEQ ID NO: 32356 - DNA, 371 bp, Homo sapiens
  chr9:1042615-1042986
  hyper
cggaagccgggggcgctgggtctcaggcccggatgctgagcgcggaccggcgtgtcctccccacagcgcccccgcgcggcctcctcccgctgcgccccgcacggcgacccgccgcgggtagccctggcgtttggccacgccgtcggctgaggaccgctagagctggggggagatcaaagcattcctatggggcccaaagagcctgggattgcagtgttgttagcctggcctcgccgcgtcaataaattttcggcgaaagttgggagcaggagtggaggcttggggcgggggttggtggggcgcgggggttggccggagggagggtccgggggtttcttgcacctgcgctcctgccgcgttaagtcagtggg

SEQ ID NO: 32357 - DNA, 76 bp, Homo sapiens
  chr9:1051563-1051639
  hyper
ccccagagtgagggccgccaggctcaggccccagcgaagccccgagcgccatggccgacccgcaggctggctccgc

SEQ ID NO: 32358 - DNA, 414 bp, Homo sapiens
  chr9:1051904-1052318
  hyper
ggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggtgcgtacccgcccggcccgggcgtctcaggccacagtggaggtgggggagttggaggggagcggggcggccgtccacaccccccgcgcccagggccttgcggtgcctggcactccctaggaaggatggtaagaacgcttttctgcttgcactggcgagcagggtcgggagggaaaaagc

SEQ ID NO: 32359 - DNA, 380 bp, Homo sapiens
  chr9:2621312-2621692
  hyper
ccgtcagtggggaggcggtggcaacagcaacgatagttgcatcagcgctaactgctgctgctgctgcgtgttctgccggaggctgccgggagggtacagtaatgactgtagggagcgcacagccgctgcggcggcaggttccctggatcaggaaattaggacaggcacccgggattggaggcgagggcggcgcgcgagccaaccagcggtcgccccgggcccccgtgagccccaggcgaacgcgcggagcagccgggcccctagagcggtccgggtggcggcggcggcagccacgaccacgaccgcggtcactcacgcacgctcacactcgcacgctccccgcgcgggcacccggctgcccggcgcgtgcaagaggagcg

SEQ ID NO: 32360 - DNA, 44 bp, Homo sapiens
  chr9:2622978-2623022
  hyper
accgctcgggtctcccgtgtagctgaacgcggagggggagtgga

SEQ ID NO: 32361 - DNA, 30 bp, Homo sapiens
  chr9:3181153-3181183
  hyper
actcgcatccctacacgtgcacacacccgc

SEQ ID NO: 32362 - DNA, 307 bp, Homo sapiens; identical to SEQ ID NO: 9828
  chr9:3181573-3181880
  hyper

SEQ ID NO: 32363 - DNA, 30 bp, Homo sapiens; identical to SEQ ID NO: 9829
  chr9:4299034-4299064
  hyper

SEQ ID NO: 32364 - DNA, 58 bp, Homo sapiens; identical to SEQ ID NO: 9830
  chr9:4299348-4299406
  hyper

SEQ ID NO: 32365 - DNA, 58 bp, Homo sapiens
  chr9:4299639-4299697
  hyper
cgtctgcgagggcagcggcggcagggggaggaggaggcagaggcggggtggctggacc

SEQ ID NO: 32366 - DNA, 189 bp, Homo sapiens
  chr9:4299943-4300132
  hyper
gccggtgcccgtgcgcgccgcgctctgggctgcccgggcggcgcagtgtggacgcggctgcagggagaggggaagggggaagagggagggaggaaggcagccgggcgaggagtgtggatgtgtgtgcggccgcgagggccggcctgtagccagctgcttcctgagtgtgagcgccggagggggaggggg

SEQ ID NO: 32367 - DNA, 329 bp, Homo sapiens
  chr9:6412571-6412900
  hyper
taggcctggagctgccgcctccgccaggcgacgggaaaccctcggaagtgggtttccgcgcgaaagtagcattgcggccaggcgggaaacgtgttcgcgaagcaggagggcccccggggcctttcccgggcgacccgacccgccaggccgcgtggcgggagctttcctgttgagcgcggtggagcgcacacatttccttcagttctttctcggaagtttaggccgcacccacccgcgccccctttccaggattatacaagtgcacgccagggtttcttatttttggtgtgtttttgagaccaaagaaccatatccgctaagcctgagga

SEQ ID NO: 32368 - DNA, 17 bp, Homo sapiens
  chr9:6644351-6644368
  hyper
aacgcaggggaagctcg

SEQ ID NO: 32369 - DNA, 15 bp, Homo sapiens
  chr9:6644539-6644554
  hyper
cgattttcagggaac

SEQ ID NO: 32370 - DNA, 1252 bp, Homo sapiens
  chr9:6644899-6646151
  hyper
gatttcagttgcaaccggagctaaccggtaagcccactcttaatcagggggtcttcctcctcttgcaaagtttaggtccatccacagggccacttgggctgggggtggtttaaaaatgtacacttttgaggcacgaagactgggtgcaggagaaagtaagctgttaagaagtaagaaggcacgaggaccaaaggcacgaatttgcttccacgccacggcccgggacccagggtgcggggaccacgcggagcgcagcagagctcagggtaggagccgggaggccgcgcaggcagagcccgggcagggcggaggggaggccgcggagggccgggtggaggtccttaccgccagccccaaggtctgcagcatctctctctggtctttgtccccagggccgatgtgcctccgagcgaagtcgtcgtgtctgggcagaaggcgctccaggaggcgcgaggccccagccgcggcgctgtccccgccgccactgctgctgtcccggctccgcggcgcccagcacggccccgatcccccagccaggcggcggccgcccccgaccccgcggcccaggcgcagcccccacgccctggcacaggactgcatggccgcggccaccgtcccctgccccggcccgcaagggtcagccgcgctcttggcccctctcctggcctcggtcccccgggtggcggctgcgcccggcctggagcccctttcgctggacagtcggccggacagatggatggacgctcgcgggcaatgaatgggcgctgcgctcaaccaagacactcgcgcaaagttgtggctccacccaaggcacctgctccgcacactttaagcggcgccctggaggcgggaggtgggttggggccaggaagcccttggccaatgaaagtagacagagggggagggggcggaacagttcccgcccccgccccctcttcctaccctcttcccagcccttccgtggagtcccgcttcccctggaccggaggctgccatctccagtcctacccactccgacgctggctggtgccgggggccgggacgctccgtacgccgcccgccagggtgtggagccgcactggggcaagatcaggtgggacagcccaaagactccgggccaagttcctgggggactcggcggagatggaagatgattctcgaagctctccatttccttaattttgaggtatctttctctgtcacatttcatctcagggaaattaatatgggcagatggcggttcttttatctt

SEQ ID NO: 32371 - DNA, 37 bp, Homo sapiens
  chr9:6704532-6704569
  hyper
cggcgtcgtgttgagcgggctgcggacacagacagcc

SEQ ID NO: 32372 - DNA, 43 bp, Homo sapiens
  chr9:8857443-8857486
  hyper
gagaggacctctgcccgaggaggtccagaggagcaaactgtgc

SEQ ID NO: 32373 - DNA, 147 bp, Homo sapiens
  chr9:8857685-8857832
  hyper
cgccaacactttcctccagcgccttcgcgccccgccacggccgcgccgccgcctccgggcggccaatttaatcccgcggagcagcggccgccgccgccgaagcccccctggtcgccgccgccgcccagccctcgtgcggccagccca

SEQ ID NO: 32374 - DNA, 363 bp, Homo sapiens
  chr9:8858327-8858690
  hyper
ccagaaactgaggctcgtggggggagaggggtgcgaggcgacgcctgggaaagggcccgagcagagtcgagggccgggaggtggggtggccggtgcagcccagtctttggacctggcttgaacctggtagttacggctgcagaagaggtggtttggggaggggggaaaattaaacgaaaaagcccaggaaagtcattggaaaggcttctctctttgtttccttgtgtgggtgatttctaaaatcctcgtaacgtgctggggatcccacggaattgctgtgctccagcgctgggggattgtgtgtgcgcgttgcctgcgcgtgagtgtgagtgtgggtgcgcccggacgcggggagagctgggc

SEQ ID NO: 32375 - DNA, 123 bp, Homo sapiens
  chr9:10612684-10612807
  hyper
tacctgcactctccccgccgaggctggctggcggcgccgcgccggaggggaggaggctcgggaggaggaggagaaagagcagcgggaggactcgggctgggaggggagcgcagggttggggag

SEQ ID NO: 32376 - DNA, 7 bp, Homo sapiens
  chr9:10613046-10613053
  hyper
cgcactc

SEQ ID NO: 32377 - DNA, 100 bp, Homo sapiens
  chr9:12775664-12775764
  hyper
gcctttcatctgctgcgttttattactattatcgccgttccggaaaagtcatggaagacagcccgctgccagacctcagagacatcgagctgaagctggg

SEQ ID NO: 32378 - DNA, 208 bp, Homo sapiens
  chr9:13278748-13278956
  hyper
accggtaccaattagcggctcgcctcggggtccccgcggctaaggcgagaacgcaggaccaggagcattgctgcccactctctaccgcaacccgcacatcccgggaccacgtaacggcggatggggcgtccgggagcggcccctgcaggggagagcaacaggctcccgcgccctggaggcctggtctgcgctccgggcccccaggcta

SEQ ID NO: 32379 - DNA, 44 bp, Homo sapiens
  chr9:13279362-13279406
  hyper
cctcggcctctgggccggggctcaagcgccgcttacccggctcg

SEQ ID NO: 32380 - DNA, 116 bp, Homo sapiens
  chr9:13279633-13279749
  hyper
cgcgcgccgcacttgcgccgaccggggctgccgcggaggcggtggcggggcccaggctgctggggctgccgtgacgcctgcgaccggcggggcggcgggcgcgccttggccaatca

SEQ ID NO: 32381 - DNA, 30 bp, Homo sapiens
  chr9:14347643-14347673
  hyper
ctcttcggtcaggtccgcccaaggtcccag

SEQ ID NO: 32382 - DNA, 345 bp, Homo sapiens; identical to SEQ ID NO: 3394
  chr9:14348107-14348452
  hyper

SEQ ID NO: 32383 - DNA, 5 bp, Homo sapiens
  chr9:16154666-16154671
  hyper
ctgag

SEQ ID NO: 32384 - DNA, 26 bp, Homo sapiens
  chr9:16154745-16154771
  hyper
cggcccggggacggcagggggcggct

SEQ ID NO: 32385 - DNA, 52 bp, Homo sapiens
  chr9:16870273-16870325
  hyper
cactcccctccacctcgtccccccagcccgtccccaacgccctggagcctcc

SEQ ID NO: 32386 - DNA, 463 bp, Homo sapiens
  chr9:16870661-16871124
  hyper
gtcaagtgcagcccccgcctcttggtctcctcttagcggccgcgcctggaccagcccctcggccgccgctggctccctccgtctcggcctttctctccctccccctccgagttcctccgggcctccgctctcgccgcctccgcctccccgcccgcccgcgcgcgccctcgccgcggcccctctgcgctcaggtgactgatttacactcgcgccggggtcgcgctcgcgccccgagtcccagccggcacggttccccggctcctcctcgggacaaaaaaaaaaaaaaagggaacggcttgtcccgggagggggctgccctgctcgcgggaggcgggggaccggcgggcgaggtgacctcggcggccgtgcaagccccacaagtttttcctctctctgcagaattgtcgtgactacaatgttgcttcccttttgcaaaataaaagtcggtcgttgtgttgtttgt

SEQ ID NO: 32387 - DNA, 236 bp, Homo sapiens
  chr9:16871415-16871651
  hyper
acgccgaggaaagggcgcgaactttattccgactgcagcaaaccgcggcagctctttccttttcgggcactcgggcgtctctgtcccctttgaccagttcctcctccccagccccgcacgccccctcctcccctgccccttccccagcgtcccagccgcggccgacccggctccccgcgaccctctcagcccagctcctccgcgcgccgctggggagaaggcgagtgaggcggagg

SEQ ID NO: 32388 - DNA, 30 bp, Homo sapiens
  chr9:16872003-16872033
  hyper
gccgcaagaatggggcgggggtgggggggg

SEQ ID NO: 32389 - DNA, 341 bp, Homo sapiens
  chr9:17135041-17135382
  hyper
tgacccgttagcagccgcagccatggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggagg

SEQ ID NO: 32390 - DNA, 87 bp, Homo sapiens
  chr9:17135632-17135719
  hyper
cggccagacaggcttcgcctccgcgcccgggtttggttttggtcacttggatactcgcagtcgcatcctctccgcttcccccccaag

SEQ ID NO: 32391 - DNA, 586 bp, Homo sapiens
  chr9:17578706-17579292
  hyper
gtctttttcaggctgcggcgcagagacgccaggctcaaagggcaggagggccgtctgcaggcagcgccgccgcggctacctggaagcccagcaagtcacctgagtcctgcgggtgcctgggctgccaatctgcagcgacccgtccgcagcccccgggggcaggaacaccaaccccgggacaggaggacgtcctcggcccgctgactagggatccgccagcgggtgccgctgagccacatccccgcagttggcgccagcatccaggtaccgcgcgccacagcacctgcctgggcgttcccgcgcttggggcggggcttcccgcgtcccctttaagaggccgcatcacccgcccttgacgtcagagtgtttctccgcaagagcccgtgtcccgctaggctccgcgccctcgcgcccatagccccggcggcggcacgaccagaggcggccaggggagcgcgccgccccgctcggccctccagtccccctccgcctcctccctcccgcacagcagccgccagcgcggcctcctgcaccatgtcggtggccggcctcaagaagcagttccataaagccactcaggtaaggc

SEQ ID NO: 32392 - DNA, 297 bp, Homo sapiens
  chr9:17579402-17579699
  hyper
ggccgcgccccgcctcgcaagccaaggcggcggctcggggcatccccggtctgggcgtccaccctcggtcccccgcccccggcttggtgcgcgctgccttcccgcgggtccccggcgtcctgcctggtagcgctgctcgccgcccccgcatcatctcgcgcccgtgctgcaggaaggggaccgcggctgcactgctgccgcggcgcgcaggtgccttggcggcgcggtgggagattatgtaaagtcgcctcttcacgggtgaccttgcggagtcggtgcacccggctttcccgggat

SEQ ID NO: 32393 - DNA, 91 bp, Homo sapiens
  chr9:17906058-17906149
  hyper
gaaaagctccatgagcgcccaggggacaagtccccacggacaaacatgtcataacgatttcagttttgtcccattacgtgaggttgtaagt

SEQ ID NO: 32394 - DNA, 29 bp, Homo sapiens
  chr9:17906404-17906433
  hyper
ataaatagaagccagcgcgcagccccgct

SEQ ID NO: 32395 - DNA, 234 bp, Homo sapiens
  chr9:17906460-17906694
  hyper
cgctgccggggcggctggatgtctgcgctccccgcctccgctgggctgacacgggaggggaggagcaggagctggaggggtgttgggggtggggggagcgcgaaccatctcgagccaagacaagcagcacattcacaaataacgcccccacccccagcgcacgcgctcccattcaaagcagacccgctccgcggccgcactgaagctccaaagccgcgccgcctgccccagcgc

SEQ ID NO: 32396 - DNA, 52 bp, Homo sapiens
  chr9:17907031-17907083
  hyper
ctggggctgcgctgccgcccaggctggggacaagtggcgcggggttggggct

SEQ ID NO: 32397 - DNA, 25 bp, Homo sapiens
  chr9:17907346-17907371
  hyper
actcctccacacttccgcccttctg

SEQ ID NO: 32398 - DNA, 51 bp, Homo sapiens
  chr9:17907450-17907501
  hyper
cggacgccggaccaggtgggctccctggtgcctccgcggtctagaggtggc

SEQ ID NO: 32399 - DNA, 130 bp, Homo sapiens
  chr9:19127231-19127361
  hyper
ccaggacctggaagccgcgaggcgagcggggggtctcggaccatcacccccgcgtcccgtccacctttgagccccgcggggagcagagcagcggtcccaaggccccggggagccccccaccccaactggg

SEQ ID NO: 32400 - DNA, 547 bp, Homo sapiens
  chr9:19788355-19788902
  hyper
aagtcatctccagcccgatcctcgctccccctgaaaacccaccgctcgtctccccgggagctgcctccgtaggagaatgttcgcccccagccgcgccccaactttgccttgcgtggtcccaaactttccctggtggattaataggaaaataaatctaaaggacagacgccccacctgtgagcttggagctgggttgcatttggtgaggcgcttggcccgcatccccctgagtcgtttgtaggtggctggggaatggaagcgcccctctgcgcgtctcccccgacggcaggccctgccccacgccccccatcccaagccaaaagcaagggtaggagaggcgggggctccaaatccacgccccggagcacagagagttggctaactcctagcggggcctggggcgcccacatccacggcagagccacctgtgagcctgcagagcagcaacgggatgcgcgcaaccgggatgcggggacgaccgccacagcggctacagcggcaggcggggcgcagccgcccgcacttaccaggataagatgggaggacg

SEQ ID NO: 32401 - DNA, 367 bp, Homo sapiens
  chr9:19788934-19789301
  hyper
cgctccagtccgccggccctccgcctacccgctctgaggcccgggctctggctcgcactggctgccgctctcgccagccgggctgggttcgggaggagactgagccgctgtgagcccggcgctccgagtctggcgctgcccggcccccgccggcccctccctctgggctgtgcgctgtgcgctgggagcggggccgcagcgcgctcagctcccgagtcctttgctccacgcctcctgggcgcagaggcgacgctggcagccgtctcttaggagatttctccgcagtgtggacgggggtcaggatttgcaggcgagcaagggcagagaggagaaatcgtacaggtcggtgacgcgcctaattcacaaa

SEQ ID NO: 32402 - DNA, 424 bp, Homo sapiens
  chr9:21031412-21031836
  hyper
aggggtgcctgggcacggtagcgctgcgccttgctggcgggcggggggtgccgcccgcccgcccgccgcagaggggagctcccgcctccaggccctccacccgcgccccctcccctcgggattcggccgagcgccctacctgggctgcagccaggcgggcagcgccaagggccccatgggccgccgccgccagggcttccagcgcggtccaggaaggagtaccggggaggaggcaggggcggccccgcggctgggcgcggaagggcggggcctctccacactcagcagtttacaaaaagaaaaagcccgaggtcgtgcgttggggaagagatgaaaacgaagttctcgaagtttctgcagcactgctagagcgcgtcagggcgcaaggctgggaggcggctcgcgttcccggtggggttaccaa

SEQ ID NO: 32403 - DNA, 315 bp, Homo sapiens
  chr9:21395999-21396314
  hyper
ctctaacactgactacggcacgatctgattttgagccgtcagtcccctcaatacactggcacattggtaaaacggtctcgctaaaatgttccatgagaaaaatgtctcgggggaggcggcggtagagctctccctctgtagtcagagccgtgaaaggcggcgtttactcgctgctcacgaggcctgcggaccctaatccccaagcgcccgggcctccactctgcggaccccaagcgcgggtctccttgaggaaggggcgaccgcgggttagggtcgctggtgggtccgttaccgctggtccggcgccctctgtcg

SEQ ID NO: 32404 - DNA, 575 bp, Homo sapiens
  chr9:21402571-21403146
  hyper
cgccccagggtccagcgtgtccccttccccaagacgtccccgccctgcgcccccacacaaacggaatccccaagattaaacccgtgcgatctcgagccctcaagtcccggaatcaacgggtccctctgtaaaaacaagtctcgctgaagtctctatgggaaataaaagccccaaacccaggggaaaatcccgaaaataaaaggtgccctgctggctacctgaggaagatgtctcaagggagaccacggcggagctgcctcctgagcagcaaaagagatttttttactcaggtcgaagctgcacaaagttggcgcgataagccgcgacgacgtttccctggggctgcgggacgccccgaaactcaaacccgcggttcccaaatcctgggcatcaggaaaacccattctggcgccttgctgcggccgtggtgcgcagcgctgggagctttgcgctctttgcgcagcgggcccgcgccccttcgaggccggctagtgaatctctgaaatcacagtggcctacacctccctggtaatggcgggagtcatcatgctcatctccagcgctgcctgctcact

SEQ ID NO: 32405 - DNA, 134 bp, Homo sapiens
  chr9:21559984-21560118
  hyper
ctcctcccttgggcccggacgggacccaggtttctccactgcaacgcagctcccgagtgacggaattttgtgggggaagcggcggccactacgctcgcttttggcacagtagccctttgcgggtgggagcttct

SEQ ID NO: 32406 - DNA, 482 bp, Homo sapiens
  chr9:21964943-21965425
  hyper
tgagacacgtgagatctggaaggaggtggaggtgaagaccctcccacctggcctgcatccagagtacttggggtgtggcactggcgtgggccccaggaaggatcccagccagttttggtgctggaggcccggccaaaggaagggctgctctcccgtcccgcgggctccgaggtcgccgcacccgggcgcgcctgggcctcgtcacccgcgctcgtgacgcgtgcttacaaaggaaacttttacaggtttcggtgggcagggccttttattgcccttctgctccacagcccccgtgcttaatcggttggttgggaggtttctttcgtccgtggttttggaaagtccccgcctccaaaccgcagtcccgcagtcagttctgcagcctcagggcctcgaacagccatgcttagaatccgtccttctttcctgctccatctacccttcccctctggcttcttttttttcactggagaaagcccacc

SEQ ID NO: 32407 - DNA, 191 bp, Homo sapiens; identical to SEQ ID NO: 9859
  chr9:21965569-21965760
  hyper

SEQ ID NO: 32408 - DNA, 35 bp, Homo sapiens
  chr9:21967367-21967402
  hyper
gcggggactgggagccgagtcggattccgagacta

SEQ ID NO: 32409 - DNA, 183 bp, Homo sapiens
  chr9:21968251-21968434
  hyper
cagaaagaaaacaggcgttagaaacctgaggtcaaagatgtgtggcacatcccgccctcctctcttgccgtccctaccggcattgaaatacttatggataaagttctcgcaatggcttcacgtgcatgtacccgccgccaccgctctcccacacctccctggtccagcagctagtccactgcc

SEQ ID NO: 32410 - DNA, 239 bp, Homo sapiens
  chr9:21968456-21968695
  hyper
cgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctgg

SEQ ID NO: 32411 - DNA, 92 bp, Homo sapiens
  chr9:21969169-21969261
  hyper
aggaggggggatgatcgcttgagcccagataacatggtgagaccttcgtctctattaaacaaacaaacaaacccaggcgtcgtggcgtgcac

SEQ ID NO: 32412 - DNA, 141 bp, Homo sapiens
  chr9:21969747-21969888
  hyper
cgaagtctccttcttcacctcccgggacctggatgctagctgtaactggagggaattggcgggggggaggggaggaggggccgagtaaagaagaacttcgcgtctttaacttcgaaggtgattttgcgttctgtatttaca

SEQ ID NO: 32413 - DNA, 126 bp, Homo sapiens
  chr9:21970940-21971066
  hyper
gcctctggtgccccccgcagccgcgcgcaggtaccgtgcgacatcgcgatggcccagctcctcagccaggtccacgggcagacggccccaggcatcgcgcacgtccagccgcgccccggcccggtg

SEQ ID NO: 32414 - DNA, 936 bp, Homo sapiens
  chr9:21974181-21975117
  hyper
cgcccggccgcttctgaataatttcgatcaaaatttatattcgatatttattccaacatacaccacagatttccactgataatccctcctagtaagaaagataagctccatccaggtatctgtgaattggaggctaagtagtcccagcacatcttacatttctttaagactccctttttatcccaaacgttcgtaaattttgtatctgataaagagcatacttccatctaatacaaatatgttccccccttcagatcttctcagcattcgagagatctgtacgcgcgtggctcctcattcctcttccttggcttcccaagcccccagggcgtcgccaggaggaggtctgtgattacaaaccccttctgaaaactccccaggaagcctcccctttttccggagaatcgaagcgctacctgattccaattcccctgcaaacttcgtcctccagagtcgcccgccatcccctgctcccgctgcagaccctctacccacctggatcggcctccgaccgtaactattcggtgcgttgggcagcgcccccgcctccagcagcgcccgcacctcctctacccgaccccgggccgcggccgtggccagccagtcagccgaaggctccatgctgctccccgccgccggctccatgctgctccccgccgcccgctgcctgctctccccctctccgcagccgccgagcgcacgcggtccgccccaccctctggtgaccagccagcccctcctctttcttcctccggtgctggcggaagagccccctccgaccctgtccctcaaatcctctggagggaccgcggtatctttccaggcaaggggacgccgtgagcgagtgctcggaggaggtgctattaactccgagcacttagcgaatgtggcacccctgaagtcgccccaggttgggtctcccccgggggcaccagc

SEQ ID NO: 32415 - DNA, 446 bp, Homo sapiens
  chr9:21975190-21975636
  hyper
cgccctccggcctccctgctcccagccgcgctcccccgcctgccagcaaaggcgtgtttgagtgcgttcactctgttaaaaagaaatccgcccccgccccgtttccttcctccgcgatacaaccttcctaactgccaaattgaatcggggtgtttggtgtcatagggaaagtatggcttcttcttttaatcataagaaaaagcaaaactattctttcctagttgtgagagccccaccgagaatcgaaatcacctgtacgactagaaagtgtccccctaccccctcaacccttgattttcaggagcgcggggttcactaagtcagaaaccctagttcaaaggattccttttggagagtcggactgctctctccttcccctccccttcccctcctgcgtgtaaaacggctgtctggggcaagggtttctcagacgtgtacattgcctg

SEQ ID NO: 32416 - DNA, 32 bp, Homo sapiens
  chr9:22011013-22011045
  hyper
cagatgtgtgagcttcgcgaagcaagttgact

SEQ ID NO: 32417 - DNA, 351 bp, Homo sapiens
  chr9:22446925-22447276
  hyper
tgtaaaacttttgtccgtgcgcgggtggagctcagtaggaccacggcgcgtcctgccccggcttccccagcctcccagcagggttagctgcggtcagcgcactttccacttgggactcccggccagaaatttctcgggaatggagcggtcacagtgtggcagcagagaccgaggcgttagcggccgacctcacttggcccctgggctagtggtggctgcccctccgcccccgtccccggcgttgccggtaccatcggggatgcaggttcccccagcgttcctgcggccgcccagcctctttctgcgagcagcggccgcggccgccgccgccgctgccgccacctcgggaag

SEQ ID NO: 32418 - DNA, 122 bp, Homo sapiens
  chr9:23821297-23821419
  hyper
aggcgcgactgtccccgctcggctcccgccgcccccaacctgcttgtgcccacgggaggggcggtgccacctcccgaggcgcccaattctctctactcccgccgcaacgggctgagctctag

SEQ ID NO: 32419 - DNA, 30 bp, Homo sapiens
  chr9:23822239-23822269
  hyper
tttttccccctacttcgcagccaaggggtc

SEQ ID NO: 32420 - DNA, 71 bp, Homo sapiens
  chr9:23822568-23822639
  hyper
gcctgtcctcagacccggccccacggctggaagtcaaaacccaccccggagccacgcggctggagcacgtt

SEQ ID NO: 32421 - DNA, 579 bp, Homo sapiens
  chr9:23824012-23824591
  hyper
ggaagggacagaatccgtgcatttcggggagaaagtacagagacctccatccctgtccagcagtgttaacagtaaatactaaatggttggctatttctctcaccctcgccataataaaaccagacctgcagccggtaattacgagaaaatacccagtctcgccatcagttttgctaaccggtacttgaaaatgggaaacggggaacttatccaacctccaatttgtcacagttgtatagctttcgtattaattctgtacagacgtgaaataggtgggtacgtagcaacgtgctgggcataaattaagcaacaatggccacgcgaggtctcgtccgccgcggagctccagtggtgggcactgccaccttgccatccctagcccccaccgcccttcgcagagtccagtccgggaggctgacggtgcgctggctttcccagccggtagagtgggtggggtgaggagcaacgagacgttaaccccagccggctttgtagctttttcccatcctctgcctctcgagcaccacatgagcgctctcacgcacacactcacccacaccccctcgtgccaataattta

SEQ ID NO: 32422 - DNA, 61 bp, Homo sapiens
  chr9:23826326-23826387
  hyper
gccaggctcctatcccgggcagcacgcgcggaagtatacgccgaatcgcgccacaacgtaa

SEQ ID NO: 32423 - DNA, 40 bp, Homo sapiens
  chr9:23829874-23829914
  hyper
gaatgttttattccacgggactttgcggaaaagactgtcc

SEQ ID NO: 32424 - DNA, 30 bp, Homo sapiens
  chr9:23830739-23830769
  hyper
tttgcagcctcagatcgacgattattttat

SEQ ID NO: 32425 - DNA, 254 bp, Homo sapiens
  chr9:23831117-23831371
  hyper
ggacctgggaagaaacggtttttatgcttccgatgctcggaggctctttcttatattgaagatttatgtttccacttgtgtgcgatgcacgtctaatttgaaataataaaaccgggctgagcaaccagtcaatcagagccatccagggcgctccgcacgccgccctgccccccacctccctccggtctctaactctttccctcctcctccccctctcactctcctggccctccccgtcttccttcctccctcct

SEQ ID NO: 32426 - DNA, 15 bp, Homo sapiens
  chr9:23831450-23831465
  hyper
cgggccacggtgaca

SEQ ID NO: 32427 - DNA, 30 bp, Homo sapiens
  chr9:23831747-23831777
  hyper
gcattaaaatgctttcggcaggcagagggg

SEQ ID NO: 32428 - DNA, 38 bp, Homo sapiens
  chr9:23849841-23849879
  hyper
aaaccacccacagaccgagcagacgagaagaaatggta

SEQ ID NO: 32429 - DNA, 45 bp, Homo sapiens
  chr9:23850410-23850455
  hyper
ggttggctgctgctgcgaggctgctgcagccgaggctcccgcgag

SEQ ID NO: 32430 - DNA, 30 bp, Homo sapiens
  chr9:23850946-23850976
  hyper
caactgaaccgattacggacggcgaattta

SEQ ID NO: 32431 - DNA, 30 bp, Homo sapiens
  chr9:25678053-25678083
  hyper
agccgcgcgttctgccggtcccactcgtcc

SEQ ID NO: 32432 - DNA, 132 bp, Homo sapiens
  chr9:29212039-29212171
  hyper
cagagaaccaagaggcgaaaggagagtggaggagaaagagggcattacctcccggggctgccctcagggtgcgggtcaggatctcatccccgaagtggctccagttcaaggcacagctttccagagctcagc

SEQ ID NO: 32433 - DNA, 572 bp, Homo sapiens
  chr9:29212210-29212782
  hyper
cggaagcgcgccgggactgccgctcacgtcccccgcccctgccgcgcgggctccgccaccccgcgagcacgctggctctccgcgctcaccccgccgcctcctggcgcccccacacccacccgctccgcggcgcccgctgggagcctctagcggaggcgaagggaacagcaggcgacctgcggcgcccaggttccgacgccggttgcagggagccggccaagcggcagcgtgggcttcgcgcgcccccgagtccgcaggccgggtgccgccgccgcccccacctgcccacctgcgccaggctcacctgccaccgcgtcctagttgcgttcaccggtgcccacagctctctatggcaattgggggtgggtctgcggtgctaataaaaatttaaaaaaaaaacctctctggtaaaaaaacgaaaacccaaaacccaaatccacgctgtatatcaacctccacagagaacccagtccgaaatcgttttccaataggtttcagaaagtgtgaggacaggacactcctctggcttcctgcctcgcagctgggcagcgccgcaccggctactccctgac

SEQ ID NO: 32434 - DNA, 46 bp, Homo sapiens
  chr9:29213181-29213227
  hyper
tattcagttttcttccgtaaccccacagacacgtcagtcaattccc

SEQ ID NO: 32435 - DNA, 993 bp, Homo sapiens
  chr9:29213476-29214469
  hyper
tgggcgggcggcgggcggcggcgccaggtgaggaggctttgaggaggcggctgcaaggcgggacgcaggatagccggctggggcttggcagccgggctcagagctcgggctgcgcacacacacaggcgcgcacacccgcgcgcgcgcagctacacacgcacgcccagccctgcgcccgcggcccccggccagtggcgagcgaaaagtcgggagtcctgaggaggggtaggggttccaaggatgctgatgacagaaagagtcaatcaatcctcactagttagcggattgccggcaggcagttcctcgccgcacgccgttaagtccgttgggccacctctccgttctctgccctgtctggcatttcaactccctagctcttttcttgaagccagttacaccccctcgacacccagcgagaggccaccagactaaagatgagccccgttcccatcgccaccctccaggggccacctccgccccttctgtagtggagaattgaagtggctgcagcagctctcctgggagctgaggggctccccgaggtccttcgaatagaggagcctacacatcgcttcgtgaacataatcccctcgcatcccgtctttacctgcccactcccttcgtaacatttcccccaaggagctcccgaaagtcgcttagatgttttgaaaatgaatttcttagggaattgtagtgcctagcttttggaactgggttaatttaggtgctacgcttatattgtaaactggacggtagcaggtgaacggctcagctggagaaaggggagggattaggagtctggagacccaacccctttagcagccatttccaaggttttgcaccaggagtagctgtccgggtctctggctagctcctgtcccaacttctttttcttccctcgacggtcgggagggatcactgggtgctacaccgctggggcgtcccaggcaggagagacttcgctctcagaagcgcccccgtgtcatccacaac

SEQ ID NO: 32436 - DNA, 453 bp, Homo sapiens
  chr9:29214681-29215134
  hyper
tgccctctggggcttcgcgaatatctatggcttcggacctgctagcggaaaacgcaaagttgcccagcttggagatggcaccaggttcctttgctctggcgctggatgctccgctccgccacccaccgccgccgtctccatcgagaatctcctcaaaatcaagggagttcttgactgtccctctccaaattggaaggcggttgactttgccgggaaccgagttcctgagcggcaaacgtggagtcgcagagcgcagaagtgaagatttaatacaaaagatgaaacttgtaggatgacctctagcagcgctactcacagctctgaaatcgatccagagcattccacagtgagcgttgcggctcccaggggctccggaccggtaacttcaggcgcaagtctgaatttcagggatgaacctgctttggattctgtttgagccgactcagtgcagag

SEQ ID NO: 32437 - DNA, 306 bp, Homo sapiens
  chr9:32782630-32782936
  hyper
ccctgcctaccagagcgggaggaacgcaggctctcaatgcctgcttcagcaagggaggagagaatcgcccagagctgagcggcgtcgtagggtggtggtcctgaccggtcaaggccccttctcctcgtgaactgggggccagggagcccttctccctgtccccccggcaccacagcgctgtagaagtgaaatcccggctccaaggtcaccctctcccgagcctggagctggaaagccacggggactccggggactcccccaaggcccggactagcctggcacccacccctcaccactaacccactc

SEQ ID NO: 32438 - DNA, 138 bp, Homo sapiens; identical to SEQ ID NO: 3402
  chr9:32783083-32783221
  hyper

SEQ ID NO: 32439 - DNA, 161 bp, Homo sapiens; identical to SEQ ID NO: 3403
  chr9:32783259-32783420
  hyper

SEQ ID NO: 32440 - DNA, 146 bp, Homo sapiens
  chr9:32783590-32783736
  hyper
cgccgggctccgcttgcacagcaccgggaccgacgggcactgctgggagagccgctctcccaggttccacctccccgatgcagagtccgtgggggaaaccaggctttcctcccagaaccaagggagcgagccgagggggcagctgc

SEQ ID NO: 32441 - DNA, 300 bp, Homo sapiens
  chr9:33523982-33524282
  hyper
gcaggaaccgaccctcagccccatccccgcggacggtccctggagcggccccgatctctcttcggagaagaggggcgggagtcacggccaggcgggaagggatgcgcgcctgagattccggaacgtcccgcgccagcccaggagaacccgcaagccagcggcgcctgagcccgagctgcagtcaccctctgcgggccacgcgagctcgagggcgccttccggagtccgggctggcgctgagctgtaggcgcgcgcctaaccgctttactgggctcactctatcgagaggtcggaggctgc

SEQ ID NO: 32442 - DNA, 499 bp, Homo sapiens
  chr9:33524342-33524841
  hyper
cgggtttgggggtgcatcttggatttaggggtggatcgctgggtggggagggggatctcgaatttggagctgggtgggggtggaaaggccacgaggagccgcggcgtctcaggagcgggtggtgggcatctgagaagtcgccaccatgaggaagctcctcagttttgggagacgcctgggccaggcgctcctgagctccatggaccaagagtatgcgggtcgggggtaccacattcgggactgggaactgcggaagatccacagggcggccatcaagggcgacgccgcagaggtggagcactgcctgacgcgcaggttccgggacttggacgtccgcgacagaaaagacaggtagcgggggctcagccctcggtgggagggggcccccaggcccggtttccccgcaccgcctgaggcggggtcgtcggagttcgccgggaccctgggagccgcggagccaaatggagcctcagctgctttccatcgctgggaatttccc

SEQ ID NO: 32443 - DNA, 644 bp, Homo sapiens
  chr9:33676771-33677415
  hyper
tgcttggctctggaccgcagccgggtaatggctgcggcagcagctgctggatggtggcagctactgggcctgcttctcctcagcagccagaggcctggcagcggcggcagcggaatggggagaagacgaataatcctccgaacggctgcctcctccagcggcctccggagcccgggccacggggggtgcggcggcggcggacgagaggtttaaaaccggcccgggtccctccatgtgccgccgccgccgccgccgccgccgccgtgttggaggcagtagaaggggagagaccaactctccggcgttcccagccctggaaatggtgacaggcgactcagaccccctccctggagctgcagccgccggggccaccgggggcgccgccgccgccgcttctccccccgctccaggagggggaggtgccgccgccgccgcgcctcagccggctcccgcccaagcccacggcttccaccttccctttcaggagaagccgaggaagaggctgcacagttagaaaagacgaagaagaagcgagaaacgccgccgctgccggcgccgcccccgcggatgctcacgggttgctgagaggggcttcaggccgggccgggccgggccgccgccgccgccgccgtctctgtctctca

SEQ ID NO: 32444 - DNA, 283 bp, Homo sapiens
  chr9:34589020-34589303
  hyper
agaaaaccatggggacgccgaccgacacacacatgcacacacacacgcgcgcgcgggcgcgcggattcacacggacacacatgcactggcagacgcgcaaccgtcggttcgcatccccgggcgctttgaagtccagatttctgcccgagaaagaagccacctttgggcgcgcaaaggccactacgaacctccccaaacccaggaatttttccagaccccgcgcgtgcagctgaggggtggggagaacagggacactaggacaaaccgccggagccacctccct

SEQ ID NO: 32445 - DNA, 152 bp, Homo sapiens
  chr9:34590071-34590223
  hyper
gcgttcaccctttctcgggcgcgccctcaagacggctgtggtccccgtgcttcacgcgcagccccggccgcgggtctcgcaaacgcgcgcgcgcacacacacacacacacacacccactcggcccgctcccctagggcggctgggcgcgcac

SEQ ID NO: 32446 - DNA, 177 bp, Homo sapiens
  chr9:34591455-34591632
  hyper
ccccagggggctgaccggcctcggcgctctaatccggccggggaggggcggacggggtgaaaattggcgagtggtttggggaacggacttgacctccagatgccctggtgtccctggctcagcctctttctgccaggttgggagcagtcgggaattctgtcccggtccaacgtcccc

SEQ ID NO: 32447 - DNA, 148 bp, Homo sapiens
  chr9:34665047-34665195
  hyper
tggctggctgggcagcggcggtggggctgcggcgggggaagccacgacccgagcgctggggagtaggacccaggccgctggacagacagctcatcaggcctcgcagaggctccagcttctgctccccggggtgcgccgagctgtgggg

SEQ ID NO: 32448 - DNA, 187 bp, Homo sapiens
  chr9:34701358-34701545
  hyper
ctgtggggctctgggcgaccggggcatgtgtgcggatgtgtgtccgcgcccgtgagcgtgcccatgcatctcccttcctgggcctgcagggggcgccccgagcctgggaagggaggctctggagtggggcgcggctgcggcagaggggtgggcgcatgcggctgtgaccctgcgagctcctcagaga

SEQ ID NO: 32449 - DNA, 135 bp, Homo sapiens
  chr9:35162260-35162395
  hyper
ggcttgcccgatcctcggccatgtcactgctctgcgtgcgcggtgagtgcgcggactgaggcggggaggcggggtgtcggcgtagaggtccccgcacccttccagtggacgtccggtgaccgtctcacccaaact

SEQ ID NO: 32450 - DNA, 374 bp, Homo sapiens
  chr9:35616922-35617296
  hyper
gaaggaaatatcagacggagagaggggaaggggggcaggtaggtgaattgggaccatccgcaggggggcggtgcacgtcggattcaggcgcaccggatgaaggtgaatgtggcacggcagcccgggcgtcggaaggactgcgcccgggtttatcccggaaggagctgcaccccgcggggcccagcgccatccgcagccgggacaggcgcgagcacttggccccgcggctgccccgcacaggcacactcacaggggagaatccgcccgacagctggtgacgtcacggctctccaggacgcagttggctgctccgacttgaccgctgtcgaggggagcatccagtgtgagaccggaagccccgagtgttgcccctt

SEQ ID NO: 32451 - DNA, 154 bp, Homo sapiens; identical to SEQ ID NO: 9888
  chr9:35675494-35675648
  hyper

SEQ ID NO: 32452 - DNA, 294 bp, Homo sapiens; identical to SEQ ID NO: 9889
  chr9:35675837-35676131
  hyper

SEQ ID NO: 32453 - DNA, 65 bp, Homo sapiens; identical to SEQ ID NO: 9890
  chr9:35728859-35728924
  hyper

SEQ ID NO: 32454 - DNA, 812 bp, Homo sapiens
  chr9:36036783-36037595
  hyper
caaagagccctggtacggggcacgttcccgcccccgggaggttttggaaacactgtgaggcagggggcggggcttgagcgggccgcagccagtcaccaaagggccgggcgctgggggcggggcctcgcgcgagcggcggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtggcagggggcctggctccgggcagtgcgggtgagtaacctccagagcaacggttcgaagctgtcgggagcggccgccacagcgctccaagatggcgcggggcagggggcgggggtgcgcgcgacccccagaccctgcccacgtccggcgaccccgggaccccaggtctcagcgctccagaggctggtgccgaggcggggcgagtgaggaactctctccgccccaagatcttctgggcggtgactcgggtttgaggccttggtctgtcacccaccgacacgggccccctcttcggcactgaccccttcgcttgcctctgctgcttgtcagaaaagggtgcgatgcccccgcccaggatcgtcgcgaggtttagatgggatttcggatacgcagccgccctaccgcggccctagttagttattgttacttgttacttgacccgcacttggttcataacgaccttggtggcggtgagcactgacggtccccacagcccgcgtggtgggtcctggactcgggcaggagacatt

SEQ ID NO: 32455 - DNA, 151 bp, Homo sapiens
  chr9:36257863-36258014
  hyper
tcaaatatacaaggaagcccagactcagaatgtagactcagagcagggaggggaccttttagcccagccttttcacgccaggacagctcgcctgccaggcagttctccaccctctctcgccccgccccgctcctaacgggacagtcagcat

SEQ ID NO: 32456 - DNA, 364 bp, Homo sapiens
  chr9:36258282-36258646
  hyper
tctcccggagtcccacgccgccgcgcggctctcaccagacgccgtcagaggctccctcccacgccgccaccgcgctcctcgggcgagggacgaaccaagcgccacgaagcaggcagagcgcgagcctgcccctcggtttccgcgctcgggcgcgcgggtagacgactcgtcgctcgaccttgtccccactcctcgctcgcccagccacgcccacccggagtgccgaatccgcgatcgcgccctgacgccacccgagagagctcgcgtgattggctgctcccgtccccgtcccccaccttcccggcggtattttgaggcgcaggcagggtgctgaccagcggaccatcttccatggcctctgccg

SEQ ID NO: 32457 - DNA, 321 bp, Homo sapiens; identical to SEQ ID NO: 9893
  chr9:36258697-36259018
  hyper

SEQ ID NO: 32458 - DNA, 189 bp, Homo sapiens
  chr9:36739811-36740000
  hyper
ggagcaggatttattagcagacaggatggggaagttgattagcctccgcggctgaacggacatcctgtcagacaggcctcttaatccaatcacttacctgtggaggggagccggctgcctcctcctggcccccttcctcctcccatggcacctgcggggccacgcggggtgctccggagccagggtaca

SEQ ID NO: 32459 - DNA, 36 bp, Homo sapiens
  chr9:37002482-37002518
  hyper
cctttcccgtgttcacgaaaaggacagcgtgcgggc

SEQ ID NO: 32460 - DNA, 294 bp, Homo sapiens
  chr9:37002818-37003112
  hyper
cggcggaccggctgtcaccgcacgtgaggctgggggcggctgggagggagcgagcgcagggtgggcagggggcgctgaggaccctcgctctgcggaggcggccacacctgagccacgagcgcaggcctcgggcgggccgtgtgccccagttctctgcgatggggggagaaagggaagggtgggcactgagaaggactgacccctgcagaaaggaacacggggacacggggacaggaagggctttcgcttaaattccagcctatccatggatgcaggaagcaggggatggagagg

SEQ ID NO: 32461 - DNA, 1046 bp, Homo sapiens; identical to SEQ ID NO: 3408
  chr9:37025306-37026352
  hyper

SEQ ID NO: 32462 - DNA, 839 bp, Homo sapiens; identical to SEQ ID NO: 3409
  chr9:37026433-37027272
  hyper

SEQ ID NO: 32463 - DNA, 60 bp, Homo sapiens; identical to SEQ ID NO: 3410
  chr9:37027324-37027384
  hyper

SEQ ID NO: 32464 - DNA, 642 bp, Homo sapiens
  chr9:37027385-37028027
  hyper
gggtgtctacctcgtgccaaccaactcttcgagccccgccgccctccctcgtgggtctgattccactgtctttccgctgcctcttccgggacggccgccgtgcctgccccaggcgtggagtgaggaacagaggagagagcagagggtcccagccaccaaggccgccggggctgccggggctgagatggagccgcagtcggctctgactgcctgcgttgccgccgccgccgccgtcgctagccctccgcctgctcggcgcgcacagtgcgccaccgcgccgccccggagccgctttcaggacccgctgcgtgtggacagcgccgcccggggctcagctccctccgggcgggggcggggcgggggctaacctgccaatcacgctccaccaagccaatcagagtggcgtcagccggccctggcccgaaacaccgccccattggctaagcagcccacaggctccgcctgattagcggacacctgggcaatgggagagaatggggggcggggcccaggcggcggcgccacgttcattgacaaacgcgctggactaaggcctagtggatcgcggctgtggggaggggaaaggggcccacgcagtgcctggagagtcccgctgcgggtcccacgcgggctggacctccc

SEQ ID NO: 32465 - DNA, 40 bp, Homo sapiens
  chr9:37028470-37028510
  hyper
agttagtaactggggcgcaccagggcgcacctgggtggag

SEQ ID NO: 32466 - DNA, 30 bp, Homo sapiens
  chr9:37028944-37028974
  hyper
accttgaaaaggaagcgtgtgacagtcatt

SEQ ID NO: 32467 - DNA, 216 bp, Homo sapiens
  chr9:37029348-37029564
  hyper
cagtagacaagtttccggcgctgacacccgtccccaccccccaccagggcacagctgcggaaaacggccccaggcgggactctggggacccaggaggctgcagtgcgcgccggggtggagtggcggcgttatctcttctttgtctggaaccccgcctgtccggatcttcccctttcacccccggccttggagcaggaagatcgcaacagcagagag

SEQ ID NO: 32468 - DNA, 884 bp, Homo sapiens
  chr9:37029893-37030777
  hyper
gtagaagaaaggctgcgggctggaaacctttctcaaaagcgcctctccagagccgctctcgggatggtgggggaggggcgatgctgccaaatcgaagaactcggctggaatatgcccgcacacgcaggttttccttcggatacccgtgaggcttgcatagaatccccggggcacggcccgagcaggagtagcgccgattctccctttcacacagtaggtgttcggcttcgggacagtgttctgctgcgtggcacacacaggacccgtcttacctgtgcacccagagcagccccttcccgcaactctcggcgttcttgggggaaggagtttccctctggataggggtgattcatcaccgcccgagcgggcggcctctgggaagttccaaccccaaaaggcgcgaccggacctcataccgtgaccacctagcccagccttacaggtcaccaaacgacagcccagagaggttacgtgactagctcgaggctgcacagcaagtccatggtggagccgggctactgcgcctcagtcctgtctctgaacgcccacgagccgcagcctgggtccaggagagcgagactagcagctctcaccgcggctctcaacgcagtcgggcctcactctgatctacagtgatgcgctttctttctcccagtaacagggctttgggccgggccctgtgctaggcgctgggggcaggagaccgcgaaaggaaactatccaggaagaaactcaatttatgtgaaccgaattgcctttgaaagttttagtactgaaagacagcccattgagaataatgtgtgagaagccagagacctcgtttcactggggacacaccccctcccggcttccctttccacgcctcccagcgcactgcattaccg

SEQ ID NO: 32469 - DNA, 750 bp, Homo sapiens
  chr9:37034197-37034947
  hyper
tgagctgaaactaaacgttttaggtggaaaaaaagcgtccgaaggcaccgtgaaatgattaaggaactaaagagcttctcgccatgtgagatcatgtcctgttctcgccaacatcacaagatgtccccagacacgccgcgcccccagcgcgccgccccacactgccggcccggagcgaggaaagggtaggcgctgcgcggccgggcctgctcagcgcgccagacgtggcggacccggcccggccggagtagagcgggaagccgggagagcagcagtgctgctgccgcgccgccccagacttttataggggttggggggagggaaggaaggcttcagcctgcgccgggcgctagccagcgcacctacgggaaggggcagaccgaagcggagcccgggagcccgggtcttccagccgcaccttctattaagacatgcgcttgggggtcgcggccctctgcgctgtgcgcggggcctgtgacatctccatgtgcaaaccccgctgcttagacgagcgcaggccgggtttttgtttttgaagaaattaactgctcggccaagcaggtgcttttgaaaggggttgcaaaggctggcagtgttgccaggcaccgaggcgacgttccggtttactccgattcacccctagggcggcgcccgaccccagggttcccagccatccaacccccaccccaatttgttggggtcctgactattgctgggcccctgaccctagggcagcgccagatccctaaa

SEQ ID NO: 32470 - DNA, 286 bp, Homo sapiens
  chr9:37035534-37035820
  hyper
gaagagcctagagctcgaggaaaggggggcccccggcggcaactggacatcacatatccactgagcagatttcgccacaatcggaaatgtggctgtggattcccgggcggcccccccaccaagtggtctgcgcagttccccagcgccgcctcctccctgcagcctgcgggcccgtgtccctaccccgagatttgatttttggccatctccgagtgctcgactctttccctccgcagcccagccccagcccaggcttcccgccctcccgcctcgcccgcgccgggag

SEQ ID NO: 32471 - DNA, 1003 bp, Homo sapiens
  chr9:37036127-37037130
  hyper
tgtctttttgtgtgtcgtttgtaaggcttttccttctccgcggtgtttagatgtgttttgatttggtgtgagtgggtgtcgtctgtgtgtgtgttgccttagggaatttcgtgttgtgtgtgttttgtttccttcgatttgaattttatttttttgaactgtacgttttggtgggggatcgggttatattttcatgtgttgtctttagtttttgtgtttgtgagatgcgctggtgagagtttgcgtgtgtattttggcttttgtggggctttgggattagggaggggacatcagccgctactccgttcctgcccgcacccatgaagggcagaggattaggccaagcatcacgaatcgtaggttcgccgtgctccgccgcttcgcgctctggacgctcgagaccagcgggaaacaaatgtggttcccgagggggcgcccgctggtcgtcaaaacctcgcgggcccggaggcgccgctgctgggtcagaatcgcagagcccccctcgcggggtaccgaggcccagccgccgtccccttgcccaccctctcccctgtgagtcggtctccccttgcgcctggccagcatgcttcggaccgtccggactcccgcagcgttggcccaaggggcggctcccctcggcggagcaggtgacgaaccacttcggaggacacggaattgacactgcggccctagagatacgggacaaggggccagaacgcggggagtctaggctcagatcggagtcgggatcccgggaaaatcccccatctcccttgcccgcagccctagaatcccagaaacccaactccgcgcagctttcggtttggagagcccgccctggtttgcaagcacagatacatgtgcccacacccgaacacacgcagacaccgccagagagcgagacagcgagcgggcgcctccgtagcagcggcctgcggggcggaaccggagctggcgccgcctcaaggggaaaccgaactgtagtgaccggaaatgtccccag

SEQ ID NO: 32472 - DNA, 835 bp, Homo sapiens
  chr9:37037430-37038265
  hyper
ggaaaagaaaagagacgcagaaggggttggcctaggcacgctgcgagctgccctccagctaagacgctgcgggcaagggagggggaggccgacatcgccaggcgaggggccaaggtcgggctctttaactcagccaggaaacatcgttgggggctccagggctcgtggagcccgaactggggctcatttccggcccgatgcccctcttccccagacccctagcccggaatccagcaaaggctgggccatcgccgtccgccactgggcctccctctgtgcgagccctgggagaagcctcagggaacgactctggcactggggctcggccccggagctagcgcagagcgtgggtgggagtcgacatccaggcaggaggcaaagaagaggccccgccctaaagccgagggcccagttcttcgaaagcctgtggccggagctggactcacaggattcggggtccgtacagcgcgcacgtggtaccgcatcttcggcaggcggcgcccctaatgcccagccccgccctgcttcgtttgccgggcctgaactgtgtcagcattgagggtggacgccgagtcgcggcgagttggtcccttgcggtataaacttggggcttccctaggggcggtgccgggatggatgggggcgcctctccacctgcaactcccccagcgcagagcgcaaaaagtgcacatcgcgggccagccgtcgcctcggggtttcaggcggcgcccggggcaaaaaggagctgaggattggtttgggtcaaaacacccatttcagttggcagtggggtcctctgcgcctacagggcttcgagctccgggtgcgggctcac

SEQ ID NO: 32473 - DNA, 88 bp, Homo sapiens
  chr9:37576058-37576146
  hyper
cagacccctgatgcccgaagcccgaccagacgctcagcctcggccaggactgagcggcgcctcctgggtcggtcgcctggggaagcgc

SEQ ID NO: 32474 - DNA, 290 bp, Homo sapiens
  chr9:38424315-38424605
  hyper
ggcgccggccgcccacgtcgcggatcccaaggctcggggacagcggcggcagcagcggcagcagcagcagaagcagcagcggcaagagcagagacaagcgcggcatggcttgctccgggacagcggcggcgcctctgcttcgcgctccgctccgcgcccgccgagcagtcaccgctcccgccccgcggccgctgattggccgggcctgcaccgcggggcgcccgcagaccgctgctccagcccgggacccgcgcggtgcccgcggcccgggtctccgagctggagggtcg

SEQ ID NO: 32475 - DNA, 124 bp, Homo sapiens
  chr9:38620225-38620349
  hyper
catggagctcaggagcgcctggcccaggcgtctcccgaagctgaagagcttcctcatggtggcgacttctcagacgcccaccacccgctcctgagccgcggcggctcctcgtggcctttccacc

SEQ ID NO: 32476 - DNA, 257 bp, Homo sapiens
  chr9:38620735-38620992
  hyper
tcccgcgggacgtcccggaatcccaggagtgcatcccttcccgcctgagggcctgcctggccctgactcccgacccgctcctcctccgaagagagatcggggccgctgacaggggccctccgcagccaccggggatgggactggggggtcggttcctgtcccggtgcagccgccgccgggtagaccgcctggcttggccgcagccagggcgacatgtagccccggttctgccaggctgggagcgccagccatcttgg

SEQ ID NO: 32477 - DNA, 508 bp, Homo sapiens
  chr9:38621429-38621937
  hyper
cgcccattcctccaccggagggggatcggggtcgctggcatgggcacttggcagtcactccggatggggttgagcaggggttctcagttttcgcccctgtgcagccgccgccgggcagaatgcctggcttggccgcagccactgctacacctagcgggtcgggcgggccggggggtgaaagcgctgggaggcgggtgccttctcgccctgtggcgcctctgggccccacggcttgtcggcctccggcgcgcagggctccccagcatcctgggcgccggcccgctgcctgcacaaagtcaactcagacaggatgaacttcggttgccttgtctggctgggctgccaggcggggcagctgacctgctgatggggtgactttcttcatcttcttgcccacaggacagcgggctgggaagccaggggccgccgggacctggggctggaaaccacatctgcccacagccgcagcctcctgcacctgtcatcctggcggcgccctgacgtcgga

SEQ ID NO: 32478 - DNA, 55 bp, Homo sapiens
  chr9:38622559-38622614
  hyper
gcccgagagacagcacgtcaccgtcaccgtcaccgcctagcgcccctgacccgct

SEQ ID NO: 32479 - DNA, 72 bp, Homo sapiens
  chr9:66455725-66455797
  hyper
gaaagttgtagagtgcgcccctcactgtggcaggagcagtggcgctgagcgtgcccacgggccgcggcttgg

SEQ ID NO: 32480 - DNA, 300 bp, Homo sapiens
  chr9:66458276-66458576
  hyper
ctggctgccccaagagcccggcccagccaagcccgcatgactccaggcgtcatcgccaccccggggccgcgggtctcggatccaggacccccagaggcgctcgcccgtgcccccgggcagctgtctccctctacacccgaggaccgccggcctcccagagagtcccgccgtctccggcggccaggcctggctcaggaccaatgtggcaccgccctgctgttgttggggggcgccgccggaggcctctgtcccctgcgcaggcttccggctctaggggcggcctcctttccgcccacgctc

SEQ ID NO: 32481 - DNA, 180 bp, Homo sapiens
  chr9:66494102-66494282
  hyper
ggcggagcatggtctgggtggctgctggaatgcttgcgctcgaggcctgagggacccactgttggtgccacctgccctgctctgcgcctctccacgcctgcgccggcgccccctccgcgcctgcgccccctccgcgcctgcaccccctccgcgcctgcgcctctctgcctttgcgaaggg

SEQ ID NO: 32482 - DNA, 297 bp, Homo sapiens
  chr9:71788964-71789261
  hyper
gcgcgtgacgcggttcgccgcaggagcctcgaaggcgcggcgccggcgagcccttccccggcaggcgcgtgggtggtagcggccaatttgacagtttcccgggccgggcggccagcgcggaggcgccacgctcgggtcgggggcgggctgacgccgccgccgccgcgggaggagggacaaaggggtgggtccccgcgggtcggcaccccggcggttgggctgcgggtcagagcactgtccggtggtgcccaggaggagtaggagcaggagcagaagcagaagcggggtccggagctg

SEQ ID NO: 32483 - DNA, 61 bp, Homo sapiens
  chr9:71789696-71789757
  hyper
atttcaaaccacactcggtattgatgcaaagttacaggcttgtgtacgtgagagaaactga

SEQ ID NO: 32484 - DNA, 30 bp, Homo sapiens
  chr9:71939754-71939784
  hyper
tctctagccccagctcggcgggtggggaca

SEQ ID NO: 32485 - DNA, 87 bp, Homo sapiens
  chr9:74061672-74061759
  hyper
gtctgcggctctccgcgttgtcctcgcggtcggagcagccccgctccatttccgccgcatccctccacttcttccccatgagaagtt

SEQ ID NO: 32486 - DNA, 323 bp, Homo sapiens
  chr9:74061787-74062110
  hyper
cgccgagcgctctcgctggctcctcgccgcgggtctccctccagcctgcgcgcggctctcggttggcgctgcctttgcctccgccggctcctgccagagccccgcgctccgttaccgccgccgccaccaggctgcgcttgcgcccgcgattggctcaactgtgggctggggctgcgagcgccacctgcgcccgagccagctttcttttgcgtccccaaattgctctccacccggcagccgccgccttctctggagagtgcagggcccacgcctgaggctgttgatgcgccgcagggtagcgctcccagcggtcacctcaccct

SEQ ID NO: 32487 - DNA, 566 bp, Homo sapiens
  chr9:74764297-74764863
  hyper
gagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaagtaagcaggcgcggggtcgagcgcactccgacgggcgggaggataggtgcaaggaacctggcgcggtgcttcgcgtagcccggggttcgctcggtgcgcagtgagcgccgcggctccggagttgaacttgagtctttggctcttgggcaacgcagagagaaccctggcgctaggttcgtgggctggctggggagttcccagaagtcgggagcagtggcgtgctaacgccacaactggctcgacagcagtccgggctgcggtagag

SEQ ID NO: 32488 - DNA, 577 bp, Homo sapiens
  chr9:77111763-77112340
  hyper
caaaccacctgcccacggaaacccccgccggagaccgaagtttacccaaatagcgctcggcaaagcgctgccataaattcaaaactaactctgccgggcccgcgggggttgcgagacagggaccgaacgtgaaacccggggagccccgcgtctcttgcctccgaaggttttccgtgatcagtgtccccttctctgctggagtcggaagtgcctgtcacctgcggatctgcccgactctcccggtcggcccttcttctctgcccagttcggacagtctcgaattccccgtcgcagccccggccacctcggactccctggtccccagcccccgccccaccccccgcctccaccacgtcccctccccgcggtcccagcctctccaggcgctgctgggctctgattggcggctgcgctgacagcaggcggggcctggaagtcgcggccaagcccgccctcgcgtataagcccctctcagcgctctctctccatctctcccctctctttctctctcgctgctcccttcctccctgtaactgaacagtgaaaattcacattgtggatccgctaacaggcacag

SEQ ID NO: 32489 - DNA, 167 bp, Homo sapiens
  chr9:77112729-77112896
  hyper
gtcaccctgcagccacggcgtccgcctaaagggatggttttctcggcagagcagctcttcgccgaccaccttcttcactcgtgctgagcgggatttttgggctctccggggttcgggctgggagcagcttcatgactacgcggagcgggagagcggccacaccatgc

SEQ ID NO: 32490 - DNA, 444 bp, Homo sapiens
  chr9:77112897-77113341
  hyper
aggtaagcgagtctgcgggcaccgaggctccccgagtccggccaactccagccagacggggagatgggggaggggagggcacccagcagaaagggaaagaggttgcccaggcgcagttccccgaattcgctctcgcaggtggggctgcaaatggcctgggcgtagaaagttgcgggaaggtgttgatgtctttcgggagttctggagggacgcgggagggcgcttttttggagaggggagacaggctagttggttcttaccagtccttgagttgcactgaatcttttttgcttgtcgctctcgggtgcggaagcggacgcgggatggagaaagccgaaagagggatgcctctggacaggagcagtttggaagcgcccggcgcgcagtggtcgccggccgggtttgggcgcgcggggcgcaccggccgggggcagggtggacacg

SEQ ID NO: 32491 - DNA, 151 bp, Homo sapiens
  chr9:77113558-77113709
  hyper
cggcccagggagtagtgcgaccccggaaaagttgtaatgagaaagttctggaggcttggaaaggccacactgctcacagtcggagagtcatgggctccggctcttttgtcagataaagggccggtagtggaaggaggtgctggtgcaccct

SEQ ID NO: 32492 - DNA, 257 bp, Homo sapiens
  chr9:77113805-77114062
  hyper
cgttacgcttgctccggctggactctgggcctctcgaagggctggagggtgggtttcggggagtcacttggtctcctctcctgccttgccggagacctcaggtttccttcgcgctgtgctcggcctttcttcactcttttactgaagagccaggcgggtgtccgcttgacatggggatctgtgcaagctctgggcacccacccccactcccagtccctcttcctggccacacagcggttaatcgggggctcttctct

SEQ ID NO: 32493 - DNA, 425 bp, Homo sapiens
  chr9:77114444-77114869
  hyper
atggtcttgattggccggctcgctgggagtggggcacccgtgtgtgtgcgcgctggctccagctgattgtcccggttgggggttggttacacgctccactgtctaaattctttcaagaaactatacttgggcaattggagagtagagaaccttggcttagtaagagacgcccggtcttttgtttttctttttctagcccatctcaccatcccatccattctttcggtttcccccgtcccagtccagagctgccagttcgtccctccccttcttcccttctaactttccccctgtggctgggttcatactttctgaacgtcgtaaactatgcgccacctcagctcggacccagcactaggacctagggcataaaatccgctcactccttacatcgtagaaggagtgcggcgcggggtggggatggg

SEQ ID NO: 32494 - DNA, 30 bp, Homo sapiens; identical to SEQ ID NO: 3415
  chr9:77115417-77115447
  hyper

SEQ ID NO: 32495 - DNA, 209 bp, Homo sapiens
  chr9:77502024-77502233
  hyper
cagaacttcctgttgcgccatatgccagcggtggagaggagccagcggggactcctgaggttgcaagtccgggcggcgccgcgttggggaaggaagcggactgcggcggggcgggtgtttaccgtaaccggcgctgtcatcgctccgggactcctgcacggggaacactgggcgcacggggacgcgcaggggcgcggagggacggccgt

SEQ ID NO: 32496 - DNA, 96 bp, Homo sapiens
  chr9:77502613-77502709
  hyper
gctattctagatcctcgttagatgtagtgtccctggccccacccacttctatctaaggccgggggcgcagatctagcgaatcgcctaaggtccttg

SEQ ID NO: 32497 - DNA, 20 bp, Homo sapiens
  chr9:78506416-78506436
  hyper
atgctctgtctcctgcgcgc

SEQ ID NO: 32498 - DNA, 541 bp, Homo sapiens
  chr9:79626876-79627417
  hyper
catttctagaagtgccgctaccccaggaaactcacatctctccacctccatcgctgtgcggagaaaacccgcaccgaaggcggcttcctctctaaggcggcgaccaggggagacagcgccccctgctgactaaaatcacgcaggcctcgttgccaaagtgcagcgggcgcagcgggcgcagcggtctcccggcttccctcccggcgcccgcagcctgcctaaagcctttctggaaactcgtgttttcagcctcagcctggcagactgcggagggcgggccaggaagagtcaaggagccgggggtctcagactttgctcaccccttggaaatcaccttctcgacccgctagcctaggccgagacacagtctgtattctgaaagccgccagtcccaccaggggaggagaaacccaaaacagaaggagcagggccccacggctgggctcgtgacgaagcatttaatgacctttttaaggaaacgagggaggaggtgaggaggccaacagccgcttaggagagcccgaaacgagcaggctggagg

SEQ ID NO: 32499 - DNA, 35 bp, Homo sapiens; identical to SEQ ID NO: 9925
  chr9:79628238-79628273
  hyper

SEQ ID NO: 32500 - DNA, 230 bp, Homo sapiens
  chr9:79628711-79628941
  hyper
gtctttgttattagtcgtcggagggagcgcaagaaagttatttaatttttaatcgttggttatttatttggtggttatggttgtcagtggccgctacctaaacagacacggcccgtaggaaagcttctggatgttggccaagaggtgtgaggcgcgggtggactgtaaaggggaaattgctctgctagggtgacacaaacgcttcccatctccacgctgattgcgcgccc

SEQ ID NO: 32501 - DNA, 199 bp, Homo sapiens; identical to SEQ ID NO: 851
  chr9:79629207-79629406
  hyper

SEQ ID NO: 32502 - DNA, 541 bp, Homo sapiens
  chr9:79629879-79630420
  hyper
ggcgcggggactggacgggtcggaaacggggcagggatgcacttcgcagagatgtcaggtcgggttggtgacgctggaggcgacggattcctaaaacgttataaggggttgacgggtggcgctgctgccctgcagcgtccccagctgcgcagctcctgagctccccgctccgagcgcccagacccccagcgccactccaccgtcgagatcacagcttcaaacctcaactccttggagccttcgaaggcgcagttctgactactgagtatttcctggaaagaaaaagaagcccaaagcggtgaaatgatgcctccagggtcatccaggcctggactcgagctggaagccacgtttccgagtcctggggctggctttctcctaccctcttcaaatccactttaggagtttcgtctgggaaaagtatgcgccgagaagtcagccgaaggtcaggcaagtgccaggctagcgtgaccaggaaggctcctgggaggaccccaaacgtaactaacccaggcaaccttccgcacgtcagctaagtcag

SEQ ID NO: 32503 - DNA, 575 bp, Homo sapiens
  chr9:79631016-79631591
  hyper
gtcggaattaacctccggggaagtaggggaagaggagagcgcgcccccctccccaccgcggccccagctctgcaccccggcccagtgccgcgcttggaatcccccaggatcctccgcggcggccgcagcccgccactctccaaaacagacacgcgacccgagctccctgtctgcgctctaggcagcaattgcggcctgggccgccgcgtccggctgtggcctaggtggtgggaagtactttctaccctcgccaagcacaacctgaatgcggaagcgtgaggctcggggcgcttcgctcagcctccgagactgttttgtcccaggttgcgtggaacctggctcgccgaggccgaagacactggccaagcccctggcgtcccctggcgctgaacctgaggttgtggcggcgggtctgcgggctgtagcgagctcacccagtgagggcctggctcattttttgtgctcagggttcgcgttatgcgcccaagatttgtcccgggagtccctgaagggcccctcccctcgatcggttcccaggagccgcaagtgcccaacgggcacggtcccagagctgc

SEQ ID NO: 32504 - DNA, 317 bp, Homo sapiens
  chr9:79631865-79632182
  hyper
aattctgtggcttcccgaggccaagaggctgtccgctgctcggctctctcaagtgtctcagcggacaaaaatcgcgcagaaactcctatggcaggaggaaagcttccgacatacagtgaaagagaaaacatcttactttgaaaagggcttaggaccaagaagctgctcttttccccgggccttcttgcaagcttcagtcgtaacatctattctcagacgtcttctggcctaggacaaactggccacatagagctagccagaaatctagctcctgactaaagatggaaattacgggcctgacccgctcacggcactcc

SEQ ID NO: 32505 - DNA, 67 bp, Homo sapiens
  chr9:79632823-79632890
  hyper
ccccagctcagacatcgccatcccagagaaacctcatcttgtccaactcactcgctccaggaaagtg

SEQ ID NO: 32506 - DNA, 487 bp, Homo sapiens
  chr9:79633250-79633737
  hyper
gtaaaaggaagggggcggaagagggagatgccagagagaagagaagcaagaaggcagtgtcctgttccccctccaccgtgcttggtggcccgggtggggcgcagctgcgggaaatgcacccggagctgtgccccctcccggcgaacagcctgcgccacccgccgcaccgggaggtggctgggggctgccgagcgagtggtgaacgcgatgggtggagagcgcccgaaacgaggtggaaaagggggcgggggcgaggcacggcgccttcttgccccttcttcagctacagacgcggcggcggcggctgagtccctcagcctcggtcatgtgatagtctcgaagcgctagctgcgggggtctcggcgtctcggggaccattacaaaacgcagccaggagagcgcgtcgctgccactgccgtcgcctctcctcctcaagacaagcccgggagaaaggcggcagctgcggcgcggacggctgagcctcccc

SEQ ID NO: 32507 - DNA, 1290 bp, Homo sapiens
  chr9:79633738-79635028
  hyper
gccagcactcacccagcattcgcagacgccctctccagcccgccgctcgctcccagagtcctgcgccccacactcctcagcagaacctgcgggcgctgccgcttcagaaaccaccaaagttttttctcctcagcgacagcctagggctgcgcgtctcttctaaccccggcgacgctgcgagcctcggagaaaagagaggcgccctagaagccaatcttctctctccttaccctgatttttcactccaggaaaaggagaactccagcgcggtctggctaagtgcctggccaggggcctgcgtccagggcactggaagtcctgctgtcactggcctccaggacagcaggcgcaaactcagatttaaagggccagagtctctactgcccagaccttcctcccagccatcttggtctgggtttccctcggacctagaaaaagcaaagaggccgggaggaaacacggccccttgccactctcctctgcagccagctccagcactcagtctttggccacccgggggaagacgcagagaaggcggcggtaaacctggtgcactccgcccgcgactgtgcgcgccagtcggcaaccgtcggggccagaagttgccagcttccgagagctgagtaggcccgaaaggccaaggtcggagacaccaggcaattcggagaaggcaggagagagaagcagagagggcctggagggcgagagggcaaagtggcgggactggaggggccgagtgggaattagtgggggcagccaggccccaggaacggagtgcggagagattctgtggtccagtgcgggccggagggcggtggaggagccgggggcgatgccgcggccggggaagagctcgtacagcgaccaaaaaccgccctactcttacatctcgctgaccgccatggcaatccagcactcggccgagaagatgctgccgctgagcgacatctacaagttcatcatggagcgcttcccctactaccgcgagcacacacagcgctggcagaacagcctgcgccacaacctctccttcaacgactgcttcatcaagattccgcggaggcccgaccagcctggcaagggtagcttctgggcgctgcaccccgactgcggggacatgttcgagaacggcagcttcctgcggcgtcgcaagcgcttcaaggtgctgcgcgccgaccatactcacttgcacgcgggaagcaccaagagcgcgccgggcgccggtccgggagggcaccttcacccccatcaccaccaccacccccaccaccaccatcatcaccacgctgc

SEQ ID NO: 32508 - DNA, 361 bp, Homo sapiens
  chr9:79635088-79635449
  hyper
gccgcacatggtacactatttccatcagcaaccgcctactgctccgcagccgcctccgcacctcccgtcacagcccccgcagcaaccgccccagcagtcgcagcctcagcagccgtctcaccccggcaagatgcaggaggcggcggccgtggcggcggcggcggcggcggccgcggcagccgcggtgggcagcgtgggacgcctgtctcagttcccaccctacgggctgggctcggccgccgccgctgccgccgcggccgcggcgtccacgtcaggcttcaagcacccctttgccattgagaacattattggccgggactacaagggcgtgctgcaggctggagggctgcccttggcgtcc

SEQ ID NO: 32509 - DNA, 220 bp, Homo sapiens
  chr9:79635745-79635965
  hyper
ggcgccatccaccgtgtgctccgcggccgcggcctcgcccgttgcctctctgctggagcccacagcccctacctcggccgaaagcaagggcggctccttgcactcggtgctagtgcactcctaggggacccggcgggcgtggggagaccagcggggtgagagacgccgggcccggaaccgcccaaaccacccgacggggagagggcgccctggtcaggcc

SEQ ID NO: 32510 - DNA, 295 bp, Homo sapiens; identical to SEQ ID NO: 853
  chr9:79636258-79636553
  hyper

SEQ ID NO: 32511 - DNA, 524 bp, Homo sapiens
  chr9:79636830-79637354
  hyper
tgtttccctaacttacgaatgcaggaaaaactcggcacatcactcgacaatattgctcttaacgcttgcagaaacgttccatggctgttcccttccagtctcctcggacggaagcaaggggaccacccagtcacctttgcacgctgcggctgtttttgtattccgtgtgctgtttgagcgcttatgtctttcaggcgaattaattcttcagtttcaattcgtgaatgggaaagaaacttgccttgtcgctcttgcccttcccccctcttgagccccagggaatagcactttactcgcgacacaattttgggaatggaggggggcagagtggggagaaatccgctttgccctttggctctaagtcacctccgcctcttgtccgcgccgcgttcgggttgtgactttgtttatgtctgctggtgttgtacgcggtgttctctattaaagcttctctctggatatctatgctagccccgtgtgaaggtgtttcagttctccaaggatgaggccgtggtttgagtgcc

SEQ ID NO: 32512 - DNA, 239 bp, Homo sapiens
  chr9:79637650-79637889
  hyper
caccacctatttttaatatgtccgtttcctaattgaacttaagtccaccaccatggtagagactgaattagcaaaaacccgcaacagtgcgtttttcctgtcaccactatccgtcacctctctcccattttgaggtcctcgactaccatctaaggccaggaactcggtgtcagcggggtgggtgcccgacggcgcccccttaagtctgcggtcctggacggaggcagccgggttggcgc

SEQ ID NO: 32513 - DNA, 88 bp, Homo sapiens
  chr9:79638136-79638224
  hyper
gctggggcctgggaagccgcgtcccggcctccgccctccaccctttagcacaggtctactttgaaccagcttccgtgtgcccagccag

SEQ ID NO: 32514 - DNA, 151 bp, Homo sapiens
  chr9:80263366-80263517
  hyper
gggacgagcagggggcgcggagctgggggtgggagctggcacctctaggagcagctcccacacttgcctccctggctggggcgtcccggccaaggtttgctgtaatctgcgcgtctggccgccaggcaccgggttccgacaggtgagtgag

SEQ ID NO: 32515 - DNA, 41 bp, Homo sapiens
  chr9:80646329-80646370
  hyper
caggtgggccgggggcgcggtgggagcggatagtctgggcc

SEQ ID NO: 32516 - DNA, 30 bp, Homo sapiens
  chr9:82185353-82185383
  hyper
ggaaaggcgcactgacggaggccgccccca

SEQ ID NO: 32517 - DNA, 40 bp, Homo sapiens
  chr9:82185643-82185683
  hyper
tgctctgttcagtaccgaccgtgttcggggttcacgtggc

SEQ ID NO: 32518 - DNA, 378 bp, Homo sapiens
  chr9:86152387-86152765
  hyper
atccctcaaggctggcgcccagggcagcccggcctctctcactctggggaaacttcgccaccgccccacgcggagaactaaagaccaccggcggagggtgagggggaccgacacggagcggaaagcaggttccgggactgagggcgtctccggagcctgggcgcgggagacagaaatgagtgaacccagctgatgcatgccttctccacgtggaagaagggaggaaataccagtgggcgacatgcaggtgcccctctcagccctcggagctcccatctcctggcggagtagggcccagaggggccagagtccctccggaggcagctgccccgcgcccctagcccgggcgcagtgagacgcgcgcgcagggtgcacgcg

SEQ ID NO: 32519 - DNA, 35 bp, Homo sapiens
  chr9:86153332-86153367
  hyper
ctgttcgctcgcctccgcctcgccccctcctttcc

SEQ ID NO: 32520 - DNA, 581 bp, Homo sapiens
  chr9:86755532-86756113
  hyper
gctccccaggcaaagcggccccgccaggacgggcacggcttcgcgtcctcgctcaagtccccgatgatggccgcgtcccggcaggcacggtgcgaattgactggggtttgggggaaacgaaagccccgaaggggccttctctgccaaatgtcttcttccgtcggctcgatggcagcccccaagcctttcattttcaatgtatgaaaacactggggtggatttagcttttcctttgggaaacaaacaaacaaaaaagaacacaaagagcgtgtgtgcgggtcttctttcaaaatagtggggcatttgaaacccgcgctgcagctgcgggcgctgcttcaatcgcaagcgttttgttttctgaaagcgctttaaaagatgctgaagaggaagagagcgagcgccctgcgcattttcggaaacggaagattttgaaaacctgtatttatccgcccttcgcaaaaaatcagcttctctagggcgagcctttccaaccttttccgtcagggcacacagaaaatgacctgatttcaagagcatttggggtaaaactggaggggatttcagagcgtctctgtgaggtt

SEQ ID NO: 32521 - DNA, 30 bp, Homo sapiens
  chr9:86886706-86886736
  hyper
agcgggggagaccctcgctttctggataaa

SEQ ID NO: 32522 - DNA, 658 bp, Homo sapiens
  chr9:87283008-87283666
  hyper
gttttacgttcccttcgtaatatttaacgcttggcctagatccgagcattcactctaacgttcggtttcttgatccttcccatccccaaactctgcgggtagatcagtgactattactatattttgaacgagactccaacccattgctctctcgagagagaaggattgcccgcctttttcccccgggcaggagctcggcgaggccaggagagccgcgcaccggccgggcagggacgcgcaggcgtcgggcgccgctggttgcgcatctggcgccagagcgcgcccccagcgctgtgcccgccgcgacccgggccatgggctggtgctccggagcgtgccgggcgctctctccccgcgcgggggcaccagagccctcggaagtgtcaggcactgcggtgtattttccccgttctcttttaaatgactgcggaaaaacagattccgagccgcaaaagggaagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgtt

SEQ ID NO: 32523 - DNA, 30 bp, Homo sapiens; identical to SEQ ID NO: 9945
  chr9:87284009-87284039
  hyper

SEQ ID NO: 32524 - DNA, 439 bp, Homo sapiens; identical to SEQ ID NO: 9946
  chr9:87284555-87284994
  hyper

SEQ ID NO: 32525 - DNA, 254 bp, Homo sapiens; identical to SEQ ID NO: 9947
  chr9:87285279-87285533
  hyper

SEQ ID NO: 32526 - DNA, 85 bp, Homo sapiens
  chr9:87285748-87285833
  hyper
ctttcgcctgtcccacgtcctgcaaatgcagtgcctctcggatctggtgcagcgacccttctcctggcatcgtggcatttccgag

SEQ ID NO: 32527 - DNA, 82 bp, Homo sapiens
  chr9:88137644-88137726
  hyper
tgggttgcggcttcccgcgggtaaaccctgtcggtacccgatccccgtccgcggaaggccaggagaacgcggttccccttct

SEQ ID NO: 32528 - DNA, 240 bp, Homo sapiens; identical to SEQ ID NO: 3427
  chr9:88137874-88138114
  hyper

SEQ ID NO: 32529 - DNA, 411 bp, Homo sapiens
  chr9:89560694-89561105
  hyper
cgagtggggtccaggcgccccggggcgccaagcggccgccgccgccgctgctcctgcgcccaggcccatagggcaggtccccgcggccgcccgatgcagcagcgccgctgcccgggcgcggtgggtgcgggacgccgtcgtcgtcgtccagcggctgctcaccacccgcgcccccggtgcgctgctcgtcatcgtagtcctcatcgtagtagtcgtccaggcccccgtccgagccgctgctgccggggccgttgcccagctcggcgccgaagcacaggcgggccatgttctccttgaccgactcgcagatgggccgctcgaggccgtcgcacacgcagtcgttgagcagcgccgccttgggcatagccagcatgtcctcaatgacggtgcggcattcgtccgtgcagcgca

SEQ ID NO: 32530 - DNA, 65 bp, Homo sapiens
  chr9:89763321-89763386
  hyper
tgctactttccatcccgttaatacaatcccggccctgtttcccggccccgcggccattgcagagt

SEQ ID NO: 32531 - DNA, 53 bp, Homo sapiens
  chr9:90112803-90112856
  hyper
gccggaccgagccaacgccggggactttgttccctccgcggaggggactcggc

SEQ ID NO: 32532 - DNA, 2 bp, Homo sapiens
  chr9:90113746-90113748
  hyper
tg

SEQ ID NO: 32533 - DNA, 93 bp, Homo sapiens
  chr9:90589194-90589287
  hyper
atgtaaaaagggaaccgaaacagtttagagcgttagccggagggtggcgggggcacacccccgccaggctgccggccgcggtccagcctcacc

SEQ ID NO: 32534 - DNA, 108 bp, Homo sapiens
  chr9:91149171-91149279
  hyper
ggaggaggaagagcacggtgtgggggaagcgcaggaggcaataggtggggcgggacggagggcagggcgctgcgtcgggagaaagtgtagaagcgctggggagagtgc

SEQ ID NO: 32535 - DNA, 190 bp, Homo sapiens
  chr9:91150170-91150360
  hyper
tgctccagccacaggcgaggcctggccaaggtgtgggcgcatctggggcaggtcttgagaggtccagcgcccggtggtgcggacagaggcggggcaccgcggcgctcgccgccgcctccccgcaggtgatcatcctcctgcaggtgtcctcgggtctcaggtggctgcgtgtctgcgccatggttgacat

SEQ ID NO: 32536 - DNA, 40 bp, Homo sapiens
  chr9:91150621-91150661
  hyper
ggcgctgcccttccacgacccctaccggcagtgagtgggg

SEQ ID NO: 32537 - DNA, 398 bp, Homo sapiens
  chr9:91605965-91606363
  hyper
gcccaaacaaaccctcgctgtcagggcgacaggcgcccgcccaagcccagacctcggacctggttccaagcctgttcccgctgggtctctgggcgcccggtttctgcacctggagctcgcccgatgaggacaaggtctggaggccggcctgggaacaggggccgaagggcgagccggaccctaggggattggtagggtcggggagaaggggtccaggctaggggcgggcggggcgcacggagaccaggcggcttgagcgggaggtggggagctggaggagtgccgggttcgcgggcgggggacggggagaggggggcggggagaggggcgggagtcgggggcggcgaggggaggggcggagcgcgggtcccgccccggcgggccgctggaaaagttta

SEQ ID NO: 32538 - DNA, 30 bp, Homo sapiens
  chr9:91606806-91606836
  hyper
ccggagcgtttacaacgggctggagctgaa

SEQ ID NO: 32539 - DNA, 91 bp, Homo sapiens
  chr9:91792357-91792448
  hyper
tgagaaagtaaagcccgtcgaagagaaagcagcacagcatttggcctgctctgcaaggagctgggaattcttgctgcggggggcaacaaga

SEQ ID NO: 32540 - DNA, 310 bp, Homo sapiens
  chr9:91792776-91793086
  hyper
tttgcttgcctctaacgtgacagtcgcgggagcgccccgcaccccgggcttcagggaatgaaggagtctgccccgaactggccccagaacccccagcccccagggcggcccgcgcccgcacccaccttgaccacgtaggtgactccgggccccagcacctggtcgctggcgtgcggcgccccccgagggggcctgggcagcggctcgtcgccgggccggcccttcctggcggcgctcatggccggggcgcggggcgccgagggcgcactgccgtccggggcggccaggctgggcgcgctgcagctgcccg

SEQ ID NO: 32541 - DNA, 144 bp, Homo sapiens
  chr9:91793455-91793599
  hyper
ccactgtccccggagcgggacggagagtgggggccccgggacagccttctggagaacgagagcagagcaagaggatggtgccctcccaccgttaaaagccagcacagcggcggccgcgcagccccggcccgggagaccgctgct

SEQ ID NO: 32542 - DNA, 193 bp, Homo sapiens
  chr9:91849616-91849809
  hyper
caagggtaaaccctgcgggctgaggaggcagcggcggaggctgggcgcacgtgggtgctgcagtagccggcggacgcccagggcgcacgggggcgcaccgagagacctcaccgaacccaaagagcgtgcggttcgtctcgcccaaaaccacagcgctggctacagaaacccctgaaatcggaaatactctaac

SEQ ID NO: 32543 - DNA, 206 bp, Homo sapiens
  chr9:93405037-93405243
  hyper
ggaagaacacaactccgctcagagcttcttcagagctccactcgcgcaggacagggcagcgcagggtgtgtggatgcggctcctcccggaggcaggcgcagcgcactccctcccgccgccgtgacgatgctgtcagctgctcgcccgccgtgcgccctgcaccgcccaccggccgtgctccctgcgcccagcgccctcgcgctcca

SEQ ID NO: 32544 - DNA, 84 bp, Homo sapiens
  chr9:93956485-93956569
  hyper
acaaagtctgttcttcgaaggaaagagttggaatcaaggacttcggacgggaggaagttggtaagttaccgcttcctccctcct

SEQ ID NO: 32545 - DNA, 123 bp, Homo sapiens
  chr9:94183821-94183944
  hyper
cgccactaccagacccgcccccagccccggattctcgcagaccccaccggcccgcaggagggagcggcgcactgggggccgcacggactcgccattggagatcgcgatcggaaggtggcgcca

SEQ ID NO: 32546 - DNA, 539 bp, Homo sapiens
  chr9:94711379-94711918
  hyper
gcctcctacaggtcccgggggtccccccggcgcggccagaaggcggccgcgccccagccgctcagggacccgcgatcccagtcacaaaccatttcaatccagatcacacaccacttcggccaccccagagcggtgggggagaggaggtttcagggaccaacaaaagggatgccaaagagcccgtttccatcaagcggcccgcgggctgggaaagtcaggacccgggagccgccggcgcccccacccccgccgcaagagccgcttctccggggccacgtccaccccaggattctgccaggcatcaggccgccctgggggtggggggacgctccgagacagacgggggacactcggggccgtgtgcccttgaaggaggaagacctcggggaggaagcccgggtcctgggaccctcggggcacatctgcggactcgggtcccgggcccagggcgggtactcacattcacactcgcactcccactcgcgaccctcgggaagcgccaccgagaggctcccagccgccgccgcccgcccccagac

SEQ ID NO: 32547 - DNA, 794 bp, Homo sapiens
  chr9:94712294-94713088
  hyper
cggggtcgggcgccaccacccctttctacgatgcgtccgctcctccttctccctggcgcttcgcaaacgggtccacttcgaggacctcgtcgtcgtcctcttctccggcccggatgcgccgctcggctccggccacggcaagggctggctggggaggttccttggcgcgggctggggcgtcccgccggccgccaggacgagcgcggggggcggaccgcgggcgagcgcgcaggaggcagggtccccgctcgcccgccccgatgggcagagcgaggcttgcgccggcgccccctgccgggggaacgcgcgggcggcgggcgggacccaaggagctggggctgcagctggggccccggacctgcctcctgcgcccgccctcgggcctgcgcctcggaacgcttgaacacaaaggtggcgccttgggggcgtcagccggagttcggcgggtctgcccacgcaggagaggcgcccagagcgggtgcccccgactttcgggggcgacacacccggggatctaggtcacaaatcagtaactccaggctgcactgcgcaccgggacaaatctgagagccacccagccccagacaccagcggtgaggcaggaagaggagaagcgaaagttgcaaaaggaaatgttcaggaaaacaaacaggccgccttggcaccggcgccctcccaggtcggtggggacaagcgcgtcccccgaaatgctcaaaactgccaggggtcgagctgcgtggagggagccctcgggagcgcgatgctatccgaagccaccgcggcttttggtttac

SEQ ID NO: 32548 - DNA, 999 bp, Homo sapiens
  chr9:95569759-95570758
  hyper
ggaacaagctgccagcgggcctggggagaaccgcccgtccgatgagctcggctgagcgtgcacgcagtgccgaaatcaaggacgcctggatgcttttcgttgcagagtgacaaaggttcaacaacaggaagaggatcaggggccaagacaagaagctgaagttcggcctgccaggaaccccgggccccagcatcccacccaaggcgctgctgcaggagttccagctgctgctgaaaggtgcggtgccgcagggccagagtgcgggatcctgagccctgcatgccagtccttgcgggggccgatcgctgtgagccttactcaggtccagccgcctccagggaggacaatgtagacgaggtgcggggcgtgagggcggtgctggccgcacccctggtcctgaggccacgggagccgcgcgaggaggccgccttccactgacgcctgcaccgggaccggttgctgcagcggtgccagctgcaggagctccgcgtctgctgcttctccgacgccagggcgccgccaggatgacaggtgcaggagactgtggctgtgggcagatgtggtttccagccccaggtccccgcggcccctggcttcccagcgcgctgtcctgtgagcaagaagatgaaaaaagccacccgatcaacaggtcagctgccccgcctggcagcccagccagacaaggcaaccgaagttcatcctctctgagttgacttcgtgcgggcagcgggccggcgcccaggatgctggggagccctgcgcgccggaggccgacaagccgtggggctcagaggcgcctcagggcgagaaggcacccgtctcccagcgctttcaccccctggcctgcccggcccgcgtggtgtcccagtggctgcggccacgccaggcattctgccccgcggcggctgcacagggacgagaactgagaacccctgctcaaccccatccggggtgactgccaaatgcctatgccagcggccccgatctccctccggtgga

SEQ ID NO: 32549 - DNA, 39 bp, Homo sapiens
  chr9:95570878-95570917
  hyper
agacagcagcctccaggcaatccccgagcccgcccgcac

SEQ ID NO: 32550 - DNA, 144 bp, Homo sapiens
  chr9:95571523-95571667
  hyper
gccccctgcaggccacgcgggctcgggagcggtttccggagtccgagctggcgctgagctgcaggcgcgagcctaaaggcttagccggggcccacgctgtctgagagatcggagcgttcagctacaggcacgcgcttaacggct

SEQ ID NO: 32551 - DNA, 204 bp, Homo sapiens
  chr9:95571727-95571931
  hyper
gtggaccaggctggatcgcggattctgagctacatcgcgggtttggtggtggatcttggatttgggggtggatcgcgggtttgggggtggatcttggatttgggggtggatcgcgggttgtgggggggatggcggatttggggctgggtgggggtggaaaggccacgaggagccgcggcggctcaggagcgggtggtgggcgtc

SEQ ID NO: 32552 - DNA, 127 bp, Homo sapiens
  chr9:95572141-95572268
  hyper
agaaaagacaggtatcgggggctcagcctgcggtgggagggggccccaggcccggcttccctgcagcccctggggcgggggccttggagggccccgggcaccctcggagccgcggagccaaatggag

SEQ ID NO: 32553 - DNA, 132 bp, Homo sapiens
  chr9:95821259-95821391
  hyper
cgccggcccagcaggcgccctagcggagccgaagcctggcagcgagcagttcgaaaccaggcggctgcacgcagcagcccgcgcgcccgttcccgagtggccgcagcgccttggtcccgggcgtctgcggac

SEQ ID NO: 32554 - DNA, 253 bp, Homo sapiens
  chr9:95946216-95946469
  hyper
cagctgacagccctgcggggcgttccaaagaacttcagaggacaggagcgctacctcgagcaaagaaccgcgggtgggagcccaggtagccggcccgcaggtggccgcgcgcgcctgccagtcagccagcccgtccgcagccaggtgggcgtgccaggcccagccccctgcgccggtccggggcggggcgaacggagccccgccctccccgcgcgccgggtcggagccggtgcgggagcggagccgcgcgaag

SEQ ID NO: 32555 - DNA, 113 bp, Homo sapiens
  chr9:96588627-96588740
  hyper
gagaacacaatgcaccgcgcacaggctgtgccaaagtccacaggcacccttcggcctccatcatcgcgccctcttcacagatgagcaaacggaggccagacgtcaccggcagg

SEQ ID NO: 32556 - DNA, 115 bp, Homo sapiens
  chr9:96588857-96588972
  hyper
cggggcgggttgccgcccctcccgggagtacgggcggaggcaggggcgggcgggggctttcagcagctcgtccgcggaacatttgcatgtaatttgggagcgggtcacatgtggg

SEQ ID NO: 32557 - DNA, 259 bp, Homo sapiens
  chr9:96708199-96708458
  hyper
cggcgccgcctgccatgcgcagcacgagcctcgctaatgcgtttcgcatggcgcgtcagtcaaacgcccttctaatgtccttaaagcacgcagaaaattgcatccttatgaaaaaggagaaaaaaagcaaattgcctggtggaagcggagctgccgcgggggctggggcggcagcgcgtgcgggcggagttgcgttcggcagggcggacttggggcggctgtcaggggctctcccgggccaaggcgcaagagcaagacg

SEQ ID NO: 32558 - DNA, 30 bp, Homo sapiens
  chr9:96710135-96710165
  hyper
ccccgcccagcggagcgaggagtcccagct

SEQ ID NO: 32559 - DNA, 783 bp, Homo sapiens
  chr9:96710664-96711447
  hyper
acttgggctgggacccgcgcttcttcttttttttttttctttcttagtccccacaagtgaccctctaggggaatccagaacagggaagggagcaagccagaggaactttttttttttttaggtgaaaagccagggggagggatggggcgcccccgctcgcgactacgcctgcgactgtcctcgcgctgcgggggctgtgcgtggagcccgcggtaagctggaatatccaagccagctgcaagtggccttccgttccccacacgcctcctgcgtgctgggcccagctgggcgccgcccaaatcttctctctcccgagactctccagctccccttctactgaccaggagaacgtcttgctccggccaggatcacaccagtggagaagcgaccccctcccccatcccgggccggggcccttctgacaagcctccccaaggactccctcattccccaggccaccttgaacaaagcacactgagcgcaaacttcgcgcctctgggggaacgctgcggccaggctaatcccagccctctctcctcccccagcccttcgcgtccccagggtccaggcggtcgcaggcgctccccactcccgcagggccacagctctcgcgagactcctgagccctctccctcccctggctgcggcccccgggctccgggaagctcagccacctgggcccacgccatatctgggtttttttcccaggactttggggatgagaagagacttgtgcatagagcggaagaggaatgggatccaagggacctttccttcaagtcc

SEQ ID NO: 32560 - DNA, 83 bp, Homo sapiens; identical to SEQ ID NO: 3431
  chr9:96711534-96711617
  hyper

SEQ ID NO: 32561 - DNA, 278 bp, Homo sapiens
  chr9:96713615-96713893
  hyper
gcggtgcggccagaccgctcctgccagcgactctctggctggcaagggagaggaggtggagttcagactggcccctcacgcccagagtggaagcgattcctaggatcctgcagccaccgagccgcccgccgtgcctagcccgggcttgatggtgaagagcacagctgccttcgacagagccggaggaaaggaagtttaagaagcaactgcccgcgttccgcttatcttgccgagcccacccccacccccaccctcaccccctgcggattcagaagctg

SEQ ID NO: 32562 - DNA, 14 bp, Homo sapiens
  chr9:96715687-96715701
  hyper
gtgttctgtcctgg

SEQ ID NO: 32563 - DNA, 524 bp, Homo sapiens; identical to SEQ ID NO: 3432
  chr9:96716904-96717428
  hyper

SEQ ID NO: 32564 - DNA, 130 bp, Homo sapiens
  chr9:96717449-96717579
  hyper
cgcggtttggcggcggcggcggcgacggcttggctccggcgcggggcccgcgcggggctctaggccggcccgcagctcggggcggcgcgcgggcgccggctcatgccccctcccccgccggccggccggg

SEQ ID NO: 32565 - DNA, 342 bp, Homo sapiens
  chr9:96717857-96718199
  hyper
gagagccggagagttcgggaggcaagacccccagagacgagagtcggagggatcaaacgacacaggtgagagaaggggcagaggcagacggcgtgggccaaacaagattccagacagtgatgtgagggcaccagagacgccaccgagatgtgcgcagagagaccaaaagaggcgtgagagccagcgggctgtgacgtgacggagggcacagaggcaggcggggcagaggaagggggcggtaaagaaatgggaacagctagaaaaccggcggcttgatcggcttttaggtagccccggaaaggtcgggaggaggaggggcaaaggccgcgctcctcagctggg

SEQ ID NO: 32566 - DNA, 45 bp, Homo sapiens
  chr9:96720841-96720886
  hyper
ggacacaccccctcccgaggcctctagccgccgccgcgaaaatcc

SEQ ID NO: 32567 - DNA, 366 bp, Homo sapiens; identical to SEQ ID NO: 857
  chr9:96721102-96721468
  hyper

SEQ ID NO: 32568 - DNA, 114 bp, Homo sapiens; identical to SEQ ID NO: 858
  chr9:96721688-96721802
  hyper

SEQ ID NO: 32569 - DNA, 30 bp, Homo sapiens
  chr9:96722011-96722041
  hyper
tggagaccaccaactcgctttctctttgga

SEQ ID NO: 32570 - DNA, 29 bp, Homo sapiens
  chr9:96723131-96723160
  hyper
agagagcggccggctcgtgcgggccagaa

SEQ ID NO: 32571 - DNA, 32 bp, Homo sapiens
  chr9:96723170-96723202
  hyper
cgcccgcggaaacgactcggcttttctttctt

SEQ ID NO: 32572 - DNA, 57 bp, Homo sapiens
  chr9:97402023-97402080
  hyper
tccgtgccctccacccgcactgtggagcgggactcgggccatcggactctgccagag

SEQ ID NO: 32573 - DNA, 212 bp, Homo sapiens; identical to SEQ ID NO: 859
  chr9:98111349-98111561
  hyper

SEQ ID NO: 32574 - DNA, 264 bp, Homo sapiens; identical to SEQ ID NO: 860
  chr9:98111894-98112158
  hyper

SEQ ID NO: 32575 - DNA, 52 bp, Homo sapiens; identical to SEQ ID NO: 861
  chr9:98112343-98112395
  hyper

SEQ ID NO: 32576 - DNA, 355 bp, Homo sapiens
  chr9:98277959-98278314
  hyper
aagcactgggctggtcgcccatctctgtaagggtggcagccacccaagcgcctgaatcggtgggcataagagtcacacacaccacctctcttacccaccgccccttccagaactccaaaagcctctctggcccttttcccgcagcatgggaggggaggtgggtaaggtgcgtctcttctagcccgggtgtcccgcacccctaggcgtgcgtgcgggctcgagagcgggtctgcggggcgcgagcgtgcccttccctgcggctgcggctgctcccgcgagctggcggcagcggcttccgcgcgcgcgctctgagccccctcccctcggcgctgtcactctccgcaccagcccttcc

SEQ ID NO: 32577 - DNA, 30 bp, Homo sapiens
  chr9:98315763-98315793
  hyper
tgcagactccggggccgccccagccgccgc

SEQ ID NO: 32578 - DNA, 315 bp, Homo sapiens
  chr9:98783210-98783525
  hyper
ccaagacgcgcgggccggggagcggggagagggcggagggaacggcgcaccgggccccgtcggactgttggaccaaaagtcctcagtgtcgggggctcgcagcgccgccgcggcgaacccagctagggggcaccgcctgcgccgggcacagggaggccgttcggctttccccctcgcgcccattactctcaggcgtcccggggaaccccgcgggccaagtgtcgggctgcgtccgggcagaggcggcttcgcctggtgtcagcgcgtttccgaagggcacccgcggcggggcccacaactcgagctgggagccgc

SEQ ID NO: 32579 - DNA, 252 bp, Homo sapiens
  chr9:98784084-98784336
  hyper
ggcgggactggggctcggacggaggacaggggcgaggaggaggcaggaaggacgccgggtactgcggggcgcctagggggttccgagcgcagcggctgcggggccgacccgcccaggatggaatcagggccccggcgcccccacgccgctcctccaggccgaacccctgcggccccaatcccccggcctcacgcccaccccgcaggtcggccctgcagctgccttcccttcctccacctccctcccgcctcc

SEQ ID NO: 32580 - DNA, 40 bp, Homo sapiens
  chr9:98784337-98784377
  hyper
aagccggcgcccccggccaagtggccgctctcaacctgtt

SEQ ID NO: 32581 - DNA, 148 bp, Homo sapiens
  chr9:98784772-98784920
  hyper
gcacagaggggcactcggcttgtaagcaacggagtaattcagagcccgtcagccccacgccgagtttattcaccctggcaggggcttccgcgggagccatgacccttcctaactggggtggaaggacccgcagcgccagccgggtccg

SEQ ID NO: 32582 - DNA, 335 bp, Homo sapiens
  chr9:98789678-98790013
  hyper
gaaaggagagggcagcgactgggcgagggaggaaagaccctggccggggcagcccggcgcgggagaggctgcgtgtgcccggctcagtcacccgccctgggagaaggcggcccggttggaaagttgaggcggaaccgaaggcccccgcgtggaggctgcagcccctgcgccggccgggcgggtccggaaggagcccaggccgcacctccaggccggcgccgccgccgcccagcgcccacccgtccccccggcgccactccacatgcaccttctcccggggcgccgacggcctcggctgcccccgcagcgtttccctagcttccctccaaggcccc

SEQ ID NO: 32583 - DNA, 97 bp, Homo sapiens
  chr9:99381503-99381600
  hyper
tgatgtccaggtacacgtcgtcctgggggtcccggcggcgcgggtcttgctgcgtggagctgcggatcttcttcacacccggcgaggtcgacgagca

SEQ ID NO: 32584 - DNA, 245 bp, Homo sapiens
  chr9:99449135-99449380
  hyper
gtcctcactgccgcccgggcctttccgcttcttcaccaaggcggacaggctgacgcactaccacgccgcgcgacagcgaccgcgcgcaaagcgccaggaaccccccctactgcccgccccgcgctggcgaagcgcgacccgtcccgccccgccccgccctcggcacagcgtcagaggcggggacgcgcgctggtctatttttgggcatccggatggcgactgcgggaaatcgagttctcatgctg

SEQ ID NO: 32585 - DNA, 30 bp, Homo sapiens
  chr9:99539965-99539995
  hyper
ctcaccgcagacccacgggctgtacgcgct

SEQ ID NO: 32586 - DNA, 477 bp, Homo sapiens
  chr9:99639580-99640057
  hyper
cctgggggccgcgggcgaaggaacacccccagatgccgctgcgcagggacaggggacgcgcccagacgtagaggccctgacctctgaatcttggcggggcacccaggagcccggcttcggggtgcttagcggggcgaagccgcccccggacccgcgtggctccagcctcctgggggtacctggcagagggggctgcagcgagcgccctgccgcgccgcttcctccgcgcgtctcccgcctggctccgccaagactgggggcttccccataggcccgcgtccgagcgcgtcctcaggcttcgctccgcgagatctgggggccccgtgggctggggttcgggcggggtccgttccttgcggtccgcggtcttgaagcaatttcccggcaaagtcccgggacagcgggaaagaaactggtctccctgcctggggtcgttcccggtggatgtgcctcttcatcagacggaattttccgtct

SEQ ID NO: 32587 - DNA, 571 bp, Homo sapiens
  chr9:99983140-99983711
  hyper
aaattatccaccaagcgctacaggcgggaaattgccagggatggaaagcagctgaggctccatttggcttcgcggctccagggcccggcgacctccaaggcccccgcctcaggcgctgcgggcaaacagggcctgggggccccctcccaccgcgggctgagcccccgctacctgtcctttctgtcgcgggcatccaagtcccggaacctgcgagtcaggcagcgctccacctccgcggcgtcgcccttgatggccaccctgtggatcttccgcagttcccagtccccgatgtggtacccccgacccgcgtactcttggtccatggagctcaggagcgcctggcccaggcgtctcccgaaactgaagagtttcctcatggtggcgacttctcagacgccaaccacccgctactgagccgccgcggctcctcgtggcctttccaccccgaccaagttccaaatccgcgatccccctccccaccccgctatccacccctaaatccaagatccaccaccaaaccagcaatccacccccaaacccaagatccacccccaaccccgcgatgtagctc

SEQ ID NO: 32588 - DNA, 240 bp, Homo sapiens
  chr9:99983771-99984011
  hyper
cctctcagaccgagtgagcttaactaagccgttactcgcgtgccagcagttgggcgctccgacctctcagaccgcgtgagcccagcaaagcggttaggcgcgcgcctgcagctcggcgctagcccggactccgggagccgctctcgagctcgcgtggacggcagagggcggctgcagctcgggcgcaggcgccgctggcttgcgggttctcctgggctcgcgcaggacatcccggaatcg

SEQ ID NO: 32589 - DNA, 30 bp, Homo sapiens
  chr9:100000368-100000398
  hyper
taaaagacatgcaaacgcccttaaccgcta

SEQ ID NO: 32590 - DNA, 30 bp, Homo sapiens
  chr9:100000837-100000867
  hyper
agcatcccagaggtgcgtgtttttccttcc

SEQ ID NO: 32591 - DNA, 30 bp, Homo sapiens
  chr9:100264785-100264815
  hyper
tcccatttgtaggggcgaggtttggtagcc

SEQ ID NO: 32592 - DNA, 509 bp, Homo sapiens
  chr9:100503451-100503960
  hyper
aaggttccaggagggcgcctgcctgcctagagtccccttgccggtctcaccctggaaaggtaggcggaactagaacaggcgggccccactgcctgcagcctgcgaggagacgccagggctgcaagcccccccgccctcctccgcccctgccgggacagtcagccgctaggggattaggaacgggcccagcgcccattcaagccattcagcgagacaggaagccaagcgcgctcctgcccgcccgcctctgccgggcaggtctgcgggatgacgcgcattgtgctggggactcgcccaaagggaggcccagccgtggggaaaaccgcgtcccgcgggaatccgacgcccggtgacgggggcacctgcaaggcttcagggcgaatccctgactcccagcccggggctgagtcctcgtggggccgcctccgcgctgcccagtgctgccggttatctgctcacagcgggtggctccgggccttcaggagcgcgacgggcgccatcccttccag

SEQ ID NO: 32593 - DNA, 40 bp, Homo sapiens; identical to SEQ ID NO: 3444
  chr9:100610095-100610135
  hyper

SEQ ID NO: 32594 - DNA, 121 bp, Homo sapiens; identical to SEQ ID NO: 3445
  chr9:100610200-100610321
  hyper

SEQ ID NO: 32595 - DNA, 123 bp, Homo sapiens
  chr9:100610694-100610817
  hyper
gccgcgcacaaatttcggaaccagaccaagaatcctggactctagacgttgcctgggggccgatcctgcgcccagggtcccagaatctaactgaaatgcgcctgcgggccgccaccttcgccc

SEQ ID NO: 32596 - DNA, 516 bp, Homo sapiens; identical to SEQ ID NO: 864
  chr9:100611124-100611640
  hyper

SEQ ID NO: 32597 - DNA, 313 bp, Homo sapiens
  chr9:100613687-100614000
  hyper
cgttaggacaacggtcgtccagaatttaaaatctagatatctgaatctcagaatcttgaaagttactgagagccacgaaatcccgtattaaaaggtgcctataatataatccagttaaaaattttaaaatttgaagtttttcctcctttgtaaaaacgaaacaggacgaaatctgggttttttgcttctccattacttgggaagaaggaaaccaggagttttgtttagcgagtgtaaagcccctctcccttcgttcgaccaaccctctgccgcagaaggttgtcaagcaaacgctttgagcgtttccacacac

SEQ ID NO: 32598 - DNA, 230 bp, Homo sapiens
  chr9:100614192-100614422
  hyper
cgcggctctgcacccacagccccggcccgccccccccccccaccccggaaagctgcgtccgggctggagccactggaacccgcgccaaggcccggaatcctatacgtagcaggggcctcggagatcagcacacgccctccagctgctatttaacagagtagaacactgaggccctgcgaggggacaaggacaggccctggatctcccagtgaatggccagggaacgaacc

SEQ ID NO: 32599 - DNA, 760 bp, Homo sapiens
  chr9:100614441-100615201
  hyper
cgcgaggatctcaggttaggaccaagttccggctcagggacagcaggaaaggaactcagaaattggacacccatgaagcaaacgtgtcccgactgcccgccccttcccccggagacgcgcccacccggccaccgctctcttcccactcccccattacccgcagccctcactccccgctgcgggaaggggctgcttggctgcctctgggggtcttcagagctaccctggtcccgggggattggaggaggaggttacctatcctgcgtcgtctttaatccgtgcaccactatccatcaaatagagacagatcctgggcctctcaaagacggatgattgggggtggtgattggcctatccctaaatatctaccacgcaaggactcttgagagatccagaccccggtacagtcgagggacctggggcccaaaaagggaaagcggctacctctaccacacagttgggaagcgcagtcctaaaggagacgcaggttggagactccgctaagcggagaagccgcagtggggccatggcaagtcaccttccctttcgggcctaggaatactcattcgaaagatggggggactggagtgccgagtggctgtggcagccacgattggggtttggaaaccatcctgaaaggcccggggagccagtctcctggaacttctccctccccattcccacaaaaaccaagcgccctctcggccaattctcaccctctcaggacaaaaaagtgagatgagcccgtcctttcacctgc

SEQ ID NO: 32600 - DNA, 834 bp, Homo sapiens; identical to SEQ ID NO: 3451
  chr9:100615202-100616036
  hyper

SEQ ID NO: 32601 - DNA, 199 bp, Homo sapiens; identical to SEQ ID NO: 3452
  chr9:100616270-100616469
  hyper

SEQ ID NO: 32602 - DNA, 770 bp, Homo sapiens
  chr9:100617285-100618055
  hyper
ggtgggatagatcggttcgtgtccgccatgtgagccagcgtagggacgaaaactcatagacacatcggctgttcacacgttccccgcaatctgagaacgaacaggaatggagagaggactcaactgggacccacgtggaaaagaccgagcaggccacagaggctcggtctccccgcgcacagcgtaggcacccggtgtactctgtaaacgggaggaggtggggcgaggcagccagagcccttggactggcacagggaccctcgatggagcgaagccctcaaacgggatgctttctggtattctatcggggagggtccttggcggtaaccagagggcagcgtagtgtcaacaccagagaccaggatccaaattgtggggaatcagtttcagccttccatgtgctgccggaactcgggcctttttacgcggttcgtcctctagtgcctttaactgcgttactacaataaaaggctgcggcagcgcctttcttcttaaagtgaggaggacaaatttgcaaaagaaataggcttttcttcttttttaaattggagaaatctctgctctggttgacctgggctggttttccctgtctctgagaacttgagacctagctccgagttgaactgtgcgtcagcactccagtcccatcacctgaaccttcagtctcccccatctgttacactagagggctgcaggactctatccaccgcccccgggttatcattcagggccccatcatcttggatgctgccctgcgtatttggcagcaa

SEQ ID NO: 32603 - DNA, 1163 bp, Homo sapiens
  chr9:100619620-100620783
  hyper
agtcccttctcctctcgggtcgtcatttgtgaaatgggaatttgtgactgctacctcagataattttcctgaagttaaacgagaggagaggtgaaaagcgctttgtaaactgcaaagcgcagagcatagcagggctgaaaggctttaaataagcgctgccttgtaacaaagcctcctggagtgtcatgataaagccccgggaaggagaaagacagggtgggaaagagcggacattttcgtcccccattctacttgtcaacttgcgggacaggtaagattgtgccaaaggcgagggtcagcatcaggagagagaggacgctgcggggagggacctggttgtgtgcttcaggtgccccaagggacacggagacgcgcgagggttgggatcaaggcgttgaagacagagcgacagcccttctcggcctcccaccggccgacgacaccaagagctcgcgcaccggccgggccaggtgggaatgggcgccgcgcaggggagcgagtacctcggagacagtgcgcgccgcccggggcctcatccacagcggggtcgcgggcggcccccttagcccgcgtgactgtgggatcctgagaacattccgctgtatgtcttggaaccttctaaccctaggaatttgcaaacccctcccagtccctcatctgggggctcagagactggaggtgccttttttatttttttcttcttcactttatgaacacagaaaaatcgtttgtccctctccgggccctgcacccgccagcgtcgtgtgcaggcgtccccgggctgtggataattagacacgttcttccctcattgcccaaggctcgttagaattcgccctagagctgtatcatgtattttctttcaaattaactttgcttgcaattaagcttagggaaccagcaacaaaagcaaacttggcccgaggtcgttcaccgcgaaaatggattagagaaacttcttccccgatttaaggggaaagattcctgcggccagcgctttggggaaagtgccccgaccgcagaggcgacgacaggggagcaggaagctgctcacggtagtcggcgttggcggcagcggtggccttcctcatctgggcgatgtgggctcctagaagagtaaggataacatcctggaaatgacttctgtacggtttgagcccaac

SEQ ID NO: 32604 - DNA, 126 bp, Homo sapiens
  chr9:101469181-101469307
  hyper
atgctcaggcaaagacgagggcgataggaatgtcattcggaaatgatttcacaccgggttagccctgcacagccagccagcttgcatcctctggggcagaggacgcctctccgcctgcagcagcct

SEQ ID NO: 32605 - DNA, 723 bp, Homo sapiens
  chr9:101469527-101470250
  hyper
ggactccagcagaagcgcccggagagtcccaggaagccaggatcaagcccagcgcctcggccccgttccgcgcgatggaagaggcgccaaccgagcgtactgcacaggaaatcactgcccccttcaggccgcgtctcagacgctgcggtcggagcacaggggctcgctcggtccggaaaaactcgcaaacccgaccttgcgcggccagcgatcgctcctccagacccgctccgcgcgctccagccccggcctggcggtgaaggtccgctctggggcttcaggcagaacccaaaccgagggcgtggggaggggtcttgggatggaaagcccttggctctctggctccgctccggactgctctccaagtctgtgctccggctgctaggtcggatgcttcaagcctgagccgtgagaaactgcctgcagccgcccggccaacagcagcggcgcggccggacaccactgcacgtccgggacgagaactgccagggcactttctgagcaactaacccgaggcaggggtctcctgaaatcgctctggccacaggcagcgccgggcacgtccaggcagaagcgctgcagagccggtggccccacacttgcccgcgcggagcgggctcagagctgctggcgcgcaccaggcgcccagccacgctgcacgctcaagccccttgggttccggagccttccggacctcaaagcgcggctcggcttccctggggg

SEQ ID NO: 32606 - DNA, 30 bp, Homo sapiens
  chr9:101470607-101470637
  hyper
gatctgaccaaaggccggaggttgcctgtg

SEQ ID NO: 32607 - DNA, 90 bp, Homo sapiens
  chr9:101470839-101470929
  hyper
gcccatgatggagagcggcgggctgctgggcggcggccggggggcgccccgcgcccagccccaggccccgggcgccagaggcagcagcag

SEQ ID NO: 32608 - DNA, 564 bp, Homo sapiens
  chr9:101470989-101471553
  hyper
gggctgcccggagctccgcggggaagccatgccgcgccgcgggctgcgggcgccggctcactcggcccgcatggcctggcccggcccgccgccccgcgccaaggtcttcccgcggcgcccgcgcaatggcgccggcccgggccccggctccgtctcgggctagggttccggctcggctcagaacggccgcggcggcggcggcggcagcggcggcgcccgtgacggatcaatcacgccgggaaggggtgggagcgagcggagtgcgggaggcggggagcaagcgagcaaacgcggagaggggggccggcgtctccgcgcgcgcctctctccagcgcggccgccccgcaccgggccgcctccgcccgcccccgtgcgcgctctgaaccgctctcccgccgggagctgctaggcggcagcccctggagctcggccgggggagggcggacggcaggaaacgcgggaggcgaaggcgaggctgctcaggggcggctcgggccgcctccagggacggggacgagccgtgcgcgccgggggagggggaggcgctggcgctgcggcggccgc

SEQ ID NO: 32609 - DNA, 365 bp, Homo sapiens
  chr9:101471554-101471919
  hyper
gggagggccaccttcccagcacacgcacacacgcgcccccggccctccgctgcgccagctgccgctgcccgccgaccgctgacctccaggcaccagagcgcccggggacagcgatctgggaaccgggaccgcgcgctggcacacgcagtggccgccgccgctccgccgagcgctgcctgtagcacctgcacggtggtttggaaccgcttctcggaggtctggccgggaaggtctgggcaggagaatgttccacgaaggcgtcccagaggcatctgcagcctacgctctcccgttcttttctggcgcccacgagcccctgaccgagtcccgggggtcgctgaagacgcccacgggtgctcgaacgc

SEQ ID NO: 32610 - DNA, 65 bp, Homo sapiens
  chr9:101705976-101706041
  hyper
gcgcggggctttcctcgcaggttacataaggcagccgcgggtggaggcagcagaggcgagcgcac

SEQ ID NO: 32611 - DNA, 154 bp, Homo sapiens
  chr9:101706042-101706196
  hyper
tccgtcgagggggaaaggggcgtggggaggcggccggggcggccggtatcccccgggcgtgagtgcgcagcgcgcgggggagcgcagggcgcggcggagtcgggtttcagagcgcgggtgactcggggcgcgggccgggagccgggattctgcc

SEQ ID NO: 32612 - DNA, 467 bp, Homo sapiens; identical to SEQ ID NO: 3455
  chr9:101706312-101706779
  hyper

SEQ ID NO: 32613 - DNA, 109 bp, Homo sapiens
  chr9:102586680-102586789
  hyper
cccccattgaagatgcggggagacgggaagcacgtgctacagccgtgggaagatccgcttctacccgcgctacatcgagcgcaagctttccgtccgagcagctccagct

SEQ ID NO: 32614 - DNA, 8 bp, Homo sapiens
  chr9:103235250-103235258
  hyper
cccaaccc

SEQ ID NO: 32615 - DNA, 146 bp, Homo sapiens
  chr9:103235748-103235894
  hyper
cggcggggctctgggcgcgcggctggatgcccccggcctgcggctccctgcgcttcccgccgtccaggggcaccagtcatgggcgccgcagccgctgaggcgccgctccggctgcctgccgcgcctccgctcgccttctgctgcta

SEQ ID NO: 32616 - DNA, 137 bp, Homo sapiens
  chr9:103790552-103790689
  hyper
aaactcattttagttcggggcgacctgcagcctgtggttcctcctggacctctggggagacgcatctcggttgcccgcagggtagaaagcaagagaatggcccacaggaacgcccgcgccagcgctaaaaccacacc

SEQ ID NO: 32617 - DNA, 212 bp, Homo sapiens
  chr9:103791492-103791704
  hyper
cttgcttgtgggtgtcgaggtgcagatgaaggcggcgctggggctgtgcagaggagaggacgaacccagggagggtcgcctcctgcgaggtgtcagattgacccagcagaaagctaccacctccctgctcataaactttccttccatgtcatctgggaaacgtggagacaaagggggcgtggaggctccctccgtcccgttccaccctcctg

SEQ ID NO: 32618 - DNA, 113 bp, Homo sapiens
  chr9:103791967-103792080
  hyper
ctccggtgccaaaggcgccggggtgaggctcgggtcagtgcggggataaatgatgagttactgacaggcttgccataatcacctcctagaacggaggacgctaggatctctcc

SEQ ID NO: 32619 - DNA, 83 bp, Homo sapiens
  chr9:104248540-104248623
  hyper
gggcagtccctgccacgcttgagcctcagtttcccacccgtaggccgagctgaccgtctccatcgctgcgctccttcccttct

SEQ ID NO: 32620 - DNA, 101 bp, Homo sapiens
  chr9:104248845-104248946
  hyper
ttacccagactggcacgcgccccgctcgcgtccttctattgacctgtcagcgcagctggcgcaggcaagggccagggaggcgcccccgagacactcaacca

SEQ ID NO: 32621 - DNA, 40 bp, Homo sapiens
  chr9:104249474-104249514
  hyper
cttggggaaaaaggacggcaaaaggcgccaactgatgggc

SEQ ID NO: 32622 - DNA, 30 bp, Homo sapiens
  chr9:104499932-104499962
  hyper
gagcccggcggcccccggccatgcagggtg

SEQ ID NO: 32623 - DNA, 15 bp, Homo sapiens
  chr9:104500167-104500182
  hyper
aggagctgggcaccc

SEQ ID NO: 32624 - DNA, 448 bp, Homo sapiens
  chr9:104500207-104500655
  hyper
cggcaacagcagacagaccctgctcagcagccaccacaaactcagtctcctcattactgagacccgcagggagaaagcgcgccccctcctgcgcccggctcgcccctctgcagccgctgcctgaggtctccgcctccaggtcccgcgcgcagcttcactccactcggtgaagcggtcccaggagctggagcggtctctaggccatgcaagttggagcgtagcgcgcctccggcagtctcagatcccgctcccaggtccctccgcctggcatcctctgcccgcccggtcactgcgctgagcaggcaggcgggcgggccggcgcctgtcacccgcagctggagcgcccgttccctgcccgccccatctgcagggcgcctcgggcactgcgtccggccccgcgaggcggccgggatgagaagcagccggagttcctcgggggcagcagtga

SEQ ID NO: 32625 - DNA, 174 bp, Homo sapiens; identical to SEQ ID NO: 10015
  chr9:104500856-104501030
  hyper

SEQ ID NO: 32626 - DNA, 193 bp, Homo sapiens; identical to SEQ ID NO: 10016
  chr9:104501031-104501224
  hyper

SEQ ID NO: 32627 - DNA, 476 bp, Homo sapiens
  chr9:108418471-108418947
  hyper
ccgcgagacaaagggcggtgtcctataaaggcggcggcggcggcggcgcggtgtccaggcgagggcgcacacggccggcgagggcgacggctacggcgacgacgcgggctctttgcgaggaggtgcgtggactccggggggacatgggcgcaaccagggccgggctcgtgggcctgcgggtctctcgctgagccatactcacccgggagagcaggaatgcggcggagacttggtagcggccaccgagccaattcggtgggaagaccgggggactttccgcggggcaggggcggtggctcagctccgggggtgctaggccgactctctagcgtgttggcgggcccgcgtcgcttttatgcgtgatgccggggacccccttgtaccgctctcggcggcgcatctcccagagcccttcaaggagctcgcgcgtccccgagcgactcccggacacctggcagattcgaaacttcagccac

SEQ ID NO: 32628 - DNA, 30 bp, Homo sapiens
  chr9:109622797-109622827
  hyper
ccatcttaggacttacgacccaagccaacc

SEQ ID NO: 32629 - DNA, 168 bp, Homo sapiens
  chr9:109623048-109623216
  hyper
ggtggcggcggccagcgctcagacaccccccgggtcccggtggggaggagctcggggcaggaggacttccctaggtccctccgggcactcggaagggggagtcctcccaaagccgcacaaagccgggatcatttcaatccggaacagcctcagcgtcctcctcctctc

SEQ ID NO: 32630 - DNA, 145 bp, Homo sapiens
  chr9:109623464-109623609
  hyper
ggaagtgggtgaaatcgtgcctcggggtgagagattctgctcaggaatatagggtcgggaaaatcttggaaaatgaggatttagatctgtttatgaagccccgctatcggatgggaaccaactccgcgcgcgtctcctcctcttc

SEQ ID NO: 32631 - DNA, 60 bp, Homo sapiens
  chr9:109624462-109624522
  hyper
tggaaatactcacaccgcaagctggaaagggattaaaaagccccacgtggttgatctggg

SEQ ID NO: 32632 - DNA, 829 bp, Homo sapiens
  chr9:110227815-110228644
  hyper
tcccgtctattttcacgttagccaaagggaagcctagaagtccacagtccccgggagctggaagccaggcagtgacagcgccagcgtattctccttgacttgattgtaaatttcacaactttggtagcttcaacagggaggaagaggaggggcgccggctccctccagcaaaggcggcgcggagcgggtagccaggtccggagccgtcctgtgccgggccgtccggtggggggcactgcagaccgcgcgggcgctgcgcccgcctctagctccgggcgcagaggggtggccacgctctcctgagtccctcgcgcccctagccgcgcctgggagagcggactggcctcccagagaggatgcgggggaagccgcacaggggcccactgggactgggtaagggcgcgggatgggatcggctctggatatgggtgccccccgagccgcgccccaccccgcgagcgctcccatttgcacctccacttgagcacggagcttcaagaacgagctattctggggtgcgggttccgacactaggccccacacggatctggggactggtttggctacgacctggcggaaggggggaaacctggcctgagaacggaaactgcgggacgatccggcggcgcacttaaatctggctccgctgcttcctcgccccgcccccgctgtcaccttcctctgcttctgcgcagcgattccacaccccactccaccccatcccacccagaccgctcacccgattctgactttgaacccaaaagcgatcaggcgtgttctgggcccggccacagccagcgggcgctctggccctcgcagaagccgccgc

SEQ ID NO: 32633 - DNA, 81 bp, Homo sapiens
  chr9:110251955-110252036
  hyper
tcactcggcggctcccggtgccgccgccgcccgccaccgcctctgctccccgcgcgcccgcagacacgttcgttctctctg

SEQ ID NO: 32634 - DNA, 45 bp, Homo sapiens
  chr9:110253522-110253567
  hyper
tcaaaaagtgcacaccgagcccgccgcaggcgtccttgcccaccg

SEQ ID NO: 32635 - DNA, 52 bp, Homo sapiens
  chr9:110400388-110400440
  hyper
aatgagaggcttgtacgaaacatcagccgacaagaaacggggtgatgtcaga

SEQ ID NO: 32636 - DNA, 182 bp, Homo sapiens
  chr9:111929136-111929318
  hyper
cccggtctcccctcccgcaacccctcgccctcccgcagcctcaccctcctccgacaggtagcgcaggtcgtagaactcccccgcgaaggtgccgtaggaggagtcgtggcgcggcaccgcctcgtcggcgcccgtgtccccccgcgcgcgtccccggggtccccggccccccgggcccgcac

SEQ ID NO: 32637 - DNA, 189 bp, Homo sapiens
  chr9:111929339-111929528
  hyper
cgcaggcggcgggccccgtcagtagcagcaggagcagcgacgcccagacccccgggtgctgccggggcggccgcgccatccgtgcgcacagatcccgcagccaggccgctcgggccgcagcgggggcgccgcgggcgcgggccgggactgagcctccgccgaggccaccagcacgcgcccgcgcagccg

SEQ ID NO: 32638 - DNA, 15 bp, Homo sapiens
  chr9:111929585-111929600
  hyper
cgcagcctccccctt

SEQ ID NO: 32639 - DNA, 80 bp, Homo sapiens
  chr9:112081693-112081773
  hyper
ggggtcgactcccagcgccccagcaaagggctctgccggtgcaaggcaggcaggtctgagacagccgactctagagttag

SEQ ID NO: 32640 - DNA, 678 bp, Homo sapiens
  chr9:112402623-112403301
  hyper
cttgcagaggccagacgcttcttgcaacttctaagcggcgagagctgccaccttgccaatgactcaaccgtttgcctatgccctctgggctgtgccaccagccgcagccgccctgctcccccacccacccttctccccaggctccgcgccgcgccgccagtcccaggggagccgccggcgcacctggcgcctagggcgcacggcactgcgcgctggtgggcacctcacccgacgccagctgccagcgcgctccctccccgaaaccctgaagtggggtgtcttgtctagcgcccagcgaacaacattatccaattgcttcccgttttattcgcaggctgggagctgagagagcctgagcattcactttcaaccctccaggggaggagggggtgcgggtggggaggggagacggctcccagctccacctcgcgcgcggcgcggccagtgcactcggctccgggagaggcgagcagcgccggtgagccccgcagcagcgcacccggccgcggagccccgcgatggagtgagtatccccgagccgcgccgccagctgctctcctctcggcatgttgccatggtgaccgcggcggcaggcagatcccgctcgggtccgcgtccaggatgggtgtttaatttcagccccgtgtgtacgcctggtgtttctatagcagccgccgc

SEQ ID NO: 32641 - DNA, 166 bp, Homo sapiens
  chr9:112403302-112403468
  hyper
gcggcaggaggcaaggggtgggagccccgggtggcgtggtttttgcggctgccccttggctagcagggcctggggggcgagtgaggggagtagatgatgttgctaaggacggaggcatattctaggctttcctatctctgccccaagcttccgcttatcggggagt

SEQ ID NO: 32642 - DNA, 157 bp, Homo sapiens
  chr9:112542235-112542392
  hyper
gtgtccacgcgggcgcgccacgccagccgtgcgccccagcggctcgccgtgcgcccgcgccccaggtgcccactggctcgcgcgccctccgtctgcgccttggagacccgcggcggcgatcgctcggagccgccttggaccgcggcctcgggtccat

SEQ ID NO: 32643 - DNA, 30 bp, Homo sapiens
  chr9:112542670-112542700
  hyper
tctagcaaagccccccggggtgcccatcag

SEQ ID NO: 32644 - DNA, 357 bp, Homo sapiens
  chr9:113341265-113341622
  hyper
ccgggtcgggaggggcgggcgccttaccgcggcttgctggaaggcgcccttggtgtaggtgccgccacctcggtaggagatggcagggatctcttggaggagcagcgcgcacttgtgctggcgcgcgcggcgggtggagatgtaatcgacgcgcggcaccacgtagttcttggacgagaaggtcacgatggccacgcgcgtggccgtgggcaccacggggaagtcggacagcagcttgcggacgaacatgagctcgctgcggaagttgacttcgcccacgctggacgaatcatccaccaggaagacaagctccaggcgctcgctgagctcccgcagcagccgcacgcgtcgccggaa

SEQ ID NO: 32645 - DNA, 169 bp, Homo sapiens
  chr9:113341679-113341848
  hyper
cgcggggatactcccgggggccccgggcgcggtctcggggaagaggcggaagctgaaattgcgcgacggggacatctgctgaaaggtcgcccagcccgaaacgagcgccagaccccagcaacaaaaggccaggcgaggccacatcgcgctggagacagagcggctgccc

SEQ ID NO: 32646 - DNA, 414 bp, Homo sapiens
  chr9:113341926-113342340
  hyper
cggggcagcggccaagagcctcagcgccctttcatctgacactggggacagacacaatccagactcctcagcagctcgggaactccggagggaacggcgcgcgctctctacccctctcgctctcctctttttttcttccctctctcctcctcctctctctccctgaagcctataaaatgtttgaaggaaagggggcagtcaagaaaaatctcccgcttccctccttctctccctctctccctctccccgctcctgtctactttctgtatctgtgactctatctccctcctccccctctcattctcctcccgggatcaagccaaaggctcggagattccatgacaccagaaccccgcgtctgtcaggctgtcaacattcccgcagcaagcgcaccagcgccgaagccctgattga

SEQ ID NO: 32647 - DNA, 30 bp, Homo sapiens
  chr9:113800111-113800141
  hyper
cgcactgacctggcgcgggacaggagggcc

SEQ ID NO: 32648 - DNA, 64 bp, Homo sapiens
  chr9:113800385-113800449
  hyper
cgcggcctctggcttcgcgcccagggggcgccgtccccacacgccgcgccggcccccttacctg

SEQ ID NO: 32649 - DNA, 300 bp, Homo sapiens
  chr9:113801080-113801380
  hyper
tcgacacacccgcagcgggagacccgtggccgccagctcgggtcccacccccgcccctcctgcgcttaccccagcgccggacagctggcaggactccggtggacgccccggcacggggcattttcacgttgtcgctctcctcttcccactcgaaaagctctggaaaacatcgcggggcccgcaaaaccccggaaatgtggcctctctttcgtggctcactttctaaactttccagaaggcgcaaagtttctcccagcgccgccctgcactggaggctgcgaagaacgcagaagcggcttt

SEQ ID NO: 32650 - DNA, 136 bp, Homo sapiens; identical to SEQ ID NO: 10028
  chr9:114287491-114287627
  hyper

SEQ ID NO: 32651 - DNA, 138 bp, Homo sapiens
  chr9:114287962-114288100
  hyper
gagatcctctggctgcgtcacattttcaccgggcctcctatgtaaactccctgtagacggagccgagtgtcttagtcatcgcggagccccaggtgctcagcacggcgccaggtacgtggtgggcgcctaatatttggc

SEQ ID NO: 32652 - DNA, 30 bp, Homo sapiens
  chr9:114361785-114361815
  hyper
cctcctccactggggcgtctagaaacttgg

SEQ ID NO: 32653 - DNA, 50 bp, Homo sapiens
  chr9:114362053-114362103
  hyper
cgggaaatctgagtgcgtttgtgtgtgtgtgtgcgcgtatctctgtgtgc

SEQ ID NO: 32654 - DNA, 621 bp, Homo sapiens
  chr9:115652936-115653557
  hyper
gcgggcaggtgacctcggggctcatgtgacctctctgatggggatcgaagggctttctggctgcagtgacaaggatatgctcccaaattcggctgctacggctgctcaggtttcagtcccggagcgcgagtgtgctccgtgcgccgggagcgcgagtgtgctccgtgcgccgggagcgcgccggccagtggcgagcagagccagggcacgcagcgcctgtgacagcagcccgcccagcagccgagtgacctcccgagtgactcctcctcaggccagaaaaggccgcgctccaccctgccctcgccacctcaggcagagtaggactggcgacagtccagggaagccaggcgcgggggagcgcaccgcgagtgctggctcctggcgccagcacccccggggccgacgggtcacgctgctcctgtgagcgcggccgcctgacggggccgaatttccccacagccaggcgtgcgtgcccggacctcccgcggatctctgcggaccccccaccaccggggcaggggctggaaggaagctccccaggactggctcagggagcgtttccaaattctcccatcccaggaaggcaggtttgcgcgaggggtgggacgcctaggattctgc

SEQ ID NO: 32655 - DNA, 30 bp, Homo sapiens
  chr9:116756509-116756539
  hyper
attcagacacagccacgtgggtttcagcct

SEQ ID NO: 32656 - DNA, 43 bp, Homo sapiens
  chr9:116916374-116916417
  hyper
ccagcacctatgagccgcccccagctctcggagcccgcgccgg

SEQ ID NO: 32657 - DNA, 127 bp, Homo sapiens
  chr9:117267169-117267296
  hyper
ccgggagcgcggagacgacggctggagcctgggtttggggagcacgggtacagtggctggatcctagggggtcgcggagaccgctgctagagtcccggaggcgcgaagacggcgggggtcgcgaacc

SEQ ID NO: 32658 - DNA, 59 bp, Homo sapiens
  chr9:117880343-117880402
  hyper
cgagttccccagcagcgctgcctttgtgcccacggaggcgggggcgtgtatctgcgcgc

SEQ ID NO: 32659 - DNA, 212 bp, Homo sapiens
  chr9:118916583-118916795
  hyper
gccacctgcgccacccgggcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgcc

SEQ ID NO: 32660 - DNA, 30 bp, Homo sapiens; identical to SEQ ID NO: 10032
  chr9:118917350-118917380
  hyper

SEQ ID NO: 32661 - DNA, 45 bp, Homo sapiens
  chr9:118917733-118917778
  hyper
aataaaactggggagcggaggtgggggcggcgctggaagagagga

SEQ ID NO: 32662 - DNA, 30 bp, Homo sapiens
  chr9:118919318-118919348
  hyper
gctcagcagggaccgcgctgctatttcagg

SEQ ID NO: 32663 - DNA, 749 bp, Homo sapiens
  chr9:120175549-120176298
  hyper
gcaaggagttaacctcggaagttcagggatcgtaaaggttctcacctggaaggcccctcacctgcggtgcccgaggcggatcccgccgaggaaaagacccggggaagaagagctccgggtctgggcgagcccctggcgcctcacgggcgctgttgttggccagactccgacaaccaataaggccccgcgcccccaagaggggaggggagagcgagcaagcagcgagcgcgggagagctaaggggaacaacatttttgtaaacgctctccgagataattaagctatcaattacccgggtgggaaatcagctgcgcttcccacagctccactgaagggccgactcctccgggattcgcgcagggaaccagcaggcagcaagctgctggcgaacttttctgattaacttttccgttggagccccccacccacacccatctcctctcctctcctttttcttgcctttaagtaattattattagcccagggagtgagctgcaaggacaaaccggctctctgcctggaggtgggtagaaagggaaggcggtaacgggggtagagggaggctctaaacgtggagacctcggagtcggaatcccagttctcagcaaccactcaagtctctccagccctatttcacagatggccagaactgaggctcagagaagggaagcgacttggccaaggtcactcagcccatgcggaagccacgcttttgcgggttgagcgattccacacggaactactccatt

SEQ ID NO: 32664 - DNA, 692 bp, Homo sapiens
  chr9:120176817-120177509
  hyper
caccgcgatgcgccccggcagctcgttacgcacaaagagcaggaggcgcgactcggcggcggtgccggcagagccaggagagcccggggacgcggcggcggcggcggctccggccccggtcccagccccggccccggcgcgggcgccgctccagccgatgtcgctctcccgcagggcgggcagtgtggacaccgtgacggtcttcagccggcacgggctgtcgggctcccgcgaggcagcggcggtggcgccggccagcagcggcggcggcggcagcaggagcaggaacagcagcagcagcggcagcagtggcggcggccccgggtggaagcagagcctcggccgcccccggagccccgagccggggccggggctgagccgggcgccggcggcggccatggcgggaggggctgcggtgctgcgggcggcggcggcggtggcggcggtggcgaaggaggaagaggaggcagctgcggagacggcggacgccgaagcgaaccaggacgcccgagctaaggagcggagagagccgctcgccagcagcccccagctccgggctccgcctcccgatcggccctggaccgcccccccgcgccgcctcccggggcccagccgcccgtccccgatctccggctccccccgcagaccccgagcgtttcggaggctccgcccggcctcgtgcaagtcccagt

SEQ ID NO: 32665 - DNA, 140 bp, Homo sapiens
  chr9:120177898-120178038
  hyper
cattctcccactgcccgcaaaccttcctctcccctccatccaggccttgtgctagcactaattgctaatggacagaggggcgtcgaactccaccgtctaacgccgaccccacaactgactgaagccgggctgttctggcc

SEQ ID NO: 32666 - DNA, 211 bp, Homo sapiens
  chr9:122131005-122131216
  hyper
cacgaacacacgcatcaaacgcaaacgacgccgcacacgcaaacacactagcaccacatcaagttcccaccatggtgcacacgtcgggagcgcgcggggacacacacgccactcactcaaacccgcaattagccctttgagccccaggcacaggaaccccctccctagaactggagaagacttggaggcggcggggcggccaggtgaagag

SEQ ID NO: 32667 - DNA, 128 bp, Homo sapiens
  chr9:122131496-122131624
  hyper
cgtaaagtccccttcgctggtcccgaggacaggcatgaatcccggctccggaaggcggtcactactccctctgcctcccggctctctcgctctcgctctcgctgttgctcgctcgctctctccctctc

SEQ ID NO: 32668 - DNA, 188 bp, Homo sapiens; identical to SEQ ID NO: 10038
  chr9:122131838-122132026
  hyper

SEQ ID NO: 32669 - DNA, 162 bp, Homo sapiens
  chr9:122132051-122132213
  hyper
cgcgcaaacccggaatcctggtgcccttaagcgtgactgtactgtgtgtgtcgcgagtacctgagtgtttctggggcggcaggtgtttccacggccgcgtggatccatcgagtgtgggttttgtctcgggagttgcccgtgtgggtccgtttgtgtctgcgc

SEQ ID NO: 32670 - DNA, 42 bp, Homo sapiens
  chr9:124361888-124361930
  hyper
ccgccccgctccactcggcccagctggcgcgaaggaaacttt

SEQ ID NO: 32671 - DNA, 231 bp, Homo sapiens
  chr9:124990555-124990786
  hyper
caccctccagcccctcggcgcgccgggtaccggccccgcgtcgggattctcagcgctgcgccggcacaacccccggcgcatcggcgctatcagcgcctattcagacggacaataccggcctcgcctcctcttgattcgcctgtgtctttactaaatcgctttttgagaaattcctccaacatttgcataatgtgttcccgctttccgcgaccccccccccccgctcgcgcg

SEQ ID NO: 32672 - DNA, 114 bp, Homo sapiens
  chr9:124990828-124990942
  hyper
cgtacccctccttcctgcaaccgcccgccaccctgctcggcccggctgggtcccggaccctgcccgaccccggcccgggccgctcacccagtcgttcgccggctcacctggtcg

SEQ ID NO: 32673 - DNA, 63 bp, Homo sapiens
  chr9:126138079-126138142
  hyper
ggctggccccaaccccgggtggctcagcccaggaggagcctggacagacgaaggcagcaggcg

SEQ ID NO: 32674 - DNA, 189 bp, Homo sapiens
  chr9:126760259-126760448
  hyper
cagaaaaggggaaatcgggactcatgtggttgagggttcatgagagcagtttctgtgcgctgaggccgggacttcccagcacagcctacaagacactgcctgcccacgcctggccccgcccacctctgcagcctcatcccgctccccaccccacaccggccactccggctttcgcgctggccttgctcc

SEQ ID NO: 32675 - DNA, 127 bp, Homo sapiens
  chr9:126761476-126761603
  hyper
ggggagtgacttgtccgaggtctcagagcagggaaatggcttcagttgcattttgggggccgctgttccaaggagagacagagaaagagatagcgagtccccctgagcaaggcgagaaaggggggag

SEQ ID NO: 32676 - DNA, 1318 bp, Homo sapiens
  chr9:126770490-126771808
  hyper
acacacacttctgaacgtcttcattttgatttaatggtatatcagcgtcaactatcgcttcctctgctggtacacacggcctgatgccgcgggaggagggtgcccatgtttatcaccgagtgagatgactaattacaccttgtcaatcaccggctatgaagacataaaaccagcgcgcacaatgaagtagttgcctgcagcgtcaattagttggcgattctgaggttattgcgtggccctgctttggccgcctctaataacgggacagagcgccgggcaccgcgcactgatcaatcaccctccttccgcggccgcccggctccctcccctctcccccgccgggtctggcctcactttctccgggcggcttgcgcttcctccctccgcggccccggctccgtggcgccggcagccccgggagccccgggaagtttgcgcgcggcagctccgcagccggcagccgggagccccgcagccttcggggagcgccggggctggtggcccctttgttggaggaggcgtggagggagcgcttttgttctgagttagtcacggtggccggctggaggctgctacctcattatgcgccgggtctgcttgtctgcgaggaagcagatggtggggaggtaggcagcggcgagagtggccagacctgaattccgttcacctgtcacctcccacaaaaggcaggttcgggggacttaggcattcgttgccactttctgggggagggggaggtcgaggggccgccgtttccggcgcctgcgaaggttccgtacctgtcggtgcccgctccccccaccccttgcctttcccttggctgcagcttctcgcaccgcgtaaatgtcactcacgtgtcaggatgtgtgtttacagcctgttcctctgcttgtttagtctcggcggacagggctcagcggttgcgcgacgttccccgccgctgggggagattagcaaagttacccgcctctggaccccggggcctgggcccctagatcccgccccgcggcgggagatgcgtttgagccttttacagacggagcgcgtcccagcctgacgcagagggatgaatagacaagcgcaccgggcgggaatcccgactgcctgtgtatctggggtcggcccagcgttggacgtgggctgctggtccgagaggtggcgacggaatcgcgtgcctatatgtatgggggagtggaaagtcgcagggtgtgtttccacgtttcttgagcagcccgcggcaagagttgctgagtaccccaccccccgcccccagatcctaaggcagcccctcgagctttccaaacgtattgtatccagc

SEQ ID NO: 32677 - DNA, 528 bp, Homo sapiens
  chr9:126773252-126773780
  hyper
gagcgagaagctacacgctgggctgcagattgggccctagcgggcttggagcgtggatatgctggctggcccccctccccgggagtcacagctctcgccggtctcgccactcaggctctgccgggtacccaggaggcttgcacggccgcctgcagcccgctgtgcagagcccgggccgaaggcggagctcgatgggaaacggccggccgaaggctcttgcaactctgccacaggcctgccttcccgggcctcccaggcgggtgcctgaggccgcggctccaggccgaggggagaccgcagtgagacgagcatccccttgctgcgccttcttaggatagagggtttaattttcctttctgaagatatcgcaggaagctgttcgtatcttaaaaactccaaaccccgcgctctccctcctccctgcctcccccccacccccgccctccagcctcgcccaccagctcccaccatctcgactctcctctgctcctcttgcctctcccctccctcttgggtctcccgccttcc

SEQ ID NO: 32678 - DNA, 339 bp, Homo sapiens
  chr9:126773939-126774278
  hyper
ggctgggcccgcggccggcggctcctcctcccactctgctcctcctcttttttctcctcctccacctcctcctccgcctcctcctcctcctcttcctcctcctcttcaattctcccggtggctcgactcggctcgcaggcttcggagaaacccctactccagtcgccgactcagcgcccaagagggtcgccttgggctgggggcgcaccccagggaggggaggggtccaggcagctgggccgccgcggacacctagcggcttcagggtgaaccccgaccgcagccgtcgccgcctcgggcagagtttgcgcccttgctttgcgccccgggcgctgaagc

SEQ ID NO: 32679 - DNA, 103 bp, Homo sapiens
  chr9:126774517-126774620
  hyper
gcggtggcgatgcaccgggcccgttagcgccaggagcgccaggcagctgaggcggggggcaagccctccctcggaggagccgcgcccccggccccgccggtcc

SEQ ID NO: 32680 - DNA, 96 bp, Homo sapiens
  chr9:126775412-126775508
  hyper
tccctgggggccagacgagcagacactgcccgaccagcgggcccagaagtgacctttaggaggccgcggaggtggggagcacgggagaagcttctc

SEQ ID NO: 32681 - DNA, 123 bp, Homo sapiens
  chr9:126777624-126777747
  hyper
atgccgacgtggcagcggcggccgctgcagccgcggcggccaagagcgcggggctgggcgcagcaggggccaaccctctgggtcttccctactacaatggcgtgggcactgtgcagaaggggc

SEQ ID NO: 32682 - DNA, 9 bp, Homo sapiens
  chr9:126777973-126777982
  hyper
cggctggag

SEQ ID NO: 32683 - DNA, 106 bp, Homo sapiens
  chr9:126778407-126778513
  hyper
ctccgagtttcctggcgcctgctggggtgagggccgtgaccctcggaagcgagccccccgggcggggacgagaccggagcaggcctggcctcgcgccggggtgggg

SEQ ID NO: 32684 - DNA, 15 bp, Homo sapiens
  chr9:126779147-126779162
  hyper
aaaccgagttcagac

SEQ ID NO: 32685 - DNA, 447 bp, Homo sapiens
  chr9:126779597-126780044
  hyper
cgttcggtgcgccggcggtggctatgcggctggctctttcggggctcccgggactaggttggggaaagagggcatctccccggcctctcggggcccagcccagtcttcctagatctggcgtccgcccttccctcccctcccgcactggcaggagagaaatggccgcagtgtgggccgcggggcagctaggactggaaagcggggaccctggagggtgcgatcgcggacggggtgtgcgggcgcgggtcgtgtgcgtgtgcgtgcagggttccgaccacggggacacgagcttgtttgtggcagtgtcccacatcctgtggcccagccacgacgaccccttgcaaagcctcttgctctggggacagtccctccgaggcgcggcggcaccttactgaagggcggcgagctgggggccgagtggggagggggcgccgtcggggcgccggg

SEQ ID NO: 32686 - DNA, 31 bp, Homo sapiens; identical to SEQ ID NO: 3461
  chr9:126780284-126780315
  hyper

SEQ ID NO: 32687 - DNA, 334 bp, Homo sapiens
  chr9:126780564-126780898
  hyper
aggagagagaaagcccgggtcctccccctcccctcggcccctcgctcctccccggatccgatcctggggaatctcgacccgcccccgggcactgggggcgggagtgagggggttcggggcgccggccaaacctgggccccacggctgcctcccccgccgccgccccctgcccttgcctctggccggcctcggcctcgctacttagggccggctcctttccctttttctccactccccttctttccccttttctctactcccccgccaataacggcttcggaaaaggcctcccccgcagggaccgggtctcccggagccccgggattcagctcgg

SEQ ID NO: 32688 - DNA, 110 bp, Homo sapiens
  chr9:126781196-126781306
  hyper
ttgggcccatgggggcgccggggtccccacggagctcattaacagcagccaggcccaggcgggggctcggtggagggatgggcccaaagataccccgtagggaggctgcc

SEQ ID NO: 32689 - DNA, 30 bp, Homo sapiens
  chr9:126782415-126782445
  hyper
cttcatttcccttagcgttagtttccacat

SEQ ID NO: 32690 - DNA, 124 bp, Homo sapiens
  chr9:126783416-126783540
  hyper
gtgaccagccatacccgagcagccagaagaccaagcgcatgcgcacgtccttcaagcaccaccagcttcggaccatgaagtcttactttgccattaaccacaaccccgacgccaaggacttgaa

SEQ ID NO: 32691 - DNA, 294 bp, Homo sapiens
  chr9:126785057-126785351
  hyper
agctgcggggggagccgggagttggggcccctaggctcccgaggcgcccccttgagcagcgctgcccacggggagcgggcgaggggctgcgggagagggaggactgggtgacgtagccgagggagggagcgtcggccaatgggatgccgatgcgcccctctgggcccgcccctccctcatggtctgttttgctttggagtcccagtggcctgagctcctggtggatggagaacgtgactacactggctggggtagcaggtccctctcgtctgtttccttcgttgtttgccttct

SEQ ID NO: 32692 - DNA, 36 bp, Homo sapiens
  chr9:126872665-126872701
  hyper
caccccccttgatctcggagacgtctgagaacgtca

SEQ ID NO: 32693 - DNA, 352 bp, Homo sapiens
  chr9:127212654-127213006
  hyper
aggggcggggtctcccgggccgaggggcgggatctcctggtatctgccagagcccgccgctgcctccccgacttcagtccccgcagatgcctcgcagacggtgaacggccacaggcgccaggccagccatagcgggtgaggaactggagctgggaacaggggagggaccagcggatgaaggggaggcccctgactcaggcccattggcgcctcgcggaggagggacgcgcagtggtgggcaaacttcgcatctccctctcgggcctcaacgagtgtttggagagcaagaaaagtgggcgccagggggcttgagggcgcgaatccaggcagacgtgaacgagggagtgctttt

SEQ ID NO: 32694 - DNA, 64 bp, Homo sapiens
  chr9:127215890-127215954
  hyper
cccgggcgccctggacgtcacgccctcgctgctgcccactgtgtgggtgcgccttctctgtccc

SEQ ID NO: 32695 - DNA, 172 bp, Homo sapiens
  chr9:127239776-127239948
  hyper
tctccacccattgcgcggatgaggaagttgaggcacagaaaggcgcagccgctagccagagcccgcacagagccagagccaggtccccactggcgcagatgggggactgcaggcacagcagtagccacgcgggtgtaaacgtagagccgcgtgaacccgggttgtgggatcc

SEQ ID NO: 32696 - DNA, 216 bp, Homo sapiens
  chr9:127265875-127266091
  hyper
cggccttcccctgccaggccccacgctcccgccccgtccggggggctcctcccgcgcggaccccgtcgcgcccgatctggggccctcgggttcgatgcgcttcgattgggattcgtttgtctgagaacaaaaccccgattctgagaaaaagagatgggctcagccgcggggaagacgccaggggacccaggagcgctggggcgcccggcccgggtg

SEQ ID NO: 32697 - DNA, 257 bp, Homo sapiens
  chr9:127266331-127266588
  hyper
gagagagagagagagagagagaaacgaggggtgggggattggatcagagactcggagagacagcggaggcccgaagagaaaacccaagagagactgacgcagagccagagacacaacgatagacgacagacagagacgccgagacgagaggagccccggagagacgaggccggggagctacagaaacacggagagaaaacctggaggcggaagcgcccagcccgagggtcggggacaggggacgcgcggaaacctgc

SEQ ID NO: 32698 - DNA, 219 bp, Homo sapiens; identical to SEQ ID NO: 10058
  chr9:127266628-127266847
  hyper

SEQ ID NO: 32699 - DNA, 201 bp, Homo sapiens
  chr9:127266865-127267066
  hyper
cggagaggcgaagtccggaggagggaagcgcgaagagccagggcccgggacgcgagagggggcgcgacggcggctgcggtcggcccggcgcccacctggtcgctcctgcgagcagcgccccgcgtcccgcccgcgcggagcccgcacctctcggccgcgccgccgccgccggcgaggagccgcacccgggcgcagcgccgc

SEQ ID NO: 32700 - DNA, 158 bp, Homo sapiens
  chr9:127267338-127267496
  hyper
tcctccccccaagcccggcccgcgccggcaccctctccgcagtccagctcgagtcttcgccctcatcctccaggccccccagccgcagcccggctccccggaccccgagcgcggccagagagctgcggagcccgagtgccccgcgatctgggcaggta

SEQ ID NO: 32701 - DNA, 59 bp, Homo sapiens
  chr9:127421470-127421529
  hyper
acatggacaaaggcacgagccaaaaccagacagtcctggccgttcgataggccagcagt

SEQ ID NO: 32702 - DNA, 488 bp, Homo sapiens
  chr9:128651926-128652414
  hyper
taaacccaaagagcccgcacatgacacggaggctgctccatttacattaattatgcagtcagggcggtgagaattcgctgtcagccagcagggcgggggcgcgccgcggcggggagcggggccgggccgcggggcctcccggcgcgaacgcgggagggggagccggatcgccgtccgccgctccgcggctccgcgctgcgagaacaatgggcgcgcccgacgcccgcccgcgctcgcgctgcccggcgcgccccgaaagccgcggggcagagcgccctgagcggtcccccgcgccggcggccccggctgcgccccgctgtagcagctgaccttagccggctgcggccgagagaacgcgcgttgcccgccgaccttgtgccctggggtcagcacccactgcaagtcagaacctctccgtggtcccaaagttagtgcttttccaatccaaaccagaaacttgatttgaggcctggcgatggtagaggatg

SEQ ID NO: 32703 - DNA, 169 bp, Homo sapiens
  chr9:128984848-128985017
  hyper
aggagattccagtgccgccgcagggcccagaaggggtgtaggaggcgtggccgcagccccaccctagaccccagggccgggcaggaagatgcgtctgcgcgtgcgggcaggtgtagggggcgaggaggtggggagcggtaggaaggggaagcagcgaggggagaggctg

SEQ ID NO: 32704 - DNA, 308 bp, Homo sapiens
  chr9:129276624-129276932
  hyper
ctccgcccccaaacacgggttctcacgcggtccggccgcgcgggggcgcccggctccccggccctcgctgggccctgcgggaacgccccggccgcgcactggggatgctcggaccccagcacacacgaggcggagctccgcggactggaggcaaatcaatccctcggcaccgcgctacggacgtgtgtttggaaggaggctagcccgccgcgcaagtccccgcagcgccccgccggcctcccaccccctgcggcgtccggacctcgtggacctggggtggctcccatagactgcggggccgggcccag

SEQ ID NO: 32705 - DNA, 316 bp, Homo sapiens
  chr9:129372722-129373038
  hyper
ggcagctcatagagccgtgctcgagggaggcgggtagcgcagaggagagggtgcaaggccctaagaagaggagcggggggactagggcggggctcaatggagctggggcgtccgcagactggaaggagccgggacccccgctccagagcctccctttccattctcgcttcttccagtgattccgagcccccgactcagtctttcccccaggtagagagaatccgaggctgtttctgccgctgaaatctgagcgggagagcatcccgaagccgcctgcgtggagcgagcagcccccgcgtcatgggccagaggcgcc

SEQ ID NO: 32706 - DNA, 51 bp, Homo sapiens
  chr9:129373250-129373301
  hyper
cgaaggacccgagaccggccaactcagctgggagcacgggacacgaggagt

SEQ ID NO: 32707 - DNA, 30 bp, Homo sapiens
  chr9:129374814-129374844
  hyper
tctgaccaagcctcccgcaggttccaaatc

SEQ ID NO: 32708 - DNA, 256 bp, Homo sapiens
  chr9:129375725-129375981
  hyper
acctcggccgacagtcgggggttcccaagcggccactcccggccggcgccgtcccctggcggagccgccgcgctccctgccgtccgcgcagtctggcctcgctcggggccactcctcgtagcgctggagctttacaaaatattaataataaagaaggcagaggagaaaaaagaaagccttcgctccccaactcccaaatcaatttttcaagggggtggagcagagggatttgtttcgaagacgatcaaaacttctg

SEQ ID NO: 32709 - DNA, 131 bp, Homo sapiens
  chr9:129376187-129376318
  hyper
cccgtatccctccgccgccagccccagctctaaacccggcggctcagcgggcgcaccatggcactggagtagcgcggggagcgcgcccggagccccgcggcccgctgcgccccgcccgggaccccgctgcg

SEQ ID NO: 32710 - DNA, 131 bp, Homo sapiens
  chr9:129376549-129376680
  hyper
cacgacgccggggcccggggccagcgcgtcgccgctccacgatcgccgggggccggcgcaacccctgccctgcgggggccgcgcctccccggttccagggccgcggcggcggagagcgggtggacgggccg

SEQ ID NO: 32711 - DNA, 248 bp, Homo sapiens
  chr9:129377104-129377352
  hyper
ctagagctgccactccgatgtggtaggtggcgggtggcaggggtgatggaggacctagcaatcaccttggcgagcttgggagaggcgcaaggtcacctggggtgggggagattctaagagaaaaacgtctccctggtcactcaaaccacagattttggggagatcggggatagaagaccacgaacgccaccgtggggcgtgtcagccagcgagcgccccagcctcacctcgcctgtcttggtcccagc

SEQ ID NO: 32712 - DNA, 44 bp, Homo sapiens; identical to SEQ ID NO: 10066
  chr9:129377592-129377636
  hyper

SEQ ID NO: 32713 - DNA, 188 bp, Homo sapiens; identical to SEQ ID NO: 10067
  chr9:129377772-129377960
  hyper

SEQ ID NO: 32714 - DNA, 30 bp, Homo sapiens
  chr9:129380664-129380694
  hyper
tggggcacattgagccgaatttgataaaaa

SEQ ID NO: 32715 - DNA, 137 bp, Homo sapiens
  chr9:129386060-129386197
  hyper
gccagccctggccagcggaagaaaaaggttagaataattgccttcccctgggcgggagagcttccttcgacgtccggacacgcggatggggcggctttcagcggcctccacccgcgcacccctccaggcccacctct

SEQ ID NO: 32716 - DNA, 193 bp, Homo sapiens
  chr9:129386429-129386622
  hyper
cgcgctaggctgaagcccggagtccagggccctgcagcagctttcgggcttctcagcgtttcggggacccttggtggctcgggggctctcttgggctggggtcggggtgccccgccaggtggggccttacgcggtccagaaagagccagtgattctccttggagccactgcaggctcccgctggagggagtaa

SEQ ID NO: 32717 - DNA, 474 bp, Homo sapiens
  chr9:129387847-129388321
  hyper
cgcactcctgcaggtctccagggttggccattcccggctgcatgctcggcccctttcttccgagggtgaattcctttgttccacccccacggaaaccctcttctccgccaggcccgtggcgcctttctcgccacctccgccgccgccgccgccaccctcgtcccaccgtttgcagggctttcctgcggcgctctggccgcagagacccagccctgtctgccgactggcccttcgacgtcgccgccgtgcctgagccccgctgcctgctcggacaagcagaactccggcaggcgcagcgggcgccgaggcttgggctttagccgtggcgctcgcctcggcgcagtggggagccgcgggcgtcggagaagcggccgcgctgttccgggtcactgcaccggctgaaaaaaccaaaagcaaaaccaacacccagaaacgaagcctgcgtgcccccgggggctccgttttgctcccctc

SEQ ID NO: 32718 - DNA, 352 bp, Homo sapiens
  chr9:129388892-129389244
  hyper
agagactttctccctcgaaacacttgataccaactttgtttttttggcaagaaaaataagccttgtttggaaaggggtgggtggggggcgtcgagcgagcgagggaaggagcaaggaggcggcggcggagcaaactctgcggattaggtttcagcgcctccgccccacccccagccccgcggcggtgatttgtgtgcgggggtctgtgaccctgcaagcatcaaacggcccgcgggaaccggccgagttcagagggacagtgggccgaagggcggcctaagacaacgcagatggttcctatcagcccggccgggcccgcagcgtccgccggtccgtccgggctcctctgcag

SEQ ID NO: 32719 - DNA, 347 bp, Homo sapiens
  chr9:129400848-129401195
  hyper
agtgattgccaggcccgcttggcagtttttaatcattttatctctgttctcggctctcgggggagacagccagtgcttagcagtctgctcagaaagacctcggggcgcgtggcgcagcggcggctcggagctcccattattagctgtgctcttcggagcgcgctccgatctctcccgggggagccggtgaaaaattaacacgggccggcggcgcgggcgcccgatgtaactgtaattactccattgatattcctcacacaatagcgctgtcatcagtcatttacataaactttctctccccaggacgggcggaggtgcctaatcctattgggcgcttccactgcatg

SEQ ID NO: 32720 - DNA, 93 bp, Homo sapiens
  chr9:129414430-129414523
  hyper
gattgaaacccaaaccggaggagctgcctgtcacggtgcctgtgatcctgtgatccgaggcatgattgagagggggcgcggcaggagggggct

SEQ ID NO: 32721 - DNA, 640 bp, Homo sapiens
  chr9:129445255-129445895
  hyper
cctgggatggctccccgggctcccggctgtgcccgtccctccctgtccctggcccgtgacctccagccccggctgggggctcccgacagcgcccctggcgcggatcaaagggccgaggggccggcggccccgcacagctgcgggccgcaggaagcgcaggggcagccctcgctgcaggcccggccccgacgcggcgaggaggccgggggaggccgggaggctgggagaggccccgcgaggcccgcagagcgcgcccgtctcgccgcgcattccagccgcgtgattgacgcgcgtaccggggcccccgcccgcggctcccgccgccgcccgcccggcccgcggccgccgcatcaaagcagatgtttgcagctggtttgagttggatccccatcaacaggcccttttttgtctcaaaataaaaaacagctacgcccggaatgataaggacgcggcaggcacgtgggggagatgtcagcgagtccggcagggaggaggccgggcggctccctctctaagtgacaggctgactctagcagcagcagccgtgacccccagagtgtctagggtcctgtcgcctagctcctgtgaactgcagctcatccttcagccggcatcatcagagccccgtcccgcccacaac

SEQ ID NO: 32722 - DNA, 92 bp, Homo sapiens
  chr9:129485680-129485772
  hyper
agagccgcctgacaccgtgatatccgcctggctcgctgcgctccgggtgatggatggggcggagctccccaccccccagccccggaacctgg

SEQ ID NO: 32723 - DNA, 245 bp, Homo sapiens
  chr9:130461686-130461931
  hyper
gggactgggcttggggaggccgggcttccggggctagtaagcgtctactagccgggctgtttagggattggtcgcctctggccctggaggcgggggttcctggagtaagacggttgctgattggctggctttccgaggcggggttgtgaagcgttggtcattctatctgggtgctgggttaggcagtacgaatactaaaattggaaccagtgacacgcagattggtgaagcgttccatatttttt

SEQ ID NO: 32724 - DNA, 30 bp, Homo sapiens
  chr9:130689420-130689450
  hyper
aggccactcacctctcggagatgcggccgg

SEQ ID NO: 32725 - DNA, 115 bp, Homo sapiens
  chr9:131127226-131127341
  hyper
gccggcccctccccccgaggagggggccctgcttcctcccggcctaatgatattctgggctcagccctcgtctttggcggcagtttaacccgagccggggcggatttctttctca

SEQ ID NO: 32726 - DNA, 193 bp, Homo sapiens
  chr9:131159439-131159632
  hyper
ggagttaggtgaaggcgggcactgtcccaggcggagggaacagcgtgctctaaagaagtacttggcgagctcagagaaggaaggaaatttggtgtggctggagcgcagtgaggaaggggaagttccacataaagctgaggtcgaccttgccaggctcttaggctattgggaggatttgcgattatatcctaaa

SEQ ID NO: 32727 - DNA, 345 bp, Homo sapiens
  chr9:131872500-131872845
  hyper
ggtgctaactgaagccggggtcccccttgtctttcctgggtcgttggaactgaatgctccaggacgtgggtttaatcccgcttctgaccttgcgccccaatctcctgctctgccaaacctgggacgcccgcctgaccccaccccatcagctggaggccgggtcgaacagcggccgcaggacgcggtctccgttcccggacgcaaccgcacggcccgcccaggccgtccagggccctcaggcccgggatccgccgcactcaccacggtcctggcagcgaaggctaacatcttcgctgcccgtccgcggacacgcagtccgctccgccccacacaccgggcaaagtc

SEQ ID NO: 32728 - DNA, 64 bp, Homo sapiens
  chr9:131872856-131872920
  hyper
cgccgcggctggggtcggtgggtccttgctagagccttcgggccaaggtcgctgagttacagcc

SEQ ID NO: 32729 - DNA, 164 bp, Homo sapiens
  chr9:132020946-132021110
  hyper
agcgagacaaaggaccgggggaggcggggaacgaagccgggcggaggggtccgcgtggcccgggcggggatgggccccgcgcttctcctgcgagcagggcaccccctcttcctttttattttgaaggaaagggaaaaaaggaattgctacggaaagagaggtgg

SEQ ID NO: 32730 - DNA, 95 bp, Homo sapiens
  chr9:132382260-132382355
  hyper
gtggggtggtgggtgcggggacacaagggaccaccccccaccggaaatgactcgggcccgccccccgggccccgcggggcctcactcagtggctc

SEQ ID NO: 32731 - DNA, 383 bp, Homo sapiens
  chr9:132382634-132383017
  hyper
gacgcccaccccgggcttggcgtccccttccggccaccacgcggcgccgccccccgggatcctccagtccccggagccccgcgcgcccagagccgctcggagcgcgggcggggtcagcttgggcagccgcgggtcgctgctgcgtcggaagtctccgtcgccagggagccccttgggcgccaggtcctgggcccctgggcgaagtcgacgccagaacatgcttggccccgcactcagctcaccgcaccctcagcgcgcgtgggtggggggcgccggctgaggtggggagggcatagtccagccccaggccatagtgccccgggcggggcagcgcggtgcggggtgaacgccaccggcccggcggacagcgagtggcttcaggc

SEQ ID NO: 32732 - DNA, 71 bp, Homo sapiens
  chr9:132428052-132428123
  hyper
ggcggccggggctctcgctccgacccgcgcccgcgacccttcctgggacccgagcccgagacccccgccgg

SEQ ID NO: 32733 - DNA, 256 bp, Homo sapiens
  chr9:132428401-132428657
  hyper
gatggtgagtacggccggccagggacgggggtggcggggccggggccggggccggggccggggcgcggggtccggggagccggcgcggggcgggcgaagatgcagggcgcgtggtcggcggcaggacttctgggggcgcgtgtaagtgacggtggacggcggttgaccagcactctgggctgggggagggggaccctcttcgggtcttggggtgcgtccccacggggaagtgcgctgccttcgctccccagtattc

SEQ ID NO: 32734 - DNA, 30 bp, Homo sapiens
  chr9:132459828-132459858
  hyper
tggcgcgcacatggccgggctgggcggcgg

SEQ ID NO: 32735 - DNA, 30 bp, Homo sapiens
  chr9:132805863-132805893
  hyper
cgagcagagtcagcccgggaggctcttttc

SEQ ID NO: 32736 - DNA, 174 bp, Homo sapiens
  chr9:133308867-133309041
  hyper
ggcgtccccgccaaccgcaccgagctcagcatgctggagcccgacccccgcagccccttcgcgctgcgtccgctgcgcgcgggccttggcgcggtctacacccgtcgcgcgctcacccgcgccggcctctaccggctcaccgtgcgtgctgcggcaccgcgccaccaaagcgtc

SEQ ID NO: 32737 - DNA, 112 bp, Homo sapiens
  chr9:133320662-133320774
  hyper
gttatttgttccctgcgcagccgggtcctttctggactccttgtcggatccggcttcctctgtgtcgtgaagcccccacatggagacctggggagtccggagcgtgtggggg

SEQ ID NO: 32738 - DNA, 390 bp, Homo sapiens
  chr9:133534580-133534970
  hyper
cgagtctttgtacccctgcgtctccgactcggcctttcatctgctccctccacctcggcatcgccttgcctcagtctcccccgacccctgtctcgccccctctgcttccagaagcctgcgcctctgtctctcccaccgcccggtctcctggtgtccccggcgtctctcccgtcgttcccgccgccttgatcagcctgggctgtggcgctggcatcgctggcctggggaccggggtgtgggcgatggaagggggttcgagaggcgcaggggaggggcttcccctcctccgcccctgggcgcctggggagactcgcgtgccagtcacctgccggtcggggcgccgacttcgcgcctacgcactccacgtgggcgccccggggcgcgcctttg

SEQ ID NO: 32739 - DNA, 189 bp, Homo sapiens
  chr9:133535296-133535485
  hyper
aaagccagagagagacgtgcgaggaggaagcggagagggtgtgcgaagctggagagggagtcggagcgccagcgaaagaggggagcgctggggaaggaggaagagaaggagagggggagaagagagacgcggatgctgggcgcgcgacggcagcgggcggaggaggggagcggccgggaacctgcgcgc

SEQ ID NO: 32740 - DNA, 200 bp, Homo sapiens
  chr9:133535734-133535934
  hyper
cgcgggacctgcccccgccgctaatatctttttaatgagttcgccaggcttaaagcgagcgcgatctgccctccagggtggattttcccccggcagatgtttcgggaggaggaggcgcgcggagctcccgggaggggggacaaatctctccctccgaggggcgagaacaggagactttcttctaaagttcaaaagaaaga

SEQ ID NO: 32741 - DNA, 149 bp, Homo sapiens; identical to SEQ ID NO: 3472
  chr9:133535971-133536120
  hyper

SEQ ID NO: 32742 - DNA, 196 bp, Homo sapiens; identical to SEQ ID NO: 3473
  chr9:133536149-133536345
  hyper

SEQ ID NO: 32743 - DNA, 184 bp, Homo sapiens
  chr9:133536346-133536530
  hyper
gcgctccgccctgagcggggcaacaactagaaattagccaaccccgggcggctgccgggccctgagactgtcttgcccgccccggcccagccacccctccgggtcgcccctgctcttctcctccacttccccttcaatgtccctccgtggggccgtcggcctgccgcggcggccctctctccac

SEQ ID NO: 32744 - DNA, 607 bp, Homo sapiens
  chr9:133536777-133537384
  hyper
tcaagtcctacgagccgcccacaatggaccgatatactgagggcctctctattaacgcccatgaatattaaagagatcgccaagtggcggccagcgggcgaggggggcgacggagcctgagagctccggcccggccgaggggagggggcttttgcgcgagcacattccgcgcctgggccccgcggaaaatgacaaaataacacgggtcatccgctgggaaagcccggaatgtttcccctcgaaatctcctcccggggagatgtgagcacagggtcttgctccctatttcaatgcaccttgagactgggcgctacctacgggctcctttttccccgggcgggggtccaggtgggttttgccgctagactagaagcacaaaatgtgagcgcggtggagatttgggcgcaccagctgggaggacgttctgcgctccgcttctgcccggctcccagtactgctctccgggcttgcgggtccggaggagaggaatgggactccctggccgcagtccgagcccgtggtcactgcgccagcggaatccaagcctctaactctaagccggggttcaggacccaaacgctgcaccccagcacggaggatgcacaga

SEQ ID NO: 32745 - DNA, 1620 bp, Homo sapiens
  chr9:133537600-133539220
  hyper
tggaggaactgaggtcgctttcggggcttgggagctgccgcagcgcttggctcctggcagcgctccccgacgtcgtctccctcgctcctagcactttgtcctctccacctaggtcttcccagaagccaagaagtaggccccggtgaggctcccctgcaggagccatcggactccatacgccccctcagactcgagctctggccagggagccgatgcgacccacaagctgcgtcgaaaaatgagtggagggttcggcgaccctaacccacctccctcctcagcagcgctgccctctgctggcgccctgcccaacggtcctgccttctgccaggtgtgcccttccttgggctccagcctcgggcggacccggacgcagggtctgaaggccagctaccgccgccttcctccctttgcgtcccaacggggacgggggatgccggagactactggcaggaactggggaccaggggtctggagtctggacgccaggtgtgagaccctcttagccaaggcgcgtccgggtggtggaggggcgtctatgccaacaggcgtttggacagggtctcgctcatgggaggtcagctcgctgttcttccacccaagtcctccgcgctgaggagaaggtctagggagtccacacagtccagcggagactaatccgtgagcctgacccacgccgagagggtccaggcacctctgttagcggcatctgaaattgtaggctggtgatgggagccagaagtgcggcaggtggggtgagctccctcacccagcatgtcagggcctggggtccgaggcttgaggctgacactggggagccgcgaagcctgcaggaagcggggccttccgctgggctcagcagctacctgcttcgggagaggggatcgctgggctccgaggtgcctcgaaaccgccgcaaagcaagtctgctcctgggatgatgggcaggaggaatagaggagaggaagggaaagaagagagaggcagaggagaaagaaagaactaggaggcaagaaggaaggggcgccgcaacgccaccggcttcccgaggttgcagctcagcaaggagccggaaagccgggccgcaagccgaacccgcactgaggcctctcgcggagctgcctgcagtttctgagggacttcgctctcaggcacgcctgctcccacctaggaagggtctcgggacccctttcaatccccctatatcccgtaggaaattcttttcccagagacaggctgccagggcgattcctgtccgcccatctcgacccccgacctggccccgcaagggccgggagcctggccttccatgaagctgtctcaggccgggaccagccccagccccgacggccgctgcggccccgcctcggcagccccgtgagcccgcggaggagtttcgcacccgaccgtgcacagcgaccgagttggcgcggcccgtatgaagcgaagcgccggcttcagcagcgcagtctgagcaggggatccgcgtggcaactagggctgcgcgcgagctcggggcgactgtggcggcccggggagtgcagggccggagagggaagaggacgcgggctctggccggggagggagagcggtgcagggctgggccggccagccggggca

SEQ ID NO: 32746 - DNA, 553 bp, Homo sapiens
  chr9:133539679-133540232
  hyper
cgagaggctagcgcgcgcctgagccccttgctgccgcttccctgcaaccacccgcctctcacccaccctgcaccccccgcacccgcctccgcctccacccgcgtctctccaccctccgcgccgcctttgccatctctacagatttcaccatctctcttcccctctccccctcgttcgctttcctcccagtcgccccctcacctcccgctccctcctgcgtcctcctcctctccgtcctccccctgctctggttccttctccatcgcagcgctctcctctcgccccttgggctcccctctcgcccgcccacctcccccgtcggcccggccgtcccccggcgccggggagctccgggccgcccatgatgggctccgtgctcccggctgaggccctggtgctcaagaccgggctgaaggcgccgggactggcgctggccgaggttatcacctccgacatcctgcacagcttcctgtacggccgctggcgcaacgtgctcggggagcagctcttcgaggacaagagccaccacgccagccccaagacagccttcacc

SEQ ID NO: 32747 - DNA, 37 bp, Homo sapiens; identical to SEQ ID NO: 10093
  chr9:133540453-133540490
  hyper

SEQ ID NO: 32748 - DNA, 386 bp, Homo sapiens
  chr9:133541079-133541465
  hyper
ggagccgaatgaatgcgatcactttaacagcgtgacaaattgcccgccgcgccgcaatggacaccgtttaacccccccctttcagccggcccgctcgccgggtattttcccaggtagcttagaggggaaccttgtaagacatggaggccgcccttgtgcgcctcgccgcttccagccctgccgcagatgcccgacaggggaaccctcggggagctgggggccgccgcggctcctccccgcccagagagatgacatcggggtttgtctgagcccgggcgccgccctccctggcaccccagggcctgggagcagagagggactcgggcgcgcccggggtcacacagcgagcgcagagcctggccagctgctgccggtgcttctttggc

SEQ ID NO: 32749 - DNA, 757 bp, Homo sapiens
  chr9:133541665-133542422
  hyper
attcttaaacttatccggggcagaggatggaagaagttgcgaatgctttgagaattcgcggagagactaaaaacccacttctaaaaatgatccccaacgcaccactcgctttccagggcacggagggtctccaggttgcaaacagaggagaggtcgttgagcctccgcacatccgacttcctccacacccgggtggcttctctggatttggggccgacttgggtttggctggtctgggcaggaccgaagccggggtcccggcggggaaggaagggccgggcctcggctgcctcgggctctgaccggttttcctggccccgccgccgcagaagtgcagaagctgtccagcctggtgctgcctgcggaggtgatcatcgctcagagctccatccctggcgagggcctcggcatcttctccaagacgtggatcaaggcgggaaccgagatgggccccttcaccggccgcgtgatcgccccggagcacgtggacatctgcaagaacaacaacctcatgtgggaggtacgcgcgggctggggcagaggggcgcaagggccggcgaggggcgctggtcgcgggtaggactcgggcgtccggccgtcgccgcttccacccgggctgagagcggcggacactcctggcctggacgccccctgagccgggactctaagccgcccgagcctggagctcaccccgcctctaggctcctcccaacccgtgccgaaaatccgaccctccttcccccggacaccctggcag

SEQ ID NO: 32750 - DNA, 42 bp, Homo sapiens
  chr9:133884491-133884533
  hyper
ccagcctccccgccccgcaggggaaggcgggtcctggcggcc

SEQ ID NO: 32751 - DNA, 30 bp, Homo sapiens
  chr9:133884902-133884932
  hyper
cctggtggcagagcccgtccatggccttcg

SEQ ID NO: 32752 - DNA, 546 bp, Homo sapiens
  chr9:134151976-134152522
  hyper
tgacttcctgccctccggccttccgcacgcgctccctccgggccccgcacccgcacccgcccggcgcggtcgaatcaattgcagagcagtttgtgttcacccggccgaggtcccggcgccctcggggcgagcgccgacccgcggcttccaggaggcgagctcagggctccggccgctcgccggtgacgggggagcgcggcgcgggtccccgtcggcgcccactcgcgggcgcgggccggacgtccccacgcaggggcgccgcgtcccttcgccgctgtcgctgccggccgccgtgcagggtcccggggctgcgctccggccgccgccgcctgcttcgccgcggccgccgaggacctggtgggaggtggaagggacagcgcgtcaaggccagcctcaaagttaagccgaactttgctgcggggggcgcgcgggggcggcgacgcgtgtgcgctgggcgcgggctgcggagctgacggcgcagctctgggcggtctccccggaggcggtggcccccgccccccgcgcccgccccgtcagtggcggccg

SEQ ID NO: 32753 - DNA, 225 bp, Homo sapiens
  chr9:134158243-134158468
  hyper
gcccaacgccggcaccgcggagctgcagcgcgctcagcaccgccccgcccaccccgacgccgcccctctgcacccgctcaccaccagtcccacccagcagcctccgtccgagaggtcagaagcccacgagcaggagatgccagtggggggacgcgggcaaccccggccgggccaggggcgcgccgcccaccaacacgccccgcggtcccccgccccccgccgccg

SEQ ID NO: 32754 - DNA, 32 bp, Homo sapiens
  chr9:134421906-134421938
  hyper
cccctcatcccccagcgcgactgatcttgaga

SEQ ID NO: 32755 - DNA, 84 bp, Homo sapiens
  chr9:135036830-135036914
  hyper
ctgggcgcagggacccgctggcccccgggccgggaggcgatgtttaggcagcgaccccccagaggctgccggggccaccctggc

SEQ ID NO: 32756 - DNA, 154 bp, Homo sapiens
  chr9:135037134-135037288
  hyper
ggcattaacttggagcggagtgcaggggggcagtgaagcgcccgccatctggcccgcgccgcgccggggggatgccccggctccccgacgagacgccgcgaagcccacccgggccgggggctgcccggcgcccgagcgcgggtcctccccgggc

SEQ ID NO: 32757 - DNA, 15 bp, Homo sapiens
  chr9:135037333-135037348
  hyper
cgctcagcccgggcg

SEQ ID NO: 32758 - DNA, 111 bp, Homo sapiens
  chr9:135038352-135038463
  hyper
cgctccggagtaagttggccgtctgggctgggggcggcggcggccgggtcgccacaggcggcagcgccggggcaaaggatacagccagttcctgggcgccctgctctgtgt

SEQ ID NO: 32759 - DNA, 153 bp, Homo sapiens
  chr9:135116312-135116465
  hyper
gataggctccgtgcacgaccggtgcaacgagaccggcttctgcgagtgccgcgagggcgcggcgggccccaagtgcgacgactgcctccccacgcactactggcgccagggctgctaccgtgagtgcgcgccgtcccccgtgggcggggcctg

SEQ ID NO: 32760 - DNA, 30 bp, Homo sapiens
  chr9:135118020-135118050
  hyper
gaggcccggtgaccacggaactcaccgtct

SEQ ID NO: 32761 - DNA, 47 bp, Homo sapiens
  chr9:135285476-135285523
  hyper
aggggccggcgcgagcggggcgcgcctggctccggaggggtcctggc

SEQ ID NO: 32762 - DNA, 134 bp, Homo sapiens
  chr9:135285731-135285865
  hyper
tcagccaggtctgcccgcccccgcggcggcccctgaccgtggcggacatccgttccggcatggagaacgagcggctgggggtcgtgcgggactccatgtttcagaaccctctcatcgtcaaggtgagcacccca

SEQ ID NO: 32763 - DNA, 169 bp, Homo sapiens; identical to SEQ ID NO: 10098
  chr9:135285880-135286049
  hyper

SEQ ID NO: 32764 - DNA, 41 bp, Homo sapiens
  chr9:135286274-135286315
  hyper
tgcacgcctggggtacgtctatgcagcggtggctccgtgtc

SEQ ID NO: 32765 - DNA, 30 bp, Homo sapiens
  chr9:135287745-135287775
  hyper
ccttcgtgggttcttcggggtctttaaggt

SEQ ID NO: 32766 - DNA, 253 bp, Homo sapiens
  chr9:135454991-135455244
  hyper
tgggaatcccgaaatcggaataaaacgatgttattgagagagggctaaatcccagagtaaatttcaaacgaaataaatcgcacagcacattttagatgataatagacggcggtaactcaatactaatgatagtgtactgacaacccgctaatagtcttgggctccaagaagcccggcaaaaccggctggggcggcaggaggtccggctttggtgttctttcccaccgggagaggttggagccaccctcactcc

SEQ ID NO: 32767 - DNA, 737 bp, Homo sapiens
  chr9:135455287-135456024
  hyper
cgctttcgctgggtccgggatccaaatcccaacccaagagccaaaggccagaaaaggccctggcgttgccagctgcttgtcgccctggggaggggcggctccggacccgcccggggcagaggaggacagagcggacgctctggggaccaggcggtcccgcgcatgcttggccaggggcatcgccgtggctaacaggggggttgtgtggtggcgggggctcgccgtcgatctaagtgaggatctcggtgctccgaggaagatgagattcctcaggggatgcgggcgcaggcctgggaggagtgggtgatggggagggaagtggggtctccagagacgcccagagcaggagcaaggccaggctggggactggactggaagagccagggcagccggctctcctcgtgatttatgggcccctcctcatccaccaaactgaaatgagctgccggcccggaccgccgcgggaggtgcccactgcagtggccgccgccgatccagagcctgggcccccgccctcccgcctccccgacagcttgcagccgagccgggccactgtcccccgggagccgcccgtcctcacccccagcccggccggcggcggggccgcttccaatctgccggcgggcacagggggagagcgccgggagccgggcgcggggccaccgccgacctagcccgagggaggagaaagtttttgctcctcccgaccacgccaggctgcccccgggagaattctg

SEQ ID NO: 32768 - DNA, 126 bp, Homo sapiens
  chr9:135456079-135456205
  hyper
cgacgtaggagccggggtagtttcctgggggctgggggtggtggcaggggcgtgcaggccgggctggaaaggcctggcttcccgagcctgcggggggtaaaaggacgcctctgacccgcccgacct

SEQ ID NO: 32769 - DNA, 140 bp, Homo sapiens
  chr9:135456234-135456374
  hyper
cgccctttccgccgcagacccgggttgcgatccctggggctgtgcagagaggatccaggcccgggacacagttcggatctgcccgcggtcctgggccccaacgccgggggctgaccctagaaaggcgctggactggagcc

SEQ ID NO: 32770 - DNA, 139 bp, Homo sapiens
  chr9:135456760-135456899
  hyper
ggctttccccactcccgccaggcccacagggtcccaagaggccagagagacaggactgcaaattgtcctacatgggaaacaccgagagcccaacagaaatgccgcaaacaacataacttgaattttcttccccacacta

SEQ ID NO: 32771 - DNA, 738 bp, Homo sapiens
  chr9:135456959-135457697
  hyper
cacacacacaccacacttcttcctccgctggttttagtccctttctgctgctggaggaagaaaaacgggggaaggaaaaaggatctacaatagacctgccgacgaataatttgaataactgtgggaaagggtcggggaacgctaaaaaaaaaaaaaaaaagcccagcgcacatcccagcccaccgcagcgcagtcggctcggccccctcccctccagccgtaccccccttggctaatcaccctcattaggagcttcgtcaccggcctaatgaaagcaaaccgtgtggaaatcgccggtaaacagttgggtctgtgctgtaattaattcggtgtctcttttaatcaaactgaaagggaatcgggcagcggcttgcggagccgtgacatcacccccaaaatcggccagagccaatcagcgtcatcactccggggacacgtgggcgagtccccttaaaaaaacacacacaacacaacgaaaaaaaagaaacaacaaaaaaaaacccagacccaaagtaaaagtgacacaagttcattttttaaaggaagggggggaggagaaggcgcgcgcggaccggcagagagctgccgccgaggagcagggaggcgctgtccacggtgctgacgggcccccggagcggcgagggcgcggagagaggacctccccggccaggtggagagtcatgagccgcgggcagccgccgccgctctccgcggtgctgatgccgccaggtgcgctcc

SEQ ID NO: 32772 - DNA, 102 bp, Homo sapiens
  chr9:135457946-135458048
  hyper
ctcggctcggcggctcggcgcgatgctgcagaagacgcactgagcccttttggatctaatgcgcagaggaggttggcccagagctcccgggctcccccaagg

SEQ ID NO: 32773 - DNA, 32 bp, Homo sapiens
  chr9:135458408-135458440
  hyper
ctcccacctgcagcccgggcagctctcagccc

SEQ ID NO: 32774 - DNA, 191 bp, Homo sapiens
  chr9:135458456-135458647
  hyper
cgtcacctcctcctttctgatcagggacatccttgccgactgcaaaccactcgcggcctgtgcaccctactctagcagcgggcagccggcagcccctgagcctgggggccgccttgcggccaaggccgcggaggactttagagacaagctggacaaaagtggcagcaacgcctcatcggactctgagtata

SEQ ID NO: 32775 - DNA, 159 bp, Homo sapiens
  chr9:135460044-135460203
  hyper
ccccacacaaatggccgagcctccttcagccaggctgtgccgaccatgcctggaaagtaggcaggtttaacggagcggccaggaggagatccagaggcatgcgggtgtccccaggcccgggcccagtggtccttgctcctcccccggggggcctgctta

SEQ ID NO: 32776 - DNA, 30 bp, Homo sapiens
  chr9:135461292-135461322
  hyper
tgagatttggatgatcgtttcctcaaactt

SEQ ID NO: 32777 - DNA, 537 bp, Homo sapiens
  chr9:135461541-135462078
  hyper
tcagttgaaaagtctcgatccctaacggctcaattaaccggattattgtttcctacagagagaaatcaccttgcattcagctgaaccccgtcactgcaaacgccacgcacaatgaaactccaccataaaagaaaacagagaaaaaagggagtaggttgggggaaagccccagtctgagccgccaattttggggaagtggtctagctggttatataatcgctttagagggagaaggagggtgagcattgagcttgttcgattaagtgttttctgtgcagtcaaagccgaacgaaagtgtctgggataaagaaactacctgtgccaggtctatccttcgacctcaggagctgggcccccggtgtaattctgtcccgactgtggggtgtaaacacacgatgccacgcaggtgtagcaggagccatcgttagcgggcaatgtaatgacaacggaacgcagacctgggcaatgcgcgctgcgcccaaggggcaagcgagtggcagggtcgcttattctcccagtgctcggcgctcgcagacc

SEQ ID NO: 32778 - DNA, 301 bp, Homo sapiens
  chr9:135462647-135462948
  hyper
cgggcaggagcgggagggcaccggcggcggctgcgaggccgggccctgacatgccgctgtgtccgcagtgaaggaggagggcgaccgcgagatctccagctccagggacagtcccccggtgcgcctgaaaaagccacgcaaggcgcgcacggccttcaccgaccatcagctggcgcagctggagcgcagcttcgagcggcagaagtacctgagcgtgcaggaccgcatggagctcgccgcctcgctcaacctcaccgacacgcaggtcaagacctggtaccagaaccgcaggtgaggcctg

SEQ ID NO: 32779 - DNA, 175 bp, Homo sapiens
  chr9:135464001-135464176
  hyper
acagtgcgcagggctcgcagtgcgagccctggaggatggcaggtgcagcctgctccagccggcagggcgtgcgagccgggagcgggtcctctccggttgccatttcaggcctgctcgcttctgctagcttgcagcccggccagcctgcagaggaatcaatcgcattcccttccct

SEQ ID NO: 32780 - DNA, 189 bp, Homo sapiens
  chr9:135464750-135464939
  hyper
gcgctctacctgtaccgcggccccagcgcgccgccgcctgctctccagagacctctggtgccccgcatcctcatccacggactccagggcgccagcgagccgcccccgccgctgccccccctggccggcgtcctcccacgcgccgcgcagcctcggtgaggcgcccgtcggctccggggcctcctcccg

SEQ ID NO: 32781 - DNA, 834 bp, Homo sapiens
  chr9:135465231-135466065
  hyper
ccccaggagcgggtgcggctgattcccaggcttcgctctctcccacgccccttctacgctccaggtggagaacagcccctctccccgcgcccccgccagggagagaaggggagtgcggagccccgtctccctacccctcgagcacctgggccagcggctgagctgtacataccgtgtgcaaagtgtatatgaagttatttattcgtgacccatgagcccgtgaccgtgtccgtggattagtgagtctgtggcctgtgccctccccactcccaggcggggcaggaaggggccaagggggcttgcccacccaccccgaccccagcccccagcctcagccccggtccgggggcagccaggcctctcgggttctctcttttttaaatgtcgaaataaacttcttacaaatgaccaggcgcctgtccgcgctcgcgtcgctgggtccgcactcaacccctctcccatccctctcctggggactcggtttccttccatcctcaataacgaaacatttttgtcccccttctcttccccggtgctgtggacatgcgcgggggccccgacgggactcgctggggcccgggtctcccctccctggcctcagtcttcccatctctacagcgaggccagctcgttgttcccctcctcctcctctgtctccatctggttcctagcggctcccagacggtcccgagggccggggcgggggtccgtgccggaacaggcgggggtcagcgcggggcctcggtcggctgcgggccgggctgcggggccctcgccgagccgactcatctggccgcgacaagggccccggcagctggtgaccggcccgccggg

SEQ ID NO: 32782 - DNA, 488 bp, Homo sapiens
  chr9:135466117-135466605
  hyper
cgcccagcgtccggccgcgctcgggctcccgacgctcgcgggcgccaaggcggcccgggcctcccggcctcccgcaccaggcaggactccgcgcgccttcgctgcgaaccagacgccacatcgggtaaacccccactcccacatcttctcacctcccctttaccccgggaggaggttggaaatgagacccagaggggagccaaatcccagcgtctgccccatctcttctggctgccccagaccgcagctctagcatctcaggggagaggggtttaagtcccgagtcagactcgaggcttccagttcacgtccaaagggccacggtcacctgagactgctccctctctggggaggtgggcgcaggtgctcccttcccacacaccacctgcagctcgctaaccctcagcgctgggaagttttgggggccggcaagccgtggcccctctagtttgggggcagggtttctctgaagacgggggctgtgttca

SEQ ID NO: 32783 - DNA, 280 bp, Homo sapiens
  chr9:135645863-135646143
  hyper
caccctgtggaggagcgggctgggagcgcgggggatgcccctcgccctgcacgcgcgccctgcccctggctgtaacctgagcagcccgcgtgagggtcagtggtgacttccgggattgaattggctgggaagccggtcccatttcaacagagacctggggcagcgcggtgggcagcgggctgggccgagatcgagaccgggacaaggcagggaagagcgggatgggtcggccccttcaaggggagccctggggcgcagtgtggggcggtcttgctccctg

SEQ ID NO: 32784 - DNA, 456 bp, Homo sapiens
  chr9:136038991-136039447
  hyper
ccgccggccccagtccgtggtcgggacccgggaccctgggtccgagatgcgcacctcctgggctcagggccctcctccttggccccttgcgtggcagggactgggtggggccaagggagcgcgactgtccctacggggtgcagacttactccttgctgccggcccggcgttaggacggttggaggggcgccaccccggcgcggaaaacggactcagctggcctgggcccccgcgatacccgggcgatcggcggcgcaggtggagcctggagcagggcaggcagcggggccgcgggccagacagaaaagaggaagacagacaggaaagaggacagaaaagagaagccagacgggaaagagggcgccgcagccccgcccacctaccgcaggccccgcccctgcggtcccagagccccttccctgcggcctgggagcaggatcccgggggaccgagcgc

SEQ ID NO: 32785 - DNA, 55 bp, Homo sapiens
  chr9:136400112-136400167
  hyper
ggggtaggagcaccccgcgccctctggagccgttacataacgtggggaggcttgt

SEQ ID NO: 32786 - DNA, 131 bp, Homo sapiens
  chr9:136474260-136474391
  hyper
cgggcgtccgacccgggcagggcgcagctagcggcggccgctcatgcccaggccacggcggtggcgcctggtgtggctgggcgggcgaggcgggcgctgagaagcccgggaggcccccggggaggcgactg

SEQ ID NO: 32787 - DNA, 161 bp, Homo sapiens
  chr9:136474431-136474592
  hyper
cgcgactccggacgccccggctggctccctgcgagctgcacgcgcggctccagcctggtcccgagcgcagggcgcgcgctggcggggagggcgcgcgcccgagcctggcggggagcgcgcgtcaccggcccgcgcgcgcagtcgtcgggggatgccgggag

SEQ ID NO: 32788 - DNA, 30 bp, Homo sapiens
  chr9:136603602-136603632
  hyper
agctccctctgagggcggcagagcagggtt

SEQ ID NO: 32789 - DNA, 30 bp, Homo sapiens
  chr9:136658309-136658339
  hyper
cttcagtccagaaaacgcagtgtccagacc

SEQ ID NO: 32790 - DNA, 90 bp, Homo sapiens
  chr9:136931060-136931150
  hyper
tgggtatgactacttcggagtgtagggcaggcactgtttgcaagtcccgtccttcattcaaagctcactcacttccgaagcaggcgcgag

SEQ ID NO: 32791 - DNA, 39 bp, Homo sapiens
  chr9:137295661-137295700
  hyper
tccccttgacattggcgaggtccccggggtgggtgtggg

SEQ ID NO: 32792 - DNA, 37 bp, Homo sapiens; identical to SEQ ID NO: 10113
  chr9:137299217-137299254
  hyper

SEQ ID NO: 32793 - DNA, 30 bp, Homo sapiens
  chr9:137533003-137533033
  hyper
taacccagatgttcccgtccaagcacatgg

SEQ ID NO: 32794 - DNA, 42 bp, Homo sapiens
  chr9:137533555-137533597
  hyper
gcgggcgttggggatcgacagcctccgcggctgccttccagg

SEQ ID NO: 32795 - DNA, 148 bp, Homo sapiens
  chr9:137533819-137533967
  hyper
aaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacc

SEQ ID NO: 32796 - DNA, 493 bp, Homo sapiens
  chr9:137534065-137534558
  hyper
cgcgctccgcccgggcgccccgctgctgcccccgctgctgctgctgctgctgtgggcgccgcctccgagccgcgcaggtaagggcgccccggggcgcggggctgcgggatggggcgcgcgcagcccgggcgccgctgtcatccccgggcgccttcgcccgcagaacttttcttccttggcctgtggaatgcacgggccaagaccacgaatgccatttgctgggggcccccccgagatgacgacacgcagacacaatgcccgcgggcgcgccgccgccccctccccagacgggcgggtcgggtggggctgtcgcgcgagccgaggaaggaccgagggctggatcagcaggaggggttgtccacgaggcgggcaaacttttgtcccaaaaaccttccttctctgtcccacatcacaggcgcccagcttgggccctcacagccctacagcagaacttcctctgctccaaaccgggcagggccgccccctagagtta

SEQ ID NO: 32797 - DNA, 170 bp, Homo sapiens
  chr9:137967194-137967364
  hyper
acttttggcacccaccgcagcccagcgcgcgttcgtgctccgcagggcgcgcctctctccgccaatgccaggcgcgcgggggagccattaggaggcgaggagagaggagggcgcagctcccgcccagcccagccctgcccagccctgcccggaggcagacgcgccggaac

SEQ ID NO: 32798 - DNA, 179 bp, Homo sapiens
  chr9:137967472-137967651
  hyper
ggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaagta

SEQ ID NO: 32799 - DNA, 243 bp, Homo sapiens
  chr9:137967688-137967931
  hyper
cggcccggcccctcgggagccccacaaagtccgggaacggctctggctccgcgccgccccgcgcccccggcctgggcgcccgaagtgccggggttggggagggggccagggcgctaggctggacctgggtgggagggaggggtgcaggctgaccggagacggcgctcctccagccccggctcagcagagctgacagctgccccctttttcctaggactccgctgcccccgactccctgctgag

SEQ ID NO: 32800 - DNA, 180 bp, Homo sapiens
  chr9:137979493-137979673
  hyper
gcgcagcccgcgcagcgctcagagccggacggcgcttcccggtggcggcggaggagcccggagggacgcagccgggcaaggcagggcgcagggcgggcggcgcgaggcgcagggcgcggcgggcagaggccacctggccaccttccctggcgcccggggaaggcgcggcgatggccgggg

SEQ ID NO: 32801 - DNA, 167 bp, Homo sapiens
  chr9:137979977-137980144
  hyper
gcaccggcgtaagtgcgcccgccggccgccttggcgcggctcctcctcctcctcctcctccccctcctcggtccggagccccgggctgggcgggcgccgcgcgggacccgagtcgcccagggaggcggcggggagcagggcgggcaagggcaggcgtcgcgggccgg

SEQ ID NO: 32802 - DNA, 756 bp, Homo sapiens
  chr9:137980216-137980972
  hyper
cggcgtttccttcgtctgggcccctcgccgcggggccgggggagcttggtgggttctcggaggcttggagtcctgggtcagtaatcatgagccccccattgaaaaggttaggaaactaaggctggggacttggggacttgtccaaggtcacactcagcgagtgaggggtggagccgccgctagaccctagtctgggctcggtccagcggggactgagcccgccctagtttgtaaaagccagactggccggaccgggctgggagtggggccccagccggtgggctccggagctcctgcccgcgcctgcattcccaaagtcccaaggcgccctttcctccccagtccataggagggtttgttccttctcctccgaggacggtgccgaggggcttgggtggggcccctgggagcctgcccttgggcgctcaccccctcgcctttgccttcgtcttctgcgcgcacccctccctcctggcctctgaaattgaaatcgcgtctccctctcgagcctagcgggaggggaaccgtggccggggctgcttctgggcagagctgacttagatggctgagcgaggctgagctgaaaccgccacccggagggccgcgcggggaaggggccgctgccgggaaggcgcgccccagaccactggccctttaggctgaaaggagaggtgaaggacgtgagtctccctccctctctctttttgctgccaggggtttagtgccctgcgaagagggctccgtggtgtggctccc

SEQ ID NO: 32803 - DNA, 95 bp, Homo sapiens; identical to SEQ ID NO: 3486
  chr9:138606154-138606249
  hyper

SEQ ID NO: 32804 - DNA, 72 bp, Homo sapiens
  chr9:138606523-138606595
  hyper
gggacctgctgctgggcgacccgtccttccagaacgacgacaggtagggaccgggcgcggggtgggggctgg

SEQ ID NO: 32805 - DNA, 30 bp, Homo sapiens
  chr9:138607023-138607053
  hyper
cctggtcacttattccgagtcaccgtgtcc

SEQ ID NO: 32806 - DNA, 30 bp, Homo sapiens
  chr9:138628067-138628097
  hyper
gcaggccatcctgagcgccaggcctggtcc

SEQ ID NO: 32807 - DNA, 404 bp, Homo sapiens
  chr9:138628339-138628743
  hyper
ccagccccccagccccggcacccggccgttccactgcgcggcggcgtggggagggcgcggcgcgagctgagatggttccgcccggcgccgcccccgctgcccgccgcccgccgcccgccgcgccgagcgctcccgcaggatggcgcgggccaagctgccgcgctcgccgtccgagggcaaggcgggcccggggggcgccccagccggcgccgcagcccccgaggagcctcacgggctcagcccgctgctgccggcccgcggcgggggctccgtgggcagcgacgtgggccagaggtaggggcgcgcgggcctgggaccccgcttgtcaaatcgcgcttgcatcctgctcgggctgcgctggctgggctgcacctgcgttgcctgcagcccggggaaggggggag

SEQ ID NO: 32808 - DNA, 69 bp, Homo sapiens
  chr9:139024452-139024521
  hyper
ggtgcctgggacccccgaaggcgtcgggagttgggggcaaacggccgccgccggcccgcgtcaggcgcc

SEQ ID NO: 32809 - DNA, 155 bp, Homo sapiens
  chr9:139024749-139024904
  hyper
gctgcagagcgcggagcccgggagctcgcaccgcctgttcgtggggtccctggggtgcaggggtggaggacataggagtgtgggggtcgtgggcagacccaggcgggacgctgtgccagtgccgccccgaaggcccagtgcgcagggtcccccgc

SEQ ID NO: 32810 - DNA, 54 bp, Homo sapiens; identical to SEQ ID NO: 10123
  chr9:139025663-139025717
  hyper

SEQ ID NO: 32811 - DNA, 717 bp, Homo sapiens
  chr9:139084634-139085351
  hyper
gggtcgggaccccaacgagcgggaaaaaaaaaaaaagacagaacgcgtgccggggagtatgaccccggccccggctccctgcaccccgggctgcgcagagccctcgccctccgggttccctctgccagcgacgccagcagagccgggcaggtcccatctcggggtctccccgcgcccggacgacccctctcccactgcggccccggccctgcctcacccgccgccccaccagggtccgagaccgggagaccccagccgcggggggggggggacatcagccttcgacctgcccccgcacctcccgctccgcggggagactgggcgccaggaaccccgaattcggggctgacaacccgcaggcgcgcggctaaagcttccaccgtccgcgagaaggcgtctccaccctggaaggaagggggctcggacccagggaggatgaggggtccgccttctccttcccctcacctcgctgcagcccagagcccgcagacagccccgcggcccaaggtctctctccgcccgaggtctgcagctctggctgggcgtcccccggcctggcgggggtccgggtgggggccgcggcccgaagtctgattctgggttcgccctcgcgggtacggagcaggagccggaggaggtcggagcccgcgtttctgtccctggggcgcggggaggtcacagggctccccccaggcccgcgcggggcggaaccgggta

SEQ ID NO: 32812 - DNA, 211 bp, Homo sapiens
  chr9:139085372-139085583
  hyper
cgctccgatcgggaaccggaggccggcgaggtcacgcagacgcgctctccagggcaccgcgggtctcccatcgccgaggccgcctccgcaggccccgctcccctccccgcggcggccagggcggtgtcgggggcggccacgggctccgggattatcgacgcgccgccagctggagcgggcgcgggcggggtccccgcgggaacagtcggca

SEQ ID NO: 32813 - DNA, 36 bp, Homo sapiens
  chr9:139085792-139085828
  hyper
tgcccccggagagttcggggtcgtccctccagcgcc

SEQ ID NO: 32814 - DNA, 174 bp, Homo sapiens
  chr9:139085985-139086159
  hyper
cgctcggctccagtgttgccgccattcccagtggccgtcggggcccttctcccctcccgggaccgccctggtgatccgcgcgtctctgcgcttcccaggggtgctcggtgcctccttagacacagcgtggctgccagagcctgggggtcgaaggccatgcgccacagggaggga

SEQ ID NO: 32815 - DNA, 336 bp, Homo sapiens
  chr9:139089123-139089459
  hyper
caggggcagctccctcgtgtgaggtgcagggtggagccgggcctgggtcagaactgagcgtggtctacctcatccagccaggaggcggggctggcagggaagtcggggtaacccccgctgctccccgtggataggtcagaactgggtccgttccctgccagcaccctcatgggtgggggcccgccgggggctcccgagggcacaaggcccaagctggtgtctgggtacaccaggctggagaggaggggctgggggccagggaggctctgcggggcggcgggggatggggggacaccgtaggggctgccgggacgcagctctcggtactgctctggg

SEQ ID NO: 32816 - DNA, 147 bp, Homo sapiens
  chr9:139090405-139090552
  hyper
tgggaaattcagatccgcgggctccctgggacccctgcgaccccgccgacgcgcgctcgtccccccccgagctccgcgatccctccgcctaccggggaaggagacctcagcgtcgctgtcctgcccctcctgaacgctgtccttgtc

SEQ ID NO: 32817 - DNA, 156 bp, Homo sapiens; identical to SEQ ID NO: 10130
  chr9:139090586-139090742
  hyper

SEQ ID NO: 32818 - DNA, 454 bp, Homo sapiens; identical to SEQ ID NO: 10131
  chr9:139091071-139091525
  hyper

SEQ ID NO: 32819 - DNA, 151 bp, Homo sapiens
  chr9:139093772-139093923
  hyper
ggacagcgcctcggccgcagctcgccgccggcgcccgcgtcgggcaaaagccgccccagcccaccccgcgccgcgcccgcgaccccagccttacgctgcatggcgactccagccctggcgggggctcctgtgtcagggatggcggggtcgg

SEQ ID NO: 32820 - DNA, 178 bp, Homo sapiens
  chr9:139094021-139094199
  hyper
cggccaacccctcccaggaaccgtcgaaaaataaataaataagtagggaaccgcgagcccccacagcctggatgtaacccccttcccgccggccggtccctctcactccccactggctccggggcctccttccccatcctgcggctccagctggcccgggagtcgaggagaactgccc

SEQ ID NO: 32821 - DNA, 98 bp, Homo sapiens
  chr9:139094635-139094733
  hyper
aaatacaggctgaggcgcccaggcgcggacgttccggggtcctcgcgcccactcccgcccagatcctctagctcctgccagcctccgcggccaggccc

SEQ ID NO: 32822 - DNA, 117 bp, Homo sapiens
  chr9:139095014-139095131
  hyper
gccctggggcccggagcctctggccgagcggagggcggagcggccggggggcggggccgcggggcggggcggggccgggggtcgcggagaccagcccgggccactgcggactctgag

SEQ ID NO: 32823 - DNA, 320 bp, Homo sapiens
  chr9:139095165-139095485
  hyper
cgccccgcgtgcccggcccgagggcgggcaccggtaagggagggcccaggtcagggcttcccgccagcgttcgtcccggccccgcagcttcctgcgccggagcggcccagaggcagaggcctgagctggagcacacgccaggagggctaaggttcccgggagaggggtcgagaaggcagcagggtcctcccgccgctgaggtttggcctcgggagcagcagatggtcggcgggagctcaacccgaaacgcagaaggggtgagtgtggcgccgagggctgcgtaccggaaccgcaaggtgccggaccgatcccagatgcta

SEQ ID NO: 32824 - DNA, 531 bp, Homo sapiens
  chr9:139096584-139097115
  hyper
actcttgcaggccagcgtcaggccctccccgccaccctgggatctggaaactcactctctgcagtttccatctctgtgtcccgcctgcagagcggcgggactttctttgcctggccgctggccctgcacgcacccccttcctcgcgcctctgccgcccttgccgtttctgtcctcagtgtcctgctggggcttaccccgagtcccgcccaaggtgcagacggcggcggccccgggcctcgctcggtcgcgctcgagccccgtttccagcagcatcgcggccaccaggccgagtggcgcgagacgcgctcctcctaggtcagcgtcccctggagggttcggggctcccaagtcccgccgcgtcgtgcggggcagggagcccgggagccactgggcctggcgctgtccgcggtgctgaaggaggcgcccgctgcccgccccgcccgcgcgcccgcccacctcccggggcccctctcgtcgccccggtccccacccccgcctctgccccgtgtcgggcgcgcctccctccctgg

SEQ ID NO: 32825 - DNA, 373 bp, Homo sapiens
  chr9:139606331-139606704
  hyper
ggcagctgctggctgcgccccacatccctcaccgtccaactcagcccccccaggtgtttaccgaagtgcaatgaaagcttctgttcacacggaacctgcctatggaggcggcaacggctcatccccgagcaccccacgcggaggcgaaggaagtgtcctcccggcgagtggccaaggcgcggggtctcagccaggagggaagggtcggaccccggggcgggctgcaggctcggccagcccagggctccgcgcgtctgaccccatcctgaggacccaggggaaggaccagccctggctctgcggcctcgaaccgggggcgcgcgtggggagccctgaaccccgcagcctgcgtagcgcacggggcctctctcca

SEQ ID NO: 32826 - DNA, 131 bp, Homo sapiens
  chr9:139607156-139607287
  hyper
tgccccttctccaagcgcctgcaggtaagcgcggtgcgcgcccgccgcccccggccgcctctgcctggggaggccgagctccagccccggagtgggccgagtacggagcggggccccgggttcggacacga

SEQ ID NO: 32827 - DNA, 80 bp, Homo sapiens
  chr9:139739053-139739133
  hyper
ccatggagaccctgccggagccaccgccgccggagtccgctgtgccgcgcgcccggacccgcgaagccgagccacgccgc

SEQ ID NO: 32828 - DNA, 54 bp, Homo sapiens
  chr9:139739447-139739501
  hyper
cgcagtgctccagcacgccacccggggctcgcggtcctgcgggcccaccgaggc

SEQ ID NO: 32829 - DNA, 83 bp, Homo sapiens
  chr9:139872708-139872791
  hyper
tgcgacgtcctctgccgcccgctgtatgggccaggcgctcagccagggcacagaatcgggaccgggggcggaggggccgaagc

SEQ ID NO: 32830 - DNA, 36 bp, Homo sapiens
  chr9:139879955-139879991
  hyper
cggggcagctagggacgacagcgggggtgatggggc

SEQ ID NO: 32831 - DNA, 95 bp, Homo sapiens
  chr9:139943364-139943459
  hyper
ggccccgccccgccccgccccagcccaccttcttctggaagatcacgccgccgaaggcgcgctcgtcgaagccgtagccgcgactcagcagctgc

SEQ ID NO: 32832 - DNA, 141 bp, Homo sapiens
  chr9:139948048-139948189
  hyper
acagcccctgggctgcgttgacggactcggcggcgggcgcggaactcccgggacttgttccttcagcaccgcgtcgccctggaagcgccaccgccccccgccccctccgcgtacccggtcggggagcgcagagcgcggaac

SEQ ID NO: 32833 - DNA, 69 bp, Homo sapiens
  chr9:139971509-139971578
  hyper
gcccacgccagctggcgcgacccagagggtcctgggatctctcggggcggggcgcggagtggacagggc

SEQ ID NO: 32834 - DNA, 145 bp, Homo sapiens
  chr9:140024626-140024771
  hyper
ccgggcgcggcgtcgcgggggccgagggaaggaccggaccctcccgaggtcgcggacccggccggctggggcgaggctggggtggcccctaccccgagctaagctggccgcgccgcatctcaccgtcgccggggcccgagcgctg

SEQ ID NO: 32835 - DNA, 133 bp, Homo sapiens
  chr9:140024786-140024919
  hyper
cgagcgagggggccaagcggccggctggacccacagtccccgcgccataggcgggtcggggctttcagactcggctccagccctcaaacctggtagccttggaggtcagcttgagatgactgcgcttcctgcg

SEQ ID NO: 32836 - DNA, 134 bp, Homo sapiens
  chr9:140024956-140025090
  hyper
cggcgtccgtggccgccggaggcctgtgttctcccctgccgaacctcacgcgcggcccctccctcattttcttctggccaggctgccccctgccccttgggcgattctgctgcgtcccacggtcctggctgtgg

SEQ ID NO: 32837 - DNA, 40 bp, Homo sapiens
  chr9:140032911-140032951
  hyper
gctgagggtgtgaaacggctggccccgaacacacctcgcg

SEQ ID NO: 32838 - DNA, 73 bp, Homo sapiens
  chr9:140033418-140033491
  hyper
acccctccaggcacgcgctcacacgcacacgcgcgctccccggctcacgcgcgctccgacacacacgctcacg

SEQ ID NO: 32839 - DNA, 9 bp, Homo sapiens
  chr9:140033618-140033627
  hyper
cgtccggac

SEQ ID NO: 32840 - DNA, 400 bp, Homo sapiens
  chr9:140033762-140034162
  hyper
cgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggc

SEQ ID NO: 32841 - DNA, 141 bp, Homo sapiens; identical to SEQ ID NO: 10143
  chr9:140050956-140051097
  hyper

SEQ ID NO: 32842 - DNA, 272 bp, Homo sapiens; identical to SEQ ID NO: 10144
  chr9:140051219-140051491
  hyper

SEQ ID NO: 32843 - DNA, 262 bp, Homo sapiens
  chr9:140772069-140772331
  hyper
gtgggaggcgcggggcgagggaggcgcagccggaggggccggggcggggcgggggcggccgcggggcggggccggcgcggcagggtgggcggggccggcgcggattggccgggccccgccacgtgaccggccccttatagggcgtggcgcggggccgcggagtcgggtgaggcggcggcggctgcggcggtggggccgggcgaggtccgctgcggtcccggcggctccgtggctgctccgctctgagcgcctggcgcgcccc

SEQ ID NO: 32844 - DNA, 8 bp, Homo sapiens
  chr9:140772586-140772594
  hyper
tgcttcac

SEQ ID NO: 32845 - DNA, 623 bp, Homo sapiens
  chr9:140772756-140773379
  hyper
cgcgacctggggaggcgtcgggagacgggcgaggggggtacggagcgccccagggcccctcggagcggcgggtgcgggagcatttccgtgagtgcggcgggcgcggggcggagcccctctgctccggactcgtccctccgcacgccgggtcctggggatcctggtcggtgcacagtgcgcggctagcctggagggcaccgagggcgaagccgcgtccgtgcaggtgcgagcgctgtggggacgcggccgtgcgcgcgcctggctgcaggtgcctgcgtgtgcgggctgagctggagcctggcgctgcgcgtgcgtgcgctcgcgatgcgggctacatgcatgttcacgtgcctgtgtaggtacatgtggctgcgtgtctggagggagcagcgtgcgcctgcgcggggtctccctccagcctcgcctgggggcgctcggccccctcccctcggggccctggagtcgggcggagccgggccggaggcgctgtccgcggtgctgacggccgcccgggtgtgccgaggggctggcggcccagactgcggaggccccgcctcgcggccgcccctagggatgggggcagggagtgagggagaccaggccgcttccgccaggagaggggc

SEQ ID NO: 32846 - DNA, 33 bp, Homo sapiens
  chr9:141044732-141044765
  hyper
cgggacacctggggccgccgaggcaaaggtgag

SEQ ID NO: 32847 - DNA, 30 bp, Homo sapiens
  chr10:735019-735049
  hyper
gaaggccgatcccgccgggcccgctgcatc

SEQ ID NO: 32848 - DNA, 30 bp, Homo sapiens
  chr10:830880-830910
  hyper
ctcacggctgcgccacgtacccactgggcg

SEQ ID NO: 32849 - DNA, 40 bp, Homo sapiens; identical to SEQ ID NO: 10147
  chr10:1778568-1778608
  hyper

SEQ ID NO: 32850 - DNA, 257 bp, Homo sapiens
  chr10:1778826-1779083
  hyper
gatgggagtagctggcgcgagggctcgttcccccgtttttgggtaattcctttggcactgggagacgagatggcctccggagggtggaaggcagtgccagcccggccggccactggggactgcggggcccggagacgcgcggggtccccggggagctcctcgccgccctcgccccacttcgtccgggtccctcaaacatgtcgcagcgtggctgctcactgtcccctctgggcaagaggaggccccagacatttcca

SEQ ID NO: 32851 - DNA, 724 bp, Homo sapiens
  chr10:1779111-1779835
  hyper
cggagcagccatcccgccagcaccccaaagtgaagctgctcacaacggacaagcccggagaccccatgagaggccggggtggagaagccgggggtgaaggggggcaggggccggcgcgccacgcggtccttacctttccgcttggacctccgcctcctcctcctcttggacttgcatttgagttgactgctcagccctccagaccctctgccgctccccaggaccgaggccatggccgagacccaggcgcggagcccagagccgcctccctcctgcacctgcacctgcctccttcccggcagccgccgccgccgctgctgcgaagcttgaggttgcaaacccgggagcggctcacttttcaggactgagcaggaaagcgcgctccgtctctctgtctctcgaattgttctctatgacttgctcccactgggctgggggcctcggctgggcgcctggagcgagctgctccctggtcagggagggcggggaagggcgcgcggcgtcctgagtgctccgagcttcccgcgggctctgcctcctgctctgggctcccagcgcagggaggctacttttgcgcctctgctagttgtttggcaccagccactttgaagccaatcacgcagggagcttgtctatttgctgcagcagcgtctaattagatccaatcacaactgctttctggctctgacatcagcagcagcaccagccgcaccgccgcctggcc

SEQ ID NO: 32852 - DNA, 220 bp, Homo sapiens
  chr10:1779836-1780056
  hyper
cttgcaaactcagctcccgtttggacggtgaagctcccaggaccggcggctggagggaggctgctcccggggaacaaggacgcggcgcgggtgcgtctgggagagaccgggggagcctccaggagggaccctgcccgggaggacgaggcctcctgccgcagcctcgcggacagctcagctcgccctgctcagaaagacacagggacgggtttttccaacc

SEQ ID NO: 32853 - DNA, 94 bp, Homo sapiens
  chr10:3108959-3109053
  hyper
ggaggatccactctccgtccgtccttcccgacctcaggctgcagaggaaacctgggggcgggggtcgaggaagccgagccccgaggctcccagc

SEQ ID NO: 32854 - DNA, 114 bp, Homo sapiens
  chr10:3109054-3109168
  hyper
ccgccccaggaggaatcttgcgggccactagaagctgtgcgcgcggccgggctcggcccccacaacggcccgagcggccgggcctgccgcgagcctccgcgtccaggtggggtc

SEQ ID NO: 32855 - DNA, 30 bp, Homo sapiens
  chr10:4698935-4698965
  hyper
ccaatatcaaagaagcgtgggcccttccgc

SEQ ID NO: 32856 - DNA, 195 bp, Homo sapiens
  chr10:7449995-7450190
  hyper
aatcaactgtacatccgcttccacggcacggcctcgtgcaaaatcgcgggtttcggggccttggagcaaattgcgcttgtcagcggcgacgtcaggaggacaaggggaggggttcgcggctgaaactgcagcttcgcagcacagagccattttaggctgctccccacctcgcggggcccatgggaaagccggccc

SEQ ID NO: 32857 - DNA, 2528 bp, Homo sapiens
  chr10:7450490-7453018
  hyper
cgcgggcccggaggaggtcctcccacctgcccccgccagccccggggaccgtgcgcggcctccgtgtggcccccgcccacgaggtccctcgggcaggaaccgccgcgcgacctctgttcagcggccgcgtcctggccacgggcgacccctgtcgggaaccctgttcccggctaagctgcgttcccgcattccggtggctctcacccgagctcgcgtttgctggctttccctctggctcctctgcctgaccccgattttgtctccgaactccactcccagatcctccccgccctggaacgccgacctttcccccgcacttcgccgcccactcacatcccccggcgactgcccggcctccatgcccgccaagacaagaagatgcccctctccgatgcgccgagagggttcctaagccgagcaagggacaatttcttccccaaacgctgtccccatcccccaccttccctagagcgcgaaacccaaaagtaaggaaggcaacccctcgcctcgaccctacgtgcttgtctcccagagccgcgcgctcccgcccttctgccccaccccaccaccaccaccaccactttggtcttctccaagcttcggtcccggtcccccacctcccaccccagagcggcgtggaggaaagcaggagcccactattaagtgcagcgcgccccctgcacacacgaaatccggctggcgtctgcagcccgattgcacccaatacccgggacagttagtccttttaataagcacctcctcgccccacctactcggggatctacccgcgcaggatccagcacacacaaggcgagagctagctcgtctcctagaaagacaaaataaatcactccctctgccctcatgtactttacaccacgtgtccgcagtttgtcacgtcaaatcatggcagggtctggttccaagacgcacacacacattcggggtggttctctttgacacacacacccaaaaaaactgcgcacacgcaggcctgcacactaatccacaggcacacacgacagttgcgtttcggtgccctggtccgggccaggggcacttctccatccctttcccccctagcaatggacttgacacacagactctaaccacggaaaaaaaaaaccggacagcccattccttctttttttccccacttaattcgctaaagcgcttcctggggtagccaaagagagtcgaaactaaggggtggaaacttcagctgggttttttcccacctcaaaacctttattttcagtttttaaaagccaccttagcccgccatattgaaactggcacggtttctaaagactccttccccgcagttgtggcgcttccaagaaaacacgagtacggatcaggctctggatgagtgtccggccaccgagaatcagccacttcccaccctccaggatcccccagctccctccagccccttcccaccgcccctggtcaaaatcaataaatacatctcgcagttcctacagttgcattttggcggatttctgcaaaacatacacacacatacacatacccacgcacgcatattaaaaaataaactccagaaccagctcaagtcagcaattttgaaagggggtcgaataagaggagacaaccggaaagcccctaagtgacaggatattactttaaagagaaaataatgaacaaaaagaccatcctcgctggagcacgctccaaaactactactgccaattttatttcagttgctcaggcaaatgtttccaagggagcgattccgaatgtctgcacgatttttacccccatgccggtctccgattccccgtcctcaccatctttttctcccacccaaaccaaaagaaaggggagaccccagcgcggaggagacgcgggagcgcggggtaggtagcagcggcggctgcgtcgctaaaatgagtgcagaaacgaggaaggtgggcggcgggaggggacaggctgcgcccggggaaggaggacactttgcaactccggacggactcccgcacggctcggcttttccgagcccggagacgcaggcgaaggggacccgggaagcaaaaatgacaacctggagcgcacagaggagtttgaagcttcgctcaagtgcagtcgctttcttctcctgcccttctctttcgctcccctgcaccctccccagccttcccccacccgccacctccaaccccagctccctcaggcttccttcctttttttttttttccttttttttcctaggctggaaaaagcccctgaccagcgcactcaacctgcgggccgaagggctgctctccggccagcctgggcgccggggacagcagccggcgcggcgtcctacctggtgaagttcgtcctgccctcggcgtggacccaggccccggtcgccgcccgggagggcaccggcctcgctcgcttgctcgctcgcccgcccttgcccgctcgctccccgcccgccgcctccctcgcgcgcccgctccggtcctccggctcccactacagctcattccaatatggcatcctctctgtgcgcatgc

SEQ ID NO: 32858 - DNA, 579 bp, Homo sapiens
  chr10:7453078-7453657
  hyper
tgtgtgcgtgcgcgtgcagcgaactccttcaacgaccttttccagcgcttgcaaaatttcttaagccaattagcctgcgggacgtgatcggctccttccccagccagctccgcgccattccctgcgcctaagcaggcgggcacccccaggaccctgggaccttccacgcccacgcggcctcctccccaccgcgctccccttcctcctttttgtgagctccctccatacatgatctgcagaaagttcccatcgcgggcgtttccgcacacccctccgcaaggacaactgggcaaactcccgtttccctggctgcggttcgtgagctgggtttccaatggctcagtcgaccgtgtgcacaaacttgcgctttatccgccggggatcgctgggagcggagataaattcaatccccagggcaatcttggccccgcccgccccaccccatcctgtgcttaaatagagcctttcttgaagctgcgaacatttccaggccccttgggcagggctggaggggccgaggagagctattcgagggaaaggtgccccgaggggcaggaaattaagttggggctgcccggg

SEQ ID NO: 32859 - DNA, 98 bp, Homo sapiens
  chr10:7453902-7454000
  hyper
cgcagagcccaaacgaaatgtccccagtgcggaaaagccggtgacgccctggtagcaagaccaagagcttccgaagaacgctgcgcccttaactaggg

SEQ ID NO: 32860 - DNA, 158 bp, Homo sapiens
  chr10:7454448-7454606
  hyper
gagatccagggcgggcgtccgcagccgtgaggccccctgcgccgccagtatgggaagatcctgcctccttacaccttggagaacgctgggcgacgactaaagcgccttccgccggcctgtcactccatgtgacacaggagccacgtgagacccagaag

SEQ ID NO: 32861 - DNA, 386 bp, Homo sapiens
  chr10:7708471-7708857
  hyper
ctcagaaattaacaacgacgaacagaaatctgcgcaatcaacaggagccaagaagaaaaactcggctccgcaggacaagtcccgggcacagttctgcaggaagcctcaggccagatcaggcaccgcggctcacacagaggtgacgcacgagtgacccacagagagggacccctgggcctctggtgggggcctgggagacggtcgaagggggcccgggcagaagctccgcggccgggccggcggagggaagggggcggccgcgcccgggacccggctcccctcggctccacttacctgctccgaagagtggccccagctctgcgcctcttcctgcgaccccacacacagggacagccccaggcacagccccagcagcaggagcatgg

SEQ ID NO: 32862 - DNA, 17 bp, Homo sapiens
  chr10:7708954-7708971
  hyper
cgcggtcccagcccgga

SEQ ID NO: 32863 - DNA, 15 bp, Homo sapiens
  chr10:8075930-8075945
  hyper
gctggcagccaactt

SEQ ID NO: 32864 - DNA, 124 bp, Homo sapiens; identical to SEQ ID NO: 3501
  chr10:8076053-8076177
  hyper

SEQ ID NO: 32865 - DNA, 984 bp, Homo sapiens
  chr10:8076340-8077324
  hyper
cggtccctgggggcggggctctggcacgagggggaccctcccgggtcaagttcacagaggcggaggggcctgggctgcgccccagagccccagggggtcctctgctcccataaaaaacaaagacgggggcggcggagggtgtggaaggaaagaaattgaaaagggagtgcgggcgactgagggaagctggaggggaaataggggcctcggccaccagtggcctatgtccataactgccctttggttttggtggccttgcaggccgggaatcgagtctgccatgttcgctttcagacgggcctcctggcaagctcttggttgactgtccccagatgttccgggaacccacccctcccccacaccctcccgccccaaccctccgcagagaagccgaggaccacatccatccgcttcctaggaacctgcccgcaccagcaggccctgtttcctggacaaactgggcaaagaaacctaagaaccgcgcgatcccggcaggtggctttctgcggagccagggctgccagcgcggccgggcggcgcctcgggacccggcctggcatccgcgggcgcccggggagggccttggcgtcggcgggggtgggggtgggcggcagatccgaagcagggtcggggaaaaacggcgttgcgggagggttggggggtggcctctgaggaagtgggacaaaaggctttatttcagaaggtacgccaggaaaggggcgtgggtcaccaagtcctgcgcagcagagttggcgcggcctgggagccggggtcccttctgaccacagacgtggccaccgcctcttctcatcccgaaggtcccagccatcccgaggtggtcagagaagaccccgacgggcggatcgggcagtggagagacccgtggtcctcgcgcctgctgtgtcgctgtgtcaatgaccgtgacactcagggcaatccttaccaacacagagcaggacaacgataccccgcacccccccgtac

SEQ ID NO: 32866 - DNA, 352 bp, Homo sapiens
  chr10:8077891-8078243
  hyper
gggggacccctgttccgctgcccgtctcctccccggcacccaactgcggggcacgcgcccgttgctcggccctaaaggggcctagagctgcgccccgggggcgcggaaggtgcggggagagggggtgaggaaggacagtgaggggccggtcctgggcccggaggactcagcagccgccttggcagcaaatcctgtaggctgtcccctgccttggttgtctcgatgttccgctcagcgctggggaaataaatcgaacctggtgcacacccctcccccaggttgtaacacaactgcccccccagccaacacacacgcccaagcacgcagactttgcacacgtgacatgggggtc

SEQ ID NO: 32867 - DNA, 30 bp, Homo sapiens
  chr10:8079721-8079751
  hyper
ctccactcctggaggcgacaccattcatct

SEQ ID NO: 32868 - DNA, 391 bp, Homo sapiens
  chr10:8085599-8085990
  hyper
ttctccctgggtcctcaaaacgcgccaagaacgtggctctgccacttggtggcggaaggcgggaggcacagggcaggaaggtggaggaggggctgcattcgtgacgacgggggagcagagagggaaggacttagggactccccagagggcagacagacctggccagcttggcaaatcataaatccctctccctggaccctcggcctaaacctacccccagggtgtgcagcggaggcgcacaggggttggctgacgggctggggtgcgcctgggtggaggctggtttggggttctggcgtctggaggcaggccatggaaccagaggagagggcaggagggcccaccgcgcagagctgcggcccggctcctagagtggcgcccccagcctggg

SEQ ID NO: 32869 - DNA, 30 bp, Homo sapiens
  chr10:8086710-8086740
  hyper
cagagggtagcagcccgtcacccagcatcc

SEQ ID NO: 32870 - DNA, 130 bp, Homo sapiens
  chr10:8087215-8087345
  hyper
tccctcttcgcaacccggaagagctccgctctctacagtgagcaggagaaggcggaggggagggggctcccaggaagaacgtacatcgcccaggttttacctctcgctggaagcccgcctgagatgcggt

SEQ ID NO: 32871 - DNA, 264 bp, Homo sapiens
  chr10:8090494-8090758
  hyper
aagatgtccaaagcccgggagacccagggacgccggctgggctgcctccaccccttcttttcctcccgtggcacccacctgtccccccacctgccaaggccaggagggagggagagagctgaaaagggcacttttcctccagggtgactccaattcctttccactcaccctcaaggcgagttccttctctcccacccaacccggggctccccccaactgccactcgcctcacgtgtgagttgttaaacccgaaagcagaaatcc

SEQ ID NO: 32872 - DNA, 30 bp, Homo sapiens
  chr10:8091376-8091406
  hyper
actgccttttcttcccgtttaggtcttgct

SEQ ID NO: 32873 - DNA, 140 bp, Homo sapiens
  chr10:8091858-8091998
  hyper
cacggcccggtcctccggcttctctcctttgaacaggcgctggggacctccgcggcggccacagctggacgcgcgccgcgaaaggcgcggcggtcccgcgggcgcccggcgtgggctagagaggccggccctggcctggc

SEQ ID NO: 32874 - DNA, 89 bp, Homo sapiens
  chr10:8092446-8092535
  hyper
cccagcaagattgatcgagctggaatgggaagggacttctcctcccccaggcccagctcgccagggcctcgggccgtgctgcagtttct

SEQ ID NO: 32875 - DNA, 6 bp, Homo sapiens
  chr10:8093458-8093464
  hyper
aagccc

SEQ ID NO: 32876 - DNA, 107 bp, Homo sapiens
  chr10:8093718-8093825
  hyper
tttccctcccccgcccgccaagggaggaggaagcccggcctgctcttgccggcgaggcgggtcaggccggcgcctggcctggcccggacccccgcagcccggctctc

SEQ ID NO: 32877 - DNA, 105 bp, Homo sapiens; identical to SEQ ID NO: 10171
  chr10:8093859-8093964
  hyper

SEQ ID NO: 32878 - DNA, 6 bp, Homo sapiens
  chr10:8094252-8094258
  hyper
catccc

SEQ ID NO: 32879 - DNA, 261 bp, Homo sapiens
  chr10:8095198-8095459
  hyper
tatggggtagaggagcgaagagggaacaatgtctccaattcaaataaaaccccaaattaagctctcagccccatcggtgggatagcctgcgggggaacccactccctctcctggcagcattgccctgggggcgagcagagagtggatttggagtcttcttttcccgcctgacccctgctcgcccgagcagcattttcgggccagcggctgcagccacccgggcgccgctaggggatgcagtggctcaaaggaccgagcggg

SEQ ID NO: 32880 - DNA, 186 bp, Homo sapiens; identical to SEQ ID NO: 10174
  chr10:8095492-8095678
  hyper

SEQ ID NO: 32881 - DNA, 385 bp, Homo sapiens
  chr10:8096155-8096540
  hyper
cacgtttccccacatcgatgcgctctcccaaacaccctgcattagatcctaataatgatccatgcgtgcctattttttaaaagtctgaaaaagaaaattctgcccatcgaaatgaacttcatgaatggggcaggctggctgcaccgggacggaatcgtccacccgacccgaatgaattggcaggagccgcggccacatttaaagggccagagcgcgcgttccctcccgtccgcccccaagccccgcgggcctcgcccaccctgcccgccgcccctccgccggcggccgccctctgcggcgcccctttccggtcagtggaggggcgggaggaggggcgggggtgcgcggggcggggggagaagtcctggagcgggtttgggttgca

SEQ ID NO: 32882 - DNA, 88 bp, Homo sapiens
  chr10:8096747-8096835
  hyper
aagaagagagagagacggagggagagcgagacagagcgagcaacgcaatctgaccgagcaggtcgtacgccgccgcctcctcctcctc

SEQ ID NO: 32883 - DNA, 433 bp, Homo sapiens
  chr10:8097071-8097504
  hyper
ccggctcccgcgagccgggctgcagggacgtccccgagagccctgcgggctccgcggccgtgtccccgcgctcccgtgcgggtctcgggtgcgctgggcgggcgggcggcgcgaggggaggttgtgccactccagcaactcaggggctcatccaggtctcccattctctcccttgcaggtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagccttcccatccccccaccgaaagcaaatcatt

SEQ ID NO: 32884 - DNA, 375 bp, Homo sapiens
  chr10:8374353-8374728
  hyper
gggaggtgctgggggcggtggcatagcgcccacaccgcgtggtccccgcgcgcggctgggctggcagcgccccaggcagcgcgcacggtaagcaggaagctgcggccgagctgagtcgctcaaaagctactggagctaatagattgtggtcatgaggagagcggcagcatctcggtagtgatgggaacactcaaaagcatcatcaaaacagttgcagaaacatgctgagctctgcactcccgagcccgtgcctgctgcagccggcttggagtttgctggtagccactgcagccccggccccgcgcgtccagcctgggggtgcgatgagcaagagaaatgaggtgcaaaatgttgcatccgcggagctgcttgcaa

SEQ ID NO: 32885 - DNA, 195 bp, Homo sapiens
  chr10:11059469-11059664
  hyper
gcaagcacaccacaccgaggagcatcgaagcgaaccctcgggctgctcgcctcccgcggctgggctctgggagcgcggctcgggtatggaagtggagcgggctttggcgcctgggtggccctaaacctactccgagcggccacggcggcctcttgccagggacccccgggcgggggagcagagccaggcggggag

SEQ ID NO: 32886 - DNA, 226 bp, Homo sapiens
  chr10:11059932-11060158
  hyper
ggctcggcggccgccgggggaggccgcgcgcacctgtccctgcccgtctcgcgccgcccgcggccgctcggacgcgcgcagagccgccccccgccgctgccgccgcgtgcgcccgcgaacatgacttctgccttcaagctggatttcctcccggacatgatggtcgagggccgcctgctcgttcctgacagaatgtgagtggcgccgcgtcccgaggccgggcgag

SEQ ID NO: 32887 - DNA, 121 bp, Homo sapiens; identical to SEQ ID NO: 10180
  chr10:11060314-11060435
  hyper

SEQ ID NO: 32888 - DNA, 117 bp, Homo sapiens
  chr10:11060512-11060629
  hyper
ggggtccgggcggggtccatgagtccaagtgggaccggcgagccgggcgcggagtcccggggtccggtggggcgggcggggaccgggcggggtctgggggtccgggtgaggactgag

SEQ ID NO: 32889 - DNA, 81 bp, Homo sapiens
  chr10:11207195-11207276
  hyper
ggcagggcgctgccccgtgctcccccggctctgctcgacagcagcacgcagtgagagcctcgccgccgccgaggagcaact

SEQ ID NO: 32890 - DNA, 37 bp, Homo sapiens
  chr10:11784349-11784386
  hyper
cggggcggggcggggcgtgccggggcggggcgtagta

SEQ ID NO: 32891 - DNA, 359 bp, Homo sapiens
  chr10:13043175-13043534
  hyper
cggcggcgccgccgggctcacctgaggaagaagaaataggagtagtcctggaccacggtgtgggagtggcacgagaagtagcccaggccggtgaggttgagcctggagccggcgggcacctccagcatgctgccccacgcctggtcgcacagcatctcgacctcggccgagtagaagaggcccccctggccggcgtggtactgccagggcaggtggttgtagaggccgggcgcctcggggtgcagcgccagcaccctggcgtacacgatggtctcggccagctcggcgcggcagccctcgctcaggggcctccactcggagggcagctggcaggcgcgcgcgggcgctgggggacccgc

SEQ ID NO: 32892 - DNA, 43 bp, Homo sapiens
  chr10:13043744-13043787
  hyper
gtcccggggactggacgcgccgggcgcccgcctcccgccctgc

SEQ ID NO: 32893 - DNA, 33 bp, Homo sapiens; identical to SEQ ID NO: 3508
  chr10:13933506-13933539
  hyper

SEQ ID NO: 32894 - DNA, 339 bp, Homo sapiens; identical to SEQ ID NO: 3509
  chr10:13933596-13933935
  hyper

SEQ ID NO: 32895 - DNA, 14 bp, Homo sapiens
  chr10:13933982-13933996
  hyper
cgccaccgcccgcc

SEQ ID NO: 32896 - DNA, 129 bp, Homo sapiens; identical to SEQ ID NO: 3511
  chr10:13933997-13934126
  hyper

SEQ ID NO: 32897 - DNA, 145 bp, Homo sapiens
  chr10:13934168-13934313
  hyper
cggaggtccccaagcgggggacccctggctcccccacaaaacccacccaaagccaccgctcgaggccctctcctaccctgagagcccggagacagcagctcccttggctgaaggcacagctcttacccctcgatctagtccaatt

SEQ ID NO: 32898 - DNA, 165 bp, Homo sapiens
  chr10:14215748-14215913
  hyper
ggctgtctaatcaaccgagaggcgaactcatttactgaggttcccattgtccacgctgacagatggctcgctcccctctctgctctccccttcccctcagatcgcgctgccgtgcaggcaagcctattctttgagagatccagttgcaatcgccagcctagttct

SEQ ID NO: 32899 - DNA, 106 bp, Homo sapiens
  chr10:14216190-14216296
  hyper
aacttgaatccccagcgcctgcaaagcgccgttcctggagaagcctgctcctctcctcgccctggtcccctctctctttctccctctcccgcgctctctctcctcc

SEQ ID NO: 32900 - DNA, 891 bp, Homo sapiens
  chr10:15760963-15761854
  hyper
ctgtaacctcctgcccggggacactggggcaggcgtggagggcatgaacgtatttatgatgaggaccgactgtcaaacttgatttcctcttggaaacgggggtccgcaacctggtttgcaagaatgcaaacggtcctgcttctctaggtggagctctgtgggtacagtgagatgagagaagggggtggggtaggaggaagccaaggacagagcccagctgctggtagccgacagctcttgcgcccagacgcaatggttacagactctgcataaacagacctcgctgtggtggcggttttaactggcttgggtcttctgggtcctgttctctcctttgtaggatgcgtgcgtcttggtacctggaacacccaggacttgcgtgttctatgcaagtggcatgtctctagctcaaaattcacaaggcacatctagcatggcaggggagagaaggggctggtggcggggagagggacgggaccccgggcaggcggcaggacggggatcccaggctgcggggggactccgcggcagagccgctgggacctgacccgggagcgccttcgtccccgcgcgcacctccccgggtcgggcgacttacgtgcgggcgtcgggtatgtggaagtccacggcgtagccgaagtagctgcccttggggccgctgtacactgtgagcttttccacgtccaggttgaacgcctgacaggcgggggaccacagcaacatccccagcgcggccgcggcgcagcagaggggcgcgatcagcggcgcctggcttccccggggaccgcggctggccccgggcgacatctccctccgccccggtgggtggctgctacccaggagcgcgagccgaggacccctgcggggcaaggggggctggtggaatctggc

SEQ ID NO: 32901 - DNA, 259 bp, Homo sapiens
  chr10:15761855-15762114
  hyper
gtccccagctgcccgtgtcccgggtcggtgcgctcggcgcacccgtggtgacagtgcccggcgtctgctcccacccgcccgcccgcccagccggctcggggggctggcccaggggctctagccctcctccggccgcgggcagggaccagctctctcgcggcgcctcctcgcggctggtctagagccagggactcccgggcggcccagctggtggctggagcgctgggtgcctcttcgggctgcccggatttctattgca

SEQ ID NO: 32902 - DNA, 258 bp, Homo sapiens
  chr10:16562368-16562626
  hyper
cgcgcccttcctccgcgggctcccacccccatttccggggtctcctccctctcgcccgcaccttcccgcgctccctccccgccctccccgccgcccgcccgcgctcacctggttgtttttgcagagatcagcccacatgctggtgccgtcccctccgcgcatcaggacgtggtaggtgaagaagtagatgcccgggatggagcaggtgaacttgccggtggtggggtcgtagtggtttccgaggttggtgaccacgtc

SEQ ID NO: 32903 - DNA, 46 bp, Homo sapiens; identical to SEQ ID NO: 3516
  chr10:16562627-16562673
  hyper

SEQ ID NO: 32904 - DNA, 956 bp, Homo sapiens; identical to SEQ ID NO: 3517
  chr10:16562709-16563665
  hyper

SEQ ID NO: 32905 - DNA, 261 bp, Homo sapiens; identical to SEQ ID NO: 3518
  chr10:16563690-16563951
  hyper

SEQ ID NO: 32906 - DNA, 70 bp, Homo sapiens
  chr10:17270334-17270404
  hyper
ttaaaaacttaggggcgctcttgtcccccacagggcccgaccgcacacagcaaggcgatggcccagctgt

SEQ ID NO: 32907 - DNA, 589 bp, Homo sapiens
  chr10:17270666-17271255
  hyper
tccgccaaggcaagtcgatggacagaggcgcgggccggagcagcccccctttccaagcgggcggcgcgcgaggctgcggcgaggcctgagccctgcgttcctgcgctgtgcgcgcccccaccccgcgttccaatctcaggcgctctttgtttctttctccgcgacttcagatctgagggattccttactctttcctcttcccgctcctttgcccgcgggtctccccgcctgaccgcagccccgagaccgccgcgcacctcctcccacgcccctttggcgtggtgccaccggacccctctggttcagtcccaggcggacccccccctcaccgcgcgaccccgcctttttcagcaccccagggtgagcccagctcagactatcatccggaaagcccccaaaagtcccagcccagcgctgaagtaacgggaccatgcccagtcccaggccccggagcaggaaggctcgagggcgcccccaccccacccgcccaccctccccgcttctcgctaggtccctattggctggcgcgctccgcggctgggatggcagtgggaggggaccctctttcctaacggggttataaaaacag

SEQ ID NO: 32908 - DNA, 76 bp, Homo sapiens; identical to SEQ ID NO: 3520
  chr10:17271443-17271519
  hyper

SEQ ID NO: 32909 - DNA, 428 bp, Homo sapiens
  chr10:17271520-17271948
  hyper
tccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcga

SEQ ID NO: 32910 - DNA, 102 bp, Homo sapiens; identical to SEQ ID NO: 10197
  chr10:17495534-17495636
  hyper

SEQ ID NO: 32911 - DNA, 94 bp, Homo sapiens
  chr10:17496002-17496096
  hyper
actccactctcaggccgtcgccgcccgtgggctgctccccgccgcggccaaaagtctccgcgcccgaggggaagcgatgggcggcttgggggtc

SEQ ID NO: 32912 - DNA, 300 bp, Homo sapiens; identical to SEQ ID NO: 10198
  chr10:17496544-17496844
  hyper

SEQ ID NO: 32913 - DNA, 232 bp, Homo sapiens
  chr10:18429517-18429749
  hyper
ggggcgctgcggggcgctgcgccgagaacggccgggcctgagccctgggcggcccccagagccgatcagagcgcggggaggcgggggcgaggaggaggggacccgccgccgggggctggctgcttcgctccgagccgacttttcgccaatggtccaaagggacatgtccaagtcgcctcccacagcggcggcggcggtggcgcaggagatccagatggaactgctagagaac

SEQ ID NO: 32914 - DNA, 103 bp, Homo sapiens
  chr10:18429750-18429853
  hyper
tggctcccgcgggggcgctcggagccgccgcacaggtagcgagagcgcggcgccttctccttcctttgtgagccgccgggcagggcaccgacctcgggttctc

SEQ ID NO: 32915 - DNA, 7 bp, Homo sapiens
  chr10:18430144-18430151
  hyper
gtgagtc

SEQ ID NO: 32916 - DNA, 64 bp, Homo sapiens
  chr10:18430183-18430247
  hyper
cgctttctacgatgccgactctcctggccacgctccgagccggggtgggcgtgggtgtgaggat

SEQ ID NO: 32917 - DNA, 188 bp, Homo sapiens
  chr10:20105422-20105610
  hyper
gcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaat

SEQ ID NO: 32918 - DNA, 66 bp, Homo sapiens
  chr10:20106628-20106694
  hyper
gtgacctgggccaagcgggcgctggaaggggggcggggtaaatgcggccggcgcagaggtggggag

SEQ ID NO: 32919 - DNA, 63 bp, Homo sapiens
  chr10:21783695-21783758
  hyper
gcgcgcggactcggcttccccaggtcaggacccactaggtgggccgctcggccccaagcctgg

SEQ ID NO: 32920 - DNA, 45 bp, Homo sapiens
  chr10:21789093-21789138
  hyper
ggtgacaagggaaggcggcgggggtggagccgctctctggtggag

SEQ ID NO: 32921 - DNA, 243 bp, Homo sapiens
  chr10:21805094-21805337
  hyper
tctcagataccctatcgttccttatctcagcgaaacaactccccaggctggccgggcagtacaccggagatgctttgggggcccagctctgcagattccactccgccggcgactccgctttgacactactcttgaggtcgggaagtctgccggcatcctcgaaagcagcgggtttggttgcagcggcggcggaggccagatggtacaagaagttggcctgcgcctgcacgctgggaggcttgc

SEQ ID NO: 32922 - DNA, 117 bp, Homo sapiens
  chr10:22518011-22518128
  hyper
gaaatacatgcatttcggtggccccgttacatttcacgcgtcacgaagccgagcaagaccagcccgggccgccttccccgtgtacgcgcgggcctccggggacgcgcagagctggag

SEQ ID NO: 32923 - DNA, 37 bp, Homo sapiens
  chr10:22518491-22518528
  hyper
accgattgcgccacagagacttcggtgtcattttccc

SEQ ID NO: 32924 - DNA, 98 bp, Homo sapiens
  chr10:22540740-22540838
  hyper
cgggcgacgctcggctgatgggaccgggccgcgcaagcctcggatgcagccgggtggggggcaccaggcgctaggcgaaggagcgcaggaccaaagga

SEQ ID NO: 32925 - DNA, 789 bp, Homo sapiens
  chr10:22541062-22541851
  hyper
aggaagaaggaaaaccgagtaaaggaggttattcataagaacaggaaaggggccgaggggtagagaacacccgaaggaaagcgcaggaggccctcgtgagagggcaagggggaaaagatcgacgaagtaagagcgaaaagaggaaaggaaagaaagactttctagatgcggagtctccattttcagcagcgccatattcgcttttcctctcgccgcttttggctgggttttgtgtgcggcggtggacaggcgccagcacatttctgcagcttcagcagctctgctcagacacctggggagggccgcagggcccgggcgggggacgcgcgctcttggcccaggcccgggcgcggccccctccccggcctggcggttcctgcgcagcgccagccccgcgctcctctaggctgcaaagggggcctccgactcgggcccggcccggaggggacacctcactcggggccccgcggcagcccccaggggacgcgggccctctagtttcgcccacggtgtggctgggcatgcgtgccaaggggatgcgtaaccgagaaccgaaaaagacgaacttaaccttcggggaggaggagagggcgcacgctgcgggtaccggggcttgggggcgctcctggaggtgacggggtcacctccacctgcgcggggccactctctgggagccggcgatcgatgcccgccgcggcgcctggcccaggcccccaggcctctcgcggctcccggaaaaacgtccgaggtcggggctcggccgggagccccaagcgggtcccctggcct

SEQ ID NO: 32926 - DNA, 226 bp, Homo sapiens; identical to SEQ ID NO: 875
  chr10:22542024-22542250
  hyper

SEQ ID NO: 32927 - DNA, 29 bp, Homo sapiens
  chr10:22542567-22542596
  hyper
ggccccgggataatcggatcctcccagac

SEQ ID NO: 32928 - DNA, 179 bp, Homo sapiens
  chr10:22624127-22624306
  hyper
gagtgccggcgcccccggccgggcagaggagcgggtgggccgaggctgggacatcgcctccgaaagctgccgggacgcggcggcttcctgcagagcctgcgcctgccggatccccagaacacagaagcttctcggacatgggagctccccgtgcgccctaaaaccaggagaggaaggga

SEQ ID NO: 32929 - DNA, 560 bp, Homo sapiens; identical to SEQ ID NO: 876
  chr10:22624561-22625121
  hyper

SEQ ID NO: 32930 - DNA, 401 bp, Homo sapiens; identical to SEQ ID NO: 877
  chr10:22625382-22625783
  hyper

SEQ ID NO: 32931 - DNA, 292 bp, Homo sapiens; identical to SEQ ID NO: 878
  chr10:22625811-22626103
  hyper

SEQ ID NO: 32932 - DNA, 190 bp, Homo sapiens; identical to SEQ ID NO: 879
  chr10:22633985-22634175
  hyper

SEQ ID NO: 32933 - DNA, 108 bp, Homo sapiens; identical to SEQ ID NO: 880
  chr10:22634324-22634432
  hyper

SEQ ID NO: 32934 - DNA, 6 bp, Homo sapiens
  chr10:22634433-22634439
  hyper
gctccc

SEQ ID NO: 32935 - DNA, 215 bp, Homo sapiens; identical to SEQ ID NO: 882
  chr10:22634440-22634655
  hyper

SEQ ID NO: 32936 - DNA, 1017 bp, Homo sapiens
  chr10:22764573-22765590
  hyper
tgcgtaaataatactcgattaccatgccacctacatctttttgttaaaaatgcctttatgaaggctataatccttatcaaattaaaccctgcggatcccccttttaatacacagggagtcctcctcatttatgggcgtcggcgctaagcagctctggaaacgggcagacccagctgtgcagcgatgtccagtgtcgccgcatctgccccgcggggtgcagcatgagtcttcctttgtggcgtgcggctccatcggaacgcgcgttgcgacgacaaattccttttttcccccccgcagttaacagttctggggcagaggctggtggagaggtccagagcccactcagaccgagatgaagatgaggaaaagcatgagcaggaagaggctggcggctgcggcggccacagggaagagctcggtgcgcggcgcagcctcccgcgaccgcgactcctgggctgcgtcgaggagccgcgttgccataggaaccgtagcggcgccccagtgaaaccctgcgttcggacaggagaagctaaccgcggccgcccactcccacccgcgcttcctccccgcccccaccggccgtgcgcgaaaagcagagatccgagaaccgcgtgcggtacaaacggcaaaagcttcgcgcgcattttccgggagttgagcgcgcggccgcaggccgggaacctaccgctctcaggctcccagcccgggcgctacgaccctgtgggcgccgcctgtgcagcccctccttccagcccgctcgggcgcatcccccaggccgggccagcgacgcgggcaccgggagcccctcccgccggtccgggctttggcccacacccggggaccgcggagtgggaaaggaaccaaagcgcggcgcctggccgaccgcggacgaaattcgaggccggagggcgttttcttttttgcaaaattgccccaaagccagggccgcatgtacctactgtctcctttgccccacatgctccaagaaaataagacacattctaccccgagtcctaa

SEQ ID NO: 32937 - DNA, 30 bp, Homo sapiens
  chr10:23001954-23001984
  hyper
caaaagcagggaaagcgaacttacactttt

SEQ ID NO: 32938 - DNA, 18 bp, Homo sapiens
  chr10:23216825-23216843
  hyper
ctggattcaggtaatcgc

SEQ ID NO: 32939 - DNA, 286 bp, Homo sapiens
  chr10:23216844-23217130
  hyper
gacgcacttggctcctcccgcactggccgctgccctcggcgggacaatgggcgccctagcagccccgagcgttcccagggcgcaggcgcggcgcggcgtggcgtcgcctagcaacgaggcacaacaagggactgggggttcgtctgctgggtttgcggagcagctagctactcggcgggatctcccggcaggtaaaggtaaccccgtggggtggggaggcccaaggcagaggcctgaggaaaacctgggaaaggagaaggtgccacgtgggcgcagactgcttggg

SEQ ID NO: 32940 - DNA, 44 bp, Homo sapiens
  chr10:23460401-23460445
  hyper
cagcaccaaggccagcgcacctggctccacgaggctcccagaac

SEQ ID NO: 32941 - DNA, 571 bp, Homo sapiens
  chr10:23461156-23461727
  hyper
cgatccgcagttcttcgcccctccctctgtcccaattatctagaaacaaaaagagtagaaaatcgaaaatgagatggaggtcggcaggggtgtgaggccacggatggctgctgcttccttgcttccttcttttgaagccagaatcgactctgctcttgctcgatgacagcccctcgccggaggcgcggctcctggcctctgcgggggtccgcgcaatccgggcgcctccagctgcccccctcctccgagggtcgcagccacagagcgcaggcccaagctggggcagaccaagggcggctggggtgctcatgccggtgccggcatcactgccggagccgccctgggcgcactgcacccagcgctgcttctctcgctggttctgtgccgctgctcctcccgatgcttgggggaccgcagggaggccgaatgacaaccggggagcctcggggccgcgcctgaggcccagagtctgggctgtgcagagcgcagagccccagcttccccagctccctcctggattaatgcttggtgccagggagaagcgcagggctctttccgcctcctccccaag

SEQ ID NO: 32942 - DNA, 443 bp, Homo sapiens
  chr10:23462020-23462463
  hyper
ccggaatccctgagtcgactcaccccctctcctttttttttttttttaaatgggcgaatacctgtttaagttttaaaagcacatggaaattgcccgcgagcgaccatataatttgatttgccaggcaatctgcagagcgatcgcacgtcatttataatgttcattgagcattttgcctaattgtgtctgtctctgaaagggcagcgcaccccctcccgaccgctagcagcacaagtggcgacattcccatggagcggccgcgccgcagcttgccgcattcagcgcggacggcctggccgcgcgcttccccgcccggacgaccgggcgcgcctgacactaatagctcgcggctcaggtacgagcgggcgccgcatttgactcaattcaattcacaaccggccgcgcttgcaggtgtcgccttttgaaaccgccattcaggcggc

SEQ ID NO: 32943 - DNA, 130 bp, Homo sapiens
  chr10:23462485-23462615
  hyper
cgcgggttctgtagaagcgcaagaatggggctgattattccggtgcccacatgccgcccccacacgcccccacccccgtccggcgcaagacttcccttggccaaaagaggcgtttaattagttctggggc

SEQ ID NO: 32944 - DNA, 440 bp, Homo sapiens
  chr10:23462634-23463074
  hyper
cgacaaagcccggctccccaggtaacccgggttccctgcggacccgggagggggcgcgcggggccggagcaccggccttgggctgcgcgctccctccggcgacactgccgtccccctggcctccggcccggtcccccgcaggccaaaggctcatctgccgggcttgggtggcccgggccagcgccgcctgcggtccccgagtgcggctggctctaaggccggcgccctctccccggctttcagtgctcagagccaggccagcgggaaagaaggcagcatggtccgcaaaagacaggtggcagtggcagtcttgcatgatacttgtccttcttccctgttccccattttggggaaacactggaaacacttttctctttatgcgcattcgcgtctcagcaccgagtgctccaagccctgcgcgcagcgccgggcttggaagg

SEQ ID NO: 32945 - DNA, 588 bp, Homo sapiens; identical to SEQ ID NO: 3535
  chr10:23463266-23463854
  hyper

SEQ ID NO: 32946 - DNA, 190 bp, Homo sapiens; identical to SEQ ID NO: 3536
  chr10:23463887-23464077
  hyper

SEQ ID NO: 32947 - DNA, 724 bp, Homo sapiens
  chr10:23479973-23480697
  hyper
tctgtagagagaatacgcacgatggctgcgcttctgaactctcccggggtggaagctgcagcctggcttttaaccggaattgcccagaccttgaaagtgtttctttgttgctcttaaaaagaggaattcacgttgcatcgcagtctgtgataaagtctgtcttggggcagagctgcatacgttttgtgttttttttttttttcagaaaagaaaggtcgagaaagaaaaaaacaagtcattcagggatggtccctgtggccagtcggaaaggtgagagactcgggctttgaaaacgattcacattctgccctttaacttcaatgccttccctccggactgcgccggagcagacgattcaatggactccttttgtatccagtttattgctcagaatccctagggtctagatttgctctcagaagaaacgcgccccgctgagctgctctgggggctgcccctcccgtctccccattcctttctccgggccggggagggcaggggaggcagccactgagccgatgtcgctggggacccgcaccaggcaccacagccaggctccagagcggagtcccataggtgcgctcccagcccccgtgttgcgtctggaacgcagtgggagtgggcccggatcaccttccaatgacacccgcatatactctgcaaactgtgcaaaagcccttgaaaagtccagagatgggacagaagcccccagcagaacccaggc

SEQ ID NO: 32948 - DNA, 147 bp, Homo sapiens
  chr10:23480903-23481050
  hyper
ggaaggagccggcgctgctcagcgcgcgcgggtacgcagcgggcaccgcgggacgcaggtgcccctggagccgcacgcggggcaggtacagaatccagtatgcagaggcagaggagagggaagagagcggtgcgaggagccccgggc

SEQ ID NO: 32949 - DNA, 82 bp, Homo sapiens; identical to SEQ ID NO: 10226
  chr10:23481303-23481385
  hyper

SEQ ID NO: 32950 - DNA, 400 bp, Homo sapiens; identical to SEQ ID NO: 10227
  chr10:23481386-23481786
  hyper

SEQ ID NO: 32951 - DNA, 446 bp, Homo sapiens
  chr10:23481787-23482233
  hyper
gcttcccctactcgcccggctcgccgccctcgtgcctggcctacccgtgcgccggggcggcagtactgtctcccggggcgcggctgcgcggcctgagcggagcggcggctgcggcggcgcggcgccggcggcgggtgcgctccgaggcggagctgcagcagctgcggcaggcggccaacgtgcgcgagcggcggcgcatgcagtccatcaacgacgccttcgaggggctgcgctcgcacatccccacgctgccctacgagaagcgcctctccaaggtggacacgctgcgcctggccatcggctacatcaacttcctcagcgagctcgtgcaggccgacctgcccttgcgcggcggtggcgcgggcggctgcggggggccgggcggcggcgggcgcctgggcggggacagcccgggcagccaggcccagaaggtcatcatctgccat

SEQ ID NO: 32952 - DNA, 174 bp, Homo sapiens
  chr10:23482288-23482462
  hyper
cgaaggctccggaggggctgggggagctgactgccaagcagacagtcggaccgacggattgtcggtgggcacggaaaaacttgaatgcgagctcgcgtttctcgtttttttttttttttttatttttctgccacgttgaccgcggctctcaagggcgcgcgtccccgccagact

SEQ ID NO: 32953 - DNA, 793 bp, Homo sapiens
  chr10:23483777-23484570
  hyper
aaggtaggaagaagccgcccgctacccctgccaccttcgcaacaggcttacttccaaaactgagttcgttttgccttcatcagaacttggccctcctcggccagcaacctggggagaaggcgagcctgaggcggggggcgtagggtagccccctagcgaaggggagaagagcgagggcgcggccgaggtcgcttagccagaaagcctgggagtccaggcttgggtttgtctcctttgtggccaagagcgcctcccgggctctcggggcgtcctcccctgcccgccagagccggggcgccggcactgggccctgaggcctggcgcgcgcgcagatggcgttggcgcgagcgcggactggagacgcgctcattgacgtggcaccgtagccccgtgcggcgcaggcctggcccaggcggggtgtggttccgtgggccgcagcggcctggtgggcgaaggtacaattgcggatagcctctaatactcacggccctgccgcaggacaatatgttggcagcatgctaattgctttaacctagtttcagacccaccgaggggttccccgcgcgccgcgggtgccatggacctcgtccaagagcaattaaagcgaggccgcgagcccgaccccgcagcgcggcctggccagacacgcggagattctgggtcgcaaggctcccgggagccccttggccgtggaccctctcaccccttttaagccttcgcgccctctccctccactcctcctaaaagaagatttcacactggagacagaatttcagaacgagagaaaataatt

SEQ ID NO: 32954 - DNA, 173 bp, Homo sapiens
  chr10:23486241-23486414
  hyper
gaactcctgtgaaatcggctgagaatgcttcccaggaccgctcatctgccagccccaggattaacgcccctccgtggagagggtgtgaagcctcttaaatccataaactcatcccatttccattaatgggcctttgcggtggcaccgagtaccagctgcgaggttgaacaaac

SEQ ID NO: 32955 - DNA, 413 bp, Homo sapiens; identical to SEQ ID NO: 3538
  chr10:23487742-23488155
  hyper

SEQ ID NO: 32956 - DNA, 1673 bp, Homo sapiens
  chr10:23488382-23490055
  hyper
tcttcggaggaggcccggggcaactacgccccgcggccgggagggaagccctcgggcggccgcctgtagagggccccgtggcccggggcgcaggttgtggcgagctggtttttgcctctgggccgaggcgccagcgctagcagcgacagcagcggggggcgcaggtttctagccagtccccactttcggacctctgggggtctgcccttgcttctcggggagtcttggcccttgactgatccccgcaacttaaggccaatcccatccctagctggccggcacctgttccaaacaacctgttgcgctgacatcgctttggagaggcgccggcgctttgctggtggaggcgggttgtgtggaggccccaagccttcaggaaatagtttagggttccgttgtggtgagaggcaccccctccccgcttcctgtggcatgtggggtgtttcacctctgcctgtgtcccaggaacccaaggcgtcctgggcacctctgcacctcgcccactctagggacttctcatgtagagctcggcagtttgggtggattagacaaagatgaggattagagacacaccgccggctaattaaatgggctcttctcctctcctcgtcccctccccgcaacccgcagccagataggactcttcggttccctacccccactcctaggccctatgtaagtgcggatggagaaagctagttacattagcccttctgtcttagaggtaccggcacctcggggcattctcgctcttaaagatgcgttttctgaattatttctagttttacaatttctcttcggtgactgcacaggatcccttctagctcttttcctgttggagtcgctggacgtctcccaaacagctagttagtcgcctatctctggagcgcaggccttcggaattggattcagggtatgagtctagctaggggatgtttctagaagttttataaaatccatttgggcaagcgttggcattcggattttaaaaatatagacgtgcactggcattgggcaactcaaaaaaaaatgtgtctcctggcgcttgtcagtgacatgctaattacaaattttaaaacaagccacttctaagcgaaggacgcctggctgcaaccccacaactcacaccggtgcatataataaaatattagggttcaacagttggcatatgtggcaatagcaaatgtgacacctcgaagcgattatctggaagtttttccgtacttttgaaaatacacttgccgcctcatttctctgatggccgctcaatagacactgggagatggtagctgggccacccctcccaagagttcttcttgcgtgcagcgctttcatccagggcttgaattgtgttgtcaaagtttagcagacaagaggagggggcatgagaacgggagggtgtcttgaaaagtcttggaaatcggtgtattttgcaggtgtagaagtgcctaataaccatggctagtgcgcgctccccaatggcgagggtatgacagggacagctggctcagttttcagtgtgaaaacaccccctcggtggaccaaacacaacgacactgacctttcttcggggggaaccagggatgtgcctttgactgaattagccataaagacgtcttgctatgacttttgttccccacgaaagcaaagaaatattgcgtttaatatgagaa

SEQ ID NO: 32957 - DNA, 47 bp, Homo sapiens
  chr10:23491161-23491208
  hyper
acctagctagttctgcggacctctttgttccgcggcagaaagtcaaa

SEQ ID NO: 32958 - DNA, 123 bp, Homo sapiens
  chr10:23633374-23633497
  hyper
gcctggaggctgctgcgataccccagaggaaagctgcacccccgtaaataacccttcagcctcccgccgtgcccctggaccctgctcgcttcctcctctacccaggcgcggagctcagcctac

SEQ ID NO: 32959 - DNA, 896 bp, Homo sapiens
  chr10:23982384-23983280
  hyper
ctcgcagttaaaaaccgttgccactcgacggtggcaaaattgctggctgcactggagatcactgcagagcgctcctgatgcctcgatgctgacggcggatctggcgcgggctggggcgcattgcacattctgctccagccgggaggcggcgggcgggcaactccgggttggtcactcggcagccggcagaggtgcgcagaaggcgcacagaaccaggcactcagcctcaaggatgtctgggtctctgctaagggacaaacgctccaggaacaaggaacaacctctagccatcccagcaccacctaacgaaccttcgtttggctctctcgcagaaagtctcttctatttttggcccccaagacaatttcagagaaccagtaaagttgggtgacaacgtggatcgctttctagtgtaaggtcccggggaatggcaaaactcaaatgtagcctcactgatgagctcaaggaactctgcttggagttgtcacccctacgactgacctcagacccaggacccaagggcggggccctcttgcatctggaatccagcctcggccttgacccctttcgcttgttcggagtgctttcgcccagcttctggcggaggttcacgcagggaggggactcaggtggaaaaggctggcccctttgatctctttgcaggaacttagtagacaggggccccgggctggagatttgcttcgagtaggctagaggcgcccttggcgcaccgaagctggctgccttgctggaacctgccgcgggggtggaggttgaaaggactctgagctcttcttccccaagccgaactccctcctacaggagcgtggaaaccaactctcccacaccgtctatcccactcttcccccctaaacctctagcgcagctttttaaag

SEQ ID NO: 32960 - DNA, 190 bp, Homo sapiens; identical to SEQ ID NO: 10237
  chr10:23983617-23983807
  hyper

SEQ ID NO: 32961 - DNA, 728 bp, Homo sapiens
  chr10:23984047-23984775
  hyper
cgcatttcgcagctgcgctggtgtggggcatgagagcgaggtggctccaggtctccgcggagcagctgccagtgggagagcgaggagaggcgagggggcggcagcctcggcccgaagtaagtgcagcagaagtttgcgtcggttgccccgccgctcccccagcgcgagtgggaggcacatctcccctccttggataaggaaaccgaggggagacttacaagggagccttgcgcgggagagcaagtgagcgtttcgagagagggcaaggacccccccaggagggccaggccgggaggggtcccggtgcggtgatggggtgccaaaaggagaagacccccaactgggaggagggactggagaggaaccggaccccggggatctcagaaagggaaggatgtggggagagtgaaggtggaggcagtcacacctatcctggtgaccttggcgtgcccccctggagtggcgagccaggggcttatataggtgcgactaggatgttgcctcgtttttcactcggggctgcgaagagggcattgctctttctgatggctggaagacaggggcaaggagagagagaaccggccccgagacgggctggagggtggggacactggggagtttggagctgggggttcggagtgggaggtttgggtcttctgagacgctccagactctccggaggcggcagaggtcgaggcaggaggcgaatgtgacgcttagggtcgcta

SEQ ID NO: 32962 - DNA, 146 bp, Homo sapiens; identical to SEQ ID NO: 10240
  chr10:23984841-23984987
  hyper

SEQ ID NO: 32963 - DNA, 42 bp, Homo sapiens
  chr10:25241916-25241958
  hyper
gattcccagatccaccgtcccagccctcgggctaacaatctc

SEQ ID NO: 32964 - DNA, 60 bp, Homo sapiens
  chr10:25463833-25463893
  hyper
cggtgcgggtctgggcgcgcgccccgcgcctccgggcgaagcggtcgaggaggagccagt

SEQ ID NO: 32965 - DNA, 254 bp, Homo sapiens
  chr10:25464520-25464774
  hyper
tcggctccctggagccgctccaccgatggcaccatcttggcgcagaaactcgccgaggaggtgcccatggacgtggcctcttacctctacaccggggactcccaccagctgaagcgagccaactgctccggccgctacgagttggcgggcctgccggggaagtggccagccctggccagcgcgcacccctccttgcaccgggcgctggacacactgacacacgccaccaacttcctcaacgtgatgctgcagag

SEQ ID NO: 32966 - DNA, 147 bp, Homo sapiens; identical to SEQ ID NO: 3542
  chr10:25465203-25465350
  hyper

SEQ ID NO: 32967 - DNA, 204 bp, Homo sapiens; identical to SEQ ID NO: 3543
  chr10:25465351-25465555
  hyper

SEQ ID NO: 32968 - DNA, 183 bp, Homo sapiens
  chr10:26055811-26055994
  hyper
gatgccattatcagccgccaacagatggagcctatctgcgcgctgtcaatcatcccccacctgtggatcgcgcagcccagccaaaaaattaattgcttagaaatataaaatcggtggactcagatcggaaaggattaggagaaaaaaggttaagcgaggggaagaagccgtgctgtgccagag

SEQ ID NO: 32969 - DNA, 99 bp, Homo sapiens
  chr10:26223001-26223100
  hyper
ggatggcgcggatggcgcggcctccacctgcgggcagtggagagagcggcgagaggaagaatattccccgcgagccgggataaggggccccttcggctc

SEQ ID NO: 32970 - DNA, 105 bp, Homo sapiens
  chr10:26223101-26223206
  hyper
gttgacccaggtcagatcctcccgccgaccttcggcccgccctctacaggcggcccagttcttcccctgctcggctgcccctgcccgcccctcgagggagcgccc

SEQ ID NO: 32971 - DNA, 435 bp, Homo sapiens
  chr10:26223600-26224035
  hyper
gccaggaggagggaacgggaagggtgaacctgaggggtggacttgagggaagatcttgtgggtgaacccgaggagggaacgcgaggggatagtgaggggggatctcgaggagggaacgtgaggaatgaacttgaggagggaacgggaggggtgaacgtgaagtggaaacaggaggagggaacgggaagggtggcgtaaggggtgaaggaagatctttaggggtgaacttgggaaggaaacgtaaggggaggacctcgaagagtaacgaggggcgagaactgagggggccctgcagggagactggagggaggaggcgccgagtctggcgggtgtcgcctcggagacctgtggcgcgcgcgggctttgcggcgccgcccacaggtggcgctgggtcggcccgtccctgagggaactgcgttccgggtgatttctcag

SEQ ID NO: 32972 - DNA, 279 bp, Homo sapiens; identical to SEQ ID NO: 887
  chr10:26500592-26500871
  hyper

SEQ ID NO: 32973 - DNA, 136 bp, Homo sapiens
  chr10:26501026-26501162
  hyper
cgctcggccctcaagtgcccgggccggccttcgtgctccgaaacaagagacctgggagccctcgggaaacctcccccgacgctctctctcggaactcccgcaccctcctttctcaccagcccgccagttgtggcaa

SEQ ID NO: 32974 - DNA, 39 bp, Homo sapiens; identical to SEQ ID NO: 10249
  chr10:26501446-26501485
  hyper

SEQ ID NO: 32975 - DNA, 443 bp, Homo sapiens
  chr10:26503701-26504144
  hyper
gagttttcgaccacccgggctcccacagcctggaacagacttcacctagcacgctcagtgccagccttcggcaggacgctatcaacgcccgactggtttcctgctctcatcctggcgcctgggcccagttgccatagtgtggatcccatgactcctcagggaacccctggactcaggcacgcgagaagaagacagcgctttgtggagagaattgaccagggacagttatgctcgagcacacaggacttgggcctgtatgcgtccagcatgggccccaggatgtcccttctaagcgagggtcgaggggtgctcgcccagacgggatccccgggtctctgctttgttagcagctttggtggctggttcaggaggtcagagaaataaaacgacttgtgaacacaatggaaatgacaggcgctctggccaggcgcggggaaggcagc

SEQ ID NO: 32976 - DNA, 694 bp, Homo sapiens; identical to SEQ ID NO: 3546
  chr10:26504190-26504884
  hyper

SEQ ID NO: 32977 - DNA, 228 bp, Homo sapiens
  chr10:26505008-26505236
  hyper
cgcccggggcgcgagctctcgaggtcgcagtgacctcagcacctgcttggaggaaaacggcgcgggaaccccgcttccttcccctcagctggagccagacctcaaacaaaaccccaatcgatgcacacagaaaactcctctgggccacgcttcccgcctcgccgaggtctccccagtctgcccctcgctgacgctggcgcgcagcggctgtggcagcacccgggacag

SEQ ID NO: 32978 - DNA, 62 bp, Homo sapiens
  chr10:26505441-26505503
  hyper
cgctttcctgagtccgggctccgaggacccttaggtagtcccggtctcttttaaagctcccc

SEQ ID NO: 32979 - DNA, 114 bp, Homo sapiens
  chr10:26505504-26505618
  hyper
gcttccaaagggttgccacgtccctaaaccctgtctccagctcgcatacacacacgcacagacacgcacgttttctgttcctgcgtgacacccgccctcgccgctcggccccgc

SEQ ID NO: 32980 - DNA, 640 bp, Homo sapiens
  chr10:26505713-26506353
  hyper
cgacctgctccagtctccaaagccgatggcatctccgggctctggcttttggtctttcgggtcggaagatggctctggggattccgagaatcccggcacaggtaggaaggagaacgggggcctgcggcgggcgagttttgcggtggtctggggtttgcggaactacggagaagacgaaggaggtttttccacctgcaacaggaaacttcttcgggcgcttctccctgcttttgggctaagtccttgacggcccaagagctcaagacctctacagcctcttgtaccctgggaagacgcccaaatagtctcaggcccgttccacagaaggttggaagagccccccaaagaccgcggtgtctcggggacatggaattccgtggtcctggggcgctgctaagatccgggtgtctggaccctggggtgggacggagtgaccgtgaagatagaaaaaaaaaatgggaaaggtgagagatttctttatctagaaagacagtctgcgaaaaaatggatagcttcagtgtttaggaaaactcgtccaaggtaggcagggagaggaatttgcctgagccgattggcacctggaagggcagcggtgtgggcttctcctcgggaaacagataaaggaaatgagggctggccc

SEQ ID NO: 32981 - DNA, 265 bp, Homo sapiens
  chr10:26506354-26506619
  hyper
ggccgccagcctcccgcttgccttctgcacctgccggcctcaccgagtcctgagcggcccccaggaggaaggcggcccctcctaggaccccggactgattgattttcacatagaacgaaatttcacacgtccgtctgttgttctctttctgcctcgctgtctgcctgcctattcttccttgcagcgcgagcctggtgccaagtggctcagaagttcacgggcggcatcggaaacaaactgtgcggtgagtgcccagggaccgggg

SEQ ID NO: 32982 - DNA, 545 bp, Homo sapiens
  chr10:26506902-26507447
  hyper
cgtttctccatgcaacaggtaaagactcagcggggagccccggggcgcccctgcccctctctctgccccgcccaccgcggccggtgcgggtccggcgctgagagccggacaggggcgtcgaggtggcagcggaggcgggacctgccagaatcttcagataaaagcgagaaatgcgggacctgcccgctgggtccaagcccccgaacctggcctcggagctccaagagggctctgaggccgtggcgctcttcccccagcgcggcccttgggatggcgggtggccgacgatccaggcgctcgtgcgctcactgaatcgatgacggctggcttccctaggccgctggggcctcgggtgggactcagtttccaaataccgtgcccgagaattcagaattgcattttttttaggtctttagatcacgagagtgatttgtagctgcaattgcacaagagaacgattccattcacatgaaacccgcgcgccgagttttacccccgtgcacttacacaccgtctcccaaatgtacgcgcgcacacacacatgc

SEQ ID NO: 32983 - DNA, 30 bp, Homo sapiens
  chr10:26680701-26680731
  hyper
acctgctggaaagctcgcagcagggcccgc

SEQ ID NO: 32984 - DNA, 171 bp, Homo sapiens
  chr10:26680960-26681131
  hyper
gggcagactgtacccgggcaacggctccccgcagctccggctttttgcctgaagccccctgcaggcaaattccgcgtcgcgcgggcccgcgggcgcgctgcagtctccgagccccaggaagcagagacccaggtaggcaaagccaccgcctggccgcgtcagctcatgtgg

SEQ ID NO: 32985 - DNA, 741 bp, Homo sapiens
  chr10:26727076-26727817
  hyper
tcctccacccccacccgagagacagctgaactccggccgggacgcgcgtgttgccagtccagccctgcaccgcgtcccctgagggcgggctgcaggcggccgggaagccttgcacaaccggcccaaaagaggaagcccagaaagtgctgaagtaaacactttgggagaccgttgcaacataaagcggcctctcagtctttggtggaaccatcactaggccccaatcccttagtccctcttgcgtcgaggctgcaaaatggttccattcgccaggagacgctcctgagagaagggcgcgcgcggcacaggtagggggaggcgcaacgtttcccagaattaaaataaaataaaataaaataaaataaaaatcccttcaaggtggttgtgtagtaggggtgggatgggggagagaaaatcaggcgcagactcgatgagttggagaaagcagcccctaactcggagtcctttacgcatatgtttgtctgtcccactgtctctaaccaggggccttccttgcacctcggagcaaagcagctcggatagcgccacacgtctgcgcgctgcgtgggaagggcagggctgacagcacttcctccccggggcagcgacctggagcccgggtgcggcagtctgcaccgcgcgtcgctttcccggccggagtctcgccgccttcccgcgccccgcagcgccccgcagagcagtcgaggtaagtggcgctcccagtcccgggagccctgggag

SEQ ID NO: 32986 - DNA, 183 bp, Homo sapiens; identical to SEQ ID NO: 891
  chr10:26727867-26728050
  hyper

SEQ ID NO: 32987 - DNA, 763 bp, Homo sapiens
  chr10:27547569-27548332
  hyper
caacctttcctaccgcgtggagtgagttgggatgcatactggggagttgtataagagtgtctgagaaagggaaatgcagagttgaatgaaagtgtttcccgggaggggccgagtggaaagcagcaggtggccggcgcgggtggaacccagcgcgggcgcagagcgtctctggcgtgggcattcggtgcagcgagtccgcgggaatcttggatgcgcggaggtccccggaccgcggtgacggacggggctgcgatcgtggccggtgagactgggagcggagggctggggcggcgcccgagggagggcacaaacccgggaggcctcagccgacggcgcagctttacgcggccgtagggcgcccggggttgagtggtgtcctagcaacaggtgggcgccgactgcggcggggcagggcgctgcaggtgacttcggccgggggtccccaggcccaccccatgggggctctgcagccggccgcgtagatcgggaaaccggggccgctctccggccccgccgctgctgctctcgcctgcttccctttccctcccgggggccgagacctgccccctccccttttctctcccaggcccatctcgctccttcctccccgcgagaccctgcctcggccctcggttggggaccgtctgctcctcagtccctgcgcccctctctgcactaccctggacccatcacctcccggatcggttctccacttaccccgctgtttccctgtctctccttccgcgagcccatctttctcctt

SEQ ID NO: 32988 - DNA, 84 bp, Homo sapiens
  chr10:27548400-27548484
  hyper
cgaatccattcttggaaacttagggtctcagctctgacgcccccttcttgtaacgagtctggtgggggccgtcatcccacacta

SEQ ID NO: 32989 - DNA, 190 bp, Homo sapiens
  chr10:28030892-28031082
  hyper
ggtcaggggaaaggtcgccgactggacatagggaataaagcaaaggagcattgccgccccggctctctttaagctatttcctttgatcttttaggaaaagggggaaactttctaaaggagttggtggtttgtggaggaaagctgcagaacccaaaaacaccgtcgggccgtttcccgactaagggagggt

SEQ ID NO: 32990 - DNA, 324 bp, Homo sapiens
  chr10:28031314-28031638
  hyper
aaatgcaattccacccgaaacgactggtagtaacattttgacgaaaccgaatctctgttttactaagcagcgacgccgcagaacaagcagctgatgcaatcgttcaggtggaggcggctaggacggccgcccctccccggcggggcgcccggggagccgccggatcgggccaggcagagcctgccctccactcaccggcagtctgagcagctggcccacccgcaagctaccgccccccccagcatacccctcaccccgctaaactcaaacccggccccgcaggcccggggcctccccctccgggttcgccgcgggcccagccga

SEQ ID NO: 32991 - DNA, 881 bp, Homo sapiens
  chr10:28031863-28032744
  hyper
aataacccccaactccgaggtccaggcagcggagggccgaggggcagctcctggcgcccttagtctccaccaagctctttggagctgccccgacgaattgatccctcatgttttaagataggagccccttaacatgagaatgcgcgagccctggaggggcagacctgcactcccagggaactccgggccctttcccgtccacccgcccgcgttgccacgggaccccgtcacagctcaccacccccacccctccgggccgcaggcgggcagggcccccaggggagtgcgcatacccggtcctccggtgtctcaggccgaggttgtccttgaggggcgggccgtcgggaatgcccacctcggggcgggcgtgaggactgtccaggacaccgctgtagggccggccaccccgctcccgctccgaggcgcctccgtcctcaaacagcaccgcaccgctgagcttgttgaagacgatggtgttcatggtgtcggttggtagggacgcgcggcgcggccgcagagcctcggggctgggccgccgggagctccgcagcggggctcggcttctaggagaggaaggtgcatctcgttacttactggctgagagtgctcagacccctgcaggttcagggccttgaacttggccgggtcgccgggctgcggagccgaggggaggagcggcgccgccgcaactggcagggaccctgcggctctccccagttggctacacgcccccgcccctgcaggttccccggacaggtacctgccctcttccttgcctgggcgatcgatccccccaatcccttcactccccagaactacaaccgggaatcattcacccgcagaggcaaaggaaacgaattcccaaacgagcctctgggttt

SEQ ID NO: 32992 - DNA, 688 bp, Homo sapiens
  chr10:28032952-28033640
  hyper
gatttgggggattttcgtgttttctagatcgtggatggtttggttgaaacccccgcatcttctgtccgccaaggtcccccggggtgaggttgggttcaaggacaggaaaaagttaagtggcgtcaggacgaaagcaccacttctcccccttctctcccagaatcttcctatcatcccccaacgcgccccgggaagtgcatggtcctaaggtccaaggcgccaggacccaggtccccagagccctcaatcagtgccattctcttccgcagcgcgggtgtcagccgcgagctcgtagcccctcgacacccgcctctctctggggtctccggggaccctttcagaggctgtaaaggtgtcagaagcccaaggcaggaggcagcttggtcggcgcacctcccgggccactgctgccactgtcggggagagccagcagctcacctctggggtcgcggaggccctgagcctctgcctgccgcgcaccggcgtcaggagcaagtccgcgcggccgcggagccgcagagttacagccccaaggcgcgcggcggacttcgcccgccccatctcctcgcctcgcgcctcgggacagctcccgtttcctccgagcggcctcagcttcgctgccagcgccccctttgcccgtccagccgcggcatgggctgctactccactaacacacgcgcgcgcgcat

SEQ ID NO: 32993 - DNA, 388 bp, Homo sapiens
  chr10:28033700-28034088
  hyper
cgccaacgcccccgccccgcccttcggccaccgcagcagaggccacgcgtgacatttaggaccacgcgtgaccaccgcgatcaaacgacggctacggtctgtgttcgtagggaagtgaagtcagacctctgctggatgtcgtgtgtcccctaggactgcgtcctcccgcgcagacaggtacgtgcctggggtgtgcacatagcctcggtgataagtgtcaaagagaattttcgtgcttgcagcccctgttctacagtcaagactcgcgttggtgttttcttttaaaatcatgcccttagggatgtgtgttcatgctgctttatttgtacaagacacccttccccggcccggccttctccgagccaccccagcgcgtcctcctagatgc

SEQ ID NO: 32994 - DNA, 193 bp, Homo sapiens
  chr10:28034326-28034519
  hyper
cgcctcttctcaaatcacttaccccgattcactccagactgtggccggggaggtcactccctgcagaagtgtccccctcccccaacgccggcgaataattttaaagcaaaggaggcgcggccaggtgggctcccaagctccgcgcagacccttgggccagccttggccgctacccgagcgcctctccaccaga

SEQ ID NO: 32995 - DNA, 881 bp, Homo sapiens
  chr10:28034873-28035754
  hyper
ggtatccacgttcccgggcgggtggagaggaagcgtccgcgcccgcccggccgcgggggctgctgttaacccctagcagaggagccgctgccggggagccccgggcccgccgagtcctccggagccgggcgcggctcccagatccgccggccttgcagtcgtggagcagacggggcttttcccttcgcactttaggagagaaattggagaagctgccgggagcgctcggctccggctccagaagctgagaggctgcggtgcaaatcccgtgtcttagctggcccgattgccggaaatttcactgcgcgtggctaggcgggagaggccactgtgacgcgccctgtattttcctctcgattagctggagggaagttagagctccgttttgcacctacagccctggagcgtattgcgggaagtgctagtgcccaggagcctcttttctgatgtcactgggcttctggggtcctagttgtctcagtcaaagccaggcacacattcacctccggggcaagggctggtgaggctgccctcgccgctgggtatagggatgggggaaagcaaggatgggatgagttcagcccaggtggccaacccgcggtggcccaagtgcagaagaggaagcgcgcccaaagccaaggatctgcacgcagcaaaggagatggaacttagaagaatcacaagctgggacacagggcaaagagagagaatggctaccagattctctgattgatgatactttgcttcctaacattaccgcaaatataagtagcgaaagcggcggtttaggtgcaactgcaagctcagagcttctggcagcccagaagatccccaaggtgccaacacgaagctgcctgcgctctcgccgaaggccctgtggt

SEQ ID NO: 32996 - DNA, 15 bp, Homo sapiens
  chr10:28287365-28287380
  hyper
cgggaggcagagctg

SEQ ID NO: 32997 - DNA, 378 bp, Homo sapiens; identical to SEQ ID NO: 10270
  chr10:28287828-28288206
  hyper

SEQ ID NO: 32998 - DNA, 537 bp, Homo sapiens
  chr10:28957458-28957995
  hyper
ctggtttaaatttctcgagttacggggggaaggggttgcggtgggagcgagactgagaaccacagcgcgaacaggggcgcattggtaccaggatcggtacagggatgtctccagttcctatagactctagcctcggggggagtctgtccagactacaagtgtctgtgcccctgttttattttgagacaagtcggggtcgctcaatgagtcagcacagaggaggcagtgggggagacagacagcggctgggacgcgcgggactggggcgcgccttgcgcgctgggcaccggagctgcgcacgggcggcccggggcgggggccccagagagcccgggagggcgtggactcggccggggaggggcgggctcgggcgcgtctgggttggagctggatgatgtaaaacagcgcggagctccttggcgcctcggcaccattaccttcaattatcataattggtgcctctctccagcgtttgcatttcccccgagggatctctcactagttcccgttccttctcctcgccctctctcgctcact

SEQ ID NO: 32999 - DNA, 73 bp, Homo sapiens
  chr10:28958043-28958116
  hyper
cgatctttttggatgttctccctgcctaaaacggatgctaatatctcttcgattgaaccgaaatggcgctgcg

SEQ ID NO: 33000 - DNA, 141 bp, Homo sapiens
  chr10:28965689-28965830
  hyper
attgagtgtcagtctcggccagtgtcgtctcgttggcgccgggtgcttttggatttgctaattttcgttaagtgtctctagcccgctactcgtcccgcgtacccgggagaacctagcggctcctaacggatcaacagtcag

SEQ ID NO: 33001 - DNA, 124 bp, Homo sapiens; identical to SEQ ID NO: 10274
  chr10:29011038-29011162
  hyper

SEQ ID NO: 33002 - DNA, 118 bp, Homo sapiens
  chr10:29011504-29011622
  hyper
tccagctaacatcagcgctcagtctccccgcccaggtgggatcctccaagcgcctcaacgcaccgcccatcccggtgccaggtgtaaatgcgccccagcaacacgtggctctaggagc

SEQ ID NO: 33003 - DNA, 81 bp, Homo sapiens
  chr10:30026076-30026157
  hyper
gcttaccctggagccctgagaggcccctttgagtctccagaccttccagggataaataaaatctggcgacctgtgccaacg

SEQ ID NO: 33004 - DNA, 259 bp, Homo sapiens
  chr10:30348156-30348415
  hyper
aggggacgcccctcccgggctggcaggcgccctccaccccgaggctgccgggctaggcaccgcgcggggggcccaggcggggctgcgactgggggtgcagacatcccccaccgccagggtggctggaaccggagcgacgtcccagctggagaagttggggggagtgcgggaggctgcgggtgaggcccgcgaagcgccgtgggagcggccctaatggacggtgggagccaggagggttagacgccgggacttaccgagc

SEQ ID NO: 33005 - DNA, 30 bp, Homo sapiens
  chr10:31073324-31073354
  hyper
gttcagctccaaaggcggcctggttcgcag

SEQ ID NO: 33006 - DNA, 32 bp, Homo sapiens
  chr10:31074146-31074178
  hyper
cccagcgccgccccccgcggtgcaggggtggg

SEQ ID NO: 33007 - DNA, 48 bp, Homo sapiens
  chr10:31422926-31422974
  hyper
ttaagcaaggggcttcggagaaattagaaccagcgttctaaattaagg

SEQ ID NO: 33008 - DNA, 335 bp, Homo sapiens
  chr10:31608744-31609079
  hyper
cgccgcggccccggccggcgccgtcgctgtcgctcgggccccgcgactcgggccgggctgtgggcgcgcggcaggcgggctgcggcggcggcgggacggggcggccgcgggttgcgtggggtttgtgcgcgcgtgtgcgcgggcgccggctgtgcgcgccgcgggcggacagggttcggccggcggcggtaaagttgggacccgcgggccgggcgcgctcgcgtaacggggattagaggcgcgggggcgcgggtccctaagcgcccctcctccctggcgcctcccgctgcccggcccagagccccggcctggggactccgcggcgagccccgcga

SEQ ID NO: 33009 - DNA, 45 bp, Homo sapiens
  chr10:31609288-31609333
  hyper
ggtgtgcgtgcgcctcgcgcttttctctttcggtttttggggaag

SEQ ID NO: 33010 - DNA, 397 bp, Homo sapiens
  chr10:31609668-31610065
  hyper
gctttctctccctctcgtgcagcagcgaaatgtctgctgattgttattgtctggacagttcctgtggcgagaggggcgagacttgtccgcccgggggcggcgggagcgcagggagagcagcccccgcctgcgccgccccggtacctgtttgtataataatgggcggcaacggccctgccgccggccgcagcccaggctatataaggaattacacgtacatttcggaccgaggggctcgctttggttcctgcgttatttttaaaacgacttttaagagaggggcaataaatgcgtctataatgggaccgctgcagcgtcgagaaaacgaggaaatacgtgtttaggagaaaactctctcgtgctcccccagccccaccccccgcgcctgggctccctt

SEQ ID NO: 33011 - DNA, 47 bp, Homo sapiens
  chr10:33622724-33622771
  hyper
actccagacagattacggaaggtgtacaaaggcgggggagggagttt

SEQ ID NO: 33012 - DNA, 74 bp, Homo sapiens
  chr10:33623014-33623088
  hyper
cagcccaaggatcaacgtcaggagggagcccaaagacctgaaatcctcctgctctaaaccgcctgatctcattt

SEQ ID NO: 33013 - DNA, 237 bp, Homo sapiens
  chr10:33624107-33624344
  hyper
ctggccagcccacctcgcgtgctcgctctgcacccctagagggagagctgggcagctcctgcaggcgcagatcccgccgccgcgcagtgcggagcgcccgggaggtggcggctgcttctcgcaacttcaaatcccggggcccgcgccctcggcggcgaggaacgcagggtcaccccctgccactcctcatcgcgccatcctgagacctgtggcggggagcagcggggcacccctgga

SEQ ID NO: 33014 - DNA, 98 bp, Homo sapiens
  chr10:33625772-33625870
  hyper
tagggtgacccggagcgacctcggtccaggctcggagggagaggcgcctctcaggacctggcaggttgacagggaaggggaaccgggagggagcggcg

SEQ ID NO: 33015 - DNA, 158 bp, Homo sapiens
  chr10:35105055-35105213
  hyper
cataaggaatcctaacgcgaatccgtgaacagtctattccgacggcgcagagaaatctcacgcggggatccccacgatgtgccggcgcttaacgcagacgcccgaacccaggggaaggctgcgactccgcgatgagtgacatgcgggcttgagacgtt

SEQ ID NO: 33016 - DNA, 348 bp, Homo sapiens
  chr10:35929333-35929681
  hyper
cgctgcacgccaccttctcgtggcccgccaccaggcgcactaggtagcccaccgacacgaagaggtagcaggccgagaggaagataatgggccgctccgggtacttgaagcgctccatgtcgataaggaaggtggagacggtggcgaaggtggacacgaagcagagcaccgaccacaggccgatccagaagacggtgaaggcgcgctcgtcctggctgaaaaaggggttgtggcagggcagcgcgcagttagcgatctggcctgtcttgacgcggttgtagagcgggtggcgctcgctggacacgctcaccataggcgcgcggcactggcacccgggctcgcagggag

SEQ ID NO: 33017 - DNA, 335 bp, Homo sapiens
  chr10:35930004-35930339
  hyper
cagccggccttggcgcgctcgcacaccgagcggcagggcggcagcggcttcttgtagtcctctaggcagatgggcgtgtacatgctgcacaggaagaacttgagatcgggcgagcactggatctccaccagcggccagaactggtgcacctccaggcccgcctcgtcttgcgtgtcgtggttgaactgattgggcatgtaggtgtagttgtagccgatgcccttacacagcggcacggtgatctcttggcatgccagctccttggccgaggcggccgcagcgccgctagagcgctgcagcagcgccaaggcggccagcagcgaggtcacttccaa

SEQ ID NO: 33018 - DNA, 43 bp, Homo sapiens
  chr10:35931819-35931862
  hyper
gagcccagccttgggcgcgcgaggggcgcgggggacaaatgcc

SEQ ID NO: 33019 - DNA, 197 bp, Homo sapiens
  chr10:43248578-43248775
  hyper
ccgtgcctactggcccggcagtcctgcgggtcagctcaggggagtgctctggagagccctgagcccacctcctgcgccccgcccaacctcgggtccccaggcccagcctctgacacgccgctcccagcgcggccacgccacagctccgggctgcgctcccccaggcaaaggcgccgccggcgcgtccagcgcggcct

SEQ ID NO: 33020 - DNA, 30 bp, Homo sapiens
  chr10:43249043-43249073
  hyper
ctgcgcccaggtccccgacacccgccaggg

SEQ ID NO: 33021 - DNA, 636 bp, Homo sapiens
  chr10:43249483-43250119
  hyper
ttcttccttgttttccgggtctcgcgcctctgaagcgaactgggcctggaggggtgctggggatcgagggagcggcgttggtgggtgaccgagggaaaggtggggccagcccctgggcaccggtcggaggaggattacgaggcggagccgctgcctgcccgcgcctcacccgcttggtccacccaatagctccgctgtagactcgcggcggcaggagcggcgggccagatggtgattacaacccggggcgctatccctttggaacctgacccccaactccgctcagtaaccggatttccggaagccgcgacctcgaagcccccagcgtttctccaccgacggcggggccggggctcctggaagcctcggagccgcagctccagcctgcagcgcacgccttggcccccagggagcagagaggcagagtacccccctgcatccggagcatagcaagcatgccccaggctgaggacctgcgacttggtgggacttcggtgcccgcccctccgccactacagggagcagaggcggctctggaagtcggtttagtgcggagaccgcgaccggaggagcgcagaacgctcctcccagcgtcctgggctccgcaggcacaatttttaaaccagaggcgaaatc

SEQ ID NO: 33022 - DNA, 644 bp, Homo sapiens
  chr10:43250136-43250780
  hyper
cggggagggagcgtggccgcctagccgagccccttctctggctccgcccgcttttgcgccgcgaggccgcctggtgagttccagggccctgtggtcccccagccgccggcgctctcgggtgtcttttggccgcggcaggaacggagctgggcgctcagacggcgccggggtcgtttctgtgcccccgcccggtggccggagccgcagccttgccccttccccactggggcagcgcctgcctttctcgcggccggaccgcgccggagtcccaggccccaggcagcccgggccgcagctgtcatggagaagcccggcgcgtacttggggtgcccggcaggagccccggccgcctcgcgcccttcttctcacccacgactgtggccggcggcggcctctgcttcccggacaaagctggagatgctgctgcggagtcggccctgggacctgcttcttctcttggctccggggcccgcagccgtcggggcccggaagggctccccggggcgttccctcaggagcggtggccagggctgatggggcgtgtacgacgcgggaccccgagcccggcagcagccaagtatggcaaggaccagcgcgagcatctccccactgcggccggggacggcgtggggtgggagccgacc

SEQ ID NO: 33023 - DNA, 55 bp, Homo sapiens
  chr10:43250854-43250909
  hyper
cgcccaggccgccggctcggtgagcgcagagaggggcccccggtttatgccaaac

SEQ ID NO: 33024 - DNA, 32 bp, Homo sapiens
  chr10:43332719-43332751
  hyper
gggaaagttaaagaacgcgctgcagctacttc

SEQ ID NO: 33025 - DNA, 38 bp, Homo sapiens
  chr10:43361563-43361601
  hyper
agtgcccggccgccgcgagctcgcggggtgtatgcccg

SEQ ID NO: 33026 - DNA, 102 bp, Homo sapiens
  chr10:43362008-43362110
  hyper
cggtgcttgtgcacacgcgtgtgcgtgcgtgtgaacgcgtcagggtacccgaggatgcacacacgcacgtgtgagtgtgcgcgagtgcgtgctcagaggaca

SEQ ID NO: 33027 - DNA, 78 bp, Homo sapiens; identical to SEQ ID NO: 10283
  chr10:43393565-43393643
  hyper

SEQ ID NO: 33028 - DNA, 177 bp, Homo sapiens
  chr10:43428400-43428577
  hyper
ccagccctgtgctcccgcgcccccagtctcagcgggttccggcttagtccggcaccctgggggaatgctgcgctctggctggcagcacgccctgcctgcgctcgccccgtctttgctcctggtcaccatgcgtcctgcacagttaccatccgtgcccacatgctgccccggggtcgc

SEQ ID NO: 33029 - DNA, 23 bp, Homo sapiens
  chr10:43428954-43428977
  hyper
gggctatggagaccacgctcctc

SEQ ID NO: 33030 - DNA, 131 bp, Homo sapiens
  chr10:43429066-43429197
  hyper
cgccggccttcccaggccccgggagccaggaaggtctgaatggagtgatgcgcctggacttttgttcggaaatcccgcgtggagggcggcctagcggggagaggctggaaacaggcgaggaggagcagggc

SEQ ID NO: 33031 - DNA, 223 bp, Homo sapiens
  chr10:43429215-43429438
  hyper
cgggaaccgggtcttccctcgctaagaaagggaagggtctcagccttactgagaggagcccctgtggaggaagcgggcctgcacctgcggcttccctgcaccccgcacgccgtgcccaggcacttcctccccaacacaagcaaaggtagcccagctgcagccggatcctccctgagcgcagcgcaggggtcacagcccccgacagctgcgcaagtctattcct

SEQ ID NO: 33032 - DNA, 229 bp, Homo sapiens
  chr10:43571989-43572218
  hyper
gcctctgagaaatggcgcagcaagcgctccgcggagagcctggaggcggggcgcccttctctgagtccgcggggtcgcaccccgagccagtcggccagacctgcatcccgcgtagcatccctgccctctctgtgcagcggaaagggcaaaaggcagggactgcaagcgggcgcgcaccgggtaggaagagcggctctgcgtaggtgcgcggacccgggctcctgggttc

SEQ ID NO: 33033 - DNA, 284 bp, Homo sapiens
  chr10:43572495-43572779
  hyper
agccggcgcttacctcgcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaag

SEQ ID NO: 33034 - DNA, 70 bp, Homo sapiens
  chr10:43600561-43600631
  hyper
acgacgaggacgactcggcgcccaccttccccgcgggcgtcgacaccgccagcgccgtggtggagttcaa

SEQ ID NO: 33035 - DNA, 109 bp, Homo sapiens
  chr10:43697887-43697996
  hyper
ccctcttggctgaaacgactccgaccctctcggaagatgcccgcgcggcctctgcccccggggagaggggactgtgcccgatgctcaggcgccgcgcccccatcctcca

SEQ ID NO: 33036 - DNA, 30 bp, Homo sapiens
  chr10:43698279-43698309
  hyper
gccccaactcagacccgccccacagcccca

SEQ ID NO: 33037 - DNA, 626 bp, Homo sapiens
  chr10:43724462-43725088
  hyper
ggtctccataaacagcgtgggaaatgccagtgctccatgctcaggtcctctccaggaccagttctccgcctgcaccctacagcgccctcgccctggagcgcacactcctcgaagccccacggtgggctccactctccctaaacgcacaggcgcgcgtggggctcacaaggcacaggcacggctgcgctccctcccatgtgccgtgaataagcgcgcccgcgcttccgcagccctcccccgcctgcacctcacacagaccacacaccgcggaccacccctcgcccggcacatcctcctcagagcaacaggtggttctgcgcccctcaagtcgtccgggctcctacacgcccgtccccaccccttccaggctcgcaggagccactgtgctctcggcgtccgcgggccgcgccgcgaagggcagggcaggagcagaggcaggctgggcgccgcccaccgggcagtaggtgctccagcggggacgcacagagggcggcgcgcgggtcctcagggcgggcaccctcccgcacgggtcgggatgcaggggaccgtcgcacccctcccgagcccgacagcgcaagaaccctgccccgcggccttgcgcctgggcccgccgcagccctacctgg

SEQ ID NO: 33038 - DNA, 30 bp, Homo sapiens
  chr10:43725334-43725364
  hyper
aggctaggagcatggcgcggaggtggggca

SEQ ID NO: 33039 - DNA, 30 bp, Homo sapiens
  chr10:43762699-43762729
  hyper
aaggataaggcatcacgcctgtaatcccag

SEQ ID NO: 33040 - DNA, 30 bp, Homo sapiens
  chr10:43818377-43818407
  hyper
ccagtgcctttgtggcgcattaggagctaa

SEQ ID NO: 33041 - DNA, 220 bp, Homo sapiens
  chr10:43857606-43857826
  hyper
cccgttaccgaagaccgccaccatcacgacatagcgcagcacatatgggtaaacaaatggactgagactcaagcaaagaagtaacccgagacgcgcgttacacggaaaacgactgcgcaagcgcggtagagcaggggcttgcaggtgagtgggagcagccaatccacgcgaagggggtcgggaccacttccgcggaggaaagccccgcccacacctcctg

SEQ ID NO: 33042 - DNA, 33 bp, Homo sapiens
  chr10:43892849-43892882
  hyper
aggagagagtcagggcggcgggaagacatttct

SEQ ID NO: 33043 - DNA, 703 bp, Homo sapiens
  chr10:44185340-44186043
  hyper
cctagcccctcaaaccgcaagctctcccccttggggtcctcgtcgtgaacgcccttctcgtctcccgccgggctcactctttcgcattttgctgcgaaagtttactggaaataggtccattcactggtcgattcagagggacactagaaacgcgatgcccatatctaacacatcctggccttttgaagagggataaaaaataatacccactagagccccgtgcctccggagagtggggcttcgcatttgcgcgtccgaggcccggcagggagagcttctgggtcctgggggcgcgcacatccggcgcgcgctgtgtcggggagcggcgctctgggctgggccggcagagggcgctgcggggcggccgtggaacaagcaggggagagcgtcaggggacccagcacagcctgcctgctgcgccctgctgccggccgcgccctcctccgtgctgcgttctcctgctcgacgctgcgtcctcatccaacactggcaccgcgcgctccttccagggtcggaggcccacagacccctcacgttcgcttctgtcaggagtagcggcagaatttcgataatttatgtctttgatggagactgggaaggtagcctggccgctgcgcaggagagctgcgcggggtccaggaggggagcgcggagtgggagcagtcgactcgggctgcgcagtgcgtgtcggctgtcacgggac

SEQ ID NO: 33044 - DNA, 30 bp, Homo sapiens
  chr10:44788550-44788580
  hyper
gggcctcgggaggaccgcgggtgggaggtg

SEQ ID NO: 33045 - DNA, 223 bp, Homo sapiens
  chr10:44806396-44806619
  hyper
gaaggggagggtgcgcggggccggctggtccagtgcactccggcgcggccccggcacccgtgggcaccgccatgtccttcgctcagctccgccgcggctacctgcggggtctgcgcggctgcggtggccaggtgaggacgtctctgcccttgcgcggcctgcgctgtatgcttcctgcctggcccgcgcttcccctgcctgcatcacccgctgcccgcgcggc

SEQ ID NO: 33046 - DNA, 216 bp, Homo sapiens
  chr10:44879180-44879396
  hyper
ccagcttctccagcccgactcagctgcgctggtcctgctcacaccagcgcacagtccaagccagctaggacgccggggccacgtctgcaccaacccagccaagggctcgaggcgcgctgggcctgcacagcccgcggctgcaagagcactcagagtgtccttcaactctttgcaggaaacttcacagccaaggaagctcagcggcctgagccacag

SEQ ID NO: 33047 - DNA, 604 bp, Homo sapiens
  chr10:44879851-44880455
  hyper
ggagaggatcggcttcgcagggagcggaggctgcgcggctgcatcggacctcacagcctcaagtcgcggcatgaggcgaactttgcaaagcgcgctctcgccatgcaccgcccgacctccagcactgtgcgcagcaggacctcggagcccattcgcctgtggaaaccgagcccgcagcgggaaggcagtgggtggagggtgggcaggcaggggtctggggtccgcggctccccaccctcgcgccttcccgcgccagtcccgaacgctctcttggggcgttcctgcccagttgtcccggctgacctcgctctgcagccagcttgaggtcaggcggtcgctctctgcaggtcacaaaccctcggcgcaaaagtagggctttgaacgcgacaccgcaccagagcgcccagctaagcgagctgcctccacccccactgtgtcgggcggcgcaaactgcgggcgcaggcagaggagccgcggctctgcgccgggcgggagccgaagcccagagcctcgccagggcctccccgccgagcgcacttaccgtcgctgaggcagagcgcggtcagcacgaggaccagcacgaccacgaccttggcgttcatgg

SEQ ID NO: 33048 - DNA, 26 bp, Homo sapiens
  chr10:44880519-44880545
  hyper
cggctgacggagagtgaaagtgcggc

SEQ ID NO: 33049 - DNA, 99 bp, Homo sapiens
  chr10:44880546-44880645
  hyper
gtgggaggcgcgcgccgggcgctttagaggggagagccaggcggggcggggcggggcgcgcggtgaggggcgggcccggagccgagtgctggccgtggc

SEQ ID NO: 33050 - DNA, 357 bp, Homo sapiens
  chr10:44880673-44881030
  hyper
cggcaccccccacccatccccttcgcccctcctccgctccctctgtgctcccgaggcgcagtgcgctccggcctttgaccttctcaggctccgctgggccccgcaccgctggcccggtctgcagtgaggtccgcagcctgagcgacgccggctggagggccgcttattgtccctgtgacagggccccactggagagactgaggaccttaggcgtaaagtggggcgcgcgtggaaagctgcgggacggggcctttcgatggcgggaactgaatgagaaccaatgaaaagcaaacaagttagtcccgggcggagggcctgctggcggtggcggcccaaggcagccgagggggtcctgct

SEQ ID NO: 33051 - DNA, 159 bp, Homo sapiens; identical to SEQ ID NO: 10295
  chr10:49731642-49731801
  hyper

SEQ ID NO: 33052 - DNA, 86 bp, Homo sapiens
  chr10:49732002-49732088
  hyper
cggccctggacaccccgtggcgagtccccgaggcggggctggcagcctctggcggcggccgcagggagcggggcgcacgtgcgcgc

SEQ ID NO: 33053 - DNA, 160 bp, Homo sapiens; identical to SEQ ID NO: 3561
  chr10:49732155-49732315
  hyper

SEQ ID NO: 33054 - DNA, 239 bp, Homo sapiens
  chr10:49732316-49732555
  hyper
cagcgggcatgccggcctccgggcagaccctgctaatcaataggagaacgcgcagatcgcgaccgccgcgccactgcccgcttttatctccgcgcgccggggcggccccgcgctgctccctgccctcgccggcgccctccccacggcccgttactctcccggggtgccgggccgcgcgctctcccaggagccgccagggggcgccacggagccggggctgcctccgcctccctgggagc

SEQ ID NO: 33055 - DNA, 432 bp, Homo sapiens
  chr10:50323255-50323687
  hyper
cgcgctcacgggaggcgtcctctgaaccttggggaggcgccgctgcgcccgccagaccctcggcgagcccaccggagcgcgctggcgacagtgacagcgccgccccccgcccgcgcccggaggtggcagggcctccccaccaggcccggagccccggcctccccggcgcggccgcccggcccccacccttcccgctcccgcctggccccgccgcgcttacccggagccggagcccgcgccagcagcgcggccgccgccagtgccagcagccgcatctccccgccgccgcccggcgctgtgacgcgggagagcgccgccgcctggcccggccgccgccagcccgccccgggcccgcgctcgcgcccgcccccggcccgccccttgggccgcctgccacgcggggccggggctgctgggtcccgaggcccgcac

SEQ ID NO: 33056 - DNA, 228 bp, Homo sapiens
  chr10:50603003-50603231
  hyper
gtgagagcagcccagcgacgggcccttgtaggctcgtgcagctcgtgatctgggccaggacgcggcgggtccactcgcctttgctttctgggatgtttgcagaagcaccgtgaaagattgatgcggccccctgggttgcggagccccaattagaggcgtgacaccagcatctgtgctgggaggattcggccggtccccgcggcacgcctagcccggggcgtcctggcc

SEQ ID NO: 33057 - DNA, 333 bp, Homo sapiens
  chr10:50603837-50604170
  hyper
cagaagccctgcacccgggccaccgcagccaggtccggctagcgcgcaaggccatctgcgagctgcagctcaggccaggaaggcagccgagccccaaggcccggcgctcggggcccggcgagtgggtcaggagccgagcatacctcggcgggcggcggtcgaggaggtcggagcgtgaccgcctccgatccgcaagccctgctcggctggcggcgggcggggctcggcgcggctggcgcccgcaggaccaaagaagtgactcgggaagtggccagatgtcttgctgtctgtctgcagcgcgcgccgccgctcagcactcgcctttataatctc

SEQ ID NO: 33058 - DNA, 309 bp, Homo sapiens
  chr10:50604532-50604841
  hyper
gggactctttgcacacggcttccctttccaaacgatcgtacaaaaggaaagtttgattttgttctcagcaaggggtccctgaatttatgttcgcttctcgatgcaaatgatatgcggtgggaccctttgcaattacttttaaaatgcatccgaggcagacactcaacggagagagaccgcccttctctctgcctgggtgaaaattaaactctaaagtaccgggctgaaattttcaagtcaggggcgcgggattggatcaaatcacataaactgcaaaaaaagcaagtctaatggcgcataattggttct

SEQ ID NO: 33059 - DNA, 1620 bp, Homo sapiens
  chr10:50605142-50606762
  hyper
aacattctaatgctgcgttagggagccttggcgaggtggtgggtcgggtccctgcacggcccgggatacagccttgatcttaaagacgcagcgctttggaaacaaaaggcctggcaggcccgccgctggacaccagcgctgggcaaggagcatcgagctgcaggacagagcgctgggtcccggccgccgttgacgcccctccgaaaacagccgggaggaagaccagtcccgctccggtcgaggcaagtcaggatctattccagtgaagcggcccttcctgggctcagtcgctccagagcagagtctgctctgcctcggggaaagaatcacaggaaacttccgctcgtttcagagcggagagagctcggggcgccatttccgccagggccaccgactccgagagtccaggcagccggcccgggaggagcggctagcaggtcccgaaggcgggtgaggtggcaggcaggggccggcagggcagccgagggcctttcctacgtcatgccaagagggctgggagcccctagagctgatcctcccttagcccaggtcaagagactggctcgcgcgcgctgtctctctccctgtctccctcagagggcccctgctctctggagctcttgacaagagcccgaggctcctcttgccgcctaggtctgccgaaagtcccctcgggttccctcctgccctaggcagcagttccctgcctgtgcgctttgggaacccggtggccgtgaagtgaggtgcggacagcttctgggccgcctcggccaagatgctcaggcgcacctgggggtgtgtgcgggaaccctcagcggcagcagcccagcccggggtgcagtgttggccccagaaaccaatgaggtccaaacgccagtctcagttccccatccctgacatcgaccgaggcaagttcctattaaggcccagagatgaccccgggacgagacaggctcatccggcgcggatgagacaggctcagacctgcgcggtctgaggacggcgcgctcgccgagcaacccggcaggtcagaaccctggacagcggcgccggtttccgcacccccacccacccccggctgctgcggagaaagaagccgtaccgggggcccagccggggcccctcgctgctcaggggtgggatccgcccggccggaccccaggcgtccggggaccgaccccaatcctctcccagtccaaacctgcgaaagttactccggacatgcgctcagcgctggcaacagagacaaaactcccttctccgcagtaccacgcgccgctcctacccggccgctgcagccggaaaccatctcgcggcccccgaggagagtccggccgcctcactgactagataaccagccgagctccctcaacacacccacctcgcgggggctctaagccggcttgggaccctcggcctcgcctcgcccggcgctcctctcccggagccgctaggctgggctccttcccgttggcaaaacagcgagtaaacaaacaaccaaacaaccttagaaacgaaaggctgcaccaaactttgatgacgccagccccctttttttccgaatgtctcgacacccgggagaaggtgactaataggtgttcgctacggtccccctccccc

SEQ ID NO: 33060 - DNA, 30 bp, Homo sapiens
  chr10:50815067-50815097
  hyper
tcagatagaggagtccggaaaggaatttac

SEQ ID NO: 33061 - DNA, 574 bp, Homo sapiens
  chr10:50817080-50817654
  hyper
ctggagcctctctcccgccagtccgcccactggaacacgggttccatgtgccatccagggtcaacgccgctctggggacgcgtcaggcccagcgcacagcctgggcagctcagcctgtcagctgagcacgggcgcctcaaggggtgcggccctctcagaaggaaggtgagtctccctggagcccctgacgacagcgaagcggctgggcgctctccggggagtgggcgcggcacccaagaagggtttcttacagttccaagagaggaccccagccacagtcactccagagcccacccggggcttggaggaggctctggaaaatgagggatgggggagtgtgcagaacagggggcggaggctggcaggagccgagggagggcttggtcgggtgcgaagagtgcctgggaggagttagagtggggagggggtgcggcggcggggagagaagaggcggagctgggggaccagaccgctaaaggagaaagggggattccaggcaaggggaatgtggccaggcagtgcgggagggcggcagcggccaggctaatattcgcgaccccgactggggcgcggc

SEQ ID NO: 33062 - DNA, 15 bp, Homo sapiens
  chr10:50817858-50817873
  hyper
tccacaatccagctg

SEQ ID NO: 33063 - DNA, 480 bp, Homo sapiens
  chr10:50818152-50818632
  hyper
cgagagcccttcctgggcctccagccctggagcatctggagagcggacccctgcccggccacgccccgcccccggcccccgccccgccgacgtcgcattagcatgagcgacgtaagtggcccgggcaccactcgggggctgggactcgccgcgtcacagccccgagtggaagggaaaaaaaaagaggaggcggcggaggaggcaagagccgacgcgaggggaggggagcgcagcggcggggctaacgggcgggcaagcgggcgggcggcaacagcatgtccctcggccagcgcgggcggcctcttagcgcggcgggggctgctctgggcgcgccccgggcgaagtgcgcccagtctccggccccggcccctcggcgcgcccgacttcccggccgcccctgagcccagcagccgcgggtcccgggatcggctaagagtagctgcaacgcctcgccggacggagtcctttcctttcccggga

SEQ ID NO: 33064 - DNA, 18 bp, Homo sapiens
  chr10:50818986-50819004
  hyper
cggcgagggccccacccg

SEQ ID NO: 33065 - DNA, 178 bp, Homo sapiens
  chr10:50819747-50819925
  hyper
cggcttccgagtgggagatgggcatggcctggctgccggccttcgtgcctcatgtgctgggcgtctacctcaccgtgcgcctggcggcgcgctacccacacctgcagtggctgtacggcgcgcttgggctggctgtgatcggcgccagctcgtgcatcgtgcccgcctgccgctcctt

SEQ ID NO: 33066 - DNA, 127 bp, Homo sapiens
  chr10:50821077-50821204
  hyper
cgccctttgaggacacgccccacaccagcctcagagctctgaggtgcctgggctgagcttcccttcagaccagaatcccgccccgttgaggctttgagaaaggagtaggagccgagcattccggcag

SEQ ID NO: 33067 - DNA, 229 bp, Homo sapiens
  chr10:50821472-50821701
  hyper
agagcctcaagccagcgttcgcgcaacactccatgtcccgaagaccgtagtctgatgatcgaggcagagtcttcccatcatagcgtgaagaggcggctggtcagggtcgcctgtgtgttagctgcgcctgtgagggtctgctctgctgttgtgcgcatgtctgtcctcgatctgcgagtcgggctgtgtgtgcctgggcggagtctgcctttgtcggtctgtctgtgct

SEQ ID NO: 33068 - DNA, 52 bp, Homo sapiens; identical to SEQ ID NO: 10308
  chr10:50822142-50822194
  hyper

SEQ ID NO: 33069 - DNA, 67 bp, Homo sapiens
  chr10:50822825-50822892
  hyper
tccttgggtctgacccgactcgcctgaattgctggttggcaaccgcttctcccgggagcagggggtg

SEQ ID NO: 33070 - DNA, 160 bp, Homo sapiens
  chr10:50887456-50887616
  hyper
gattcaaccagataacgcagggaaaatgcttcgcacgccgcctgacacgaacttactgtgcctggctgctgctgttatttatcactaacacttgccacaccagctcaaacgcgcgtatttgcggaccaggcgctgagggtcacgtgagcagcttggggcc

SEQ ID NO: 33071 - DNA, 137 bp, Homo sapiens
  chr10:50887617-50887754
  hyper
ggaggatcccctagcgccaccccggccccgcccggcgcgtagcgacgcccacgcgcccgggccggaagagaggttgcttagcagcgtgtgtttctcccttgcctctgcggcggcggaggcctggcgatgcccaagaa

SEQ ID NO: 33072 - DNA, 47 bp, Homo sapiens
  chr10:50887789-50887836
  hyper
cggcaggcctaccggtggagcaccacaccttccgcctgcagggcctg

SEQ ID NO: 33073 - DNA, 516 bp, Homo sapiens
  chr10:50969896-50970412
  hyper
ccgccaggtgcacagcgctgaccctccccatcccccgcacagccctcgcagctccgggccctcccctggccacggaaggcgcggggcagtctgaagtcctcgggctggagaaacccaccgcgagcacccgctcctctgcgcaggaccctggactagccgggtggtacgcgcgcgatgggctgggggtcccgggggaggccacggccagccaaggtcagagccaaggtcacagtctgttcctcctccccctccccccggcggggccagactcagggctgcgggcagcggcgccccaggacccaggagagaggagctgtggggccggtccccaggacggcaggagaagcagcggcgcagggaccgggagggggcgggccgccgcgctcaccgggcgggcgggccgggtccgcgctgcagcgaggtccggaggctgcaggtcagggggctgcgcggaaggggtgcgcgcgcgccgtgccaattacctgggtcacgtgacgcagccgcccacgggcgcgc

SEQ ID NO: 33074 - DNA, 30 bp, Homo sapiens
  chr10:50976382-50976412
  hyper
ccgtcccctcacaggcggctgcacgctccg

SEQ ID NO: 33075 - DNA, 5 bp, Homo sapiens
  chr10:50977033-50977038
  hyper
cgctg

SEQ ID NO: 33076 - DNA, 88 bp, Homo sapiens; identical to SEQ ID NO: 10312
  chr10:52177735-52177823
  hyper

SEQ ID NO: 33077 - DNA, 135 bp, Homo sapiens
  chr10:52178170-52178305
  hyper
gggtgtggcccggcagcagagggtttttggaatgcagggtgtggccctctaccacggcaaaaaagaaatgagtcagcccgttcagtcctaaccaataagcatgttcagtgtcggttaaggcggaactttcctttc

SEQ ID NO: 33078 - DNA, 160 bp, Homo sapiens
  chr10:52750888-52751048
  hyper
gcctctcctctccatcgcttttagacttctcatcctcccctcggtgcttttagtccattcagcagaagcggatcgaagcaggaggctccccgcgccgcattaggggcgcactccgccgcgctcgagtacttagcgcccattcactcgctcacccgcgctc

SEQ ID NO: 33079 - DNA, 179 bp, Homo sapiens
  chr10:52751383-52751562
  hyper
gaagttcaccaagtccgaaaggtaggcgcggaggccgtgggcccgggcgctcgtcccggcccgcggcgcagaggctgggggctctggccgcggcggcgggggcgggtcggcccagggcgccccctgctcgctgcggcgcgcggagtgggggtggccccgcggcccgggaatgggaagtg

SEQ ID NO: 33080 - DNA, 41 bp, Homo sapiens
  chr10:52751795-52751836
  hyper
tggagagcttcccagcggcgaccccccggactcaggccact

SEQ ID NO: 33081 - DNA, 88 bp, Homo sapiens; identical to SEQ ID NO: 10315
  chr10:52833568-52833656
  hyper

SEQ ID NO: 33082 - DNA, 113 bp, Homo sapiens
  chr10:52833864-52833977
  hyper
gtagcgctcccgcctcgctccacccgcacacccccggcgcgcctcggaggcttatcaggctccccgcacgccccgcaagcttccttgggcgcccggcgcgagggactctgaga

SEQ ID NO: 33083 - DNA, 395 bp, Homo sapiens
  chr10:52834361-52834756
  hyper
gcgggatttacagtacgcgctccaggagaagatcgaggagctgaggcagcgggatgctctcatcgacgagctggagctggagttggatcagaaggacgaactgatccagaagctgcagaacgagctggacaagtaccgctcggtgatccgaccagccacccagcaggcgcagaagcagagcgcgagcaccttgcagggcgagccgcgcaccaagcggcaggcgatctccgccgagcccaccgccttcgacatccaggatctcagccatgtgaccctgcccttctaccccaagagcccacagtaagcaggggtgacgcgccgggtccatgtggcgccctggcgatggggagctgcgggtctctgtattgtctgtcggcccccgcccctcccgcttg

SEQ ID NO: 33084 - DNA, 389 bp, Homo sapiens
  chr10:54068221-54068610
  hyper
gcctttcccctcacccgcctctaattaagtcagaaaggccctgtatttatttgcccatgaactgacacagcaaaccaacagcagccattgtagtgtgaatggatttgcgaccaggcaaggggcttcagccgggattacccgccccgcagccggatgaatgtgctgagcacaaagtctgctcaaagccgagcaaacggactatttgtgaaaatgccatcctggctcaagtctgattaagaccgggggtccccaggccgtttgatcttcgctcatcaaagagagtctttaaacaagcttcattttacactactgtatgctagcgacgggttgtgacacccaagtgcagccaccgtgagcacccggcactgggagcgcgtgaacaataatgg

SEQ ID NO: 33085 - DNA, 752 bp, Homo sapiens
  chr10:54072904-54073656
  hyper
caccaatttcaatgacgtcaaattcactttctaattcactttcagctcttcttctcctcaaggttgtttcttttctccctagaaagggtattgcgtggtcccgtgcaaggtaagacttgggagcaaaccctgcattcggaagcgttgcgatgtgatatactaatgaggaagtcaggcgctaagccctaagggtttcttatttctccacattagcccaccactgagaagggagaaccggggaaaggcgactgacctggcacgttggaccctgtccgctttggtcccggccactttgatctcacgcgtctgcctaatcaagttcatctaccgccgcgattgccctgattcaaagaacaacattaaatggtttgattatcggatggtcatttccctcttccctccacccctgatctaatttctaaacgccagtctctcgcctccctctctaaacttcccatcaaaagagaattagctcttcttccttcttaccctcgtttgatgtgcaaatttccttctctttgcacatttttctcgcagtggcggggggaggtgggggaggagggcaactgaaggacctcaaagccggggatctaactcagatctgcaaactgcgactctaaagggttaatgagcaacttgcacccgccacctggccctctcagaggcgtcttgctagagccattgaattacagaccggtttgtatttaatactgaatatgacttgtgtgcacagtcagcgagtattggcataa

SEQ ID NO: 33086 - DNA, 66 bp, Homo sapiens
  chr10:54074759-54074825
  hyper
cgtgcaaatctgtctcgcctgcaggaagcgccgaaaacgctgcatgcgtcacgctatgtgctgccc

SEQ ID NO: 33087 - DNA, 1085 bp, Homo sapiens
  chr10:57387425-57388510
  hyper
ctccttcagcagcagcggacgtagggatcccgagcagccacggagcttaggtcccgcagagagctcctgccaagcgcttctctctcgactagttaccaattgagaaaaaaaagggtcagagacacacaaggatggtgatcaaaatccagtgtcaggcaccagggtcccagaaggttccggctcctcttctgcgccttacccagctcttttcgtctggcaaagggtcacccagcgagcccccagcagcagatccttcccttttgctcctcctgatagcgccaatcttcgccgccactgccacactgcgcgcccgctatccactcaccgcacagcgagaaggcctggcggagatagcgcggggggaggagggtggattaaaaggatagatttttggaagggtaagggagaaaaactttgatgttgtaaccacacacaggactgagaagaaaccaaaacaagttgcagcttcaggagcggggaggacgcttttcggggtaaaaaaaaaatcaccccctaccaaaatcagggggaggaagctccctgctccttgagcgatcacccagagcacctcgcaatctctgatcttcgaacccactgaaaaagcacagggcatggggagtcctgttggttcatgcccagggtacgaataccaaaagcgcctcccgctggagaggctgcggggaactcgaggcaaagacagaggcaaacgcaacgctgggaagagtgaggggagtccgagctgccgcctgcaaaagcagagacgcgtcgcccttcgggcaaagtgactgctacaaagtccgttccctcctgcgcagggacagagacatttaaaggcctgaatggacgtcagcaccagtcgagctcgctgggtgagcgccaggtctccccgccccacggattgtagcgcgcacagggcgatctgctgctcgcgaggtagagtggcttacttggggagaaaacagagctggtggcgctgcggagtgtcaaaccctggagcccatcgtcaagacgttatactggtggcagttctgctgtgagtgcacttgccgaattaaaaagagccagagctgcgtggagaggggtct

SEQ ID NO: 33088 - DNA, 46 bp, Homo sapiens; identical to SEQ ID NO: 10322
  chr10:57389890-57389936
  hyper

SEQ ID NO: 33089 - DNA, 386 bp, Homo sapiens
  chr10:57390290-57390676
  hyper
tcaggggagcatagtcggaaatcttcggttgtattcctgactcagcctgggtgcggagcgagcgcggacaggaaccgagatgcaaaggcggacgcaaccagcgcacccgcagacggcgcgcggcaagaaccaccttctagccctgagcctgcggtgccgggcgggctcaggaggctagtggggtattgtgatcactgggacatcaggatgaaggggtcactccaatcccttggagatcagattctcggggactccatggccagacccgaacggcgcccttcacatggtgggtggagagggtactccttggccgaattgacccctccctgtcccgcagggtcagccccgcgcccacccacacatccagtctccgggaacaaaactct

SEQ ID NO: 33090 - DNA, 194 bp, Homo sapiens
  chr10:57391166-57391360
  hyper
gaactgcagctggtgcgccactgccttccccgcgcggtgcccaagagcgccagtagaaggaggaggtcggcacacctgctgttcctgcttccttcccaggaggccgattctctccatcccaactcgctccgtggctcctgcttgctcctgttccccctcccgactccccgggtaacagtcgaccttagggtcac

SEQ ID NO: 33091 - DNA, 109 bp, Homo sapiens
  chr10:60272038-60272147
  hyper
ggtatgaactacatgcgagccacgtccatggcgatgcctgcgaaagacgggcatgatttcttctccaagccttctttttcctcttcctcacgttcgagcttgtggaacc

SEQ ID NO: 33092 - DNA, 272 bp, Homo sapiens
  chr10:60272562-60272834
  hyper
tgtaggggcggcgggcggggagggggcgccgagccctgcggatggaggcgcgggcagcgcggcgcgctcattccgcgcgggcgttgctggcggggggcggcgcagccactggacccggaccggggccgcgacccggggtggcgggtggcgtgggcggcgcccggggctgggatgcgccgggggctcagtggcggcggcggcgttggcggtggcgtcggcggctgcagggggacgagctagcgccgcggcgctgggagccagttgagcccggc

SEQ ID NO: 33093 - DNA, 384 bp, Homo sapiens
  chr10:60272895-60273279
  hyper
cgcccaccatggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaaggtaggcatccctcgtgttctcggactctccgactgagcctctaactccttttcggacatccccaccgcgcgctccggcgcccgctactccagcctacggccggccggtttagctccaggcccgctcccccgcggagccggaggacacccagggactggagacttcgcgggactccccacccttcca

SEQ ID NO: 33094 - DNA, 352 bp, Homo sapiens
  chr10:60936378-60936730
  hyper
gcgccgggtcctgctcggtctctcagagccgcacactccgcggagctcctgccacagccgtcgccttcgcggcggctctccagccccgcgcctcagcctcggcgccgcatcaccgcgtcccaggcctccttccctccctctgccactccccctccctttcccgctcttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacggtaagagcggc

SEQ ID NO: 33095 - DNA, 62 bp, Homo sapiens
  chr10:60937041-60937103
  hyper
gcagtccggatttcctgggtctctgggcactgaaggggaaatgccctcgggatgtttctagc

SEQ ID NO: 33096 - DNA, 36 bp, Homo sapiens
  chr10:61122490-61122526
  hyper
tggagagttaccacacgaccccgacctcgccagccc

SEQ ID NO: 33097 - DNA, 82 bp, Homo sapiens
  chr10:61469912-61469994
  hyper
gcgtttggggggagccggggtgtacaaatgaatgcgagtgttccttggtctccctggctcccggggccgctggcgccctcct

SEQ ID NO: 33098 - DNA, 30 bp, Homo sapiens
  chr10:62702560-62702590
  hyper
ttactatctgctgctcgtcagaggacttat

SEQ ID NO: 33099 - DNA, 863 bp, Homo sapiens
  chr10:63212027-63212890
  hyper
gcaagataggcaggccgttagccaagccccaaagccagcaaacccagacacctgaagctggcgctgtgctagagaacgcgcgacgcgcgcggctggagggaagggaagcggatgaaaccacagacgtgcagcgagggtcttctcgtcttaggagggtggccagtgtgctcagctcttgcgaaggtcgctgatgcccagcgaaggacattcccacatgtgcacgcacgcagagtaacccgcgcacactcacacaccccagtttcagaaggcacactacatggcaacctccttgtcccaagactcccctatttgcgggcacattcagcaaaatagaccagcgcttcctctctttactcatcttccaagtttccaaacctgagactgggtgactcttgcctaggctcacagatcgagccttcccagtgttgcactgggaccctagggtggccctggggtgcccaagagatgcgcaagcatctcgcgccttccaagcgatcagcgaggaaaaacggggtccaaattcgagtagaatctgcgggttgcgggaagatggcctgcgagtgcggtgggggacaataccctagggccccgtgcgccctcgctttcccggggcactctcaccatttgtagcctctgccgcgcttgaacttgagggtgagcgcagtctccaggaagagcaagaggttgagcagcgcaagcagccagtaccgcggctccttcttcacctcggtcactcgccagaccccgaccagcgagtgcagcaggaacagcaaccgagtggccagggcgttaaggaagaccagtccctccatgctggccggagcactctgcctacgtccccttgcctgcgcccccaggaccct

SEQ ID NO: 33100 - DNA, 92 bp, Homo sapiens; identical to SEQ ID NO: 10332
  chr10:63213120-63213212
  hyper

SEQ ID NO: 33101 - DNA, 520 bp, Homo sapiens
  chr10:64133867-64134387
  hyper
agtgtaatcctgagtcggatcgggctcccggctgggtggcgggggggcagatgatgctcccgccagctgggcagagcaagggtgttccccgcggaggtggcagccctgggccgcggcgttccggaacccccgcacccacggcgcggtgccccacggtgcccgcgagcgccgcccccgctggctagccgcgcctcgctccgccctggacgccgccggtcccggcgcggaggtgcggcggggagtgggagccggcccggctcagtctgatttacggctctgctgaaaaccgcttcgctcccgcagcatcagcaccggaggcggcggctgcagcagcagcagcaacaagtcgggtaagaggcggccgccggccatctgcgcccgcggctcggcggaggggacctgccggggtggccggggctggggagggggtccccgagcccgcagcatggcggggagttgggagagccggcttcccggcccccaccagcaggaactcatgtgcacacgaatccactctggc

SEQ ID NO: 33102 - DNA, 478 bp, Homo sapiens
  chr10:64574590-64575068
  hyper
tgcctgggggttccacggctgaggcaccaagacaaacaccacccaagaatcgacctatcccagtcagtgccgtgatggtgccaaaccgagaggagagcccgagaagggggtgggtgatttcccggctgctccccatccccggcgccttgtgcctttttctccctccctctcccgctgcgcttcagccgagggctgctggagcgaatgggggatgtagaggaaggagtccgtaggtttccgtgccctcccaatcttctccgcctttcccgacagccgcgcgtccccgcctcagcccaaggccagtggcccggcctcgaggaaggcgcgggggccgcgagagacgactttccacagcatcgccaaggaaaccggcgtcgccggtgcccccgcgggcctccctcggcagtccgggggctgcttcccgccgttgcgcgccctcctccaccacccactcgctgcctccgccggccggagcccc

SEQ ID NO: 33103 - DNA, 685 bp, Homo sapiens
  chr10:64575127-64575812
  hyper
cgcaagaagggagcgctccgagattttcccggggtcggctctgcccaggagggagctaccgacgctttcccctggcgcttctccgccgctcggctctccaggcgcgcagctctccccgagagccccgaactttaccgtcactttgcccctgccccgggagaggggaggtcgaagtgctgccggccagagggcctacgcaagcctcgaaacccggggggacgcctcttccacccccatccctgcgctcgcccggggctgggcgcgccggggcgcacgcacgccggtttgctggcgacctggcgcatctgcccgcgcgccctggtctcagctgtcgcaggttcctcctgcacccacttccagtcttcaaagccagtgcagtcagcaccgtccacctggagccccaatcctctcctgcgattcccgcacacccactgcaccccatccaccacctccgggccgcgcaggtccgggcctgcgaagacacgcggcttacctccggccactccgttcatctggtcaaaggggcctcccagttcggcattgggaaagatggtcaccgacgtggcggcgaggtcctccaccgggtagatgttgtcagacagctggtgcacaaaaccactgagagttactgggattttgtctacggccttggcggtcatcatttgctcctcgcacaacctggaga

SEQ ID NO: 33104 - DNA, 342 bp, Homo sapiens; identical to SEQ ID NO: 3567
  chr10:64578287-64578629
  hyper

SEQ ID NO: 33105 - DNA, 15 bp, Homo sapiens
  chr10:64578651-64578666
  hyper
cgagggggagctcct

SEQ ID NO: 33106 - DNA, 287 bp, Homo sapiens
  chr10:70320197-70320484
  hyper
tggcccctctactcccgggtctgccccccgggacacccctctgcctcgcccaagtcatgcagccctacctgcctctccactgtggacctttgggaaccgactcctcacctcgggggctcgggccttgactgtgctgggagccggtaggcgtcctccgcgacccgcccgcgcccctcgcgcccgccggggccccgggctccaaagttgtggggaccggcgcgagttggaaagtttgcccgagggctggtgcaggcttggagctgggggccgtgcgctgccctgggaat

SEQ ID NO: 33107 - DNA, 71 bp, Homo sapiens
  chr10:70320857-70320928
  hyper
ggctgaatataccagcggttggttccctggcccctttggggagttggaggtcggggcgcctcggggtgagg

SEQ ID NO: 33108 - DNA, 42 bp, Homo sapiens
  chr10:71267763-71267805
  hyper
gcaacgcatgcagagcgtggtgtcggtcgacccctgctggag

SEQ ID NO: 33109 - DNA, 41 bp, Homo sapiens
  chr10:71327725-71327766
  hyper
cgcctcactcccagacgcatctctcgcgctggatctacgtg

SEQ ID NO: 33110 - DNA, 229 bp, Homo sapiens
  chr10:71328773-71329002
  hyper
gcattccaatggccccgggacgcttttgtcctccgactgaggccggctgggggtggggtgggatgggggcagggcaccataaatctacctgcttgtgtgccagcgcggcttgactggaaggaggagcaagattcatgtgcggtttttctggaagccagtcttgggctcagacaaaagcagaagaaggggggagagccattcgacgagagggtctttcctgcccgggttt

SEQ ID NO: 33111 - DNA, 183 bp, Homo sapiens
  chr10:71329076-71329259
  hyper
cgggctccgggcagagaccgctagcagcgcggtttaaaaagccccaggactcaaaacgccgcaagaagtggaaggcggggacggtggtgcagagctagttggacaggccacccctagaaatgtttccgagcccttcttgctcaggggttctttggaaagaggcatggacgaggtttcccactc

SEQ ID NO: 33112 - DNA, 30 bp, Homo sapiens
  chr10:71329503-71329533
  hyper
tggctccttaatgagcgccctcaaaagcag

SEQ ID NO: 33113 - DNA, 299 bp, Homo sapiens
  chr10:71331434-71331733
  hyper
taaaaaaaaaagatgcgcggtgctccaggcacctgcagcgcagctcacgtttcaggcgcagttcgcagggaggctggggagatgctccctggccgggctagcgctttcccagttcacagcctggtcttccgccccgggagggcaatggctccgaaaagtgcacgaggagaaggcagagggtcgccttcgtggctttaaggcagagtgaggcgccctgaaatcccggacctgattgggagtagagcagatcggcagcgtctttggagcaaggcaaggggagtaagcgctgagagaccaaa

SEQ ID NO: 33114 - DNA, 517 bp, Homo sapiens
  chr10:71331951-71332468
  hyper
tgcgttggcgcggctcggagggccggggaatgaacccagcctgccgcccccgtggaggcctgggccggccaggggtcagccagggagaagcagaaggaacaagtgcttttgagggccgccgccgtcggccaccctctacggctcccggctccctccctctcccttacccttagcacccacagcccagcgacagacaggtcctttcacagaaaatctgagaaagccagactgcctgggctcaagcaggcggaaaaggtggcccccagcagcccgggtcgctcctccagcgacgcggcgggactcaggctgccagcctgggagactggggagtagagggacccccagtccccgggggaaccgcctgggctgcccagctccccgcagtgcggcgccggcggctccagcgcgtacaagctgtggtccgctatgcgcagcgtttgagtcagcgcccagatgtagttgtgggcgaagcgcagcgtctcgatcttggtgagcttcgcgtcgtctgggaaggtgg

SEQ ID NO: 33115 - DNA, 260 bp, Homo sapiens
  chr10:71332821-71333081
  hyper
gggtaagtttgagtccgtcactgggcgcagtccgcgattccgaggctaggtgggaaaaaacaaaaacagccatcctcccagcccccgctgggtcagaggatccctctttcccctgcccgtccctcggaggcctccaaatattacctttctaccggcgcaaaagaatagagagcgatgagcagcgagggccgtggggagctcagcgggcttctggtcgccaagttcagctgagctgcaggcgcccccgcctgggagttgcc

SEQ ID NO: 33116 - DNA, 22 bp, Homo sapiens
  chr10:71334335-71334357
  hyper
cccaaggcgctgggaagcagag

SEQ ID NO: 33117 - DNA, 103 bp, Homo sapiens
  chr10:71334853-71334956
  hyper
ggaggggacaggacccgacttcgagactgtagggtggggtgaggggatgaggtaggtctgtgagtctgccctagtgatagcctcttaccgcctaggctgcttg

SEQ ID NO: 33118 - DNA, 30 bp, Homo sapiens
  chr10:71337383-71337413
  hyper
acccaacggctgctgcgccagctgagggga

SEQ ID NO: 33119 - DNA, 103 bp, Homo sapiens
  chr10:71338223-71338326
  hyper
ggcatccacagaaaacgcgactgatgacacagatgcggagcgcgagatgcccatatgtccggctctgcgcccatcccggctggggaaacgaataggctgtgtg

SEQ ID NO: 33120 - DNA, 37 bp, Homo sapiens
  chr10:71562106-71562143
  hyper
agagccttttggcagcggctgtcgcctttatttattc

SEQ ID NO: 33121 - DNA, 84 bp, Homo sapiens
  chr10:71562530-71562614
  hyper
tccagactgttcagccggtgtccgcgggcgctcgctctctgcgagccccaggttcgcgcgagttgcctgcgggaggggtcgggg

SEQ ID NO: 33122 - DNA, 95 bp, Homo sapiens
  chr10:71813377-71813472
  hyper
ggctgggggttgctgcgcggacacccgggcgccgcgggcgggcgtgcgccccggggccggcgcggaagagggcgcgaggccgggcactccccttc

SEQ ID NO: 33123 - DNA, 92 bp, Homo sapiens
  chr10:71813702-71813794
  hyper
cagccctgcctcccccggctcccagcctccagccccggcgcacctcagccccagcccggccagccccccggatcgcccgtgggtgtcctccc

SEQ ID NO: 33124 - DNA, 193 bp, Homo sapiens
  chr10:72015202-72015395
  hyper
acgcgcgctctgcgccgcgatgctcgcgggtccgcagcctcctcgcccccgggggccgggcccggggcctggcagagcttgcgcgcgatgcgggcgtacatgaccacgatgagcgccagcggcgccaggtagatgtgcgagaagagcacagtggtgtagaccctgcgcatgcccttctcgggccaggcctccc

SEQ ID NO: 33125 - DNA, 70 bp, Homo sapiens; identical to SEQ ID NO: 10347
  chr10:72043778-72043848
  hyper

SEQ ID NO: 33126 - DNA, 15 bp, Homo sapiens
  chr10:72200050-72200065
  hyper
gccccctcccatccc

SEQ ID NO: 33127 - DNA, 655 bp, Homo sapiens; identical to SEQ ID NO: 896
  chr10:72200117-72200772
  hyper

SEQ ID NO: 33128 - DNA, 679 bp, Homo sapiens
  chr10:72200824-72201503
  hyper
cgaggtgttatttattacacctatcctacagatgcgcagacccaggctccgggataagcaacttcacaagactggagattagaagctcccacccttccgcgctgcgctccgcgcaatcccaaaccaaaacccagagacaatggtccccgtcgaggacacaccctgaacgctagaatcccttcccgactcggccgtggatacgcccccagccaccaacgctgcaccccgagcctgctgacgcggagacacccgcagagctaggccctgggctcgggacgcccgggcggctgcaaacccggctcggagccgcagcccccaacccacagcacttcccgagtccgctggctggacgcggcggaggcgccccgggggtgcccagcagggcgcggcacgcggcactgcctaccttctgcctgtaggctgcggatgatgtctgccctcggcagcgggtcgcggtagaggctcagcatgtacgccagaggggatggcgacgagggctgcccccgcgtacgcaggagcgcagtggccaccgtcgcagcacccgcctggagtagggcccaccaggcgtgcagaaggaagggcaggcagtgggcgtgcatggtgggctggccaggcctgaaagcagcacctccagcccttatatcctgggcctcagcagccgccccgcccccacctttcc

SEQ ID NO: 33129 - DNA, 44 bp, Homo sapiens
  chr10:72218318-72218362
  hyper
ggcagtgagtgttcccgccgggcgggtggcgttgtcgccgccaa

SEQ ID NO: 33130 - DNA, 183 bp, Homo sapiens
  chr10:72238634-72238817
  hyper
tggcctgcccacctccggagccacctctgcccccgcatgggctggcgaagttgggaggagcgagctggagccagagcgcgcgccgggcgcgccccgtcgctgcctgactcggcgcccgcagttcgggcgcagcacgccggccgcaggagcacggatgccccccggagccgcgggctggcaggt

SEQ ID NO: 33131 - DNA, 158 bp, Homo sapiens
  chr10:72431955-72432113
  hyper
agagagcaggccctgcggccaagaaagggggcggagcagccatagaaagcggctttgggccaccactccggggatcccaggcgtctgaggggacaatcggtccgtgcgccaggaacccctgctctgtctccgcgtggcacttccgatccccggccgca

SEQ ID NO: 33132 - DNA, 106 bp, Homo sapiens
  chr10:72432524-72432630
  hyper
ggcgcttgcccagcccgcgtcccagcgcggccacatggctccactccgcgcgctgctgtcctacctgctgcctttgcactgtgcgctctgcgccgccgcgggcagc

SEQ ID NO: 33133 - DNA, 43 bp, Homo sapiens
  chr10:72432660-72432703
  hyper
cgggggcccgtggggtccggggtgcacgcggtcagggtggccc

SEQ ID NO: 33134 - DNA, 73 bp, Homo sapiens
  chr10:72973309-72973382
  hyper
gctgaacacaggaagcgcttcggtagcctcggcaggccggcttgcagggctcctgaagcggggagggctaagt

SEQ ID NO: 33135 - DNA, 204 bp, Homo sapiens
  chr10:73156664-73156868
  hyper
caagggaaagttgatcgcggacttgagcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccgg

SEQ ID NO: 33136 - DNA, 369 bp, Homo sapiens
  chr10:73156912-73157281
  hyper
cgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggtacccggagccacgcaccgcctcttccctcctcgcttccctctccttcccctcgccgttcgcccgccgcgcggcggggaagttggtggtgaccgcggctgccgaaccacttgttcccagcgcggccatcgcccgtggcgggcgctcgcggcatccttcggtcccaggcccctggccctagcctcgcgccccgctccgagctcccc

SEQ ID NO: 33137 - DNA, 417 bp, Homo sapiens
  chr10:73157508-73157925
  hyper
ggggatggggtggggcgcacccctactgcgggctgggcagaggcgctgaggggaactaaaggcacgtagttctcccctcccctcatcaagtccctgtgcccgcgggagaccccaggggacttacacatcctcccaaattcggtccagctatgggaagacgcgcccctcgaggagccgggagccttttgcggctctcgcttcgccttcctggccctggaactggtccgctacgagcggtgctggctgcccccaggagctggcacccgggagcactgcccctcatctccaccgtaggtcagcccaggactcgagcagagcccgcgtgttccaaggcagtgacggcgccagccggcggggactctgcctggctttctcggagcgggcacctagagaggctgcctccgtgctgtgagcgga

SEQ ID NO: 33138 - DNA, 30 bp, Homo sapiens
  chr10:73723732-73723762
  hyper
cggccccgggcgctccggcacggagaagcc

SEQ ID NO: 33139 - DNA, 282 bp, Homo sapiens
  chr10:73724117-73724399
  hyper
cggacgccttggacgcggttcaggaatccgccgccgctagccggctcgggcctgagcggggagggcgccaggcaggacctctcgcaggctcgctgcgcaggacggcgcccgcctggcgccgcttcccttccagcgtgccgaccggccccgcagcgcctccatccctccggcccgccccggagaagacgcacagctcgggccgcgcgggcgccggggccgcggaaccgcttctgccgggatcttccaggaggaaagcgaagttgcgagcggatgctgcccgcg

SEQ ID NO: 33140 - DNA, 104 bp, Homo sapiens
  chr10:73847688-73847792
  hyper
ggggggtcccagggccgccggcccgggccgcagggacaggggaggggcgctgggctgtgacccccagtactgtttactttccgtgtaattagccggccaggctg

SEQ ID NO: 33141 - DNA, 14 bp, Homo sapiens
  chr10:73848208-73848222
  hyper
ggtgactggcggag

SEQ ID NO: 33142 - DNA, 15 bp, Homo sapiens
  chr10:75407398-75407413
  hyper
cagattctgcacccc

SEQ ID NO: 33143 - DNA, 189 bp, Homo sapiens; identical to SEQ ID NO: 10358
  chr10:75407477-75407666
  hyper

SEQ ID NO: 33144 - DNA, 33 bp, Homo sapiens
  chr10:76803629-76803662
  hyper
ggtcgtcggcctccacgccgtggtactggatgt

SEQ ID NO: 33145 - DNA, 47 bp, Homo sapiens
  chr10:77161345-77161392
  hyper
taatcctgggtggcccgcagcggagccgtggccgggctagaggagcc

SEQ ID NO: 33146 - DNA, 543 bp, Homo sapiens
  chr10:77162787-77163330
  hyper
cccgccaccccaccccgccgccgcgagtcctcgcggggcgtgttgcgtgcggaggtcaggctgccaccctctgtagttccctaaccccaaactcggagacttctaagagccacaccaccaaggaacttctagtcctggaggtcaatggtggggcaaacctcgcctcaattctttgaccccctcgggtcgtaagcagggctaagaggctgcgaagaagaggcctggccatgggtgtatgggggaagaaacatctcaggctcactcatgccccctccccgaccttctcccacctgccgccatccccgcaggctggggagccagggtaactcggggctgctctctcgaatttattggaacgccgagtcggaatgagctgcgctaggagagccgagggaaggagcgagagagggagggggcggctgcctgtgggaacgcgggttcttccagggaagcggagcgggactgccgcgttcccctcgatttgcaccgtcactcgggttgtttgggaagaaaaggggaggcgctgtgcgtgccaccgggtac

SEQ ID NO: 33147 - DNA, 37 bp, Homo sapiens
  chr10:77163662-77163699
  hyper
tgagccgggtgcgcgcgggggtcgggtctggaactgc

SEQ ID NO: 33148 - DNA, 520 bp, Homo sapiens
  chr10:77191185-77191705
  hyper
cgggggagggaggggcgcgggcagtcggggtcaggccgccgtcggggcgcggggcgctgcgggccacctgttgcagcgggcggccagggctcacctgcgcggagaccgggccgaggggcggcggcggcgagcggcggagctgaggtccccgaggctagcccgcgcctccggcttccgccgggtcagctgactgcccagtgcggaactgtgcgcccgccgcgctcccctgccgcgctccccgctgctgccgccgcgcccccgcgctccgtcccgcgcgcccgcagcgtcctggccgccatggccgggctcgtggtgcgtggaactcaagtaagtcccggccagccccgcctccgcccggggcgcagtccgcgtggggagggacagcggggcacagaggctccccagggcctagacacccctgtccccgcctcagggggctgcgtctgcagggggtgagcttcaggtgctcaggctcgccctagtggggctaggacagacctcgtttcgggcctggcacacc

SEQ ID NO: 33149 - DNA, 579 bp, Homo sapiens
  chr10:79396686-79397265
  hyper
tggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaaga

SEQ ID NO: 33150 - DNA, 1238 bp, Homo sapiens
  chr10:79397385-79398623
  hyper
gccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcggggtgcgccgagatatatacagcgagccgccgccgcccgcccgggggggagggggatggagtgcgcgggcagctccccctccccggcccgcgccccgctcgccccgggctgcgctggccccgagcgccgagagccagggggcgccgcgggccgcccgcgcccggggtctgcgccgcccccgggcccgccccggctccgcgcgcggtcccgggtgtcctcggcgccgcgccgcccgccgtgcgccacgggtgtgcgctgcgctcggccggtgacccccttccccgagcgcctcccgcgcggctaacgagccgctctccgcttattaggtggtaactcgttaataatggataatcggccccctccgcccgggcgcccctgcgccagccctcctcccccggctgcgctcggctccggctcgccgcgccagtgcgcgcccggccgcggcaggttcaccgcgtccggccgccggcccgtggccgcctgctagcccatgttctcgggaccccctagtcctgtcgccacgccgctgagcccctcggcctccgctcgctcttcctccttgccgcctccgactcctcctcgtccccgtcctcgccgcccaagcctcttcggcgcgcgccccgcgctccccgcagccgccagcagcagcagctgcagcaactggagcgggcgcggactcaggacgacccaggcgggaggggaggaggctcgccgcgctggctcgcctgggctccgggctgggcaggggtgggcagggcccctcggcagcggcccggcaagcgcccctgacccccagggcgcaaggtagagcgcccccagcccaggcgcggggccaggcgcctctctccaaggtgctgcgcccccagccgagagcggtggggtacactgggaggacggcggggcgccccggtcaggccgtttttttccccaaagagcccccagtggggaggggaggagtggccagctgtcaactggattccacaggctgagctccccaggaccctcgggcttcgggagtgaggaggaccccacgccaggatacacac

SEQ ID NO: 33151 - DNA, 146 bp, Homo sapiens
  chr10:79470925-79471071
  hyper
taagaaggcagagctcgagggggccttgaagtcacatcgccggctgctgagtctacgaacagggaagcagccgcagtccccgaaaggacccgtcccagcgagccagggcctggttttccttccgcagaaggcggagggaccggagc

SEQ ID NO: 33152 - DNA, 75 bp, Homo sapiens
  chr10:80909909-80909984
  hyper
accctggcctggccccgggccgcagccgtgcaggtcactaggcctcggcgagtggccacccgcccacccaacagg

SEQ ID NO: 33153 - DNA, 475 bp, Homo sapiens
  chr10:81664598-81665073
  hyper
gcggacccggtggaacgcactgcgcagacggcgccggcgcctgcactcagctgttgacgagtctttcttccagctctaccctgaaagtcctccaggcaccggtcttttttttctgccttttgtttccctcccggcgagtcggcgcgacagtgaatttccgtttcccgcggtgtccaagcggacctgaggagttgcagctgtgagcaggttcggtggtgccgcgggctggggtaggcggcggtggggtccctggctctggggcactgggaagatcgcgagtcgtgcgcgtgggaaggtcctccggctcatctttgctccccaggagcagcatatttcgcatctgccagaggtgtgcccgggggtcgttgggagagggacggggtgaatccctgcagagagccgggacggggagggaaggtgtcggggagacgtggtttcctggcgacgtggtcccggcaggcgacttagacctgag

SEQ ID NO: 33154 - DNA, 223 bp, Homo sapiens
  chr10:81741708-81741931
  hyper
cgtctccttgtctcccgtgcccgcgtcaggccgccagcctcgcccacctccccaggaagagcgcgccgggcgccgacttcccctggggcggcggccctggacgtgcggggggtctctctgggccggctgctgcgccttggccctgccctctagctcccgcgctcgctcccgccctcctggctctccgggcgcgcctggcggggcagggcggacatgggcacca

SEQ ID NO: 33155 - DNA, 346 bp, Homo sapiens
  chr10:81892268-81892614
  hyper
gggcggccccttcctcgggaggcgcccaggtggcacgtcggtgcctcagctcccggggtctctgggctccgcgctgcccacggggtgccgaggggcctctggagggggcgggttctctcgagccagaaagtccggagccgcccaggaattttggctcgaactgagtgcatttcctctcgggccggccgggtgcgatccgggaagggcggctgcgggcagacgcggcgctgcgctcggccaggccggcaccatgcggcccctgctctgcgcgctgaccggactggccctgctccgcgccgcgggctctttggccggtgagtggggcgcagggcgcggcaggggacct

SEQ ID NO: 33156 - DNA, 472 bp, Homo sapiens
  chr10:82116661-82117133
  hyper
gcagagtagagggggcgcggcagagtagagggggcgcggcagagtggagggggcgtgcaggagtaggagcccgccgcagagtagagggggcgcggcagagaggagggggcgtgcaggcgcggggcgcccggcagagagaaggggtcgtgcggaagggggcgcgcgccaggggagggggccagagaggagggggcgttcaggagtcgggcctgcggcagagatgaggcggtgtgcaggagggagagcgcgcacgagggggcaacgggcagagaggagagggaatgaaagaaggggagcgtggcagagagaagcgggcgcgctccagggggcggggtccagggaggagggggagcgtaggatcggggcgggaggcagagaggagcgggcacgcgggacgggcgtgtgctcgtgaggggtcgaggaaaggcgtatgtggaggcgcgcggggtgggtgagccgaggagacttgcta

SEQ ID NO: 33157 - DNA, 311 bp, Homo sapiens
  chr10:83633848-83634159
  hyper
aggcaccctcccacccgcatccgcccccgccccctcgcccagcagcgtcagtctctgaccccactggatccgtacaggagacgactcacaatcggtcggaagctgcttttgcccccccaccccaccgcaaacgggggtttgcttggatcatttatctatcttgtgtgcattaagaaaccagcattagctgctagtgggaggcgctactctgcccgaatcccagcccgccgcggcgattctgcacacacacacgcaccagcctggcagccagagcccgtctggagacgccctcagcccggggtctgcgttcc

SEQ ID NO: 33158 - DNA, 282 bp, Homo sapiens; identical to SEQ ID NO: 10367
  chr10:83634933-83635215
  hyper

SEQ ID NO: 33159 - DNA, 15 bp, Homo sapiens
  chr10:83635484-83635499
  hyper
ctaccacttccacca

SEQ ID NO: 33160 - DNA, 49 bp, Homo sapiens
  chr10:83635530-83635579
  hyper
cgcctcctccaggacgcccaaccggattagcactcgcctgaccaccatc

SEQ ID NO: 33161 - DNA, 30 bp, Homo sapiens
  chr10:83635788-83635818
  hyper
ctcctcctaccttcacgattctactccctc

SEQ ID NO: 33162 - DNA, 59 bp, Homo sapiens; identical to SEQ ID NO: 10370
  chr10:83636287-83636346
  hyper

SEQ ID NO: 33163 - DNA, 784 bp, Homo sapiens
  chr10:85954289-85955073
  hyper
gccgctaattggtctcgtcaggcggccggcaggagcagatccgagccgtgtcatcctcttagcgccctcacgccacccgccgctcccgccccgtgccccctcccgccgcggctgcagtcgccgctacccccattgtggtctctgccctccccgcgggcccagggcatgctccgtgcccctgcgcccggtctcggcggcggcaggcgacactccgcgccggcggagacatgaggcgctgccggtgggccgccctggccctggggctgctgcgcctctgcttgggtgagtggccgctgggccgcgctggccgcgtggatggcgagggagatgggcgctggcgtcacccaggtggccagagggacatggtcctggaccacttccagagtgggactcgggctggtggacgggagcggagaagtccttccatcttcctggcccattcggtagtggggagtggggtagcggagtagtggggagctccggggcgcttctccagagctggcatcctagggccccagggtttggcgcccggacccccgctgctctccgcttgctgggaaccagagctgtaggcttggtggcagctccgatgctgcgtggggcaggagatagtgccctgactcgcggcttgaccttggctgggctggggcactgcccctctccgagcgcgggtgcaatctgcccattgatgaaggaggggttggattgctacctgggttctaagcgcccacatgctacgtgtccctgacaagcccgagcccaccgggggcggagtgggggtcag

SEQ ID NO: 33164 - DNA, 80 bp, Homo sapiens
  chr10:88124485-88124565
  hyper
ctcccatttcctgtacgtctgtcgaggggagtgggggaaggggacttgtgtcctaggcgcctccacgttcagatctagcg

SEQ ID NO: 33165 - DNA, 30 bp, Homo sapiens
  chr10:88125245-88125275
  hyper
tttcatcttctctcccggttctctctctct

SEQ ID NO: 33166 - DNA, 640 bp, Homo sapiens
  chr10:88125592-88126232
  hyper
gccaggcgcacacagcgacacacgctgacaacacgcacccacacacattcacacacggttccggtccggcctctttgatcttgccctgccaacttggcgagccccccgctgtacctccccctgccccccgctgctctgagctgcgcagaagggccctcccgacccgccgacggccccgctaagggcgcgggtctcgacgcgcgtccatcccggtgttccccgaagcgtcggccctaagtgtcggtagaggccgcggggccccgcgcggagatcggagccccggggagcggcaagcagccagcgggagcgcggcgcggccggtgcacagctcctccgccgggcggcgcggcgcggcccttcgggggagcaccgcccgccgagcccctcggcccagggaaacgccaagtttggacgccgcgcaccccctgccccgttggggcccccgcccagcctcggcccggcctccagccgcgcttaccgatgtggatgatggagtcggcccgcaccgacacgcactggcatatccaggggagaagccacagcgtcagcgcttccatgtcccccgggcgcgcggctcatccacccgggcccggggcgaggccgagggcagcgcgaagcggggaggcgctggtcccggtgc

SEQ ID NO: 33167 - DNA, 149 bp, Homo sapiens
  chr10:88126704-88126853
  hyper
gcgccgggtgctccacgctcccggctcgggggacgctcggagaccggcacagcggcggggaccggcctgggctgcggcgcgccgagctctgacggttcgggcctccttctccggttcgccaggggcgggagaatggaggagggccggcc

SEQ ID NO: 33168 - DNA, 279 bp, Homo sapiens; identical to SEQ ID NO: 10374
  chr10:88126854-88127133
  hyper

SEQ ID NO: 33169 - DNA, 50 bp, Homo sapiens
  chr10:88127346-88127396
  hyper
ggtgcctgcctcgggccggccaccaccaaagagagcgttaagctgttgtg

SEQ ID NO: 33170 - DNA, 318 bp, Homo sapiens
  chr10:88149300-88149618
  hyper
ggcgtctctgaccaccgagcctgcgaagacctagctgattacgaccaggaaacaggaggggacatggcccaaggtgggcggggccagtgctgggaagccccgccccgcccccgatcctgtgctcccaggtctgggcgttaggattctctcagtcccggagccacgccggctgaccgcagggctcggggagcgcggctgggccccttttcccgggtccgggaagcgccgggccacgccgggtccgctggagagactgagggccagggtcgccgctgccgccgggaggcgacagagccagctgggcgcacctgggtgctg

SEQ ID NO: 33171 - DNA, 147 bp, Homo sapiens
  chr10:88391908-88392055
  hyper
gaggatacagggagccgtttgcctgggttcgcgctcggctgtcctagctcacggggcgacctcggaaacgtccagcgtctgccctgtccccctgcgccgcgtctgagcagccagccccgggccaaagggtcgcgttggttggggcgt

SEQ ID NO: 33172 - DNA, 33 bp, Homo sapiens
  chr10:90342630-90342663
  hyper
gggccttttcccgggcggcggaagtccccgatc

SEQ ID NO: 33173 - DNA, 50 bp, Homo sapiens
  chr10:90343138-90343188
  hyper
cgtccttgaggagcaaacctggggctgcggagaaccggggctgtctgtct

SEQ ID NO: 33174 - DNA, 805 bp, Homo sapiens
  chr10:90966521-90967326
  hyper
gacgctcatatactgcgttgccagcgcgaacgaggacgagttctggtggtgcaccttgtggaaggtgcggtacagccagggcaccttgtggtgcagcaggtgccacacgaagaactccatgtcgaagagtagcaggcagaacaggatgtggtgcagcagcaggagcagctcgggagcttcgtggggcaggagggccgggctgcgggcccaatgcagcagcgtcacggggaacacaaacatcacatgctggtagagggtctgccccaggcaaggtagcagctgctgcgcggatggcgagaagtcagggtggatcttgtagcgccgcagggcgggcacccaggagcacaggatatccaggaccacgaagggcaggcaaaagcccacgtatgtggtgatggagaagatgaccgggaagaagggcgactgtaggagggcctcccagctcctcaggtggtcccagaggggctgcaggaacagctgcccggagctgcaaaggacctgggggtcggagcagttgtggcagctcattgcgaggctgtgcaaggcagctgaggctgctgctcgagtcccatcgacttttcacaggactcacggccccgccccgagtgatgtcagctgcctttccatccctttcccggcgatgcgaagcttgaataagctagcaacccggcagagtggcccttcattgctgtaaatgtgctcatctatagccgcatcttaccggcttttagatatgcgtgtatgcagtggcacttcgtacttttcatgtaagttctgatttttcagttgacgtacaattaacacg

SEQ ID NO: 33175 - DNA, 532 bp, Homo sapiens
  chr10:90967624-90968156
  hyper
ctttgcacagggaaccgctggtccccgaacgccggcggtgaccgtcagctcaggaaatcagacgggaagggtggccggatgggaacctccgccagctccagcttgtccccagagttttcctggccggcgggcagcaagctagagagaccacgcacgcaggctctccgggagaggccgcagcccggccgcgtagctaccctcggcggcgcgtcccggggcgccgggcccgcgatcggagccggaggcaccgcacagcggaaagagggctccgcggcggccaggctcagctttgccgggaaaatgctggatttaactcccagtctgcgccaatctggctaaaaagcccgttgtatctcaatttggggcgggaacacttaattcagcaaaccacctgcgttgttcgtcaagggaaagagatgtgagttcctgaagcctcccgggaggctattgaaggaccaggtgatgtcgtcactaccctacccttccccttgttggctttgcggggccaacttgcagtcgccctctgccaccg

SEQ ID NO: 33176 - DNA, 317 bp, Homo sapiens
  chr10:91295029-91295346
  hyper
tcccaacccaagctgcgcgccgacgcacccaagttagggtcccaggctcccggcgcgggatgggcgctagggcagcggagaatggagggtccccgtcctcctccagctccaacgacagcgccagcgccccgccgtcccgccgcccttccttgaaggatgcccgtgtcacctgagccaccgcgccctctgcacaaccgtgtcagggagagggaagagggggagccgaggaagcttcttggccagggcgctggggatccgggagcgggggccgccggcgagactgagcccgggacagcccagagctccagcgctccagc

SEQ ID NO: 33177 - DNA, 145 bp, Homo sapiens; identical to SEQ ID NO: 10383
  chr10:91295347-91295492
  hyper

SEQ ID NO: 33178 - DNA, 295 bp, Homo sapiens; identical to SEQ ID NO: 10384
  chr10:91295584-91295879
  hyper

SEQ ID NO: 33179 - DNA, 4 bp, Homo sapiens
  chr10:91295923-91295927
  hyper
cggt

SEQ ID NO: 33180 - DNA, 413 bp, Homo sapiens
  chr10:92617122-92617535
  hyper
caccaggcagttgcccgcgatcgtcagcagcgtgatgagcgtcaggatggagccgatcacaactttctcgactctgccgtagttgatctgttccccacagccggaggcattgtccgggggcgcgtcccaggtgggcgccgggctggctgtcacctcgctcagcaggtgcggcgcccaggagcccgcgaccgggtcggcgccaccgtcggggctcaagtcgggcagcccgcgccccacttctggcagaaggaaagagcggaggtgcccgtagaggtccgggcggccgctgctgttaacgtccatcatcgcgccgccgtgtgccgctgcccatggagccggcgccccggccacgcgcctccggctgccggccccggggcttcacctcaccggttccgctccgcccggcccagcca

SEQ ID NO: 33181 - DNA, 611 bp, Homo sapiens
  chr10:93647037-93647648
  hyper
gtaacaccccagggccgcgtgaatagcggggaaggtaacgtgactgcggagctcagggccggcccgggaggggcgcgggcctggccagtgggaaggtcggacgccgaggggcgaaatcaccccaccggcatcagaccaccgcctccattcagcggaggaatgtgggcgggcagaggacgcgcggtcccctcgcccggcgttaaccctgtgcgcgccgggagcttcgcccggagcatcgcagcatcgcgcagcgcccggagcccggggccctcacagctccaccggtgcccggagcatctatctccccgcgggcggtgctgccactcgccacgttcacattcctccacgtgcacgcgtgactcttttggtgttatttttaaaaatctcactatttaatcgccatgtttaccttccccagaaccacatagtctcatcgcaattcaaataatttagaaaacattttaagataatcgtggagcccacgaagccagtgcaacgtaggtggcttcccttgctggaagtcaccgcaccgaggccagaagaaggtagccagcgcccaggcaagcgcttaaaactgcagcctcctccacacctttgcacgtggggaaacc

SEQ ID NO: 33182 - DNA, 2 bp, Homo sapiens
  chr10:93647649-93647651
  hyper
aa

SEQ ID NO: 33183 - DNA, 443 bp, Homo sapiens
  chr10:94180324-94180767
  hyper
cctgcagtatttaaacgattgtcggtggaagttcacgtcgtgctcctctttcgacagccgttgggtaacggatcaaaacccttaacggccgcggctggagcgcgagctcggggcgccgaggggctccgggcccgagcgtccaccgctcatctcctgggctcgggaggttttcgcggcgggggctcagccccagatcccgggactcaggaggagctgggccgagctgcgggaggcgtggaagccccaggagagggttttgcactacgaaaaaaccatatgcaaattgcctgggaagagtttagattctgtggccaaactgcaagcggccgttgctaaaatgggaagcatttacaggaaaaagcaaacggtttcatcgaggtggattcgacgacaaactaagcgaaggcaaaaacgatcgcgggagtcgacgtggagacagataa

SEQ ID NO: 33184 - DNA, 126 bp, Homo sapiens
  chr10:94449138-94449264
  hyper
cgctctgagctcgggaaacggccggtgtgacagccagcgccactgttaatccagggagcgcacccaccgaggaggcgtcttaggccagcggcctctgctcccgccgagtcccgctgctccccgcct

SEQ ID NO: 33185 - DNA, 252 bp, Homo sapiens
  chr10:94449910-94450162
  hyper
ctccttcaccagcctcgtgtccccctaccggaccccggtgtacgagcccacgccgatccatccagccttctcgcaccactccgccgccgcgctggccgctgcctacggacccggcggcttcgggggccctctgtaccccttcccgcggacggtgaacgactacacgcacgccctgctccgccacgaccccctgggtaaggcggccgggcgagggtgggggcgaggaagcgccacccggcaggtggcagcgcc

SEQ ID NO: 33186 - DNA, 349 bp, Homo sapiens
  chr10:94450377-94450726
  hyper
ggggtggggctcccttagcgggagggacggggaaaggggcgtcgaggcgcccctggccggcccccgtggggcagggatcgcagccgggcccgggtggctacggggctggacctggttcaacaggcttgtgcagtgaaagagcctgaccctttccgttcatacaggaaatcttgagttctcgataggagtaaatctggtttcagaagctgttaagtgttttcctggctgcatgaagcagacccttcccccggagtagtgcacgctgctgattattttatcgacatcctcaatacagacaaattcaggaaacactcgacttctgatagccgggatccgtttttctgatatt

SEQ ID NO: 33187 - DNA, 56 bp, Homo sapiens
  chr10:94451448-94451504
  hyper
ggttactgctgggaccgcgcaggaggaagcaaagagtttttcgagctagaccaaca

SEQ ID NO: 33188 - DNA, 30 bp, Homo sapiens; identical to SEQ ID NO: 10390
  chr10:94822377-94822407
  hyper

SEQ ID NO: 33189 - DNA, 22 bp, Homo sapiens
  chr10:94828103-94828125
  hyper
gtgatgtatagcatccgggaca

SEQ ID NO: 33190 - DNA, 701 bp, Homo sapiens
  chr10:94828193-94828894
  hyper
cgcgaagattcccggggcgcctccagccgcttccattacatcccgttcggcggcggtgcgcgcagctgcctcggccaggagctggcgcaagccgtgctccagctgctagctgtggagctagtgcgcaccgcgcgctgggaactggccacacccgccttccccgccatgcagacggtgcccatcgtgcacccagtggacgggctgcggctctttttccaccccctcacgccttcggttgcggggaatgggctatgcctctgacatgcttgcgctctaggacacggcttggccggtggctatggcgcgcacgcagcgccacccatctgccgctccccattgtagcgtcgcgcgcccactctttcactcgttcaacaatctttcaacaaatgttcgccaaacgcggatgtgtgccggactcgaggaaggaggagggcgagccaccgctgccgcgccagagaagcatctaagcccatgggaagatgccttctgcgctccgcgcccagaggaaggaaaatgtcgtgggccaagcaggaatggagggaatagatagatccccacgaggtgctgcttggcttccccttcccgagccaatccagggagggtgcatggatgggggaaggcgaggtaggggtggcaggggagtgggaatattgcaactcggggacattgcagagacccgacgcacgcggtgggacctgcaa

SEQ ID NO: 33191 - DNA, 320 bp, Homo sapiens
  chr10:94831610-94831930
  hyper
ttgagctgaacttggcgaggtggccccgcagagttcactcggatgtcacggtccggcctgcaggggtcacaggcgggtcaggcccgaggattgggaatgggccccaggtcacgtccccattcgtcggctttgcacaccggccggaggcgctgtccagaaaggggcggacccgggatttctgagaattacctccagcgcgattggcctggcttcctgcagtggccagaggttggttcgccgtgtttacagccaccaaatcgtttgccggagactgaaaccctgcccagagcctctgaaacactgggcaggttatggggaaa

SEQ ID NO: 33192 - DNA, 38 bp, Homo sapiens
  chr10:94831980-94832018
  hyper
cgctaggattgtgcgggtccctccgacctctgcagata

SEQ ID NO: 33193 - DNA, 166 bp, Homo sapiens
  chr10:94833026-94833192
  hyper
cagatctgcctattgcgcccgatgccccgaggctctctcttggactctggccctgagttcttctgcgcgatccttcggagacgtctggaggcctgctttatgcatctctcttggacctcagtttccccacacgtgggaggaggcagctggacgattcctgaaagga

SEQ ID NO: 33194 - DNA, 69 bp, Homo sapiens
  chr10:94833580-94833649
  hyper
gtctgaccaaggtaacgtgggcagcaacctgggccgcctataaagcggcagcgccgtggggtttgaagc

SEQ ID NO: 33195 - DNA, 964 bp, Homo sapiens
  chr10:94834033-94834997
  hyper
cccacttctctcctccgccttcctcccacagcggaggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaaggtgggggcaggaggcgacggctggacagggagggggaccccatttatgagcggaattccggctgatggatgctaggcgcgggctagcagcttgaggtgggctaggaccctctgccagctccaggttagctttcccagctcggagagtgccatgtgtctggcaggactgggggtgtctggaaggggacggcggtagacgagaggggcggatggaggcttttaacgctgtcccctcctcgggactcaggtgattatgcgggccttcagccgcgaggcactcgaatgctacgtgccggtgatcaccgaggaagtgggcagcagcctggagcagtggctgagctgcggcgagcgcggcctcctggtctaccccgaggtgaagcgcctcatgttccgaatcgccatgcgcatcctactgggctgcgaaccccaactggcgggcgacggggactccgagcagcagcttgtggaggccttcgaggaaatgacccgcaatctcttctcgctgcccatcgacgtgcccttcagcgggctgtaccgggtaagggcggcaaacgggctgcggactaggggcgcgggacctgggcgtctgctcaccgccgcgcgctctctgcgctcagggcatgaaggcgcggaacctcattcacgcgcgcatcgagcagaacattcgcgccaagatctgcgggctgcgggcatccgaggcgggccaggg

SEQ ID NO: 33196 - DNA, 81 bp, Homo sapiens
  chr10:95326983-95327064
  hyper
cgctctgcctctctgcgtcttcttccgagtcgtcccgcaacggctccccggcgccgaccaggtgagcgcccctctgtgtgt

SEQ ID NO: 33197 - DNA, 193 bp, Homo sapiens
  chr10:95361207-95361400
  hyper
cggccaggccaaatgcgccagcggccctggctcagttaccctgcactcgtgccagcggccgccagctgcggtctagggtggcctccggggccagtggctctggcaggaggctcgagtcaacctggcgggaagaccgtggcctcacagagcgagagcggacccgcgaggctccctggtgcgtgagtgcccaggc

SEQ ID NO: 33198 - DNA, 137 bp, Homo sapiens
  chr10:95753607-95753744
  hyper
ctcacccggggcgggcgagttctgggaaagcccggcccagggcgggggccccgctgccgcccgcgcagccgccgctgtccgggcagcgcgcacatctcggcgggagcggactgtgaacggcgcgggtccacacggta

SEQ ID NO: 33199 - DNA, 30 bp, Homo sapiens
  chr10:98944811-98944841
  hyper
agctggctcagaacgcggccgtagccccat

SEQ ID NO: 33200 - DNA, 33 bp, Homo sapiens
  chr10:98945047-98945080
  hyper
gggatggggaaaccacggcgctcctggctcctg

SEQ ID NO: 33201 - DNA, 267 bp, Homo sapiens
  chr10:98945472-98945739
  hyper
gccgctgaccatccccgtccggggccgcctccaggtgcagtcccggggcagagccaccgaagagcccgcgggcttgcgcgcggcgcccctgcgggctgggaggcaccttgctcctccaagcgacggcgcctgtgcgcggacggagggagggcgccttgggcggagggggctcggctcctctgccgtttcgccgcctgcgtctccctctccctccctccagctcccaactgactgctgcgaggaggaaaatgggcaggccccgcgcgc

SEQ ID NO: 33202 - DNA, 268 bp, Homo sapiens
  chr10:98945799-98946067
  hyper
gctcccacccggcagtcatccatcaatcgaaaagcacacatccagggccaggctcctccccgccctcccccgccgcagcccccctctcccgacgaccactcagcggctgcaagccgcctacagtttcaaaggtggaacctccgaggcgccgtcagcgggcacggggctgcgggggatgggagaagagggaagggggtgtgactcgacccgccaagtcctggctgtacacacacacacacacacacacacacacacacacacacacaca

SEQ ID NO: 33203 - DNA, 92 bp, Homo sapiens
  chr10:98946094-98946186
  hyper
cgcaccccggcacccgcggccccagctgctagtccagggtgggagggagatcttattttgccgcttggacgccttcccggggagtcagaccc

SEQ ID NO: 33204 - DNA, 185 bp, Homo sapiens; identical to SEQ ID NO: 3581
  chr10:99080262-99080447
  hyper

SEQ ID NO: 33205 - DNA, 71 bp, Homo sapiens
  chr10:99080838-99080909
  hyper
gcacgcactgggttgcgggacagagtagccaggttctgccggtgctcggagaagagcgcagtgttttgcaa

SEQ ID NO: 33206 - DNA, 151 bp, Homo sapiens
  chr10:99531148-99531299
  hyper
caggccaggggaagccgtaggcctccatgagcggcgcgcagccggcgcgcacggcctcgcacagcgagcggcacgggtagatgggccggtcgagacagacgggcgcaaagagcgagcacaggaagacctgcgtatccgagtggcagcgctt

SEQ ID NO: 33207 - DNA, 98 bp, Homo sapiens; identical to SEQ ID NO: 10402
  chr10:99531512-99531610
  hyper

SEQ ID NO: 33208 - DNA, 50 bp, Homo sapiens
  chr10:99531829-99531879
  hyper
gccccagctccaaggcggggaggcagtgggggcggccctcagcccctccc

SEQ ID NO: 33209 - DNA, 142 bp, Homo sapiens
  chr10:99531880-99532022
  hyper
caccctgcccgagcgtcccgcccagcgccaggtcttgcgcccctctcccggctcggctcccctgccgcagccctggcctcgcccagcgtttctccccagggctccctgcctccctgggcattttcctcgaccctcgccttct

SEQ ID NO: 33210 - DNA, 192 bp, Homo sapiens
  chr10:99789105-99789297
  hyper
ttccacttggcttcacgtggaaagtcctgcacccatcccagaagacacctcaagtgcaactcaagaatgtgtcctgtcaggagaacggaagcatctcctgggatgtgcagaagccacactgggtgcacccaccagcagcagcagcggcggcggcggcggcggcggcggcggcggcggcggcagcagcagcaa

SEQ ID NO: 33211 - DNA, 218 bp, Homo sapiens
  chr10:99789739-99789957
  hyper
tccccagcctggaagcgtaggcactcggccgaggccagtggcttcccaggcccgggtctcagcctggctgactgggagactctcccgatagcccggcacatccctcctcacccgctccgccccctccaggccccagaggccccctcccctgacagctgacctccagtgcgcccccaacactttctctgccagctgctggctgtcgcccccacacatca

SEQ ID NO: 33212 - DNA, 79 bp, Homo sapiens
  chr10:99790261-99790340
  hyper
tgggaagcgggcgctcgctgccgcctctgccgccggcgccgccgcctgcttgctcccagccccggtcccgggctggcct

SEQ ID NO: 33213 - DNA, 323 bp, Homo sapiens; identical to SEQ ID NO: 902
  chr10:99790437-99790760
  hyper

SEQ ID NO: 33214 - DNA, 260 bp, Homo sapiens; identical to SEQ ID NO: 903
  chr10:99790917-99791177
  hyper

SEQ ID NO: 33215 - DNA, 158 bp, Homo sapiens
  chr10:100992033-100992191
  hyper
acacagatacacaaacacagcgggtgcttgcttccgctccccaaataaagaatggtaatcaagtttctcaccatcctcatagtttttgagatagtaatccgggcccgggcccccgcggcttttcgccgggttcctcaggttctggaactgcaggaagt

SEQ ID NO: 33216 - DNA, 426 bp, Homo sapiens
  chr10:100992221-100992647
  hyper
cgggcgaaagtccccgggccagggtcaccaagcgcttggagctgcagaggaagagaataagagaggaaaggttcccaggacaggacgagagcgcgtggggcacggagaagggccctcttcctactccctgagggcgacctggccggggctagaggctctgtgcctgccccagccggcagtccacgctggcccttggccgctgccctgcgccccagcccgccctcaccgcccggctctgggggctgtgcctcccgcttccagacgcccgcagcggccccctcccgcagacacccagatcctgatctcctaaaggctacagatagtgtttgttcatagagtgtttgtatggggtgggtgtacgtgctacgagcacggcgctaaagcgcagttgcccggcttctgccactgccaggaaagcgctccggg

SEQ ID NO: 33217 - DNA, 47 bp, Homo sapiens
  chr10:100992681-100992728
  hyper
cgaccgttgccaaaaacttgtatgctgaaagccggcattgcctccgc

SEQ ID NO: 33218 - DNA, 451 bp, Homo sapiens; identical to SEQ ID NO: 906
  chr10:100993487-100993938
  hyper

SEQ ID NO: 33219 - DNA, 756 bp, Homo sapiens
  chr10:100993939-100994695
  hyper
gcaaccgcaccaacaggaaccgaaacggcctcggcaagggcagctacagcctctcagtcctccggctacctttcctccacgtggaaggagcgctccacgtggcgcctcccgctacctgccgcgtccgcagacccgacccgggccagggggacaaccccaagagctgagaggcgggcgcacctcaagaagcaaaactcgaatttcgcaaggagtgaaaaatacgaaggacgcacaacggacctggcctcggggcaaagtgggactgagagcgctgagggctcttcgaggggaacccacagctgaggctccaacttgtagggaatttttaaaaactcaacacttggattcgacattgcagaggatttatttcttattttacactgcaactctgtccctgatgggaagggatcgcagttgcctaactgccaaactgcaacaacccgggaagagtgtgagcccaattagattacaagccctagagcaaaggggatcacaaacctccgggtttgctaatctgctggtgcggagttcagatctccgaagcctccctggagtatttctaggactcttaccgcttcccttataacgctgtgaccccagcgaggattttttttttcctttaaagaaaagctaaactgtgcagttaccgcaggagatttaaggaggaggaactggcggggggaggggggcattccgtctataaaaagcgccttacaaagtcctgaagtctggaaatgacagcggaggatataaaat

SEQ ID NO: 33220 - DNA, 732 bp, Homo sapiens
  chr10:100995726-100996458
  hyper
gctcgctcgctcgctcgttttgtttttttcttttttttttttaattttttttaattttttttttcagtgttttggtgctggtggagcgaactcacgcccctagccagccttccccgtgactcttgccaagagaactcgtacaccggcaccgcccctttaagagatttctactgcagacattttttaactttttaaaggtaaggggaggggagcaggcgggaaggaggagaaaagggtggcgttgtaccctcctaatttaaccctctagggtcaggaagcagagggaggaatccaaaccatgccgttgtaccgtctgggtacagagcaaagggtctcgtttttacgtccttccctgagaggctctggagggcggttcaagctccgactccgacccgaaagccccagcgccaacccgggacgcgctgggatagagttcccaccgacagcacgcttgtttctcctgacagcgtcaggcacttcgtccgctcagggcccttttctggttgaagcagcaataccaagggcggttaagttgcagaggggtcttgaggcggtgattcctgtcaaagcatagagccctgaaggacattccccgaagaggagccctgatctctgtgacgcgttggatagccacaccgaagcatcctctgacctccatagggcaaagagtagcaagaaggaaaaacatagtgacctggtcaagcagcttttccgatccgagggccaaaaggg

SEQ ID NO: 33221 - DNA, 30 bp, Homo sapiens
  chr10:100996680-100996710
  hyper
tcctgcagggaagtgcgcctttacagtgcc

SEQ ID NO: 33222 - DNA, 499 bp, Homo sapiens
  chr10:101088928-101089427
  hyper
ccgctacgcacagtgcggtgatgcctggccacctccagcctccagcggggacctcctgcccaggtggagtctgaatgcccaccgccaccagcccacgcgcgcagtgggcgtacacgtggtgacctgcctgcggctgggttcccagctccggctcctcctccctccagctctcgctcggcttcctgcagtatcacgtgcagctgcgctgggtgcaggatggcggcggccgcggcggcggcagcagcggtgggtgtcaggctccgggactgctgcagccgaggcgctgtgctcctgctcttcttttccctgtctcctcggcccccggccgccgccgcctggctgctgggcctgcggcccgaggacactgctggaggccgcgtgtccctggaggggggcaccctgcgcgccgccgaaggcaccagcttcctcctgcgtgtctatttccagccaggaccgccggccaccgccgcaccggtgccctcaccgaccctcaactcgg

SEQ ID NO: 33223 - DNA, 373 bp, Homo sapiens
  chr10:101089835-101090208
  hyper
tgctgctagccttgtcggccctgttcagcggcctgcgcctgagcctgctgtcgctggacccggtggagttacgggtgctgcggaacagcggctcggccgccgagcaggagcaggcgcgccgcgtgcaggccgttcgcggcagggggacccatctgctctgcaccctactcctgggccaagccggagccaacgcggccctggctggctggctgtacacctcgctgccgccgggcttcgggggcaccggggaagactacagcgaagaggggatccacttcccgtggctgccggcgctcgtgtgcaccggcgcggtattcctgggcgccgaaatctgcccctactcagtgtgttcgcggcacgggctggccatcgc

SEQ ID NO: 33224 - DNA, 292 bp, Homo sapiens
  chr10:101280193-101280485
  hyper
cacataaatcaccagcgccagagtctcgggaaaaggcgcatttttcattgctggctgcagggcgactccagaccgcgaacgagaaacagaagttgtctttagataaaccgttcaccggagcgcgcgttgtggcagcagggtccgcagagcacagggcaacctgggtctggcgctgcgcccccgccaccgatcacctcccagaggccccgcaagaaacccagatcctctcaagggctggtaccacgtcctcctgccagagaggagatagggagccaagcgggaaggaaaagga

SEQ ID NO: 33225 - DNA, 253 bp, Homo sapiens; identical to SEQ ID NO: 10421
  chr10:101283181-101283434
  hyper

SEQ ID NO: 33226 - DNA, 44 bp, Homo sapiens
  chr10:101290117-101290161
  hyper
tcctcaagagacaaccgcttaggcctggcgcaaggtacctggcc

SEQ ID NO: 33227 - DNA, 520 bp, Homo sapiens
  chr10:101290179-101290699
  hyper
cggaatttggggtagaggggcacccgtgggccggctggtggggaggagacagccccctgcatgagctcacagaggcgccctggtgggctccggcggctgcagagcgtctgtgggcgtgtattggcgatcaggcgctggaggggcgctttgtcctggtcgcagttttaagacctggattgttgggctagatttatgaaaggcctaggagcgaagcgagatgggaagcaagggaatgtaacaaggagaaatgcaggcttcggttggaaactggggagagagagattgtttcgatagcctttctccttttctttttccagaatcatgaaatcaccgaggagaagaaaactggggactagaagagagcagaaacatttcccctgagacagttttgccccggaggtggggtggggaagtggcgctggagctcagcttcctgcttttatgctcggcggccaccgtgatgcacacacactcgaggtccgccaccccgcagtgccgtgcacccctctgcccccacctc

SEQ ID NO: 33228 - DNA, 443 bp, Homo sapiens; identical to SEQ ID NO: 910
  chr10:101290700-101291143
  hyper

SEQ ID NO: 33229 - DNA, 27 bp, Homo sapiens
  chr10:101291230-101291257
  hyper
cgccatcctgaccgccaaaaaatgctt

SEQ ID NO: 33230 - DNA, 531 bp, Homo sapiens
  chr10:101292333-101292864
  hyper
gaagttttcctgccccgcgcagcagctgaaaaaaacacactcctggggcatccttccctggcgttggttcgtggacagcaagcctcccagaactggcctaggtcgggaaggtgcagccacgcgggaatcaatggttcaggaaccggatctgtgcagcctcgcccgcagcgtctcggacttcaggactctatactagtccttgtctatttctggtagagccgcaacatcccactcgcagagagcagggggcgtggcccacatgagccagaacctatagggagggaggttggggcgccagccccgcccccccaacgtgacgcaaatctcccggacagaggcttaggagcccgggccccagtccctgcagtggctgtaacaaaacccagacccccaggtcccggccaatggaggcgatttagactggagtgggaccgcgtctgtcaaaagcccgactcggcagcagcggcggagtccaggaggagagctggagccgccgcgctgcctccccgcccccgccgggatttattattt

SEQ ID NO: 33231 - DNA, 387 bp, Homo sapiens
  chr10:101293067-101293454
  hyper
ggaggacgaggaagacgagggcgagaaattgtcctatttgaactcactagccgcagcagacggccacggggattcagggctgtgtccccagggctatgtccacacggtcctgcgagactcgtgcagcgagcccaaggaacatgaagaggagcccgaggtcgtgagggaccggagccaaagtgagtagagggggaaagaaaacgcacccgcacacctggagcaatggcagagcgcacacaaacagcccacagaccttgccagcgcagctgcccatccctttaccctttggctggggccatgcctccgccctggtcaccgacagctccacaaagcgcaggtacctgcaagggagccggggtggagagacaaggacgaggtgaccctgac

SEQ ID NO: 33232 - DNA, 261 bp, Homo sapiens
  chr10:101293671-101293932
  hyper
ccaccccttcttctccgaaaagacagcccaagcagcctgtgtctctcgcacccgcaggggcaggaactttggtggaggccagctgggcggtttcctcccttctctgcttggagctcagcgtccttgaacccgtggcactcggtagagagagaggagatgatcggaaagtgcgtgggaacaatgtctattccgcgcgaccatagctctcacatccctaaggcgccagccttttttgaaaatccgtaacgttttgctttgtgt

SEQ ID NO: 33233 - DNA, 777 bp, Homo sapiens
  chr10:101294623-101295400
  hyper
ccagccatttactaccgcacgctctgcgcagccaccaaaaagggtcacggtgctccaggacaggagccgcggtgcggccgggaacagctaaggacgctgttgtttgcttcttccgcagaaagctgccagctgaagaagtctctagagacggccggagactgcaaggcggcggaggagagcgagaggccgaagccacgcagccgccggaagccccgggtcctcttctcgcaagcccaggtcttcgagctggaacgcaggttcaagcagcagcggtacctgtcggcacccgagcgcgagcacctcgccagcagcctgaagctcacatccactcaggtgaaaatctggttccagaatcgcaggtacaagtgcaagagacagcggcaggacaagtctctggagcttggcgcacacgcgcccccgccgccgccgcgccgcgtggctgtcccggtgctggtgcgggacggcaagccgtgcgtcacgcccagcgcgcaggcctacggcgcgccctacagcgtgggcgccagcgcctactcctacaacagcttccccgcctacggctatgggaactcggccgcggccgccgccgccgccgccgccgccgccgcagcagcggcggcctacagcagcagctatggctgtgcgtacccggcgggcggcggcggcggcggcggcgggacctccgcggcgaccactgccatgcagcccgcctgcagcgcggccggaggcggcccctttgtgaacgtgagcaacctaggaggcttcggcagcggcggcagc

SEQ ID NO: 33234 - DNA, 185 bp, Homo sapiens
  chr10:101295401-101295586
  hyper
cacagccgttgcaccagggtactgcagccggggccgcgtgcgctcagggcaccttgcagggcatccgggcctggtagggacggggcgggtcacgcggcgggcaccccagcgcagcctggcgccgcgggactgaagctcgagaagggcctgacctaaaggtcaggtcccctcgttaaaaaaatatg

SEQ ID NO: 33235 - DNA, 39 bp, Homo sapiens
  chr10:101296761-101296800
  hyper
ccctcccttctcccccggcggccgcggctttatgcggct

SEQ ID NO: 33236 - DNA, 125 bp, Homo sapiens
  chr10:101300247-101300372
  hyper
tgcatctgggacattcgacagaaggggaaggtggaaggacgtttcctgggggaggttcgagtcctctctagcccaccactgcagggaggaaagggtaaggagtggaaacccggcccctctccgcg

SEQ ID NO: 33237 - DNA, 144 bp, Homo sapiens
  chr10:101875008-101875152
  hyper
cggacgacagctgcacggccgcgcctcggcccctgaacttttgcctgcaccggggccgccccgcaccccccgccaacccccagccccggcccggctgccgtcggggcgatgaggtcacccgcccttgcacgatatctgttgatt

SEQ ID NO: 33238 - DNA, 72 bp, Homo sapiens
  chr10:102322219-102322291
  hyper
agagcctggggcccccgaccttccgccgactggccgtgggctggccgcagcccagctcggctctgtctcgag

SEQ ID NO: 33239 - DNA, 30 bp, Homo sapiens; identical to SEQ ID NO: 10430
  chr10:102414410-102414440
  hyper

SEQ ID NO: 33240 - DNA, 230 bp, Homo sapiens
  chr10:102414708-102414938
  hyper
ggccctggacgtccccgggcccccgtcttcctcctgggccttctctctagtccctggcagctgggagcggccctcccgcccctgcactccttcctgtcgcgctgtggttctgccctctggttgtcgctcccctagccctcccctctttctctctgcagtgtttcttggggctgttgtctttctgtctgtcactctgcgtctcggtctctctggagtccttctgcctctgt

SEQ ID NO: 33241 - DNA, 15 bp, Homo sapiens
  chr10:102415092-102415107
  hyper
cgcactgcagcgcgg

SEQ ID NO: 33242 - DNA, 30 bp, Homo sapiens
  chr10:102415618-102415648
  hyper
ccgagccttcctcctcgtcctcctccttgc

SEQ ID NO: 33243 - DNA, 135 bp, Homo sapiens
  chr10:102419132-102419267
  hyper
tcagccccagacccacgcagtgcctcacgctcgcctgccccgcccgctccccgcgggcctgcgcgtgactttagcgcgcgcggctccgcccggaaggtcacctccttcatcacggattctatttgcatccggaat

SEQ ID NO: 33244 - DNA, 448 bp, Homo sapiens; identical to SEQ ID NO: 10431
  chr10:102419399-102419847
  hyper

SEQ ID NO: 33245 - DNA, 288 bp, Homo sapiens
  chr10:102430682-102430970
  hyper
tactcctgacaggatcgccgggggcacggctgcgagataaccattagcgcagccgccgataaagcggggaggctgcatttccaaaggctccgcggccattacgggaaagttagtgtgaaacatgttaaattatccccaaagtggagggagcgggggaggcggcgggggagcgggcgcccgagagagccacgagacccgccgcctccgccggggccgggtgactgcgccgtgcccgacacgccgacgtccaccagggggcggccgcgtgcggcccgagcctcggtctgc

SEQ ID NO: 33246 - DNA, 184 bp, Homo sapiens
  chr10:102470093-102470277
  hyper
gcggctcctcccgggcgccgcgtcccgcgctcctgctgccagcccagccggcctggggcgccctagccgctggtcctggcccaacaagtagccaccgacccctcccatgtggcctaggacgggaggagcttctgcccggcagttgggggtgacaaggatggggtaaagaggggcgccgggcagg

SEQ ID NO: 33247 - DNA, 69 bp, Homo sapiens
  chr10:102470339-102470408
  hyper
cgtgttgacatagaaatcagactggaaagaaagcaacatgtagaggggcttccccgggtgtgaggtgac

SEQ ID NO: 33248 - DNA, 305 bp, Homo sapiens
  chr10:102473411-102473716
  hyper
tgggagctgggtgggcggggtggggcggacgccaccaggcgtggcgcggggaacagagcagaatgaaatgcagatgcaaaacgtgctcataagagtttcctctctctccccatctgccaaagccgagattttaatctttaatccatgagcaatcagcgagcagcggcgaatggcacattacagatgttttactgtcgcgggcgctcgcagctttcgcgctcggcacaggcgcgccgggcgcccccgctccgcccgccccctcttctccccctctggttcttcttcctctcccctccccaggtccc

SEQ ID NO: 33249 - DNA, 250 bp, Homo sapiens; identical to SEQ ID NO: 10436
  chr10:102473759-102474009
  hyper

SEQ ID NO: 33250 - DNA, 146 bp, Homo sapiens
  chr10:102475263-102475409
  hyper
gagagtgaatggccgcgtcagccgcaaagaggcccagacagatggacgcaggcaggaagacggacaggagagagagagagacaacgtgcgcccgaggctgaagagctgggtcaagaagagattcggcttccgggagcaggggcgtc

SEQ ID NO: 33251 - DNA, 23 bp, Homo sapiens
  chr10:102475555-102475578
  hyper
ggagcgagaggcagcggagccgc

SEQ ID NO: 33252 - DNA, 366 bp, Homo sapiens
  chr10:102475579-102475945
  hyper
tgtgtgtttttattattattatttctgattaaagaggaattcatctcgtatctgcctcctgccaggggccgaggctccgccattggggttaacggtgcggaagaatacaaaaaaatttcattgaggaggattataaaagttactagctggaacattaacagaagagtaacttgtaaaaaatgcaatattacaatattcacaaggacggcagagcgtggtaaagctataaaattcaacattaaaaccttccacagcctagataacctagttaacaaacatgggattggaactacttttctgtggagacaggaatacgcgccggggctggtcacacctcttccgcgggaggggcggggtcggcggcca

SEQ ID NO: 33253 - DNA, 46 bp, Homo sapiens
  chr10:102483750-102483796
  hyper
gcggggaggaagggacgaggggagggggctcgatgggggaattgcc

SEQ ID NO: 33254 - DNA, 362 bp, Homo sapiens
  chr10:102483870-102484232
  hyper
ggagttggagacgatgataaatatgataatttgtataaaatctgaatgggtcttgttttcagggagaatgccttggatgatgaatgggcccggctttcagatagatggctgataaaaagtgtattggattgttgagagcgattttaattctcattctgtacctgcagatgccgcggccgccgcgcccggcctcctcctccctcctgcccactgcgcggggcggacgccggcccggccggcctcggcggctcaggaggcttctgaaatgactctaattacagagttattaattttaagaggagggtgagcggggggtttatgattattaatcgagcgcccgagctcggcgggcggggcttggc

SEQ ID NO: 33255 - DNA, 13 bp, Homo sapiens
  chr10:102484233-102484246
  hyper
ggccgcgggctag

SEQ ID NO: 33256 - DNA, 285 bp, Homo sapiens
  chr10:102484269-102484554
  hyper
cgcggggccccggggcggctccaagcccggcgggctccgcggcggcggcgaccaggctcgcttcccacttgggctgcgggcggcatggtccctctgcgcccatccggctctcctcacccctgccagtctccgacccggccgtccaacgtccctccctggccggctcgcctgcgcagccgagcatcaggctccgcgccggggtaggcgagcaggtccccagccccaggcccgcagctgtaggccggtgaggaacagctctgctagagaaagcgcaccccaccccca

SEQ ID NO: 33257 - DNA, 30 bp, Homo sapiens
  chr10:102489083-102489113
  hyper
tcccatctctgtctacgtagatacctagtc

SEQ ID NO: 33258 - DNA, 336 bp, Homo sapiens
  chr10:102489328-102489664
  hyper
agaagaccctgggaacgggcagaatctgagccgcgtctctgagtcgcagtgggaaggcggctcaggaaatgcgccctccgctggcgctgggtcgcggttctggctgcgttactttttccttgcatctgtggcccggcgcgccagcctggacactagatccgcaagaagggagttttcccagggccggctgaagaatgagaagtccgagctgcggggacgttgggggtctgtgcttagcggccacagcctgcccaccacgggttcccgccaccccgcctccccacctcccttcgcgccagggctgaaagtcccaggcgcccaatgcgtgcccaagaa

SEQ ID NO: 33259 - DNA, 164 bp, Homo sapiens
  chr10:102489700-102489864
  hyper
cgccatggacccaggacgacaccccacacccagacaccactctttccaggggcagatgctccggcgcgccccgcgccctgaagttcaacttggaatccaggtccgcgcgggaccccgcctagcgccccaagcgcacaggctgagcgccccgccctggcctcctg

SEQ ID NO: 33260 - DNA, 40 bp, Homo sapiens
  chr10:102495101-102495141
  hyper
ggtgagagggtgtgccggcgtctaggctgggctgcggtcc

SEQ ID NO: 33261 - DNA, 67 bp, Homo sapiens
  chr10:102495142-102495209
  hyper
tgggcgcctcaggcagcgagggtggctgcttgcctgcggctggctggggcctcggtgcgtgtgcacg

SEQ ID NO: 33262 - DNA, 182 bp, Homo sapiens
  chr10:102495437-102495619
  hyper
aggacgcggcggccgcggggagcctagcatggaagagcgcgcgggtccggcaggtaagagcggcagagacccgtccgcgccgcaggcgaggactaggggagagggatgggggcggccatggccggggcgggctcctctcctctttcatccctgtgctcagtacccggcgggcgacgtgaagg

SEQ ID NO: 33263 - DNA, 23 bp, Homo sapiens
  chr10:102497153-102497176
  hyper
acgggttagggcggccgcttacc

SEQ ID NO: 33264 - DNA, 46 bp, Homo sapiens; identical to SEQ ID NO: 3599
  chr10:102497252-102497298
  hyper

SEQ ID NO: 33265 - DNA, 510 bp, Homo sapiens
  chr10:102497299-102497809
  hyper
ggggggagctgcggagctgggcaggagacagggctgtgtttgggaaaaggaaaccgcacttcgaggcggctccgcagagcagagctgcagagtcttccgccctcccagccgccttctccctttgcctctttctcttttcaccgccccctccctcatctcttcggtagccacgtttggccggggcacaactccctggaggccctgcccccctagacggccccgagcccttttggacctcatccggctagtttaaaatgacaatgacagaggcgcgtgaccgaacgtgcctgccggacgtcctggcgcaactgccgcagccgggtttgcgaaggatgcgggttttacttagtctcgctgagcctgttccggagcagcgaaaaccatcaggaaagggcgagagaaggaggaaggggattgaatcagcaactagggcaattgtggtcttcagctatcgctgcctatacccccagaacttacaaaaataagccgtttattcgatgccctcccttt

SEQ ID NO: 33266 - DNA, 257 bp, Homo sapiens
  chr10:102498176-102498433
  hyper
ctcccatctcagccccgcctggaacacagctgtctgcctatactaccttcgccaccccctggcactttttacacaccctcacaacactcaagcacactcctacgatcccctcatccagacgctcagcccccaaagagacacatcagaaattctccttaattgattcagaaattgaaaggggcttcctccctccatcagtttcttcaatgtattcgttatccgcgggtctagacctcccagcccgtctagacctagcg

SEQ ID NO: 33267 - DNA, 33 bp, Homo sapiens
  chr10:102498739-102498772
  hyper
gagggcctaatccgtcgcgcgcgcgcacgcgga

SEQ ID NO: 33268 - DNA, 332 bp, Homo sapiens
  chr10:102498832-102499164
  hyper
agcagcagccctagccccgacccgaggccccaagacggcgggccaggaacccctgggacgtcctggctccaggctggacgtaggcggaggtggcaggagtggacaaacccaggcgggtcccacgacgcccctttcctcgggtctctccttgtttcagccagccgctctcgcccctggtcccctctcccctgcgttcgggtcctttgtctccagccacctcgcagcctgtccccgcctcggcggccctgccctttgggcctcccagtctctctggcgggtccccctgccttaccagctcccggctgtggcgcgctctccgcctgctcctcaca

SEQ ID NO: 33269 - DNA, 39 bp, Homo sapiens
  chr10:102499518-102499557
  hyper
tgggtcagcctgcaccgtctccctcgaccacagcccgat

SEQ ID NO: 33270 - DNA, 174 bp, Homo sapiens
  chr10:102501247-102501421
  hyper
aggagggggaaaggccgggcaggagccggtcaggcctttctgcggaaggggctggggtgtaagtttcggctccctgggatctgacagccgagggtatgcgccctggggtgcgccgggacccagagggcgagtgagcctcggttggtcggctctggagttcggttgtcagaagaa

SEQ ID NO: 33271 - DNA, 743 bp, Homo sapiens
  chr10:102501726-102502469
  hyper
ggcaggtcccggccacgggggaggggcgcggctgggatgctcccgcggccccctccgtctcaccaaggctcagccgccttcccaagctactggaggccgggcgcctgggccccgggtcagggccctgcaggaggaggagaggcaaccacgcttctgccttttctcgcctgggcagaaaacgctgggccagggaactggaaaccggaaaacaggagaaagggtttctggaaggcagcgggagcgggtggcagcggggcagcgggcagtggactaggtctacaccggcacttcacttttgcacaacatgcccagaaacgcatttgagagccctggagtcgcgcttggcttggcttggggcgccggtgcgtgggtacactcgaggtgcggggtgcctatccgccaccccgacacctacacccagacagagcaggcgcggcccagccagaaaaccaggccggcagtagctcggcctggagggcggaggcaaggttgggggccgccaggcgcctgggcaagcctggcagggaagggagccgagaaggcaaaggagccgagatccacaaggaagatttattgggcagatcagatgcacagaggcggctaatgaagcaaatcccgagatgggtatcagagcaactccccaaaagtttatttgcctttaaatttccgcagggaggcgggctccttgtttgaagtgtaaatgcccctaggttggggggtggaagggccgctttgaaaacacc

SEQ ID NO: 33272 - DNA, 142 bp, Homo sapiens
  chr10:102503828-102503970
  hyper
ggcatcccaaaaacccgggtacaagacgcccagtagtagtagttaggctgagtcaggcaggtgcatctctccccatggtatctgccgcccaggctccggccagagggaggggagcgcgagtccgccgcgcttccgcggggcg

SEQ ID NO: 33273 - DNA, 216 bp, Homo sapiens; identical to SEQ ID NO: 10455
  chr10:102504302-102504518
  hyper

SEQ ID NO: 33274 - DNA, 93 bp, Homo sapiens
  chr10:102505756-102505849
  hyper
ggccattctgctgaccgcccagccccgagccccgacagtggcaagttgcggctactgcagttgcaagctccggccaacccggaggagccccag

SEQ ID NO: 33275 - DNA, 43 bp, Homo sapiens
  chr10:102505873-102505916
  hyper
cgcccccgcgcgccccgcagcagccgggcgttcactcatcctc

SEQ ID NO: 33276 - DNA, 141 bp, Homo sapiens
  chr10:102507395-102507536
  hyper
taatcatatatttagcgttgcgggggttggggggggcgtttaaaaatacttctgggataaaatatatttttctaagtaatttccaagcgcaggaaagccgcgccgagggcatcaggcctccgcgggtctcggcgagcgggc

SEQ ID NO: 33277 - DNA, 184 bp, Homo sapiens
  chr10:102507767-102507951
  hyper
ggtggactggtgggtgagacaccgcagcccgagtcggtgctggcggccgtggcgcattccaggcccgactcagcgccgactcgctgcagtcccccagccctggactcccgccgtgtccccttcccatccccaccccttagactggggctgaggggccgggccctgagcccggggaggctgaatt

SEQ ID NO: 33278 - DNA, 10 bp, Homo sapiens
  chr10:102508280-102508290
  hyper
cagtccgggc

SEQ ID NO: 33279 - DNA, 1201 bp, Homo sapiens
  chr10:102508341-102509542
  hyper
cggctacgggttgatcgctctgggtgcaggatttctagactgctgtaggccagggagaatggggcacaggaagcaccctcaggcctggcacccagtggccgcctcggttccgagatcgggagcccgcgctggagccgggttggaaaccccgtgcccttctcttggccgaaagagcaaaagcccgagccgctcggtttcctgggggggctgccgaggtctgaggggtcaaagggactcgagtcgggtttgggtcggctacacagggcgccccgagagttattaactcgccagcgaggcctatgccgtgccacctgggcgagacggtgggccccaaccaggctctgcgaggcgcggcaggcaggcgagcccaagcagccggcattctctgcctgctgcctggagccgctctgcctccctgtctctgagcgcagcagaccccgggcccctgcctcatccgccttccttgctctacttcagatactaaggaggtgaaagagagatacggtccccctacagataaataacattagaaaaacttcccatcaaaaacaaacaacacaggaaagaggtagaaaaattccgattacaatttaatactttttaaagaagaggcagagagcaaaggggggtgtgtgtgtcaggcacttatcccctgtctgtgctaggagctcggataaacagtcagccgagcctcgacgcccccaaatcgtccgcctccaagccccgcacgcgcggacagctcccgggttgcctgcggcgcaggcgggatgctgcttcgcactagtccagtcctctgccaggcccttcctctcctcgctttcttacgccctttccgctggcatgaattcccctttggcattttctcccctctcccctcttttctgtcatctggtttctctccagtcccccctttgctttctaccttgcgtcgcaaggcctgagtcgccctctcgcccagcccccagtcttcagcccagcgtctgtgcttccagtccccactcctccgcgtggtcgtggaggtccaccacctttcttctcaagctcgggaacatgcccttccgccctgcctgcttccttcgcccgtcccgggccgcggaccctgactaatggccggtccctgctgtgtgtggggtgttgtgtttttttcttgtctctccccagcagggcacgggggtgtgaaccagctcgggggggtgtttgt

SEQ ID NO: 33280 - DNA, 33 bp, Homo sapiens
  chr10:102586113-102586146
  hyper
ggaggtagcttccgacgacggctcccaacccac

SEQ ID NO: 33281 - DNA, 39 bp, Homo sapiens
  chr10:102588299-102588338
  hyper
catcggacgctctcccgggaccgccgcaggaccagtttc

SEQ ID NO: 33282 - DNA, 1165 bp, Homo sapiens; identical to SEQ ID NO: 914
  chr10:102589250-102590415
  hyper

SEQ ID NO: 33283 - DNA, 78 bp, Homo sapiens
  chr10:102890941-102891019
  hyper
tcccctcccctccctcgcgctgtcattcaccccgctcctctccgcgcacagccaatggagagacccagtcgaaaccgc

SEQ ID NO: 33284 - DNA, 936 bp, Homo sapiens
  chr10:102891020-102891956
  hyper
aagctctcttgcaccgggctttttcgcctggtgattgatgtcccagagtcaacagcgagcgagcagccggagcggggaagcagaagccagagaggggaagaatacggcgccccctctctccctcccctcccccttctactttagcctttctgcgcacttcgcttccaagtctccgcgcagccaggagccgctgttgcctcccagcccctgctagctgccccccgagccgagcgcagcgagcgccgccgcccgggccccccggtggggccagggccagcatggagcacctgggtccgcaccacctccacccgggtcacgcagagcccattagcttcggcatcgaccagatcctcaacagcccggaccagggtggctgcatgggacccgcctcgcgcctccaggacggagaatacggccttggctgcttggtcggaggcgcctacacttacggcggcgggggctccgcggccgcgacgggggctggaggagcgggggcctatggtactggaggtcccggcggccccggaggcccggcaggcggcggcggcgcctgcagcatgggtcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccctggatggagagtaaccgcagatacacaaaggacaggttcacaggtgagtccggcccgcgcgctccccgcctggccgcggcccgggctccgtgctacccctgccccgccgggtggctccccaaagccggttctg

SEQ ID NO: 33285 - DNA, 159 bp, Homo sapiens
  chr10:102892090-102892249
  hyper
cggaggagctctccctggtcccctctccggatccactagccgggtcaggcagagagaaggaggccatagattcaggaccaccttctgcagctactcttggcctgggaatcttagagaaaggggtgcaacgtgaacagtttcttccgtcctggctgctgt

SEQ ID NO: 33286 - DNA, 369 bp, Homo sapiens; identical to SEQ ID NO: 915
  chr10:102893583-102893952
  hyper

SEQ ID NO: 33287 - DNA, 1199 bp, Homo sapiens
  chr10:102894090-102895289
  hyper
cgcaggtcaaaacctggttccagaaccggcggacaaagtggaggtgagcaagcggggcgggccggccgcccgcgagcggcgcggtctcaggcagctctcggttcattggcctctcgtggggcgcacatactttttccgctcgcggtttctgatcctttcggaggagcgagctcccgctaggcttgcggggagctggaagcaaccgaggccgatagctgggatggggctgaagagccctggctctgttttaccggaggcttcagggctttctggttggcacactctctgccggtgtagacgcggcaggtctattccgccgcttgggcaaacaggcgggttagtgcactccacgcagtccaggctccagggatctgtgagtcctggggagctttttgtttgcgcaaactcttgcttatggaatcctgctctgtcctggagactggatgcagaacagcccgcaccttgttgcagcgctccagccgggctcccggcagagggtctgtggccccagaccgcggccctgctgacggtctcctcccccagacacccggcctttgcgcagccggtccctaccctggaaggagaaaatcaatccgcgccggctgcggcggggtttcgcgggtcccactggaaggggaatcaattaggagcagatgggtgtgtgtgagaaagagaattttccttctcccatagccacaactctagttactacgcaatgggctttttgttttgttttgttttttcacatttacgctcacggacgtgaagcgtccccaacactctcgagcagcctccctctccgcgcgcactgacgctttctccggctgcaccctctggcacgctgcaccctctggcacgctgcaccctcccgcacatctggcccttgcccgccggagtttctcccctagctcaggccccatggggtagcgcgggagagtctgggcgaagtcggcggcgccgagacgggcgggccttggggcaggaggaaggaattggagtttcctctttttctgaacgaaggcgaggaatctgcctgggattccgcctacggggccacaaaggaagccatggccccacgattctaccacaacatttctgacgctgggaaaggagtgggggatgcggcctcagaccttggaacgctaaagagggagccagggctagctcgggggttggggggactccggtttccaaggcct

SEQ ID NO: 33288 - DNA, 716 bp, Homo sapiens
  chr10:102899140-102899856
  hyper
ggagggttcagggtccgaagacagcagccagcctttccgccccatccccgcaggcccgcggagtgctcaggttgggccctgacgagctgtgtggagcgtagtgagcaggttctggcggcagcgccgggtctgctgcaggtctcccgcattcaccggctgtggcacccagcgccaggccgcgcaaaatccagaaatagcctccagcacctcagaagtcgtctccctctacctgggcaggtctgctgtcccctctgctcccgcaggactggagccaccgagctcgcgccttcttctcggggtgcgatttctctcctcttttggactcaagatcaatgcttcccggccggcgcagatcacacagcaggaccccaggggagactgtggccttcttcccgcctcccaattccccaagaccgcctctagaggctgctgtgtccggagaactccgagcattttctggacacagattgcctaacagaggaacaggggttaggtggggagcggctggccggcccaaacacagcagccccaagctggctcccaagcctgggctctccacccccgctcccatcctctcttgagcacagttaggcccaacacccctgtcccccaaaacacctcctaccctccctcccccccagcccccatcttcaggaacatcacagggctcacactcactaaccgcggagagcacatgcaggccggagccctcagcc

SEQ ID NO: 33289 - DNA, 420 bp, Homo sapiens
  chr10:102900262-102900682
  hyper
ggaggctggaggggaggggggctgcgagggtcacagtcaaggccaactactcacaacagaaagctcgaaactctccctctacctcccctgccggaaatgacccgtctctgttcaaaaatagaaaaagaacgatcggaataattgttcgcagaggtgccgggagagaaggggaattaacaaacctgcctgcgcggagaggtctgcttccttctttggcttcagaaccgacggcaatcaccaaattcctgcggccagcgagccctgcccctcagatctggccctctggttgagtgggtggcggcctgaggggccccaggaacccaggcagggatggggtcctagaggccctgtgcagtgcggtgggtggcacacagagaatctggctcaacctgttaactataatagcggctttgtgtggcc

SEQ ID NO: 33290 - DNA, 83 bp, Homo sapiens
  chr10:102905699-102905782
  hyper
ccacaaggacttgtccgggccgggccgggctagatgccgagatgtaattcaccagatttgtgaaaagacgagaaatctgctct

SEQ ID NO: 33291 - DNA, 191 bp, Homo sapiens
  chr10:102975143-102975334
  hyper
cggggctcccttcctcgctcttccttcggacacccacagcagctgctcctggggaatctgcccccaagtttcgaggaactgccccccagcgcccaggaggaaaggggaatggggctgtaaacgtgtctaattcagacccgttatccagatcggaattagtttctcgcggacacctccgcgccgcgggccat

SEQ ID NO: 33292 - DNA, 285 bp, Homo sapiens
  chr10:102975595-102975880
  hyper
cgccgtctgggaactcgagatccgaggaggggcaaaagccgccggcgccggggtcaggcctggtggacccgagctccttggtgagacctggacccaccgtcttctccttcaaaagcacagggtggcagcggggaaaggatacgttcccattgaaggggcgatggaaaactggaatcagagactgaaggaggcggggcatgggaccccggaagatgcctcccagacgttccaggcctgcttgcccggctccggaggtcttagcagcatcctcggaggttgccaaac

SEQ ID NO: 33293 - DNA, 242 bp, Homo sapiens
  chr10:102976414-102976656
  hyper
gcaggatggattagccgagcaacgacctagagtctgagaaacgggcaggcacaaacgcttactcagaccaagggacccagaagtcccggacttccacaccagccccgcatccaagcgcgcgcctttgaaaccttcggcctctcctgccagccagagacccgccctgccgttgccatcgggacacgcgggatctttatttatacgctggggtgggtcttttccttcctcgcagaggaggagcg

SEQ ID NO: 33294 - DNA, 1240 bp, Homo sapiens
  chr10:102977051-102978291
  hyper
attaaaaatatttatcgggagcagatttacgtttctgggtttccagtctcggggcgtctgggtaggctattaagagtaattagcatcttttgcgcatgcagatttacttcgctcattgccacataactcatccctaaaagccggcgcaggcgaaagcaggcgccgccggcggagccgctgccacagctaccgccgctgcccgcccgagcccccctcccctcctgcgctgcccgctcccagtctctccggcccgaattgtccgctccaggccccagacgctgaacacggaacgaaaaggcttccatcctggagacctggagacgagtgacgccagagcgacctcgtgcggttggggaaggcccagactaggctctccaggctggggccgcgccgtctggaccccaggcattgcgaccacgcatgtgtgtgcaccaccgagtgggcgcttgtgtgtgtgcacgctcacgtgcgcgcgagtgcacaggagtatggttgctagtgcgcgttcctgagagggcgaaggggcgcgtggaaaacgagctgatcaccatcctccccttccctgcagcccaccggttcccaggacgacgctcaaacgtcagtcctaggccacccacctagggcactgagtttcagagggagactcgggcccctaccttgcctcgaattcccttctacagagccagttccatccagccaaacggcctggagcactcagcgcccagccgggggaactgggaggcccaacacccggctgcagccgagcgcatggctggcctggtaccggtgagaggccgccagagaaagcgcaggcggagccgggggtcactgaacagagactttcagggtcgctggggggcggctggagacgatgaggccacgcgactgaagggattggggggtgaggagtggtggtgggggcggacaaagggacaacgtggcggtggacgaaccagggccagagagggccgctgtggctcccgctcttcgggccgaagcacccaccacgggttcgttattaacgcgctgggaagtccgcaatccgcccaactttcttctctttaatgagcctagaagaggctgccctgaaggggtttgttcattaaagatgtagctggaggaatattgtctcattaattatctggttttaattacactcctaccctttgaatccagagatgggaaaagttgatttggtggcgccgcccccttgagcttaaagggtcggcctggctagggg

SEQ ID NO: 33295 - DNA, 392 bp, Homo sapiens
  chr10:102978742-102979134
  hyper
tccaaggacatggctcggtttccagggtccccagagctgggacgccgccgggaaaccatggtcctggaggggagggagttatttgagggggtgcttgtccctgcctcgtcccttgtcaggccccgcgcggcgctaaagcgggggccgttttccctttaaatcgcggacactttgacaggggacattaaggacccggctgctcaggctgagcagatcataaaaccggacaggcaatttctgctcccgccaaatagccgggcaaactcgttctgcatctttggttttaatgcactaaactggcagctaagcagggagcgagcaaaaggggggtgggaagcccccccccccacatacacgggcgcacacaccggcacaggcgcaaacactccttc

SEQ ID NO: 33296 - DNA, 770 bp, Homo sapiens
  chr10:102982287-102983057
  hyper
gggggggggggtccccgcggcgacgggaaggggcggagggtaggcgcgcggccccagctcgtccctttcaggggggactcatgcatcaaacttcaattttccggacgattgaattagtgattttttttctcctgaactaaaatacacttaagtctttgggattaattaccacgttctggtccctcagactggagtattacttatcggagctgcgtctgacaccggcccgacacctcgtaaaatagggaactgcgcctctctgcctcaccccgcgccgctcgccaggccaccaagccgggaaaggcggagcgaggggaagccgaacaagcgggatcggccgtccgcgcgcggaggggttcctagactggagagcagaaactacccgcgtcccgggacttggcaagccccgtcgagccccgggacacaacggggaagggagagacaaagccgagccgcctctcctggccagcccggaaccgaaagtgggtccgtagagagcccagagtcctgggggaacagatgggcaaagggctctaggaggtgatggaactcaggcccgaagggcaggcagcccacaggataccaagccttaacgaactacgccagaagaatgggcgtagggcccacagcccctcacacaacccaggccaagctccctcgtacactcagaccaggagaagaaacagacacgcaatacacaagccccgctcccttggagcctacacttgggcgaacacaccactgctgtttgcagtatcccgagacaggcc

SEQ ID NO: 33297 - DNA, 293 bp, Homo sapiens
  chr10:102983087-102983380
  hyper
cgaacttgggatttgaggctctctcacatcgccggtcccagcggcagcgcctgaggcacagccaagaccatccgaggtccccgggccgcgcgcaggtagcagacttcttcagaactgggggagctaaagagagagtgggcttagagcccaggcctccctggatcccagatcctcgcctccgcctacagccaagcccctcagcttttgcccagagctgctgacttcctcgccgcctccctgcgcaatgggacctagagataagccccaagcccgggtgctagtccaggcagagt

SEQ ID NO: 33298 - DNA, 492 bp, Homo sapiens
  chr10:102983434-102983926
  hyper
cggctgggctccggaagcccacccggaacctgatggaggcagcgaattcctcagagcagaggacactgcggagaggctcgaatccacttcccacattgtgcgggaccgagcgcgcagggcgctctcgcgtggcctccttagctcgggttcagccgaggctctcacgtacacttcgttaccccttccccccgccgcagctctggtccttccttccactggctctcttctctggcctatggaaacaacgaactacttttcgcctttcaaggcccgggtcccaagccacctcctctgtgaagccgccaacaccctggtagctgcctctcagtgttttgcaactggcacggccctgtccctcggtccgcttctactagcgctgggggtgctgcgagtcttgcccactagactaggagctccttgagggcaggaaccgaatctgattcgtttccattttcccagcccccctgcgcggcctggcgcagaaaagacgcg

SEQ ID NO: 33299 - DNA, 15 bp, Homo sapiens
  chr10:102984356-102984371
  hyper
cggaggtgccagggc

SEQ ID NO: 33300 - DNA, 29 bp, Homo sapiens
  chr10:102984512-102984541
  hyper
cgaggaggcgcgcgcggggacctaatcca

SEQ ID NO: 33301 - DNA, 1806 bp, Homo sapiens
  chr10:102985147-102986953
  hyper
ccactccggtgacagcggctactcgccagcccagcgacaacaaaagcccggagagaaacccgctctgtccaggaaagtgaaagcggcctcagcccccgccccagccggccttggggcgccgcagacccgagagagtccttgcaagatccatacctctgcccccagcggtgtgccggggtgtggaggcagaattggttaatgttgccagaaattcacaccagctcccagacgcttgggcttacagttccaggtgcccacattgaaattcagcctggccttgatgcctttagcctttggcccccgactccccaaggatgaggccctcggggctagaatcgaaacttgggaacccaaggctccaccccgcgtctgactgagtgatacctgcagcgctcccggggctcagccctgttttcggggagtgcagggagaatgcccttgggtctggggtgggatgcaggaaatgcagggcaagaccccctcccaccctttgttcaacacaaattaatgttgtactgtggtgtgcccccacatacacaggcattttctcccagcatttcacggctcgttttttaccccgacctggcgaagcccgcttctctcccgatttagcagctgcctcaggtttatgggcaagaggcgcctcctcctgctgcttccccctcgcccttcactcttaagcctgtcctgaaaatcccccccaaatctccaaggctagggcgaccggcacgaagagcggcaagaagcccagcctgccgctgcttctcggaaacgggcccaccactcagacacggtcgccgccggttctagtaaaatggcaaagactttatttattggagaaagaggccttgggtacagtctagggaggagaggggaagggaggagcagggaaggggcactcgcagcccactcacatccagccaccctcctctggccaagtcgggtaggagtggggtgttcgaagtggcaagagagacccagagctgtggaggaggtgaggtgagggcttgggtcggcctcctctctgtctctgtcacatgcaaaaaaattctaaaaagagtacaaaataattatagggctttgggttctgttttcgatagttggttggttggatttccccctgcattgtccctaagagccggactccaacagtcagtccgaggaaatgcgggagggagggaggaatcttaaaaacagcattagtgggcattaggaggcagaaatggcatcgaaaacagacttttctctcagagggtggggaggaaagatcgattttgaaacttgcaagtcaggacctgactgcccacctcttcccctcccacatgaggaaaaaaggcccgaggaaatagaagtcaactgcaataaggccgagggaggcgaggaaggagcgggccggtgcattcgccacatgcagagaaaaatcaaaacagccggagctgccactcccctagaccgcagggttagtgttccccgccctggtttctgtctcgccctcagcaaacccggcagcccgagagctttgaaaacatcgaaatctccgagatttaaaaaataataataaaagaaaggaaaaatcaggctgcggtgggaagaacccgctatataggtttaaatatttatatagaagccatacagaattgcacggcgagggcttccggggcggcggaggccgctggtggcggccggcccggccggccagcctgggtttattgcttcgagagggaagaggcggctgccaggagccgagtccggggccggggacaggggaggaggcgggagttggcagaggaggtcccagctcccctc

SEQ ID NO: 33302 - DNA, 352 bp, Homo sapiens
  chr10:102987206-102987558
  hyper
gccaccgccggctgtggcctccgagttctgctcgagttcggccagcgccacgatgtccatctgcccgctggggcccagtttcttggcggactctacgtcggccttcatctcctccaggtcccgcttgagcttagcgcgccgattctggaaccaggtgatgacttgcgcgttggtgaggcccagctgctgcgcgatttggtcgcgatcggcgggggacaggtacttctggtatagaaagcgcttttccaattcatagatctggtggttggtgaaggccgtgcgcgactttcgccgcttcttaggggtctgccgctgcccaaagatggtcataccgtcgcggcctgggaggaaa

SEQ ID NO: 33303 - DNA, 215 bp, Homo sapiens
  chr10:102988150-102988365
  hyper
cggagagggcagaggcgagcagaggcataggggacgaagcgcgcagggcacagggcgcgaggcgctgggtgcaggggaacccagcagctgcgcctaccttcggctgcctgcagaacgctgacctccagccccttaaacgtcttgctggcgagctcctccagcgcgcacagcggcgaggtctgcgagagcagcgcgcggcccgccaggggcaagcc

SEQ ID NO: 33304 - DNA, 141 bp, Homo sapiens
  chr10:102988734-102988875
  hyper
aggaggggagaacagcgcggggccccgggaagagggcgctgacgcgggcgccgctgctgctggggcttccagcaatccggggccggagccggggcgcgctgcgcggggctccagtttcgccaaccccggtgctatttaaag

SEQ ID NO: 33305 - DNA, 1125 bp, Homo sapiens
  chr10:102989172-102990297
  hyper
tctctccctctccctcgccctctctttcactctctgtctgtccaatgcaggcggctgtaagttgggaagctcattaattagcgggccgggggtaggaggagccggctggaattagcctgcctaatgcgcctgtcagtccgggcgctgcgctgcgttcggcccgagctgtttgtaaattacattagctgctcctttattgcacccgaacctcgggcgactgaaaagccaccgcccccaccccaaactgcgagccgcgctcctggcgcacccgcctcccgccggcctagctgcaatgaccgcaccggcccgaaggtctcggtctctccgacccgggatgtggagcccgaaagagtggtgggaaccccagcccgggagggacgcggccgccgctcgggccaggtaggaccaggagcccgggtgggccccgctgccacccagagtggactttgcggagctgagatcaagagcccagcgcctctacctctgaccctcttgcccctcaccccactgcctgggcgacgcgcctggggagagggaatctgaagccctcctgcgctggcccgcaggaggtcagagccggctgcgcagccttgggtgggcgacgcgggaagggggtggaggaccccaggggttgggggagggggctagtcggagagctcagccttctccacgcggagaggcggaggagggaattgttggcggctctggacgcctctccccggcctgattccgaagcggccgccctacctcctccggcaatcttgctcactttcctccggcagccgctccccaggctggctggggccaccaacggcctgatgatgggcgtctgaagagtagccaggccaggtgccggggctaacggggccggctccgtgcctccctgctgcgctccgcccgggccccggccggggccccgctgccggccccgcctagcccagcgcccggcttgagtgcatggccaggccgactccagctgttccggatgcggggcgggggcccggcgggagccaggccgcggctggggctttgctctcaggaactcgcagggaggccaggcttccagttaggctggggctaaagaccttagggcccgggatctgtgaatatcgggagaacatgttg

SEQ ID NO: 33306 - DNA, 462 bp, Homo sapiens
  chr10:102996019-102996481
  hyper
aggtctcactactgtcggggggcgccgggcgcaggccgggcatggggcctgagcttaggccaggtggaaaggtggaaggacctagtggggacagacgaagagaccgaggagccgcccgcccggctaaatggacacaggaaaggcctgagtcaggcttctcataataaataaactgcacgtgaataattcagcagtcgcgcgggggccggttgcatcagcgccgccgccgccgcgcggcgcccaattccccgcggaggggagtagccaattaaggcacttgaaaagggagtcgggtggaagatcccccgcccaccagtatcctggatttacccaggtcgagttcagagagcctccccggtcccaaccccctcgggccccatgggtcagggggccgcctgctgggaagtgctacctcagctaagccgctcaggtgtcccgagactccgggcaagggaagacagg

SEQ ID NO: 33307 - DNA, 123 bp, Homo sapiens; identical to SEQ ID NO: 922
  chr10:102996596-102996719
  hyper

SEQ ID NO: 33308 - DNA, 251 bp, Homo sapiens
  chr10:102996977-102997228
  hyper
ttccattaattaggtcgactcccttccttcgccgctccctcctgtccccactcagcctccctacacctatgcggcgagcctcgggccaagacctccgccctggctccgccagtcctgcgggggccggcatgcaccagacctcaaaagggatcttcacgggaattccgcatagccagatcccaagcctccagggaggccaccagccctcccccatcttcttcttcctcctccgtctcctttcctcttccctc

SEQ ID NO: 33309 - DNA, 303 bp, Homo sapiens; identical to SEQ ID NO: 3619
  chr10:102997281-102997584
  hyper

SEQ ID NO: 33310 - DNA, 581 bp, Homo sapiens
  chr10:102998278-102998859
  hyper
gcctctctctgagatcgggtcctcctcctgcagggcagcagagtggaagccagggcctgggaccctctggctgggcaaggagggactggagtccggctcccggtgaccccgtccccagtgccagcggtggggtcgcctgtggcggcccggacaggccacgggtccctctccccaagtcccattacgttgtatttatgtttcattttatagtttttttttcctcctcccttattattgtctcactctgggggaggcaaaggatataatatattcatctttattataccaaatctgtgtgaagcatttaataaaacgctgtttccacacagccagggatattagtgtgagctatccttaagttaatgctcctggactgagggcgccgctgccacagcgcctgctgccggcgggtcgcgggaagcgtaggccctggccgccgcgctccccgcgcgggtccaacgccctgggtgcccttctcgcctgcgccttgaagcccccacgcccatcctagcgcgtctctctgtgacctctcggccgccagcctgggaggaggggtttggaagagccgaattcaagcaccc

SEQ ID NO: 33311 - DNA, 1 bp, Homo sapiens
  chr10:103043864-103043865
  hyper
g

SEQ ID NO: 33312 - DNA, 304 bp, Homo sapiens; identical to SEQ ID NO: 924
  chr10:103043924-103044228
  hyper

SEQ ID NO: 33313 - DNA, 106 bp, Homo sapiens
  chr10:103044300-103044406
  hyper
cgtgcctgcctcgcctccagcccggggtaaggagatccacggaggcctctgcgcctaaactcaggtggccagacagagttggggcgggaggcgggtatacggaaag

SEQ ID NO: 33314 - DNA, 79 bp, Homo sapiens
  chr10:103051188-103051267
  hyper
tccacgctccctagccgggctgcgaaggcccagatctcccagcgcctccatgccgcgtcggccgcggccttgggggtct

SEQ ID NO: 33315 - DNA, 55 bp, Homo sapiens
  chr10:103052659-103052714
  hyper
ggcaggagctgtgaccgcatcactctgcctcccgtttccacggattgacacagga

SEQ ID NO: 33316 - DNA, 80 bp, Homo sapiens
  chr10:103326534-103326614
  hyper
cccagaccgaggagccgtgaaaccacgcggcccttctcggcggaggaacaaagccctgcgctcagcggccgcagggggct

SEQ ID NO: 33317 - DNA, 15 bp, Homo sapiens
  chr10:103534562-103534577
  hyper
cggctgtagagttgg

SEQ ID NO: 33318 - DNA, 600 bp, Homo sapiens
  chr10:103534896-103535496
  hyper
acaccctggggctcccggccagcccggaacagggaagcgagctccctgcccagcgcagggcccctgcccgggccttcctagaggagcagggcgcttttaagtagggaggcagccctccccgacccctgacatttataaagacaaatttacggagcaaatgttgagagtgcagggaacctgggcacccgatcattgggccaaatcggccacaagcctcccccgaggggcgctgagagggtctctgctgcagtcacccggcttcccctggcatcgaacatccatcccctggccgcggctgcccccttcctcggcggctgggtgttccctatgcccccagccggcgaggatgcatgggggacagtgctgggctccgagaccttcgtttctatcctggccactcactcgctgtgtgacctcaggaggggtgctacctctctgtgcctcagctccctcctcggggtggctcggggctgggtttctaaggtgccctcagccctcccgcgccggccgcagagtcagtcccggtgcccccgaccggcgctgcccacccgggtctcacaccggcgcgcccggcccccgcctccgcgcacccctcctcac

SEQ ID NO: 33319 - DNA, 49 bp, Homo sapiens
  chr10:103535722-103535771
  hyper
acgcgctgagcagggcgcgagcggagagggtgcgggtgcgggaggccgg

SEQ ID NO: 33320 - DNA, 48 bp, Homo sapiens
  chr10:103535841-103535889
  hyper
cgccgctgccggagccggtggccgctggctgctcgggagccggagcgg

SEQ ID NO: 33321 - DNA, 117 bp, Homo sapiens
  chr10:103536140-103536257
  hyper
ggcggccggtctgggcgcctccccctatccccggcctgtcccctcgcgcgctccccggtcccggacgcgcggggatgggggcgcctagggctgcaaactctgcgggccgggagaccc

SEQ ID NO: 33322 - DNA, 204 bp, Homo sapiens
  chr10:103536299-103536503
  hyper
cgggtctgggtctccgcctccgggcccagccgcttccgccgccggctacgcagtggtctccgagccacctactgtgtgtcccgccgggcccctgggagcggccgctaaccatgcagcgaatggctgcgcacccggccctcgcgcagtgcgtgccggtgccacccggaccccgctcccctgtttcggccgcgtgccccgtcctgt

SEQ ID NO: 33323 - DNA, 202 bp, Homo sapiens
  chr10:103986018-103986220
  hyper
gaggcgtatcttggtcgagattggatagcggcggggcgcaggaaagaggtcgcgccagcccgggcaggcagctttgcaagtccgcgttatatatcgcagtggctgcgcccgggatagctggctgcgccgccgcgcacatgcctaggttcgacgccctcctccctttgcccaggagttccttctgtcccggctctgttccgtc

SEQ ID NO: 33324 - DNA, 172 bp, Homo sapiens
  chr10:104000813-104000985
  hyper
ccctactccctgcctcgcgaagcccctatcctggtttcaagtctccggcttcgttccggatcctctgagtctcccccttccctatcccctggttcttaccctgagtttcccttttcccaagtcctggccccaggtctgcagtccgccctcccattctcgacctgttcccaag

SEQ ID NO: 33325 - DNA, 92 bp, Homo sapiens
  chr10:104001519-104001611
  hyper
gcgctccggctaggacgcttaggcagagccaagtgggcgagagtagagtggtcccggtagccacgggtaaaagggatcggctggcagcgaag

SEQ ID NO: 33326 - DNA, 153 bp, Homo sapiens
  chr10:104168680-104168833
  hyper
ggctgaccaccaggtcggtgtagagcacgggcttgaggctgcgcgagcgctgcggccagccgtagcacagggtctccgcgccgcggtgggtgcgcccgtagcgcacggagcacagcgagcgcgagcgcagccgcccggcgctgctgtggatgc

SEQ ID NO: 33327 - DNA, 216 bp, Homo sapiens
  chr10:104170047-104170263
  hyper
gctggcgcctgggaacgggacctgctcacagggagccagaaagcagtttctagctccagctttgcgctaactcgctgccagaccttggaaaagcttagtccctctcaggcccctctccctccgggttcctgcagcgcagcagcaccgggaaggtctttttggctgtccacgcggcgggggagcagtgtggagtgtacccccatccaatccctgtcc

SEQ ID NO: 33328 - DNA, 106 bp, Homo sapiens; identical to SEQ ID NO: 3625
  chr10:104170407-104170513
  hyper

SEQ ID NO: 33329 - DNA, 287 bp, Homo sapiens; identical to SEQ ID NO: 3626
  chr10:104170514-104170801
  hyper

SEQ ID NO: 33330 - DNA, 78 bp, Homo sapiens
  chr10:104629270-104629348
  hyper
aggagacagtgagtgcgcgccctgagtcgcaggccgaggagacagtgagtgcgcgccctgagtcgcaggccgaggaga

SEQ ID NO: 33331 - DNA, 209 bp, Homo sapiens; identical to SEQ ID NO: 3627
  chr10:105036450-105036659
  hyper

SEQ ID NO: 33332 - DNA, 163 bp, Homo sapiens; identical to SEQ ID NO: 3628
  chr10:105036700-105036863
  hyper

SEQ ID NO: 33333 - DNA, 19 bp, Homo sapiens
  chr10:105036864-105036883
  hyper
ccttaaaagccgggcgcac

SEQ ID NO: 33334 - DNA, 877 bp, Homo sapiens
  chr10:105036893-105037770
  hyper
cgccctgcctgccgcacctctcctttcttctgtagctcgcgttgaagccgcacgtccggccccgatcccggcaccatgagcttcggctcggagcactacctgtgctcctcctcctcctaccgcaaggtgttcggggatggctctcgcctgtccgcccgcctctctggggccggcggcgcgggcggcttccgctcgcagtcgctgtcccgcagcaatgtggcctcctcggccgcctgctcctcggcctcgtcgctcggcctcggcctggcctatcgccggccgccggcgtccgacgggctggacctgagccaggcggcggcgcgcaccaacgagtacaagatcatccgcaccaacgagaaggagcagctgcagggcctcaacgaccgcttcgccgtgttcatcgagaaggtgcatcagctggagacgcagaaccgcgcgttggaggccgagctggccgcgctgcgacagcgccacgctgagccgtcgcgcgtcggcgagctcttccagcgcgagctgcgcgacctgcgcgcgcagctggaggaggccagctcggctcgctcgcaggccctgctggagcgcgacgggctggcggaggaggtgcagcggctgcgggcgcgctgcgaggaggagagccgcggacgcgaaggcgccgagcgcgccctgaaggcgcagcagcgcgacgtggacggcgccacgctggcccgcctggacctggagaagaaggtggagtcgctgctggacgagctggccttcgtacgccaggtgcacgacgaggaggtagccgagctgctggccacgctgcaggcgtcgtcgcaggccgcggccgaggtggacgtgactgtggctaaaccagacctgacctcggctctgagggaga

SEQ ID NO: 33335 - DNA, 86 bp, Homo sapiens; identical to SEQ ID NO: 10504
  chr10:105041683-105041769
  hyper

SEQ ID NO: 33336 - DNA, 95 bp, Homo sapiens
  chr10:106398593-106398688
  hyper
tgcacctccccagtgcgcataggacttgggagaccacactcctccgggctgtgtgagcctcgggtccgcccagatctcttatactgtggcacctc

SEQ ID NO: 33337 - DNA, 61 bp, Homo sapiens
  chr10:106398825-106398886
  hyper
cgcgcccacctgggcctgcggcgctggaacttttcttaggaatacccgctactccctgtct

SEQ ID NO: 33338 - DNA, 1259 bp, Homo sapiens
  chr10:106399306-106400565
  hyper
aactctatctactcccgaaggggaggagcagggctggaggctgtctctctctccctaagcctcctccctcctgcctcctcctttcttaatagctcctcctctagctcctctagtctcagacttttcaacccctagaatcccaggggcttctcggaggcggcgagctacaccacatgtcctggggcctgtaaaccgcagctcgaggtcgtctgtgggtttagctcatttcccttcagcccacctgaagtctccttcttcctacggtcacgaaggatctcagctgcaccaagcgcgcaggctacactcctgcagtagcggattggggaccagataagcccacgcggctcccgcctgagtaccctcttaactggcggccgacactttgaaacaattgagtccgttcagaaacggactggggagagtgagggcacgacctcaaaatcctaggcagcaaaatgaggtctggatcctccctggaagaacagacatctcgactactctctcgccccacctctggccgggaggtcggggcaaggagaatccctcaaccgagaagatctggcaagtccccgatcccaccggggccttccgcctcttttccctcatcccctaggaggctttatcaggttctaaccgcttgtagtgggggccgtgggtgctcggggcgccaagaggagggggctgccgagagcggcctgcctagttctcagcattgcctctttgaccactcgcaggctcctggaaatgcaaacacagcccgtgcgtgatccgcacgcgaccaaaagccgagcgcacacctcccgcccccgccccacttgccatcgctcacactaacgtgcacacatgctcgtgcaaacgcgcacgcacggaaccgcgcgccccctcacacccagccgcgctcccggcccggctcagccaggtgcccccacgcggcagcgcccggtctgcccgccggccccctgcgaacccctcgcctcacgcccgcctgcctgcgcgcacgcacgcgcacgcacgcattccccacgcccccgcgcgggggcgcaggccttgggtggcggggtttggccgggagccggccgggccagggagcggcgagcagagtccagggtgcatcccgcgcttggcttccgtgcgcagcctccccgcgcggaggcacctggctccctctcggctctagaacgcgaacagttggcgttgagcacacaactcctcctccttctcccccgagacccctgtaccctccccgcgcgccatctccc

SEQ ID NO: 33339 - DNA, 136 bp, Homo sapiens
  chr10:106400566-106400702
  hyper
cccctcataacaggcccgaagagtaaacccccaaacgcgtccagaagcggctcccaactcttcgccgggagcacgttggaggctggatttcggagagactcgggattggggtctattgccggcccctcctggatcc

SEQ ID NO: 33340 - DNA, 215 bp, Homo sapiens
  chr10:106400703-106400918
  hyper
gcttgattttcatattttaagaagattttcttattacctttgattactcctttttaccaaatttctggaggagctcagtggggaggattggggggaatctgattttaagaaagaaagcaccgaaggggcaattattaattttcctcgggtttggaatcaccctctggacaagagaacgggcgagcgggagctaggagggaagagtggagaggacc

SEQ ID NO: 33341 - DNA, 111 bp, Homo sapiens; identical to SEQ ID NO: 3633
  chr10:106401322-106401433
  hyper

SEQ ID NO: 33342 - DNA, 681 bp, Homo sapiens; identical to SEQ ID NO: 3634
  chr10:106401510-106402191
  hyper

SEQ ID NO: 33343 - DNA, 554 bp, Homo sapiens
  chr10:106402271-106402825
  hyper
cggccaagtcggcccccagccttggccttcaggtaaccccggttcctccttcaaagtccagggagcggccctggaaagccgtagcagaggccgtaaaaaaaagtttaaagcgtgaagcgaaattccacacccatccagcgctcatgccacaccgctcgccctcacgcacgcacaggcacacggaagtcgctcagcagaaaactctcgacttcaccattgcgtcctgcgccacaaacggctccctgagcggagttgggtgcctgagcttcctgcacacctctccacccgcttttccccgccaccgggttctcctggacaaggatgtaccgagaggtggcgtcgttgagcccggtctggcctactccggcattccgaactgggcgcccgactgagcatcgcgcctgcctggcagctgcagcggcccgcagcgcgtgcccggaggggctccccctacctcgccggcacccagcgctgtgcagccaagcaaagaaaaggcgggggacaggttcccaccatctccccgacttccctccctcccgcggtccctactagag

SEQ ID NO: 33344 - DNA, 127 bp, Homo sapiens
  chr10:108923771-108923898
  hyper
tgagtctcccgtcagcgcaaacgtggtgctggtcagtctcagctcctccatccggaagcgggtggctttgtccgggtcccgctcccgagtcccaggctcctgctgccctccatctcttagcactccc

SEQ ID NO: 33345 - DNA, 115 bp, Homo sapiens
  chr10:108923945-108924060
  hyper
cgctccgctccgtctcctccggccggagcgtgcagcaaccgccatggatgccccagtgccccgagcccgctccagggatagcgctcggtccccgggggccactgagaacagggga

SEQ ID NO: 33346 - DNA, 21 bp, Homo sapiens
  chr10:108924345-108924366
  hyper
cgctggcggctgtggggggcc

SEQ ID NO: 33347 - DNA, 34 bp, Homo sapiens
  chr10:108924367-108924401
  hyper
gcgctcaggaccccaactccatccaagttgcgcc

SEQ ID NO: 33348 - DNA, 32 bp, Homo sapiens
  chr10:108924769-108924801
  hyper
ggtcgaccccgggctcccggagcagtcgatgt

SEQ ID NO: 33349 - DNA, 27 bp, Homo sapiens
  chr10:109674181-109674208
  hyper
ttcacactccctccccgcttcgctccc

SEQ ID NO: 33350 - DNA, 29 bp, Homo sapiens
  chr10:109674466-109674495
  hyper
ggagcagcaggagcccggtctcgcagtgc

SEQ ID NO: 33351 - DNA, 1 bp, Homo sapiens
  chr10:109674853-109674854
  hyper
c

SEQ ID NO: 33352 - DNA, 117 bp, Homo sapiens
  chr10:109674855-109674972
  hyper
gcagccgccagcagagcccggtgcgggaccgggagctgccggggcctcagctccgctctccccacagctctccgtggctgcaggttgaggtcgaactgcaagcgccacggaccctgc

SEQ ID NO: 33353 - DNA, 257 bp, Homo sapiens; identical to SEQ ID NO: 10516
  chr10:110225912-110226169
  hyper

SEQ ID NO: 33354 - DNA, 175 bp, Homo sapiens
  chr10:110671709-110671884
  hyper
gctctcaatagagggcgcgctgggcgaagtaggggcgtggcaggagccccgctccgcggatccaggttgaaattcctccctcctggaatccgaccgtgagcatttctgagcggtggtgaggaggaggccaccaagacacctccctcccgctgtgcaaaggaacgcaggagcccgg

SEQ ID NO: 33355 - DNA, 345 bp, Homo sapiens
  chr10:110671929-110672274
  hyper
cgccgctgtctgccaacctttcccagcttttcccacgattggagccaagagaggtccccggggatctcagttgggcaattgtaagggaaggagctcaggacactgacttcaagatgaagggggaggtcagcgaagacagttctagggtgggcggcggccgctgacagagcaggagccacagccaccggggcttggagataggagcaagtcgcaggcggagggggctgcgggctggctgcctgggcagcacaggacttgagggagctgcggggactcctggagtctcatcaggccttccagtcgctgtggggaccccggctgcgcgcggatcgcctgcgccactgt

SEQ ID NO: 33356 - DNA, 51 bp, Homo sapiens; identical to SEQ ID NO: 3638
  chr10:111216345-111216396
  hyper

SEQ ID NO: 33357 - DNA, 122 bp, Homo sapiens
  chr10:111216682-111216804
  hyper
caacttttgccatcccgggagccatagcggcagagagggggtcccggacccgaggtggcagcgaggggctctgctttggcagctgtcggggctggagctcaggaccccaactccagccaagt

SEQ ID NO: 33358 - DNA, 74 bp, Homo sapiens
  chr10:111217161-111217235
  hyper
cgcagcttatgccctggcttgggcagaaaataatattaattactgatcctttgtgctcccggtcctggcttcct

SEQ ID NO: 33359 - DNA, 120 bp, Homo sapiens
  chr10:112257819-112257939
  hyper
ctggccgtgggcacccgcggggcgcgcggcgcggggccgctggccggcggcggcggcggcatgaaggtcacgtcgctcgacgggcgccagctgcgcaagatgctccgcaaggaggcggcg

SEQ ID NO: 33360 - DNA, 30 bp, Homo sapiens
  chr10:112258378-112258408
  hyper
ctgtggcttgttgtgcgcttgggagggcac

SEQ ID NO: 33361 - DNA, 817 bp, Homo sapiens
  chr10:112403098-112403915
  hyper
gcatattcgcacccacgcgccagggcattaagccgaaccttgcttggtggctctcagccttgaaaggccgcaggatgtccgcgtccacagctgtgaaccggtgagtgcaggtggacgggcgcacgcgggcgccagggtaattaacagggcttcagagggcgtgacggtgaccgtacgttgtcggcgaactctcttttcatcctttacatttccacggagatttggccaataaataacaagaataaaatgtacgcatggttttgtctttgcgctcgtggggtcgtggcggggtcttttaagtgaagagaaaaagaaaccagaaacccacggtggccccaccggctgcttccggggacacctgaaatcagcagctggaactgacaatttggagagccccggggatggtcatctgagacctgggttacaatacaagtctgacctcggggcgagtccaggctttcttcccctcagggtcgggtgcctcaagagccagtggcgctggccgggctccagccgcgagcagatgccaggcccggcacactttgcacgggcgatgcgcgcggacgtcccgggcgcgctcggtccgcccggcttggcaggagctgcgagaggccgcgcgcaccgtccccagggacagccggaggactcagggctcccgggtggagcgagagcgcggcggccgaccgcgggctgcgtgtgtcgccttcctcacgcggtatgctgcgccgtggaacgctgggctacggaccctgagggtgcactgtggcgggtggcgtacgccgcgctccctccccgcttcctgcgcccagggtcggcg

SEQ ID NO: 33362 - DNA, 168 bp, Homo sapiens
  chr10:112404226-112404394
  hyper
agccatgagccaggacgcggaccccagcggtccggagcagccggacagagttgcctgcagtgtgcctggtgcccgggcgtccccggcaccctccggcccgcgagggatgcagcagccgccgccgccgccccagccaccgcccccgccccaagccggcctaccccagat

SEQ ID NO: 33363 - DNA, 253 bp, Homo sapiens
  chr10:112431872-112432125
  hyper
ggcattgcttttacccggtgggcttcagggagccgtccctgccgcgctttgcgtttctccgcgcacttggacagggttctgccacgagggaggcgatgcctggcgccgcgggtgggggcagtggtgagacttcggcccctggtggccggagaggtcgcagcacttgtcagtttatggctccctcggctttccccttcttaatccgctttctgctgagctctccgaataattcaaccctcgtgtttgaaaacta

SEQ ID NO: 33364 - DNA, 79 bp, Homo sapiens
  chr10:112432360-112432439
  hyper
ccctgaagatgcttccgtccgcggataggggacgtttcagacctggggtgggcacagcggtccccggtgagatggtctt

SEQ ID NO: 33365 - DNA, 41 bp, Homo sapiens
  chr10:112836758-112836799
  hyper
ataaaacgagtccaccgtgagcgcagcggagcagcagcagc

SEQ ID NO: 33366 - DNA, 61 bp, Homo sapiens
  chr10:114712100-114712161
  hyper
ttttctttggcaacccgcagggccgcgagcgccctgggcgccgtggcgggctccgctgccc

SEQ ID NO: 33367 - DNA, 116 bp, Homo sapiens
  chr10:115804051-115804167
  hyper
ctcagcagtggacagcgggcatgggtctgctgatggcgctcatcgtgctgctcatcgtggcgggcaatgtgctggtgatcgtggccatcgccaagacgccgcggctgcagacgctc

SEQ ID NO: 33368 - DNA, 9 bp, Homo sapiens
  chr10:115804553-115804562
  hyper
ccgggccta

SEQ ID NO: 33369 - DNA, 420 bp, Homo sapiens
  chr10:115804635-115805055
  hyper
cgcgaggcccagaagcaggtgaagaagatcgacagctgcgagcgccgtttcctcggcggcccagcgcggccgccctcgccctcgccctcgcccgtccccgcgcccgcgccgccgcccggacccccgcgccccgccgccgccgccgccaccgccccgctggccaacgggcgtgcgggtaagcggcggccctcgcgcctcgtggccctgcgcgagcagaaggcgctcaagacgctgggcatcatcatgggcgtcttcacgctctgctggctgcccttcttcctggccaacgtggtgaaggccttccaccgcgagctggtgcccgaccgcctcttcgtcttcttcaactggctgggctacgccaactcggccttcaaccccatcatctactgccgcagccccgacttccgcaaggccttccag

SEQ ID NO: 33370 - DNA, 36 bp, Homo sapiens
  chr10:116163376-116163412
  hyper
ccttttcaaaagaaccgcaatcgagacttgtagacc

SEQ ID NO: 33371 - DNA, 63 bp, Homo sapiens
  chr10:116164301-116164364
  hyper
ctccccgtgaggtcacgctcgcggccggacctcctggcggggccgccgcgcccagggtcctcg

SEQ ID NO: 33372 - DNA, 30 bp, Homo sapiens
  chr10:116164624-116164654
  hyper
tcccacacccctgcccgctgcaaacccaat

SEQ ID NO: 33373 - DNA, 195 bp, Homo sapiens
  chr10:116852246-116852441
  hyper
gcagaaaaggagagacgtgcggtttcgaggcagcgtctgtaaggggtggagagcgcggggctcggagcctcgcagttctttgttgggggcgcgggcttcgttattcccgaggcagcaatggctccccctcggaggtccctccgcggagaccgcctcgcgcctctcgcagtccccaatccccgcccctcccagccc

SEQ ID NO: 33374 - DNA, 95 bp, Homo sapiens
  chr10:116853397-116853492
  hyper
gaggaggaggagaagcggcggcggagaggttttctgcggccggaattcccttcaacagcatccctgtcggcgcccgcgagcgcagtctcgccggg

SEQ ID NO: 33375 - DNA, 64 bp, Homo sapiens
  chr10:118030642-118030706
  hyper
gagggagcctgagtgcggcgggcggggaccccggccgcccctgctccgggcgagggcgcgcgcc

SEQ ID NO: 33376 - DNA, 202 bp, Homo sapiens
  chr10:118031329-118031531
  hyper
accgcctccctaacccggggattcgcgatcccattccccaaaaagacacttcttccttccacatccaccacacccgcgccccaattttggtgcggagggcggggtgggctgctgcaagcgaccctaggaaagactcagagggtaagaaagcccgcggcgggcctcgacttacccaagagcggcagcgcgaagtacagggtcg

SEQ ID NO: 33377 - DNA, 16 bp, Homo sapiens
  chr10:118031848-118031864
  hyper
ccctctcccctccccc

SEQ ID NO: 33378 - DNA, 365 bp, Homo sapiens
  chr10:118031865-118032230
  hyper
ttcccgcctttggggaatttccaacaccggggtgaggacccacccccacccaggtcggggtgcatgtgcgtgttttccaggggccgctgacacggggatggaggtgagggctggagaggtctgaagagggttcctaaagtccaagggggtgtctgttgggttcaacccgagacgctgaacgcaagcaaataaataaataaacggtactttccgagcgtcgcgagcggagcctgcagctgcctggagtccgagccctcggtggcggcggcggcagctccctagccagccctggcgccgaaagagccccttctcccgggaagttggcctccccctcctcgcgtcagccagcgagctcgctcagccgc

SEQ ID NO: 33379 - DNA, 729 bp, Homo sapiens
  chr10:118032412-118033141
  hyper
cgctcctctcacactctcgcccggtgcccaggactcgggcgcttccgcaccccagcccagggcgagcgcgccggcccgcagtcccggcgtgccccggcaggtgcagcccggcgccacgagcgccccccgggccctaaagttgggagacgccagcaaaaagaaaggggtggccggaggaggggggaagaaggagtggggaagagggacgggaagcggcaatgggttcccaaacagaacgaaaaaaactccaaatgccaccaacctggactcaaccgaccgcgtccagctgcggcgaggagccagtttgtttatttacttatttattctttcagggcaatggtgtccccgccccctccttccctttccgggctcactttatctgcgctaggaaaagaaaaaaaagaaaaaaaaatagatgcggtaatcttcgagagctcgaagggccgagttgggccaggacgatttccgagcagagccctcggctcggatgctcgttagggatgttagtggttattggaagcggcgcggagaatggcgtgttccgaggccagatttcttctggccagaggaccctcggcctgctcctgttcccgccgctccgcagctccagctccctcctaagctcgcccgccaggcagccgcagctgcacacgcccgcttgcggtgggacccgcggccggacccgtactcgcgcacaggacacgcagtgttctgcagccggccgcgggt

SEQ ID NO: 33380 - DNA, 452 bp, Homo sapiens
  chr10:118033261-118033713
  hyper
cttagggcaatcgagccagacccttcttcggaacacaaagttttcccccacgtcactagtggctgtgattcaagacttggtgctttcaagacacactcagacccaggacgctggagcggcgatcctgggatgcgcccatccgttcgtccacgccagcgcgtgcacactcacactcacacgcacacatgcacacgcagtctctacctctctcctggagctccgacaaggagacaaaagcggagcccccagcccactgcatttaaacccggccagacctggctttagaaaatttataagctgacctccattttggctgtttcgagagtaaattaacaacaacaaaaaaagcctaacatgtacacagcccttcgccccaacccctgggaccgctggttcccagtcgtgctgctcaccccccgccccccacgcctgacacacgctccccttcccgc

SEQ ID NO: 33381 - DNA, 77 bp, Homo sapiens
  chr10:118033917-118033994
  hyper
atggctcattttgatcgaggggggtaaattgaaaagggcacgggctttggttgaagtttgaggcccgggtgtcaggg

SEQ ID NO: 33382 - DNA, 26 bp, Homo sapiens
  chr10:118034142-118034168
  hyper
cgccccaaacccgggggacatcctac

SEQ ID NO: 33383 - DNA, 191 bp, Homo sapiens
  chr10:118890913-118891104
  hyper
tgaactgtctgtgggcggctgctgtgatctcagcaaaaagcggagctcaaggctcagggactccgccgcccacactgtgccccgccttattttggatgcctccaacttcagcttcaggcacagtacacgagtaggggcagtaaggcctggctagggccggtgccgcacgggagctgcgggtccctgcaaca

SEQ ID NO: 33384 - DNA, 145 bp, Homo sapiens; identical to SEQ ID NO: 929
  chr10:118891517-118891662
  hyper

SEQ ID NO: 33385 - DNA, 59 bp, Homo sapiens; identical to SEQ ID NO: 930
  chr10:118891715-118891774
  hyper

SEQ ID NO: 33386 - DNA, 444 bp, Homo sapiens; identical to SEQ ID NO: 931
  chr10:118892013-118892457
  hyper

SEQ ID NO: 33387 - DNA, 135 bp, Homo sapiens
  chr10:118892517-118892652
  hyper
cgccggctgcgcaggctaccgccggcagccgctttgctctttcctggaggagtgggaagctgtcggccaccgccccgaacaggctcggagaaaagattctgaatttcctttgattagcggcgttaccttttcctt

SEQ ID NO: 33388 - DNA, 362 bp, Homo sapiens
  chr10:118892876-118893238
  hyper
actgtttcctggggtcgggggtggttgtgattggagttgccctaaaggggagaaaaaccgcaggatttgcccgccaggaagctgtgttgtgtaccgactatcccgagaggtccgcaaagcggggcccaggggctcccacaagccctggtttccctggcaagaggaaggaacgtcctccttttttggtctaaagaaacctggaagcccctggggtctgcgcgcagttttcctctttcaaatattcctaggaatagtcggcagcggcagcagccgcagcagccgcggatctagagcaaacgtcctgtgctttggagttagaaccagtcttttccctcctgggctgggcacggggtcagggcatc

SEQ ID NO: 33389 - DNA, 22 bp, Homo sapiens
  chr10:118893559-118893581
  hyper
tccgggagtaaggctcgaaggc

SEQ ID NO: 33390 - DNA, 114 bp, Homo sapiens
  chr10:118893679-118893793
  hyper
cgagcagcgagggcaccggcaggctgaagaggctgtggcccgcggccggggcgcctgcgtgcaatccccccggcccggcgggcccgggacctggagcaccgcccacagccggcg

SEQ ID NO: 33391 - DNA, 38 bp, Homo sapiens
  chr10:118894034-118894072
  hyper
cgagtccttgccctggtccttcttctgcttggtgcgcc

SEQ ID NO: 33392 - DNA, 23 bp, Homo sapiens
  chr10:118894477-118894500
  hyper
ggaatttccggtggagggtgtga

SEQ ID NO: 33393 - DNA, 628 bp, Homo sapiens
  chr10:118896177-118896805
  hyper
aggggagatgtcagccgccagaaccctcccgtccccctccacctccttggcccgagctggatttggggacacagtccccagaagcgtgcagttttggggatggggggcggggtgcggagcgcgaccacaaccaggtagcaaagacactgtgtggagggcaaggggcctaactccataccgctgaccgaaggagggaccacactttgtctttttgtagagtcctccagacaggggagagaaaaaaatccaatcaattccacataggcggacgtttcttccggcctgggggggcctcggctgagccttccgggtcccctgtagcctgagggtacccttgtcgccccgcccgggtcctgcgggccccagctctgggcttgccgaccagaccgtgatccagacgtccccacccccaccctcgagtctccttccctccggagtccgcgcggcggaaggaggagggactgagtcggggccggccgggcccggagatctgctgctggctggggcggcgccgggccggggcccggcctcgcagcctccgccgccggggctaagtgcacgccgcgccatccgagagcggcagagcagagcaccaaagcggcaaccgcggctccgtaaccaagcccag

SEQ ID NO: 33394 - DNA, 30 bp, Homo sapiens; identical to SEQ ID NO: 10543
  chr10:118897545-118897575
  hyper

SEQ ID NO: 33395 - DNA, 27 bp, Homo sapiens
  chr10:118897820-118897847
  hyper
ctggtggagctgcggcgaggccgcctc

SEQ ID NO: 33396 - DNA, 307 bp, Homo sapiens
  chr10:118897848-118898155
  hyper
tcagcacccgcgtcctctgagcacgtccagtgtccccagcctggcgatcaggtagcgaacagcgcaactccgaaatgctgcggctcccgcctgtttctgagacggcgagttgtagttgtccgacacccggggggacgcacactcgctgttgcaattgattacgggtaatttcgcagcccccacgtttcggttacctcatgaatacactaaattgtttggataatatatcagatcgtaatggatggtttctgtccttgtccccaatcaagtaggggtttagccagtgaataaacggaaatgattggtc

SEQ ID NO: 33397 - DNA, 174 bp, Homo sapiens
  chr10:118898864-118899038
  hyper
ttctcgtcaccttgccggggcagaagccctctccacgccgctctccccattcattcctttatgggaaatgcggagcaaaaggagtgaaagatggcaattatctaattggactattaacaaacagtcctctgagtgcggcggtctggcgtggctcctgggcgggggaagggccgt

SEQ ID NO: 33398 - DNA, 34 bp, Homo sapiens
  chr10:118899284-118899318
  hyper
cagcgacgcgcgcaccgtccgcacctcccgcccc

SEQ ID NO: 33399 - DNA, 353 bp, Homo sapiens; identical to SEQ ID NO: 935
  chr10:118899892-118900245
  hyper

SEQ ID NO: 33400 - DNA, 175 bp, Homo sapiens
  chr10:118900323-118900498
  hyper
cgcccggtcaaagacctggaagaaagctttttaaaaaataaaaatggcccaacccattacattttcttttaggtagatgggggagctggggggcggggcgggggcagtcagggaacaaacagctgcccttagaaatgacacgccctgtgggcaatggcggcgctgggacgtctgc

SEQ ID NO: 33401 - DNA, 630 bp, Homo sapiens
  chr10:118922178-118922808
  hyper
gttccaaatccaccccgtatcaatttgccttctagaagcggcaggataagcacacgggtttgggcagtgctcacattttgggtttattggcttgatggggttgtttggggcgctctcagttacaaactgcagaagagtgggggcgggggacaggatggggaggaaagggtgggcgaaggagccgagagtaagacaagccgaagggtggaaactgcgggagggagaggaaacgccgaaggcgatgtagagtcctgcgagggaccgggagaggtagggagggatccgagccgcagtcctgagggagagcgaccgcgcgccccgcagccgagctgggtcccttcgccccgcccggaatcccggcccccgcccgccccacgcaagtccccgtgccccctccgggaggtgggagtcgccgggactctgcgctccgccagcctccgtctgctggccgggtccgggatccgcacccggagaggctgaaccgaggctgaaccgaggcggacgcagccccgggtcggtggctcgcctggccgggtggggtgggagcgattttctggcggtggcgtttgcaggaggggaggagacagcgccacccagggcctccccgagcactgccggccaggccgggct

SEQ ID NO: 33402 - DNA, 526 bp, Homo sapiens
  chr10:118923049-118923575
  hyper
cgacggctggggacgcggagaaccctctccgagctggggtccccgcctgctgggcaacctcacctcaacgtctggcctggcctggggccgcttggactcggcagcggctgcactcctacagagcccagacgcgccttctcgctttttcctttctgggccggggccctaaactcccggaactcgccgcaagaggagcgttgaaaacaaaagggacagcccaagctgtcccgcccgctgcgcccgaggagcatccccttggcgctgcaggctgtcgcctcccccagcacctggcggggcgggtgccaggctgggcctctagacggtttcaccgctgcttatcatttctccttcattttgcaggggcaggggagctgcccctcccttcggagaaaggccgcgcctgcacccaaaggtaaccctcgggtgaccccgggagcggggctgtctggccttggtgcgagaccccgggcggggggtcagaggtttctgttgcatcagagaaacacggcagcgtcaaaaagaaaaa

SEQ ID NO: 33403 - DNA, 1627 bp, Homo sapiens
  chr10:118924431-118926058
  hyper
tttcaaattacataacggtggtttatatgttcttcctctgcgctcacagaaagcaattttaaagtgtgaattcttcaaagaacgggcaaagcattcacacacagacatgcgtttttattttatgtattgcaaagcgctatgagagagagagagagaaaccaaaaacaaaaatcccagcaaaaggaggccgagtccaaagagaatatgtccggtttctatttcaccaagctcctggactcacatttggccccggagccgagtgctcggtctctttccccgggacgggacagggagtggagttcctagccccttgggtgggaaaagccccgcgcacgtcaccgggtcccgtctgctcactgcttctgcatattttaagcctggacacagcctcctttaggatagaaaggcatttcccaaacaacaccgattctgggggtgtagtgggcctggcgctgggtcctggagagaaggttcagccccccttctcatccctgtactttggggatggctcgtacttggacaggggtgggcctccgccttctccgccttctatcggacctttcttcggatggatttctacgtaaactcggaaggcgatcaaatgcaggcggccaacctccagcgcttttttttttcctctcaaaggcggcgcctgcatttttgggggctccagcccaggctgagaaagtcccctcaaacctctactctgaggttgctcacacggcctgcaaaaacccgacggggcaccccgccaccccaccttacgtttccctagggccaagtcagtggtcaaaaaccaacccggtggtagctgcctttaccaaggaaagacagccaggacgcccgcaccgacggcaacgcgcggacagagaggaccgtgccctctttcgcatgttacggggcgagggggctgttggcgtcaggagcgccctgggaggaacttcgtagcggattcgagagacagagggaattcagcaaacttgctgccccgggctgccggctggagcccggcagattcgctgcgcagcactgccccctggtatccagcgccgaaagtgcccccctccgcagctgcaaggctcctccctgggctgcgcgggacagattttttctcctttcctggctacacgcctaacagagaagctatcccgagggacctcaagaagtccccccaagccgtactcaaaagcctttctccctcctcctcaagcgctcacttccccaaagaggacccggacccctgactgcctgagccaggtccccagcatggtccgcaacccttctcgactccggcatccacctccaggctgacgtctacccgggagggggctggggacccaaggagacttcgactacaggcccaggcgaacggaaggaagaggcttgcgttcagagagacacgtttggagctgggactgttcattctttaaggaacaccagcttccagggcatctttcgttggcaccttggctttccagagaagaaaggaagtgggtatcagggccagcccctcctcgcaccccaggctggagaggtgccgaggtgcttagtcactcagtccaagggcacctgagagatgggggcaaacttggcaggagcttgagcacggaggcgtgatccgcggggg

SEQ ID NO: 33404 - DNA, 557 bp, Homo sapiens
  chr10:118927006-118927563
  hyper
agagagccaagctctcgcccttcggtttccattcacgctaccctctctgagccgcaattctctctcctgcgttggcactggcagaagttgagacacgctcccaggaatcgcgggccgtggcgcgtacttccacgcaccccagctagttccagagactcagcttgttctgagatcctcttgtcgagcccccttggtcccggcgcccggcctgtgtggtgctcagatcagacttatccacccgagcaccacgcagaccagcgcctggaccaaggtcccgggaaggaagccctcctccccttctcctgtggcttagctcagcgatcagggaggagccagttaagaagtcacagtcgaagccatgactgctgtgtcccggggaggcagtggaaggcgaggagcacggagcggggataccgccggacaacccctccccgccgccccgtcggcgtcctcgctgcgcaggggctcccttgctgccccaatctaaaaggaagccgtcgcggcccagggcacggtaactaaaaggccgtcggggagggagacgggaatgagtgggc

SEQ ID NO: 33405 - DNA, 40 bp, Homo sapiens
  chr10:118927999-118928039
  hyper
cgcgtggctgtccggagcccctccacgttccccagcagca

SEQ ID NO: 33406 - DNA, 160 bp, Homo sapiens
  chr10:118928364-118928524
  hyper
tcacacctgtgtccccgatgccatctgcccacgtctgtgtgtgaagcaaaccccgctggcagacgggatggagagagatggctcctccaaaccagaattaggaggaaaaccccgctgagggcgtttcaaaaacccaacaggcgagcggggaaacctgcat

SEQ ID NO: 33407 - DNA, 113 bp, Homo sapiens; identical to SEQ ID NO: 10555
  chr10:119000479-119000592
  hyper

SEQ ID NO: 33408 - DNA, 466 bp, Homo sapiens
  chr10:119000689-119001155
  hyper
cgggcacggaggacccgggcaggcatcgcaagcgaccccgaggtaacacggccccggttccctgctcgcagggcgcggtgccggaggggagcgggcccgggggaggcagggaggcagggaggcccccagagctacgcgggcggggctgcggggaccccggggcagccggggcgcagggcgcagggcgcaaggtgcacggggccgagcgtgcagtttgggaggtggcacagttgggggcggcggggatcagggcagcgtcctgggggttctaggttgggtctccagattgggtccccgacggcgctcgcgggcgctctttccagggagcgcgggctctcgtggggacgcgctcgaggcaggtgagccgaggctggggcgcccgggggtgtccccggatgccggtgcgcgcggctccctgacccgcccttccgcggcctgggggacgggagaatggggggtccacggc

SEQ ID NO: 33409 - DNA, 200 bp, Homo sapiens; identical to SEQ ID NO: 3656
  chr10:119001328-119001528
  hyper

SEQ ID NO: 33410 - DNA, 535 bp, Homo sapiens
  chr10:119294363-119294898
  hyper
ccctcgggcctcactcgcggtgtctcctccagacgccaggggcaggccacgaagccgagggctccgcgtggccgtgggagaagcggggtgcacggagccttcccgcgcccagacgccgaggggatgcaaacaggggagccgggcctggtatggccaacctccaggatcgaggggccccagaatgtgcgtgtggccgggggcgggggcagctgcgggggccagaactagagtattccttcgctctcccctgggggccgggcccccacgagttgcagcagagcccgtctgtaattagggcctcctggtccggcaaagctgcggctgctcccagagagagttggggtcttctcagggcccgcgatgggggagtggtcgtggtcagacccccgtgagccccttcggaaggtcccagtccctgtccattcttctgtcccgcagctctctccgcgcaggcggggcagagccggggaagaagacgctggacgaggggtcttggggccgcctcgctggctgcggttggaagcacccgttttcc

SEQ ID NO: 33411 - DNA, 259 bp, Homo sapiens
  chr10:119294908-119295167
  hyper
cgcaggcgctgctctgtggccaccagcagaggtttcccggccgctgtgagtcgcccacgcgagcgacgtggggatacggggcgcacggagtctcagctgccgccacgcagcgcttgccctgcccgagcttcggctcactggcagcggcgaggccaccgaccaccctccgccttccagtcctaaactcggggctggagaccgcaggagctaaaccaggaagaagaaagagggcagggcctgaggccgggaagagcggccc

SEQ ID NO: 33412 - DNA, 933 bp, Homo sapiens
  chr10:119296755-119297688
  hyper
cgggcgtcttcagccagccgcgagggggcgcggatctgagagagtcgcaccccgggaccccagctcttcctactccaccccaggcagggcccgcgcaggccgtccaaggcctgttctctgaaccacctgggttgggccgcgaaatatgggacctcaggcatggaattgtggctgcacaggtgatcacggcttcctagtccttcttagagcagaacctgtcccactccagcccacctctgcgcccccttcggaaggaagcctactggagctggaattccagcgtgggtggcgaactctcaagccaagagctggagctgatggaggcaggagggacgcacttccaagccatccgggctcctccgtagccagtgagcctcctttaacccctccactggcctggatgacggcctaggcgagactttggcagtgtggcgcgaccccagcgctcccccgccctcgggctcgggggcgcggtgggtaccgcgcccgcgcccggccctcgccactaggcgccgctgcgctcacgccgatcggggccccgggtcgccgcgcccgcctggcgagaggcctctggggaagacgccagaaagggatttgtcgtaataatttttaaaaaatgtttttagggcattaattatacttttcgttttctcaccgccaccctgcgcgttcggagaggccggcgtgactggggatctcagtgggttggaggaattcttaacgcccccgaggcctttccaactcgggacaccattctcgcgcctcgggccgggaaagggctcgcccttcacgggcgtcggtgcggtccgcggcgagccgcgggagcacagggcgggctcagcattctggttcaacgtgaggaccagaacctcggcgatcagggaccaggacgtggcagagtgcagcgggtagcttcgacggcacaaggccatg

SEQ ID NO: 33413 - DNA, 505 bp, Homo sapiens
  chr10:119300923-119301428
  hyper
tgatcataattatgccgccgcgcgagccaatggggacgagggaactcggtcctaaaatcatcccaaaaccgaaggcgagctcgaaaatgcggacacggcccgggaccggagatgcgatccgtagtcgttagttgcactgggtttgcacagcaaccaccacccccccaccaaccccgggacaacagatggcataataataataatagaaataataataataaaataatatcatctataataataataacattgaccacactgacaaaaataattacgacggaaccttaatagtacagtagcaccatatcgggctctcccctgaccttggactgccggtcccagatattccagaaggaattgttttggggaaggaggtgagcaccctcccagacagaaaacgctagagaccgtggggcgagagagggagagagttggaagcccactgctccggcggggtcggcagctcccggtctcaactcgcaaacgaacgagccgggtcaagaat

SEQ ID NO: 33414 - DNA, 96 bp, Homo sapiens
  chr10:119301759-119301855
  hyper
cggcgccggccagggactctgcagggaccggggtgccccggagggagtggtgctggtggaggaggaggcggtggctgagggggagtaggtggggaa

SEQ ID NO: 33415 - DNA, 32 bp, Homo sapiens
  chr10:119301915-119301947
  hyper
ggaggaagaggaggaggcgaaggaggaggaga

SEQ ID NO: 33416 - DNA, 185 bp, Homo sapiens
  chr10:119302876-119303061
  hyper
cgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctgg

SEQ ID NO: 33417 - DNA, 409 bp, Homo sapiens; identical to SEQ ID NO: 10566
  chr10:119303312-119303721
  hyper

SEQ ID NO: 33418 - DNA, 30 bp, Homo sapiens
  chr10:119304074-119304104
  hyper
acctccggcggcagccgatcaatactccgc

SEQ ID NO: 33419 - DNA, 40 bp, Homo sapiens
  chr10:119304439-119304479
  hyper
tacagactgtcctggcggtgtctgcaagtcggtaaccccc

SEQ ID NO: 33420 - DNA, 40 bp, Homo sapiens
  chr10:119304501-119304541
  hyper
cgtttctcttctagttctcgggagccgggagccccggagc

SEQ ID NO: 33421 - DNA, 41 bp, Homo sapiens
  chr10:119304788-119304829
  hyper
cctggccaggctctgcggctccctcccctgcctccagcgcc

SEQ ID NO: 33422 - DNA, 136 bp, Homo sapiens
  chr10:119304850-119304986
  hyper
cgcggcgccagggcggctgcggagccggccgaggtcaggagcctggggactggctcctctgcgacagcggctggttgggtgccgcaccggtggagacccggcgttccgggccgggcagctgagcaggcgttccctt

SEQ ID NO: 33423 - DNA, 48 bp, Homo sapiens; identical to SEQ ID NO: 10569
  chr10:119305061-119305109
  hyper

SEQ ID NO: 33424 - DNA, 47 bp, Homo sapiens
  chr10:119307022-119307069
  hyper
caggcaaaccctgatcgcctacccagggcccccgccacgaagaggag

SEQ ID NO: 33425 - DNA, 71 bp, Homo sapiens
  chr10:119311647-119311718
  hyper
cctgagagggtcaaacggaatctaccaagcgcgtgtgccgcggctacgttctcctgcgaagtacacatggg

SEQ ID NO: 33426 - DNA, 30 bp, Homo sapiens
  chr10:119312507-119312537
  hyper
agatgggggtggcctcggtgtgtgtggctt

SEQ ID NO: 33427 - DNA, 368 bp, Homo sapiens
  chr10:119312751-119313119
  hyper
tattccagcaatcagcgctggaattactggggcgccgcctagaagcaaccgccggcggggcggcagaggatgccggcctccagcgtcgggggaccgcgcccgaaagccgggctgctttgtggggcctctcgcgcctcgcccgcagcttccggcccgcgccctccgctcgaccgccgattttctcgccccagccagccccgtagccagaggaaagtgggagttttgagaaccctctgaccccagccgtgacccctctccgggaggtggcttctcccgcaggacccggtgcgccagaaaactctaggcggcgccacgcttggaagcgcaaggtccattcatcagccgcgccccagcgtctaattggcctt

SEQ ID NO: 33428 - DNA, 164 bp, Homo sapiens
  chr10:119313340-119313504
  hyper
cctcccggctgctaacgccccaggcttcgcccctgcccccacctccacctgcagaccgagccctccccatctctccacaccctcaggatttcagacccgccttcctgcctctcctaagtacccatcccaggcgctggccttgtggctcggttccgctcacgtcc

SEQ ID NO: 33429 - DNA, 15 bp, Homo sapiens
  chr10:119313528-119313543
  hyper
cgagttcattagtcg

SEQ ID NO: 33430 - DNA, 42 bp, Homo sapiens
  chr10:119494127-119494169
  hyper
ctttcaagagctctgcgattacaggctcgttttatgcaaaac

SEQ ID NO: 33431 - DNA, 69 bp, Homo sapiens
  chr10:119494374-119494443
  hyper
taggaagcctagggtcgccgatgttccaggatggaatgttctggtgtcaccgtgcgggggggtgggggg

SEQ ID NO: 33432 - DNA, 208 bp, Homo sapiens
  chr10:119494848-119495056
  hyper
cgggagaagttcaggtgggacaggagacacgggggtgaggagatctttgagagggccggccgggaaagtgggggtcgcctgtggctgagagggccgcatgccgaaggtcccgaccccaggctcacgacaggcagcctggcacgcaggaaggggctttgggatagaacgtagcacctggctgagtgcttaacaacgattgaactgacct

SEQ ID NO: 33433 - DNA, 487 bp, Homo sapiens
  chr10:120353831-120354318
  hyper
cgatggcgtgggggtcgaggtcccgcagcaggttgaagacgtgcagcggcagccagcagacggcgaacaccaccacgatcaccaccagcaagcagaaggtgcgccggcgccgagcgcggtcccagtcggcctggctctgggtcacgcagcccggcaccacgcggttgcggagcttcactgacacccggacgtaagacaggaggatgaccagcagagggagcaggtaggtgaccagcagcagcccccaggcgtagagctggcgctggcgctcctgggagccccagaactcctcgcagaggcgcacgtcgtgcggcttgagctccacgtgataggtgtgcacggcggcgggcagcgccagcaccgcggacagcgcccagatggccagcacagcgtaggcgctgaggcgcagcgagatgcgccgcctcagcgggtgcaccagcacgacgtagcggtccactgcgatggtggtgagcgtgaacaccgacac

SEQ ID NO: 33434 - DNA, 166 bp, Homo sapiens
  chr10:120355260-120355426
  hyper
gcgctctgccatgctcggtgcttagagaactagtgaagaggacagtgtggggaggatggaatccgaaacgggaggaggggccggcaaacctggccagagcagcgaagaggacgaatctctactgcaggagcttgcacggcccctggagggtcagggtccggaggag

SEQ ID NO: 33435 - DNA, 153 bp, Homo sapiens
  chr10:120355461-120355614
  hyper
cgtcaggctatcgggaggagccggtgcagtcttaggagggaaggagcggggaaggaagtagcggtgggagattgcaatgcagctgggggcttgagagaggcacgactgacccgttcttaaaggctggatcctgcctagcggccaggttgcgga

SEQ ID NO: 33436 - DNA, 299 bp, Homo sapiens
  chr10:121301494-121301793
  hyper
gctggcccaaagtgacggccaaggcgaatccttcgtaacgtcagaacttcgctggctcggaccgcagaagtgcccttctccatcctggggttccgccaccctcgcgatcccaccttttggctcctcgcggcagaagcgaaggcccccgacgccccaggcccaggggcccagtcggatgcccgggtccagccgtgctcccccgggcgctcggcatccttccacccacgcccgcagcggaggcggagagcgtcacggagggagaagcccgcgcgccgttccgctttcggaatctggagccc

SEQ ID NO: 33437 - DNA, 166 bp, Homo sapiens
  chr10:122216112-122216278
  hyper
ctcctgagagcaaagcgaagcccgcgagtgatctctggggaacttcctagaaaaaagaaagaatttcaggttcgaacggtgtagggagggccgaacacgggagcaaggttggccagggctgccctgagccctggagaatccccagagcgatcgtccactacatgcc

SEQ ID NO: 33438 - DNA, 272 bp, Homo sapiens
  chr10:122216485-122216757
  hyper
cgcgggtgcccggcgcgggcccaggaggcggaggcggctcctggggagagggatccgggagtccctgaggcggccccggctccgcactaggaggcggggtccgcagtatcgccagcggccggcgcggcttcccggagccccggagcccgaggcgcgaggtttaggctgagccctccccggcgcctgcccccgcccggcgcccgcctccgcccccgcccgcggcctggagcgcgcctccctcgcctcccagggtctggcgagccggcgccggc

SEQ ID NO: 33439 - DNA, 42 bp, Homo sapiens; identical to SEQ ID NO: 10578
  chr10:122216793-122216835
  hyper

SEQ ID NO: 33440 - DNA, 328 bp, Homo sapiens
  chr10:122217053-122217381
  hyper
tcctgggaccctaggcgcggagcgaccaccgcgcgccgaggctgagacctgctcccgggtctcaccgggcccgcgcctgtcgccagccccgcaccacctgcccgggggatccagggctgcacctctaaacagggacgcgcaccctggcccgtgccctcgggaagtttctccttctgtgtgatctttgaggcccacgttggaagtctttacccctggccccgtctccgattcctccccgctgtgcccagggccagactccttccgtgtccctggctttagcgcccgcggtcctggcgagcgttttcccagcgggcgtttgcggcgcttc

SEQ ID NO: 33441 - DNA, 219 bp, Homo sapiens
  chr10:122708495-122708714
  hyper
atgatcctaaagggacgcagtggtcccgcccatcgccgcctctacagggagggagccgcggccccgagctggccacgcgatggcgctgtgcacccggccgcggagcccctgcacgtccggctcccgctcgcgctctcggctcgagctccggactccaggctcggagcaggggttcgggctacggttcccggctccgagggaccgcggggctctctgcct

SEQ ID NO: 33442 - DNA, 352 bp, Homo sapiens
  chr10:122738898-122739250
  hyper
cttctcaaactactgcgcacacaagtcgcctagggaccgaattaacgtgcagccctgatgcagccgcctgagacccgcctttgcagcagcctgccaggaggtgcggatgctgccggcgcctggaccgcgcgttgagcagtgcaggtgaacagctcgcctaacgcacaagccacgcccacaccctttctacacgctttctcgttcacttctcattgcaactccttccgccgcgtggacaggttcagcactctcggagtcgatgtcattattcgccatcgacgcgaacctcggcaaagagacgggtcttaccggtctccgaatgttctcaggccctaagcgcgcagccccgcac

SEQ ID NO: 33443 - DNA, 118 bp, Homo sapiens
  chr10:123356872-123356990
  hyper
gccccaggcgcactgcgctccctccagcgccgacggcggctgcgggcgaggggcgcccaggcaccggagccgtcgcctccccagcagtgccacccctggccatcgccacccctacggg

SEQ ID NO: 33444 - DNA, 30 bp, Homo sapiens
  chr10:123358301-123358331
  hyper
tagaaaacaaatgaccgaaggctctaaccc

SEQ ID NO: 33445 - DNA, 34 bp, Homo sapiens
  chr10:123873006-123873040
  hyper
gcccgtggttcggggcgcgcgccagtggctggga

SEQ ID NO: 33446 - DNA, 38 bp, Homo sapiens; identical to SEQ ID NO: 939
  chr10:123922645-123922683
  hyper

SEQ ID NO: 33447 - DNA, 29 bp, Homo sapiens
  chr10:123923517-123923546
  hyper
cgcccgggccgccccgagtctcccgggga

SEQ ID NO: 33448 - DNA, 46 bp, Homo sapiens
  chr10:124221003-124221049
  hyper
tgcccgtccccaaggcggctcgtcaccgctgcgaggccaatgggct

SEQ ID NO: 33449 - DNA, 206 bp, Homo sapiens
  chr10:124221715-124221921
  hyper
caggttgaggggcagcgaagcgttgtggggtggccagggcaactctcggggacaggcaggtgggccccggggtggcggatttccgcgggctgcctcggaaccgagcttcgcgcccagcccggggccggttctgcgcccagacgatgccagtacgcccggcctgcactctggggctcgagacgccgggcgaccggccatggagtgcc

SEQ ID NO: 33450 - DNA, 327 bp, Homo sapiens
  chr10:124639199-124639526
  hyper
tccagttggcttatgcgcatgcgtttctctggtgcaggttctcaccaaatccagaagcggcgggcatttgaaatgatgtaagccgggagtcgctctgcctgcccgtttctgcgctgcactggccgacacttaagcactggaagagaggcctggcaggaggcggcgcagtggacacgcggtccgaggacgggggcctcacccgccgccccacgcttgcctcttcctgggatgccgcaggcggggccctaactcacagcctcctcacccgggctcgtgtctgcgcccgcgacttcgactgggaggagcttctggcgccacctgcgccac

SEQ ID NO: 33451 - DNA, 30 bp, Homo sapiens
  chr10:124892329-124892359
  hyper
ccctccttccctccccgagtccttcctgga

SEQ ID NO: 33452 - DNA, 73 bp, Homo sapiens
  chr10:124892950-124893023
  hyper
gggaggggagtcaaccggagaacttggggcgacaaccggaaagccgggatccggtagccgcacagcagggatg

SEQ ID NO: 33453 - DNA, 147 bp, Homo sapiens
  chr10:124893246-124893393
  hyper
ctctccacgcatactcggccgcgtggcaggctgtgtgcaggcggtgcccacccaaccctcatagacctacgtgcatcgagctatttctgcggttgggggaaaatgacctctgggtatccagcagcgattgggcgacctaggcccagt

SEQ ID NO: 33454 - DNA, 1013 bp, Homo sapiens; identical to SEQ ID NO: 3661
  chr10:124893594-124894607
  hyper

SEQ ID NO: 33455 - DNA, 826 bp, Homo sapiens
  chr10:124894870-124895696
  hyper
gggctcgcggccgttagtgcgcttcggccaagggcgccgcctgctccgcgtccctcgctcgcctcctgcgctcgcaggagcgctccgagtgcctctttagcgggagccaatatccttttgtgctaataggcttgtcctcatttgctgcctaattggactatataaagccaataacgggcgggctcttatagcccgaagccaaagcgccaaaatccgagggaaggcgaggagggggcggtggcggaggcggctgcggggccggggctcggctgagccttcgcctgcctaatcccatttgccattgtacgcgcccaatcgccgtatactccccgcatttaacttggatgacattttgatttcatcattagcatccggcgccggattgacgcagcctcgagccggggactgctcttgctgcctcctccgcgggagccgcagccgcagccgagccgcctcgatccctcggtgccgcggcagggccgctccccgcccctccgcacccctccctcatgcgagcccgcccgtctgggtcctcactccgccctcccgccgttggatttgcgcccggggcggcccccgactttgcgccccgtagttgagttccgtttatggtctgatttccggcctctcgcctgctcgccccgccgcccgcctgtcccgctccctccctcccggggacccggaggagaggggaccatgccggaacccgggccggacgctgccggcaccgccagcgcacagccccaaccgccgccgccccccccacccgctcccaaggagtccccgttctccatcaagaacctgctcaacggagaccaccaccggc

SEQ ID NO: 33456 - DNA, 701 bp, Homo sapiens
  chr10:124895832-124896533
  hyper
cgacctggctttccctcgctttgagatcccggcgcagaggtttgccctgcccgcgcactacctggagcgctccccagcctggtggtacccctacaccctgacccccgccggcggccacctcccgcgacctgaaggtaccgacctctctttgaactttcgttgtccccctgcgcgcccgccccgtccccgccccgcgctgcttccctccgcagttctgggaccccagcacccgcaaaccctctgctcggtcagtttttttcggcccctagcctgccctcgcgctgggttgcgctgcccgttaatccaatcccacttggtgagaaaagaagtggaattggagccccgggcacggtgcttcccgggaaaagtggcctcgggcgtgaatagggaggcttcggacggccggggcttgggacacggcctggaaggagggggtgattccaatgcgcctaagccgaaagggaaccgttctgccggcccctggcgaggaagctgagggaatggaaggaggtggccgcgctaccaccatctgcttgcctgtcctcgggaggagggggatcccaggactcggcgtcccttctctggcccagccgagaaggaggcagcccgcgggaatggtgaggcctcatggcctgggacctggaggccggcgcgggttgagcctgccgtccccaggcgccgggcctcgctcaaggctgtgt

SEQ ID NO: 33457 - DNA, 767 bp, Homo sapiens
  chr10:124896937-124897704
  hyper
ggagcgagccggcctggccgcgtccctgcacctcaccgagacgcaggtcaagatctggttccagaaccgccgcaacaagtggaagcggcagctggcggcggagctggaggcggccaacctgagccatgccgcggcgcagcgcatcgtgcgggtgcccatcctctaccacgagaactcggcggccgagggcgcggcggctgcagccgcgggggccccggtgccagtcagccagccgctgctcaccttcccgcaccccgtctactactcgcacccggtggtctcttccgtgccgctgctacggccggtctgaggccccagaggggtgggggagggagcgcccggcctccttgtccggaccccggaggagactgggccgggccgagggcgccgagaagtccagcggccttcaggaactggggcttgggcgcgcagcctctgcttcccctcccccagtcggtagcattttgtaagtatttgcaatgcattttcgtgcaattcatccctaatggattggaggcgcttcccctcttacttttggtttttggcttatattaagagaaagcaggaacaagacaaaattttcgggtcagagatttcggccgatagtttttgtaaaatgtgcagccctcccttccaaatttccattgcgcggtggctttttggttttatttttatagaaggaaaataagcgcaaaacctaaatccctctagtttattcttttctgcttttttttttttttccgagacggaatcttgctctatctatt

SEQ ID NO: 33458 - DNA, 29 bp, Homo sapiens
  chr10:124897944-124897973
  hyper
tgagccactgcgcccggcctagtttattc

SEQ ID NO: 33459 - DNA, 114 bp, Homo sapiens; identical to SEQ ID NO: 3667
  chr10:124899035-124899149
  hyper

SEQ ID NO: 33460 - DNA, 247 bp, Homo sapiens
  chr10:124899671-124899918
  hyper
ttctctttcccctggcgcccaacacctcctgggcggcatctctagatccccgaccctgtcctggcagacgccgagaagcgtagcgctcaccacacccgcgcgctactgggttccaggccgccgcgctcttagtgagcagcctgcggaggcacagcgcgccggaaccgcctggaagggtgggtccgcccgacagaagcaggtgcctgggcgacactcgctggccgggtgtggccgcctgcctttaagc

SEQ ID NO: 33461 - DNA, 30 bp, Homo sapiens
  chr10:124901599-124901629
  hyper
tggaccgggatgcctcgaagtccctcctca

SEQ ID NO: 33462 - DNA, 155 bp, Homo sapiens
  chr10:124901892-124902047
  hyper
ctgcccccccaccaccgggcgctcattctgagccgcgacgccccctcaacaggctcccggcaccgcagagccagaggccacgcggtgagaaccccagtgcgtgcgctcttcttgtgtgagaggccggaggtagagttgggagaaagaggagccgg

SEQ ID NO: 33463 - DNA, 431 bp, Homo sapiens; identical to SEQ ID NO: 943
  chr10:124902138-124902569
  hyper

SEQ ID NO: 33464 - DNA, 721 bp, Homo sapiens
  chr10:124902607-124903328
  hyper
cgccctctcgctgtcccccaccccctaacccgggctttgaggtgtgagcgatcccttgcctctgggcctaggactctggaagtgtgcacggccgttgtgcagggtggatggtgttgaccttttgacctgaaaacagttgggggctggggagcggaggaaggatggcggaagagaggaaagagccacgagaacaactaggcgggatgtacttttgagccctgccgggtgtctccgatcggagtctggggttgagatttgggctgcacttgtccccggtgtgtctctccggcggagtaccctgaaggtgcacgaggtggggagcataggctgaggtgggtaatcgggtcctggatagaaacacaaccctcgtcctcactggggcccatgtatgcgcctgggattcctccccacccttccatttccaggacccctaagggtatcactccagcgacggggcggttctggagacccgagggaagggatagctggagactgcagcgcgccttctccgagagtcccctggaggtgcgcatgagttgtactagcgcagatctcttccttggctgctgctcctggcgatgcatctccgggggaaacttcccaaagtctgagttgccggggttccaaaaggatccctttgggtttaggcctgggagaggtatagagccagcgagagagcgcgttgcgcctatcactgaggcaggagcggtgaggtggagtc

SEQ ID NO: 33465 - DNA, 30 bp, Homo sapiens
  chr10:124904318-124904348
  hyper
agggagacagggggtcgatcccaaagatgc

SEQ ID NO: 33466 - DNA, 582 bp, Homo sapiens
  chr10:124904595-124905177
  hyper
tatgctagaaaggggcggcaaggaaggttgtttcttgtccctcccgtccttgcggtgtgacggctataggtgctggaggggcgggaggtccctcgggctatcaatcgaggggagctcaggggaactgcagtcagtcaggctgcagagctgggtctccaccacagccttccttgccccagccccgtgcccaccaccatctcttccctggtaaagtgcacgcactagtaggagctcagtgaacgtttgctgaatgaatgtgtgagtgtgcgcaggcgtttatgcaagtgccttcatgcgaattaatgcgtcctttgccgggtgtggcagcagaggaagtgcctcggtgaagatcagaccctcgaagcgattagagggacgggacagaggaaatacaaggcaagatggatctttttgacttcccaaactatccctaggggaaggagagatagggacgcaaggcttcataacttccttgtttagagtccgcaagccaggcttcttgcaagggtcgactccccagtctctcactgtttcagggcctgggagttgcttttccgaggcccacttcgaggtcccctgatc

SEQ ID NO: 33467 - DNA, 30 bp, Homo sapiens
  chr10:124905596-124905626
  hyper
ctggccagttcccctcggggctgccttgac

SEQ ID NO: 33468 - DNA, 15 bp, Homo sapiens
  chr10:124905865-124905880
  hyper
atttgtaatgtgtct

SEQ ID NO: 33469 - DNA, 145 bp, Homo sapiens
  chr10:124905919-124906064
  hyper
cggaggccggcacctgcccctcgctggcctcccgggccgctgcgcgcaccccctggcccccgccccctcgcctgcccctgccccggctgcgcggccgactcctaatcaattagcccattaacgagcccctcgaggagttaagtag

SEQ ID NO: 33470 - DNA, 115 bp, Homo sapiens
  chr10:124906829-124906944
  hyper
ggagtacctactatgcgctgctagtgcttcgaggcttttaatccctacctgaggcaatccgagaagttattttcaactatgagggcagagaggctttaatcggcatgagttgtgc

SEQ ID NO: 33471 - DNA, 1027 bp, Homo sapiens
  chr10:124907268-124908295
  hyper
caagcccctgggaggcgcggagacccgtcgcctgcggaggcgtcgagccactccagctccgagtcccgcaccgcccctgcctctggagagaagggtccaaggggtccaaggagtcggagttgccgcagccgccaggaacccgggctagaatctgcagctgctttcagccctggctgcccctggttagacgccgctgatgcccgccaggccctcggcgcgctctgggggcgcaccggtgctgtgtgcctggccggagcgttttgaaattttccggggccgctcggcggcgctgcgattggccgcgttcgggtaacctctatgcaaatgaggccgcgccgcctccgcgccgccggagacccggcgagttggcgggcgaggaaggggcatttgcaccggggctgggcgggcgcacccagagccaggcgggcaggaacccctgcgcagccatccggtgcctgcatgtccctggcgcggaagggacgcctcaccagcctcggcgccccctccccctagatttcctccccgcccctccccactgcctgcctgctgcaccaccttccacccagatcacccagatcgtctctaaagggagttcttggtttccttcgatttcttatgaacccaggatgggcagcaaagaagatgcgggcaaggggtgtccggcggccggtggcgtctccagcttcaccatccagtccatcctgggcgggggcccctcggaggcaccgcgggagcccgtcggctggccagccaggaagcgcagcctgtccgtgtcctcggaggaggaggagccggacgacggctggaaggcgcccgcctgcttctgcccagaccagcacggccctaaggagcagggccccaagcaccatccccccatcccttttccttgcctgggtaaggatcgcacgtcgccagtgtggcagcgagcgagcgcgaggggagggaggctgagcgccccgccaagactcccgcgccgggccccctctggccagagctgcggcagccgggggttcgggaccgcggggag

SEQ ID NO: 33472 - DNA, 211 bp, Homo sapiens
  chr10:124908904-124909115
  hyper
gtcgcttttaaaggacggggtgctgggtttggggggccagtgagagggataagaggaggggattggtaaggtgggaccaaggctgcaggcgcttgccaaccgcttggtcccagggagagctggcggtctccgaggctccccaaccaactccatggcctttctgtctgttctcgctcctcaggtacccccaagggcagcggaggctcgggcc

SEQ ID NO: 33473 - DNA, 286 bp, Homo sapiens
  chr10:124909252-124909538
  hyper
ggcgcggccaagaagaagacgcgcaccgtcttttcgcgcagccaggtgtaccagctcgagtccaccttcgacatgaagcgctacctgagcagctcggagcgcgcctgcctcgcctccagcctgcagctcacggagacccaggtaaagacttggttccagaaccgccgcaacaagtggaagcggcagctctcggctgagctggaggcggccaacatggcgcacgcgtcggcgcagactctggtgagcatgccgctggtgttccgggacagttcgctgctgcgcgtgc

SEQ ID NO: 33474 - DNA, 92 bp, Homo sapiens
  chr10:124910363-124910455
  hyper
gtggctggagctgcccgcccactctccctcctaacgcccagaatcgtcgcgcgggctggggcgcaccccggctggaatccagctcaagagtc

SEQ ID NO: 33475 - DNA, 515 bp, Homo sapiens
  chr10:124910708-124911223
  hyper
cgctgcgcccagctacccggccggtggcagagttatgtgtctcgcgcggagagggaactgggcgcggtgaggcagttctgcggctcaggagagatccgaggcccgggaccaggcaaagaaggtgagggaggcaaaggcgcttccctacactcttttgttgttaatagtttgcattggttcagcgtgtggctggatcaccggctagcacgcggccgcttgctctgaatggaaccttgacgcgcggcgggggcgcccacggacttcctcgccctgacacctgcggccgcgcaggggctgggagggcgctgcaccgagagaatagccgcgggagtatcatgcaaattgcagattctcgctcccaatagattgcagccacctgttcttggcaaaacctcggaaaaggaagcctgagcttggaggaagccggtggttcagcaccacctggggcgagctcctccggcctctggctgggcagagcggatgcaaaggagcctggagtccgcagcgctgaggcc

SEQ ID NO: 33476 - DNA, 97 bp, Homo sapiens
  chr10:125425515-125425612
  hyper
agcggagacagagctcgcgggcatggggtgagagcgggaggaagcagaggcagaggcggagcaggggcgcaggtgcctgcaacccaggatcccgggg

SEQ ID NO: 33477 - DNA, 259 bp, Homo sapiens
  chr10:125425689-125425948
  hyper
cgcgccaggtgcctgcccgtgaggcggcgcggggctcccgggtggctgcgcgcccagacgcctgcccgggaggccgcctgaggctccggggtggccgcgcgccctcctgggagccatggcggctggggccggtggtcgccgggcggcggcggcgccgaggggctgagccggccgcgggcagcgccatggcggcgccgggttgcggaccctgagcgccggcgcggggcgcgcaccatgaactcgtgggacgcgggcctgg

SEQ ID NO: 33478 - DNA, 414 bp, Homo sapiens
  chr10:125650749-125651163
  hyper
caacagggagattcccgggactggcccatcccagacacacacaatgggagaagccagttgtcccctggaggcgcgcaaccaccggcgccccctcgggctgcccagcgcagaaagttccttacctggtggaggcggctccggagccgacttctccctcttgggagctttcttgggcttggtggccctcttgggcggcctgggctcctgcgggcgccgctcccactcctccccgggccccgcaggcagcggcggagagaaggtctcgagctcgggctccgggcgcgcgtagtagggctcccggctccagatctcctgcccgtaataatcagggtcctcgagggctgcgccctgggctccgaccccggccagggtcactgccaggagcaccagggccagcgctggggtagcggtccc

SEQ ID NO: 33479 - DNA, 88 bp, Homo sapiens; identical to SEQ ID NO: 3676
  chr10:125651372-125651460
  hyper

SEQ ID NO: 33480 - DNA, 30 bp, Homo sapiens
  chr10:125732174-125732204
  hyper
aggtgagcggcagggcggggatggagggac

SEQ ID NO: 33481 - DNA, 372 bp, Homo sapiens
  chr10:125851165-125851537
  hyper
gccacacttcattcccgagaactcggtacaattaacttaaccaacgtgaacaaggcgaaggcgcccagctgtcacagcggctccgcgcacgcaggcagacgaagaagggcccccgcccccaggagctggtcccagcctccagcctggcagcctccttcgaagacttccctacactgggcgcggacctccagccgccagcagccggcaacccagccccagccttcctcctctatacccgccgtcccagccgcgccggccggccccgggcgcagggcgggcgggaacgtgggcacccggacagcgacggggaggtcaagcagctgtgcccaggacccgggcggctccgaagcctcaacacgcacacactcgcgc

SEQ ID NO: 33482 - DNA, 303 bp, Homo sapiens
  chr10:125852195-125852498
  hyper
ccggggagagagtggcggatgcccacttacctgccccgggccgcgcctggaaacttccccaaagtgcgataggggtgtgggggcggagcgcaaggctggggggaatccccgtcccctaccgccaaacgacgcgcgctcacaccgtgaaagcactggtctgtccgtcggtcggtcccccgcctgcggctcccagagctgggcggtgcaggggcgccccgattccgactactgggctccttctcccggacagcccgccggtgcgttccacgcggcttgcgccccccgccggcctccggctatcca

SEQ ID NO: 33483 - DNA, 506 bp, Homo sapiens
  chr10:125852540-125853046
  hyper
cggccgcgtcctctctgcgagggagggggcgtgtgtcgccgctgggtaacccttcccgcggggtcctcaagcgcgcagggcgcccggagcgcggccaggaccaatggcgaagggactcctcccgctggggatcgctgaagcctcggggaggccgggccaaggagcccggggcccaaacctgcctcggctcgtcgagctcgcaagttcattgtctgcctgggccgccgccgccaccgccaccgccaccaccgcgccgggagcgccgcggggagtgaggctgcgcgccgcctccgccggcccggactccctacgcccagccccggccgccgccggcgctgcctggcccgaacccgcggaggggcgccggagccccgagcccagggccagacctcctaccgccgctcctcgccgaccccacctcggcgtctggcacctaacttgtacctgagaagcctgagtccagcccgggagcctctgcggctccggctccgcgggagcgcgcccag

SEQ ID NO: 33484 - DNA, 140 bp, Homo sapiens
  chr10:125853707-125853847
  hyper
ggtctggagccagcccgtacattaatattcaaggccacagcgctggtgagttcggcgccctctgttgtatttttgcatcccgggaaggctggcccggctctttggcccggcgtgttttgcttccgcgggggaggtaaagc

SEQ ID NO: 33485 - DNA, 15 bp, Homo sapiens
  chr10:126135816-126135831
  hyper
ggacactttgaagga

SEQ ID NO: 33486 - DNA, 846 bp, Homo sapiens
  chr10:126135877-126136723
  hyper
cgcggcgggcaggggtgcgctgacacccgcgcacctgcacccccggtggaggagccgagggcacacgacgatgccaatccctcgtgaatcccgcgaaagaggggccagggggctccggattcatagacgcggggcgtagaagggggtcaggtaggaaggcccaaggaacggcgcgaaagggctcccgggggcggcagccgtcagcgggaaggaggcggcggacgggaagaggacattggccgcggagtaggaggggaaagtctggaagtgcagagcgccggtgccgggagggccaggactgccccccgagccgccgccgccgccgccccccgccgcccctggctggggcgcgccaccccccacctgcgccgcgccgtcggcacccgggttctgcttcttccacttggtcctgcgattctggaaccagattttgacctgcgtctcggtgaggctgagagacagcgcgaggttcaggcgctcgcacactgacaggtagcgcgtggcccggaacttgttctccaaggccaccagctgctcgtaggtgaaggcggtgcgcgcgcgccgcggcttggcgcagttgggctccaggcgccggcgcctgggacgcggggagccgggggatcccgggggggacctcacagggccgcccccgccgtcctcgcagggctccccagacgccaatgccccggccggggcgtcaggtgagcgcgctaggcccggcagcaagcgcgcagcccgctcccgcagccgcggcctcctcggatcctccgcatcctcctcctcttccgcctcggaaccctccaggggggacgcctggccggcgcctgggcccgcagcatctagggg

SEQ ID NO: 33487 - DNA, 150 bp, Homo sapiens
  chr10:126137255-126137405
  hyper
aaggtaagttttaatcgaacaatattaggatcagacagggaaagggggtttgaagtcggtacctgcaagctgcgggcaggagatatgcaggcgccagtaatagaatatcgatcacgagggtgggggaagggagggcggcccctcggagag

SEQ ID NO: 33488 - DNA, 1466 bp, Homo sapiens
  chr10:126137640-126139106
  hyper
ccttcatcaggtgtccgccagcgttgggagtaattcagaaagggtttcgagaagaaagtaccgaaagcttcccaacactccatccgagccccgcccccagcccagtcccagttaacagttgagtctggggagcttgagcgcctggggcagcccagccccgcaggcgtctccgggtggcacctgacctcgctactcacgaagacccccggcgcaagccttagcgtcagctcccccatccataaaatggaggtgatgttaatgatgctgtccatctctcaggttccgaagttttcatcacctttatcccagcccttagcccaggtcctagcacgtggcaagcgcattaaatgcccgataaatgagtaagcctggcaagacaggcgccaggtaagtttccaccgcgagcatcagaactgtggtgcgggtgagcttggcgggtgagcagggatgcggcaaatccctgccctgtaatgcggggagcctcctctctgcctctatccaagtccgaggcgggggctacacttcgcacccggtcccgtgcgccttctctctgaggaagacgctgttaagggccactcaccgggcccggctgttcccccatacactccgcattgttggggctgaggcctcctggggccggggccgccttgcatcttaccaggggtctccagctgtcggacagggtccctggagctggcatctttccccgcttcgacctccgccaaacttttcctggcttcccggggagccgggcgcacggcagggagcgctgcgcgggtgaatttctgtgggtccaggatgtccaggacagagaaagaaatcttgtggtgggagggagccgccttggccccgccgtcctgccatgccagcatgcccgtcgcccacgggccggcggtcggcggcgcggggttggggatggcgccgctcgggcttgccttcggctgtggcttggcggtagctttccagccaggagccgggtccgcgctgccaagtgaagctggggaggggggcggggaggcggggcggggagagcgccgcggggggctgcgcgccgattggcaccggcgcagcccgggccagcctcgggactatcaggcgctgtgccgcggccgcttgcctgggctcggggaagcctccgcgcgcccggtgcgcgcgaccgcggggacagtgttgtcgtctccgcgcgcctccgcccaaccctctgggactctccgagggcgcgagggaggcttccatcccggggatccctcaccccgacacacacacctctgtgacttgagtttgttccctttctccggtgcacccgccttagacttggggatgcaactgaggccaggactgcttactcccaggcaatgctcagcgcatctccttccccgccagtgaattactgtaatagcttcagacccggttacctcggaggtaaaatccctcacgttctcacagtttagcgttcacaaagccct

SEQ ID NO: 33489 - DNA, 338 bp, Homo sapiens
  chr10:128075686-128076024
  hyper
gaacttgagagcttgcggccaagggaagtcgttcatcggtggaccgacagcgccccgggcggcagaaagaaggcggcggcggcggagacccggggaagttgccggatttttaaaaaggcacctgctgggtgagtcctcactgtgcaaacgggagccacaggtgcccgattttaaggggctacaactcgggaaaacctaagtctgtaaaactaagtacgttaaactaagtaagttctcgctgtgcaccaagttgatgggggcgattatttacggcggagaaactgagtggaggaaggagggagaattccgctaaagtttgcctgcgactgacagctagg

SEQ ID NO: 33490 - DNA, 268 bp, Homo sapiens
  chr10:128076347-128076615
  hyper
ccaagagggtgaggacgggggagcggtcccgaggctgtgccctccggggcaggtactggctcctgtggggctgcgggccaagtgtcgcccttccccaaggaattggcacctggggggggggggtcggtctcgccgcgctggaagcgcaagccccggggctccggagatgcgccggggcgcgtcgcccctcggggcagccctggacctcggcgcgcccaggcgcagcgtgcggtgccctcggcggggcgggcagcgagccgccctagtt

SEQ ID NO: 33491 - DNA, 301 bp, Homo sapiens
  chr10:128076940-128077241
  hyper
cgttctggcacaagccagccttgaccgttgcaataaatgagcaaactgtccgagttggcccggggactaggaagagcgttagtgagagaaggcaggcctgtgaaatggatccacggccagcagtcaccgttcttattaccgcggaacaaattattgtctcccccgcacccccgccagttggcggcgtcccgcgggtcctagagaccgctcgggtccccccgccagggtcccgccccgagccgcggctcgctcacccccgagggtgggcggctcagacgtggctcagtggcgtccgggcgcc

SEQ ID NO: 33492 - DNA, 32 bp, Homo sapiens
  chr10:128993490-128993522
  hyper
ctccaggagctgccccgaccccgggctgcccg

SEQ ID NO: 33493 - DNA, 147 bp, Homo sapiens
  chr10:128993580-128993727
  hyper
cgttggttggtttcccacgcctgtcccggtctgactcgggctgccaggcaccgggaagccccgcggcgccgaccccaacccgcagccccgggaaggtgccaaccccagcgagtggaggagacgagcatttcacgtgggcatctgcct

SEQ ID NO: 33494 - DNA, 483 bp, Homo sapiens
  chr10:128993945-128994428
  hyper
gtctggaacccacatcgcagaggcgcagccccgctcctccctgacgtcgccaaagttgccagacgcccctcagcgacccggtcgcgccagatgcagttgcataaccttgccccccacctgcgaccgcaccgggtccgctcccggctgcaccggggtgtcccggccccgggagccgccgagtttccggccaagccggtttggggccgagtgtgtgcgcccgaatcggggtcggcgcccgtcccagcggtgctctgcccgcggccaagtacgacgggcgcgggggcgcgggaggagggcacgcggggctccgcttaccttccgctgcttacagataagtcgaggtcgatgcagcgcctggctcgggcatgtctcgctgcggaccctggcaagcctggggcggcacggagcactccggacagggcatccgcggccagactcgccgcgctcacgcggaggaagcctcggctccggggacttggcccg

SEQ ID NO: 33495 - DNA, 82 bp, Homo sapiens
  chr10:128994727-128994809
  hyper
gagggaagtcctttccgctgctccaggtcccagctactccgcggagccgggcggccagaggcgagggcgccccaagccgcgc

SEQ ID NO: 33496 - DNA, 393 bp, Homo sapiens
  chr10:129535054-129535447
  hyper
tggggcgagatgtcccgagccgagcaaaggggccgcgcattggacggggctcccaagccacagccctgggggccttgaggagtcgtggtacggtccagggcagtcggggctgcggggcccgtgaagccagacgaggctacggacttagggtccctgcaaccaagaccgcgagcgactgtggactcgggacggatcgcacaaaggaggaagggggaatcagaggggcgtccggtccaggacgtgtcaggcctgggcggggcggaaaactgacaccagggcgaggacaaggatttcgctcctccagggctgccaggggaggggctcgccaccgtcactctccatgggctctggccccgacggtgtttaaagggcggagggctgggccgggctggt

SEQ ID NO: 33497 - DNA, 69 bp, Homo sapiens
  chr10:129535695-129535764
  hyper
cgcttcgggtcccgggcctgcgccgccctacgcggccccgagctacggggctcccggcccgctcctcgg

SEQ ID NO: 33498 - DNA, 184 bp, Homo sapiens
  chr10:129536040-129536224
  hyper
cgacccaggtaacagcggcgcgccggctcgctccgtccaggactccccatcttcccgccgggccgcgggcactccgggggtgggagcaccttagacaacctaatttctccctgcgcggttggggatacccggggaggagggagaaggggaagaagtgcttgggcatggacaggttctcagacag

SEQ ID NO: 33499 - DNA, 52 bp, Homo sapiens
  chr10:129536258-129536310
  hyper
cggcggtcccggggctctcaatctctgtgcgctccttcggaggaagaagcgg

SEQ ID NO: 33500 - DNA, 197 bp, Homo sapiens
  chr10:129947985-129948182
  hyper
ggatcaggtcaccttcgcaggcccagactccaccgtcagctgccgccgacggagcccacagaggaggctcgggcgcccgcgccccctgcgcagcggcccctccgcagcggccccagcccgcgtccccgcagcgccccttccgaagcgccccctccgaagcgcccacagcccgcgttcccgcccgcaccccagcccgc

SEQ ID NO: 33501 - DNA, 30 bp, Homo sapiens
  chr10:129948725-129948755
  hyper
acgttgtgggacaaacgcctttcaactgtt

SEQ ID NO: 33502 - DNA, 379 bp, Homo sapiens
  chr10:130008498-130008877
  hyper
cacagtaatcagaggcggcctttacaaatagattgcatttgaccttgttggtttgatggacgggagtggagtccggccgcggacggcgtcccttccagggccggccgccagagggcgagcgcgccttcccgggcggggcggggacgggacggggacggggaggggacgggacggggacggggaggggacggggacacggacacgggaggcttccgctcgcccgcgggtggcgtctctgctcccactagagcgggccaggcctctgggttccgtttctcaagcacacagggagggtggccgcgggccaggggcggccgcgagactccacgtccacgtcccgggcagtccctccggaggttgggccgcgcggcccggggag

SEQ ID NO: 33503 - DNA, 283 bp, Homo sapiens
  chr10:130008906-130009189
  hyper
cggggcctttaggcgcccccgtttcctcgtcagtggggggcgcggtgccgcttctccgcgggctaaactgctgaggaaggggcgagttcctgcggcccctgcctgtcccggccacgccccacctccgccccgccgcgttgcgcgttcccgcggggccccgggcacccctggggccccggggatctctgacgcccccttccctccaacccccgctgcgatcccacaggtggggtgaacagcgcccctgctgtcccacggggcgtcttcgcgggtgatgcccaca

SEQ ID NO: 33504 - DNA, 150 bp, Homo sapiens
  chr10:130085049-130085199
  hyper
acgcagggtgcaacccggacgcgcccccgggggaagcccgcgacgcagcagccacacccccagcctgcactggcgcccaccccatgacttcgccttcgcggtcgcgggcagggagcgcgcgtttccatcggttgattagaagcgggagtc

SEQ ID NO: 33505 - DNA, 76 bp, Homo sapiens; identical to SEQ ID NO: 947
  chr10:130085200-130085276
  hyper

SEQ ID NO: 33506 - DNA, 83 bp, Homo sapiens
  chr10:130085355-130085438
  hyper
cgcacgggtccccgggccgcggcgcgctccccgccacgccgcacatcaaggcccggccggccggcgggcgccttcattagcag

SEQ ID NO: 33507 - DNA, 115 bp, Homo sapiens
  chr10:130338811-130338926
  hyper
tgggcccccagctcacgatgcccgctaggagccggcgccggggcgccccaaggctgcctccccccgcagcgctgcgcagtgcgccctggtgggatggggacgctgcacccctgaa

SEQ ID NO: 33508 - DNA, 30 bp, Homo sapiens
  chr10:130339387-130339417
  hyper
aggacctcgttttagcggattttttccttt

SEQ ID NO: 33509 - DNA, 56 bp, Homo sapiens
  chr10:130339734-130339790
  hyper
tgccggggatttcctcgggtgttggggaaacaagacgtgctcgcctaacaaagact

SEQ ID NO: 33510 - DNA, 30 bp, Homo sapiens
  chr10:130830055-130830085
  hyper
tatactgtagcaaagcgatggtggaagagg

SEQ ID NO: 33511 - DNA, 38 bp, Homo sapiens
  chr10:131265287-131265325
  hyper
gggcatgcgccgacccggtcgggcgggaacaccccgcc

SEQ ID NO: 33512 - DNA, 8 bp, Homo sapiens
  chr10:131757043-131757051
  hyper
ccgcggcc

SEQ ID NO: 33513 - DNA, 136 bp, Homo sapiens
  chr10:131757717-131757853
  hyper
agaggccgatcagaacgccccgaggctaaagaagcagggaaggatggtcgcggcgcaggagcagtttgccaagggccgagggccgcgcccgccctgccctgcgcgctcccccggctctagcaagtctggcgccccg

SEQ ID NO: 33514 - DNA, 46 bp, Homo sapiens
  chr10:131758276-131758322
  hyper
cgcgctcagcccggctccgccgctgggaacccgagctggggatcgg

SEQ ID NO: 33515 - DNA, 2203 bp, Homo sapiens
  chr10:131761134-131763337
  hyper
atgtcctttcaccagcgcagaaaaggagagccagccgctgcaggggcggcgagcacgcagcaggcacttaccgttgctgtacaataactggagtttatagtggatgccgttgttggttttctcgttgtttggctcctgaaagtaacgataaataattgcatttagtgcgatcggtgtcaggcgcggccaccacgctcggtccccctccgcgaccgaggctctcggcctcacacatggcaggattcctagctcgaagcagcgcggtgatgtcactttcctgctggaagcccagcgttctcctcgccccgagtaagtccgagggcgcagagaagttgcccagccctcggcggtcccgggcggccgcacgtggcggcggcggggtggcctggcggagccgagcccgccgcctaggggggcactcgaacccccgcgcaccggcaccgcctgcctcccgcttctagaaagagagagggtgtgatcgtgtgtttgcacttactttctctttctccacaaagtccacaaaagcggtcctttcaatctccaccggctgcccctgcctatcgtagagcgccagcacgaagtggaagaaattggatttccggaggttggaaggcggctgcttctcgaagtgcgcccgcgccagccccacgccgctgcgggaggaaagagacagcggcccggtgaggagcgcggcgccggccggcggagggggccgggccgggccggggccggggccagggcgcgcgggggcggccggtacgtacctctgggcggccgtgttggcgtccaccacgcccgccgtgtgcatccacgagcgcaccgggttcatgccgctgcccagcggctcctccttcatggtcgtccccccgcgcggaatattctcctgaatcccaaacatgaaaactgctggcggcggccgcagctcccggccgaaagcgtttcctcgagcagcggcgctcggggcttggcggcaggcggctgccctggccgccctcgccctgctcggcgcctgcggtccggccccgccgccggcttcagcccgtcccgggcaggcgcgacatacaccagcggccgggcgctccggacggccaggggcgcggaggcggctccaccggcggcggcggcgcttcgaaggagcaggacgcggtggccgcggcggcgcttgttgttgttgttgtttgcaggcgcgctcaacgtggtgtcatcctagccaggcggcgtccgcggctgcaggacactgcgggatcgcccgcttctggcgcggcccgcctgctccaaagacaaataaacggggcagtgagtgctgcggcgcagtcccgggcgcaggcggggcgcggcggggcctggagcggcgcgcgcagcggacggaggcgcacaaaactcagccctctctccccgaggaatggaccctttcccgggagccaaaactcgaagcccccgggagcggcgctgtcagagggtgacgtcggggggcggtgcctgcgccatatatgggagcggccgcccctcgccgcgcccctcgccgccgccgccgccgcgctcgccgactgactgcctgacggcgccgcgagccggcccgagccccgcgagccccgcgagccccgccgccgccgagcgccaccgagcgccgccgccgccccccgccacgcaccgcggctcctcgcgtccagccgcggccaaggaagttactactcgcccaaataaatcttgaaaagaaacaaacgcagccactgcacaattgcagtttggccccttaatacctccctgcaaaacctgccacacagtcgaacacgatgggcggggcggggggctgtaaaatgctgaggcgccccaagttgcccagatgcatgcaataaatgcaaggggctgcagcttgtcctggggccgcccgaaggagaagtgggaagaggcaggtcgaccgcagggagggcgccggagggaggagcgggcaacggactgggaggaggggtgcccagggctccccggccaaggctggacgcgcagctcagcctgatttctaagcagacctaaggctgctgcagggccggccggtcccggtctgagccccgccaggtaccccaagcttcctaccccggcggaggccgccgagtgccgggcagggaatcacgtcggaggcagggtctgccagatgctccctctcccccggtggccgcggcagaccccggcccctggcctgttctta

SEQ ID NO: 33516 - DNA, 292 bp, Homo sapiens
  chr10:131763632-131763924
  hyper
gggactccgcgcccaggagcgcggcccgcccaaaggacgtctgcgcgacacggagcagagacccaggggacgaccaggaactgtcctaggcacttccctgccaagagaaatcaggcccttttgattaaaagaaaaaaaaaaaaaagattgcagggcgcaagtgtgttgcagggcagcctcctcccgccgggtctggggcagcactcccttttcccgtgaattggcagcgtgtgtacgttaatattttaattaatcgggaaagtcgaagtccgattcacgttgtctggggacc

SEQ ID NO: 33517 - DNA, 243 bp, Homo sapiens
  chr10:131768685-131768928
  hyper
cttctggaagctaaccgcgcacaaaagtttgccaataaaattctagtttgaaaccgcggtttgccaacacgagtaaaggaagttggggtggtggagagctacagtgggcacggacggaaagggtggccacggtcaccgatgtactaatgtcctcctcctcggctacccgatctcactccttcacagcaccttaacagagtgtatacacccgttctggtgcgcaaaagtggggcgatgggtgcc

SEQ ID NO: 33518 - DNA, 100 bp, Homo sapiens
  chr10:131768929-131769029
  hyper
gcggccgggccggggagtccgtccgggtaattaactcagctccggcgactgcgacgatgaggccgggagggaaggaagagcataccgctcttggacagaa

SEQ ID NO: 33519 - DNA, 848 bp, Homo sapiens
  chr10:131769428-131770276
  hyper
tgctgggcggcaaggcggcccagggcatagctaggggccatgtagaaataaaaacagataaagaaaagaagaaagaaagaaaccggcttctcttctagactattaataagcaatttgtcccgctgaaatttacattgcaaagcggagggcgccggcagccgtggcggcgggcctggcgcgggctccgggggtgcgtcggcgcgggggcggggggggtcctccggccatccgggccgccctcgggggcgatccaccggcggctttgaactcggtgtccttgccgccgtgccgccgaccctcgcccgcacacgcgcgcatctgcacgccagggccccgcctgggctgcgcacccggaggccgggactggcgctgcgctagcgccacccgggctgagctgcagccttttgtggggggggcgggaatccctccgctcccagtgacgccttggactcgcggacccccatccgccccaaacgactgcccaggccttaaattaaaaatggcaacaataagcttaatttttttttcctccttagccgcgccgccccggtccaagtctaccgcaagcgtggagccccgagcgccgcgcccccgccggctctcccgcccgcgcgccgcccgacggagccgcggatcccgggcctagcgtggggccagggcgccatctacgggcgccgcgcggctccgggcggccgccgcctcctccctctcagcgtccagagcccgctcctcctcccgccgccgccgccctcgccccgcgccgcctgccacttatcacaattacccgacgctcccgtgccattttgcttatgaaacactgattgctagttatgcggacttttaagcac

SEQ ID NO: 33520 - DNA, 491 bp, Homo sapiens; identical to SEQ ID NO: 10635
  chr10:131770603-131771094
  hyper

SEQ ID NO: 33521 - DNA, 21 bp, Homo sapiens
  chr10:131771281-131771302
  hyper
gggagagcccacgggcccggc

SEQ ID NO: 33522 - DNA, 137 bp, Homo sapiens
  chr10:133109124-133109261
  hyper
agctgaaacagctatcgatttccagcttgctttcaagtctggcagagactgtgaaagtcctaacttctccgcgatgtcagccacggcccgcggcggtcacggagccacttcagcacctcgcgatggacagtgacccc

SEQ ID NO: 33523 - DNA, 121 bp, Homo sapiens; identical to SEQ ID NO: 3684
  chr10:133110064-133110185
  hyper

SEQ ID NO: 33524 - DNA, 322 bp, Homo sapiens
  chr10:133110553-133110875
  hyper
cgggtcccctggcccggaagttgagccgcgggtgcctggtctgaagttccgcgccccacagtggcccgcgggcctcggcggctcctgccctacgccctccaaggcaccaggcaggtggccccagggcctttgcccacgacaccccctgggtggggcaggaccacccctctgtgaattcgtcctggatgcccccaggcacagtctgtactcctccctcccccagcacacgcggcctctgacgctgcacgccgagcttcctgggacccaggacgaaccgggctccaaggaccctcgctccgcccggaccacacgcaggcagcgc

SEQ ID NO: 33525 - DNA, 515 bp, Homo sapiens
  chr10:133794727-133795242
  hyper
gccatattttaaaaacgctgtaaccccctcccatctccgcgttcacccttgaggaaatcctaacagtcaccatggatataaacattaataacaaaattaaagctcataacaggccacttgccacgccttggtgtttggtcattaaaaccaatactggtctgaactacagaccgcggagggcaacgtggactttgaggctgttcggtccaactgcgagacgcagattcacctccaggtggaattctagctcgcgcggagctggagaatcggggctttcccgtgcggtccgacccgggtccaagccaacccccgcccgagtggcgaggccgcgaaccccgggcagtacgcggggtccccacgccccgggctccgcatgcccgcaggaggggtgggtacggaaggggaggatggcgcagcctcgcccggcccgcgatgccccctaggcctccccggcaacctccccttggcgccctcttggccttccccaggcttcccccccgcgccccctcggctcc

SEQ ID NO: 33526 - DNA, 572 bp, Homo sapiens; identical to SEQ ID NO: 10641
  chr10:133795312-133795884
  hyper

SEQ ID NO: 33527 - DNA, 84 bp, Homo sapiens; identical to SEQ ID NO: 10642
  chr10:133795975-133796059
  hyper

SEQ ID NO: 33528 - DNA, 474 bp, Homo sapiens
  chr10:133849661-133850135
  hyper
cctgaagtcccagcccggagcacgcggccgtggtgagctgcgatcccaggccccggcgcagcgctgagactgtggctctcaatccgcagcagctgcttcatctgctcaatgccagactccaaaaagcatttctctcgcaacaggccaggggaggcagcgttcggggatgggacgccaagagttaagggtgaggccgcacgcgtgcagctcccccgtgctgcgcatggcgctgggatcggcctgagcggcgggtgagtccctctaagccggcggcgcccggtgcccggctccctacgcgcgccccgcggcccccgggctattttcagccacgccgagccctgttttaggagcttgcacagcggctccgcggagaccgggactgcgtgggggaggatcgcggcgggggccgtcgccgagcaaggagcgcggccgcggggaccgcccgggagtgggggcggcggggcgggccgggtt

SEQ ID NO: 33529 - DNA, 683 bp, Homo sapiens
  chr10:133850156-133850839
  hyper
cggtgacgcgcgcccccgcccgccgcctctgccatggccgatccggtccgtcggacgccgcccagagtcgctcgcggggagcctcggtgagcagcggccggggtggggccgcgaccgggggccgggcctctgcgctgcgtctggcacggtgcgtccgggacgcgggcgccctggcggccgtggggcgggcggggggcgacgtcccgagggagggggtcccgcggcagagacgcccctgtctggggcggggtcctccttgcctctcccggcggtccccccgtgggcgggtcctctccacggcaccccctgccctgcacaggcctcggcgctggcgtgacgcggccgctgggtggggcccgcgcaggtgctgggccagggctggggacccgcatctccgtgtctccgactgtgcctcccgcggaaaggggcgccgtgcgattatttttatgttggtgtctggtttttaaatttcacagcccccatttcagggatggccagcgtggccgtgggatgctgacgatacgggaagccagagaataaaggctttggtggaggtcgggaggaggcgccggcctggacagttttcctagaaaatattctctgcgtgtacccgcgaccttgcctctcgtggaaagccgctgggagttggagcggctccctcctgcccccgtctgaggtctggc

SEQ ID NO: 33530 - DNA, 206 bp, Homo sapiens
  chr10:133999847-134000053
  hyper
tctctctgtcctattcgggcccctcctgccctccgtctctcgcggccagcgtggaacagcctcgcggggtcacagcctggcgctcggaccctggcccgggtcatctgcgaaggagccggctttggccaaggtgccttcctggacgggtgtggttcccagagcgtcgcggcccggggttgactggctcggaatcccggggccttggg

SEQ ID NO: 33531 - DNA, 16 bp, Homo sapiens
  chr10:134000108-134000124
  hyper
cggggcctggcaggac

SEQ ID NO: 33532 - DNA, 57 bp, Homo sapiens
  chr10:134000125-134000182
  hyper
tggccggactctctccctcgcctccccggggtgcaaaccccgcgcacatcagctgga

SEQ ID NO: 33533 - DNA, 211 bp, Homo sapiens
  chr10:134000529-134000740
  hyper
cgcttgtgccgcccctaccagagacccccaggagcaggatgtccttccagggcaagaaaagcatcccccggatcacggtgagcccggtcccgcttcgcccggcgccccctgcccgccgcccggagtggggcctggacgccgggcggaccctcctggtcttgtgcgtgggtggggggtccctgcctttgcgtctggtccctgtcctggcgcc

SEQ ID NO: 33534 - DNA, 99 bp, Homo sapiens
  chr10:134000798-134000897
  hyper
cgcagacccccttaaggagcggggcgcccaggcccggcccggcccggccctgcccggccctgccgggccctgccgggccctgcccggccttgcccggcc

SEQ ID NO: 33535 - DNA, 286 bp, Homo sapiens
  chr10:134001139-134001425
  hyper
cgatttagccccggccgctctggccggagtccctggtggccccgaacccttccagtaacctgggttcagcgactccaaggaaagcgagcggtcaagggccactggccgggaaccctggcagcccctgaaccttcgagagcagagacccctccccaacacccacacgcaccggcgcgggaggtcccgctctgccagaaacaaagcctccccgctcgggcggggggagatgggggtgggaggaaggaggcttcgggacccggcaggacctgggcgggggagtccatgg

SEQ ID NO: 33536 - DNA, 254 bp, Homo sapiens
  chr10:134120760-134121014
  hyper
aaagcagggctgccacgggcggtgggcggaggcgcgcgcaagcccggagacgccacagccgcgggggaccctcgccccgagggcccgggcccagcctgctcctcctgcggcgccgccactagaaacggaggacgcgggcgggcgcccagaactcgcgtggggccgcagccacccggcgcgagcttctccggaagccggggcgccccgggaagccgtcccggacaccgggggaacccctgcgggaaaaagccgcc

SEQ ID NO: 33537 - DNA, 42 bp, Homo sapiens
  chr10:134122233-134122275
  hyper
ccccttgtccagatgcgacaggggcctcggcactcggcgtat

SEQ ID NO: 33538 - DNA, 4 bp, Homo sapiens
  chr10:134598087-134598091
  hyper
gtcc

SEQ ID NO: 33539 - DNA, 109 bp, Homo sapiens
  chr10:134598367-134598476
  hyper
ggggccgcccccggattctgcaaaaatagattcgcccccaccccgcgggtcctcacaaggcgtcccccgcgccgccgccgcacgggctgaccagcgccaagttcgaggg

SEQ ID NO: 33540 - DNA, 115 bp, Homo sapiens
  chr10:134599431-134599546
  hyper
gcccgggcggttagtgtccatgggcgccgccgccgccggcccgggctcccatccgggccccgccgccgccgcccctgcccgccggcccgggaagtttgcgcgcggcccgggcggg

SEQ ID NO: 33541 - DNA, 83 bp, Homo sapiens
  chr10:134599708-134599791
  hyper
gctgattggctgcggaccccgcggtccggccattggccggcgccccccccccgcccgcgcgcccccgccggccgcgcactcca

SEQ ID NO: 33542 - DNA, 22 bp, Homo sapiens
  chr10:134599995-134600017
  hyper
ctcggggaagagtcccggcccg

SEQ ID NO: 33543 - DNA, 848 bp, Homo sapiens
  chr10:134600037-134600885
  hyper
cgccgcccgtggctggggtgggtgtgagcggcagcggacgccggcggggaacgcgctccgggcaggtcggggccacaggagggcggaggacgcgggcctcgagtccacggaatccacgggcctcacggccgggcgaggctcgcacggagctgcctctggtttcgccgacacgcggccggcgcggtggaggagtgaggcaggcgggagcggggcggggaggcgggtcccgggaccacacgcgcggctcggcacttccccgtcatcggcctccaggtctcccgctgggggtcccccaggatgtgacctgggcccacgacttcgcccacgggccgcctctcgcgaatccccggccgggagaacagagaccaggacggcctcagcgcggaagccctgtccagggcccgaacgtgggtgcgggctgggggcgcagcggcagaaacgcggccttagacgcgcgcggggggccggtgtcccccccgcccccacggcaccgggagccgctcgctcatccatcccgcagaccgggcggtgagatgactccgagccccgcgcacggcggccgcgagcaaacgctccgacgtctgtggtgacgtctcgtattgatttagggacacggggcggctgtggctgtggcccacggctcgtggggagcccgagtctgtgcgcagggaacgccgctgcgtggcctctctcgggcctgtgccgcggaggaaggcggcgcccggggttcggggccggggtctcacgtccgccccctcgcccccctccagcgtccgttttcgttttgtgcaggtcgaggcggggacttggcgccgtcggccgctcctggatggcggcttggaaaagcc

SEQ ID NO: 33544 - DNA, 30 bp, Homo sapiens
  chr10:134601246-134601276
  hyper
ctctgagctgagacgcgggaactgcggggc

SEQ ID NO: 33545 - DNA, 160 bp, Homo sapiens; identical to SEQ ID NO: 10654
  chr10:134601556-134601716
  hyper

SEQ ID NO: 33546 - DNA, 63 bp, Homo sapiens
  chr10:134602327-134602390
  hyper
gcgtctgcaggggagcgggcgacggggaggacggcgggggtgtcggcccggaaggagagccgg

SEQ ID NO: 33547 - DNA, 85 bp, Homo sapiens
  chr10:134676528-134676613
  hyper
gtccctgcaaaacagcggctgcaggaaggagggtggcgaacccacgttcgcgggagtccagcacccatcacgtctgtcctgggtc

SEQ ID NO: 33548 - DNA, 46 bp, Homo sapiens
  chr10:134755978-134756024
  hyper
ccaggtccatggcgccggcgccctgctcgtccgctctctccggggt

SEQ ID NO: 33549 - DNA, 111 bp, Homo sapiens
  chr10:134901183-134901294
  hyper
ggaataacacagggtcgtgcagtccgcccggcggcgttttcgggcgagggtctggtgctggggagcgagcgcggagcgaggtgtctctttaaatacgctctgcagtgtgac

SEQ ID NO: 33550 - DNA, 410 bp, Homo sapiens
  chr10:134901295-134901705
  hyper
gcggccgcccggctggaagagccatccccaccctgcggcaggagcccgcccgccgccatcgcccgccccggtccccatggttacgcgcctgcctccggccccgggtccccgctgtcgccgcgggaggtgcgcgcagaggcggcggcgctgctggccgggctgggccgctcgtgcgcggggctgtgactcaccggccggcgccgcagccccgcaatctgttgataactcggtcccagctcggccgctgccctcgcgaatggagagcgggtccccggcggggggagcgcagcgcgtctgtctccgggagcgcggcccggccgccccggcagccgcttcggccacagcaggtgggaaggacgcgcgggtctgggcggcgggagggacgcgcggggccgcggctcggcagaaaa

SEQ ID NO: 33551 - DNA, 183 bp, Homo sapiens
  chr10:134901942-134902125
  hyper
ggttgagtttggctccggagccgggagtggggcgcagattgatttttaaatatggagaaggagacgcatctgccgctggcgcgttcggtccgagccccccaccggtccccaccggcaccgcctccgccagccccaggcgcagcccccaggccgcccgcggaggggagggagcgacaggggccg

SEQ ID NO: 33552 - DNA, 25 bp, Homo sapiens
  chr10:134902187-134902212
  hyper
cgctgaccgccgctgtcttcacaga

SEQ ID NO: 33553 - DNA, 61 bp, Homo sapiens
  chr10:134973919-134973980
  hyper
ccagcccagcccagccggaggccccgggggcggtgcgcggcgcggccgcaggatgcaggcc

SEQ ID NO: 33554 - DNA, 48 bp, Homo sapiens
  chr10:134974224-134974272
  hyper
gttaggattttcacccggaggggacagcacccccgaatgcgcacggga

SEQ ID NO: 33555 - DNA, 96 bp, Homo sapiens
  chr10:134974307-134974403
  hyper
cgcggtagctcctggtggaaaccctggcgggacagtgtgggggcagcaaggaggacggaggggggtctgcttactccctgccgggccccaggaggc

SEQ ID NO: 33556 - DNA, 462 bp, Homo sapiens
  chr10:135043164-135043626
  hyper
tgctggctgcagacgcgctgcagatggaagaagttcagattttaaaagctacttctgcgagcgcgtgaattccgacacccattcccgcggctggcgtggcttctcctcggacccatcccctggcctggcgactccccctgggacccgggtcggtcctccggacccctcgcgtgcaggtgctgagcccgggcgggggcggcgggggcgggggcagcactgggggccggacaagggggcgccagcgccttccggagcgggaggggctccgcacacacctcgacgggggcgggggtaggctcggcacaggctaaaaacgagcggagccgccggggcttaggcatcgcggcacctccgttgaacgggtctaagaacagaactcctgaggaccctccgtttccaaccgaagccagtctttgctctgcgtcttcccggccgcagcgccaggaccgaccccttaggacc

SEQ ID NO: 33557 - DNA, 565 bp, Homo sapiens
  chr10:135043826-135044391
  hyper
cgccccccgcgccgccctcgcccgccagccccgaccccgagccgcggacacccggagacgccccggggaccccgccccggaggcccgcctcgcccagcgcgctgggggaactcgggttgccggtgtccccgggctcggcgcagcgcacgccctggagcgcccgggagacggagctgctgctggggacgctgctgcaaccggccgtgtggcgcgcgctgctcctggaccgccgccaggccctgcccacctaccgccgcgtgtcggccgcgctggcccagcagcaggtgcgccgcacccccgcgcagtgccgccgccgctacaagttccttaaagacaagtttcgcgaggcgcacggccagccgcccgggcccttcgacgagcagatccggaagctcatggggctgctgggcgacaacgggcgcaaacggcctcgccgccgctccccggggtccgggcgcccccagcgcgcccgccgcccggtccccaacgcgcacgcgccggctcccagcgaaccaggtaggcgggggactggggggccaggtggggccgaggactgcggaggaac

SEQ ID NO: 33558 - DNA, 192 bp, Homo sapiens
  chr10:135044554-135044746
  hyper
cggacgcctcccccgcccccggctccccgccagctcccgccccgaccgccctcgccacctgcatccccgaggaccgcgcgcccgtccgcggccccgggtccccgccgccacccccggcccgcgaagaccccgactcgccgcccggccgccccgaggactgcgcgccccctccggccgcgcccccgtcgctga

SEQ ID NO: 33559 - DNA, 414 bp, Homo sapiens
  chr10:135048874-135049288
  hyper
ggggggagcgcgtttcggggactagctggactccgggctgtgcgtgggggcggtgctgtcggcctgggagtgacgcgggacttcctgcccagcgcaacccggcctggcccccgagggtgggggacagggcgacgcccgcggggaccacgctctggggcgtgcggggcgcaattcacggggctgggctgccccaggggctgggaggaaggaggcaggggggcgcccaagtctcctacccatggcagcgcatcagggcgcgtcccagagccgggggtggacggaggcttggaggcggaggctttggggacccccaagcctgggctagagcagcctcggcgggctctagagggagggtggagggaggggcccgggctgcaggaggcggggaggcctgagccacggtggtggggccgc

SEQ ID NO: 33560 - DNA, 628 bp, Homo sapiens
  chr10:135049727-135050355
  hyper
aggcatctgggccctcgctgcccctggccgggacacactgccggtcctgtgcagtggctcaaagcccctctaccgggggtgacccggtctctccggagatgaagtgcagcgggggtctaggccggcttcctggccccccacccctcctggctttacccccgaggccacgtccaaagcccccagcgccccacccccgccagcctcccccttgagggcccagtgacctaactgggccggcagggtccgaggaagaccagggtcagcggcggcacggtccgttccgcgacccctctcctgtgaccccaggtaggccgccgatcggttcccggctgaggtcccgccccagcgcccgcctcccgggctccaacctctttgctcagcccgggaggctcggctggctggggcgggcgtaaccgtggggcgaggcccgccggtctttctgatttccgcgggcggcgtgggcgctgaggcagccgcggtcaggacctggccgggagtcggggctgctccgtggaccccgcgtctgcgccgaaaccccgcatggcttcgggggccggacctgcgcctccgcctaactccggccgccggagacgccgtgcggaccccaagccagtgcgcggaagacacc

SEQ ID NO: 33561 - DNA, 511 bp, Homo sapiens
  chr10:135050356-135050867
  hyper
tcctaccctcggcatggctgcctcccacccggtcacgtcggtccccgcgccccacgccgacgcgcaggcgacccggggacgcggagacgcagacagctcgggactcaggttcgtgggagcagcggccgcgcgtggctatgaccgtcccgggggcccgtgctcagggcgtccccgtgaggtttgggcgccacagtcaccggcggctctgcccgcgccctggccacagtggggacagcctggcttggcggggacgcaccagtcccgccgccgacgcggagttcctaccccgccgtgcgaggcagtggctccggcccttccagctcgggatggagtcagggagccgcccgcgcccgaatgcagaggctcctgcgatggccccggagtgagtcccccagaggagccggattagggctggaggcggccgagtcccccgagaggcccctcccgacattcccgcccccgcgcgccgctccccgggtcctccgcgtctctttcccgggaaagcctccct

SEQ ID NO: 33562 - DNA, 732 bp, Homo sapiens
  chr10:135138920-135139652
  hyper
gaagcctccggtggacgtgaaatctttacttagagaaaagcgacagagtcagagacccacgggggcggggctgcagcgagggcgcctggggacacgaacacggcggagagcatcgggagacgcgctggtcacaggagctggcggaggacgctgcggagacagagcccgagggttgagagcggcgacgcggccaggggctccccgcggaccccgcgtcacccggcgggctcggattcgcaacccccaaccccgaggttctggcgggccgggtcggagggaagaggaagggaagggtggcgggggtctttggctcagaagcggtggcgggaggccaggaagagacctgggcagagccggccggagccccgcggcgcgcacctaccccgggccgggctgcggggctggagacgtcactgcgcgggcgggggcgccgcgctcccggccgccttccgcgccgcctccttctccgccttggccgacggcttcccggggggttcggtggccgccgccgccgccccagcctgggtgggccccttgcgctcctccttggctgcgcggtagccgtccccccaggccgccggcgtctccgtgccgtgcttgcggctcagcgggtaggccccgatggccgccaggatgctgcggtggcgctcggggtccatctccgtgtagtacatctccagggtcagcggcgtgcagatcttgtgctgcgggaggggccgggtcagggtcggt

SEQ ID NO: 33563 - DNA, 243 bp, Homo sapiens
  chr10:135148859-135149102
  hyper
ctccgcccgaacccccgctcgggcaggacccccgccaggaggagctgcgcttgaggggtccccttcgagccaaacttcaaatccaactcctcggacggccaatttacgtcatcgcgggtttccatggcaacgcagacaggcccgagacgcgtcttcaggaagaaaaagccattgggggcccactggagcctcgcttctggttccgggcccagcgccccgggcggaatgcggggttggaaaggg

SEQ ID NO: 33564 - DNA, 176 bp, Homo sapiens
  chr10:135150325-135150501
  hyper
gaaatagctcacaggcggctccactggcagctgctgcaggacgcggtcggggaggacgacgatgcggatgtggatgcggaggatgcggttccagacgcttcgcggccgggcggggcgggggctgcagctgcgagaccgaggctgtggtcgccatggaaacgcggctagaggcgggg

SEQ ID NO: 33565 - DNA, 100 bp, Homo sapiens
  chr10:135170736-135170836
  hyper
cgggaagttcaagtccgcaagaactaaacagccgggaggacagcccgtgtcggcacctatccctgccctcggggtcggcgccgcccgtcctcccacccag

SEQ ID NO: 33566 - DNA, 345 bp, Homo sapiens
  chr10:135236927-135237272
  hyper
gcccgccgccaggcccgcggccgctcccgccgccgccccggctgccgccccggcggcagccacgcgcagggaggagcccggggcaccgtagcgctgcgccggcctcacgcgcaccctcgaggccccgcgcgcacccccgcggacccctccccgggcactgccccgcgcacctccgcggccgcccttggctgcgccgctgtcgcagaggaaggcggccgccagtagcagagcccagcacgttgcgggtgcccagttcatcttcgtggggctaaacctgcgggaagagagggaaagggcccttagtttccatggagatcgggtgcccaggggcggagggctcaaggc

SEQ ID NO: 33567 - DNA, 32 bp, Homo sapiens
  chr11:279473-279505
  hyper
ggacgccgtggacctcgcggagcagctggccc

SEQ ID NO: 33568 - DNA, 90 bp, Homo sapiens
  chr11:280129-280219
  hyper
ggtgaaggagaggaacgcccgctccgtgaagatcaccaagcgcttcaccaagctgctcatcgcgcccgagagcgccgccccggaggaggc

SEQ ID NO: 33569 - DNA, 56 bp, Homo sapiens
  chr11:308110-308166
  hyper
aaactgttgagaaaacggaactactggggaaagggagggctcactgagaaccatcc

SEQ ID NO: 33570 - DNA, 32 bp, Homo sapiens
  chr11:308230-308262
  hyper
cggccagcctcccaactacgagatgctcaagg

SEQ ID NO: 33571 - DNA, 31 bp, Homo sapiens
  chr11:308322-308353
  hyper
tgatccacatccgcagcgagacctccgtgcc

SEQ ID NO: 33572 - DNA, 44 bp, Homo sapiens
  chr11:327148-327192
  hyper
agcagaatgaggtgacgtcactgggtcagcggctcctgtggcat

SEQ ID NO: 33573 - DNA, 35 bp, Homo sapiens
  chr11:369448-369483
  hyper
ccccgcggcctggctcggtccgattggttccgcgc

SEQ ID NO: 33574 - DNA, 43 bp, Homo sapiens
  chr11:370169-370212
  hyper
tcggctcggcccggacgctcgatgacgtcggcagtgacgcgcg

SEQ ID NO: 33575 - DNA, 320 bp, Homo sapiens
  chr11:406722-407042
  hyper
ggcccattcacaaagcgtggtgccgcagagctccccacggaggggtcccagcctggagcccgggcaccgcccatctctaacccgccgctagccccggaccctcccgcgcctgctccgcaccacggagccgggcctccagagcagcaaggtcaccaggtggcggtgctggcgcagcaggcggagcgccgggtgcgcggggtcgcgcctctggccctcgaaggtgatgaagatgggtctgcgggtgagctccagcagccggcacaggccctccctgcggggcgggaccgtcaggggggtgggtgctacgctggggcccaccc

SEQ ID NO: 33576 - DNA, 30 bp, Homo sapiens; identical to SEQ ID NO: 10670
  chr11:407401-407431
  hyper

SEQ ID NO: 33577 - DNA, 66 bp, Homo sapiens
  chr11:507716-507782
  hyper
ggtcgcgactctaggcgaccttggtagaggggctcgtttgcgccgagctcgcgacccccgagggag

SEQ ID NO: 33578 - DNA, 6 bp, Homo sapiens
  chr11:536871-536877
  hyper
cggtcc

SEQ ID NO: 33579 - DNA, 70 bp, Homo sapiens
  chr11:537026-537096
  hyper
cggtgtgtgtttcctggtcctcgggggcgcttcccccggtgcttccttttgccgtcggcctcacttccaa

SEQ ID NO: 33580 - DNA, 27 bp, Homo sapiens
  chr11:637237-637264
  hyper
aggggagggactccccggcttgcgacc

SEQ ID NO: 33581 - DNA, 137 bp, Homo sapiens
  chr11:637349-637486
  hyper
cgcgggccggccgcgggggcatctgcgggggcatctgcggggctggctgggcagggcgcggcggcgctggtggggggcgtgctgctcatcggcgcggtgctcgcggggaactcgctcgtgtgcgtgagcgtggccac

SEQ ID NO: 33582 - DNA, 203 bp, Homo sapiens
  chr11:726307-726510
  hyper
catgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggtgagcgggggcgggggatgagctgg

SEQ ID NO: 33583 - DNA, 250 bp, Homo sapiens
  chr11:1410104-1410354
  hyper
acctgaaagaggggtcggtagcaagggccgggaggcgccagggcgctgcggccggatcccaggtgagttccttgactccgcgccgcgcaggtcactgtggcataactgggaaaaccgccgcttctccctcgggagcggaggcggagggccacgtcctccctgggggtgcacaatctctgcttggacaacgcccgcgtgcagtagccccacagactcccatgcagcccccccgccacgtgtgccgcatccg

SEQ ID NO: 33584 - DNA, 34 bp, Homo sapiens; identical to SEQ ID NO: 10675
  chr11:1411655-1411689
  hyper

SEQ ID NO: 33585 - DNA, 452 bp, Homo sapiens
  chr11:1411907-1412359
  hyper
ccgggccgcattgtgcgccccagcgaccgggcccattgtgccgcgggaggagggggccgcgcgggcgcccatctgccgtctgccgcggccgcgctaataggcgtgctgcccgagcagctgcgcccccggcgggactcccacctccgcgcgccggccaccggggcctccgggcaggcccgatctccctccgcggtgggggcgggagagtgcggggacctgcagagggctggacagcgccttgcgctgctccggctcgggctcgggcgggcggagcgtctgtgacctgcattcccacggggcagggagaggccattggtgctgggaccagaagtgcgtgggacctgacccgtggagcagccccgcggcctgccggtggagggggcttcccggtggggcctggctgtcattctagggaacaggccgggtccctgcggggccgaacccaggccaga

SEQ ID NO: 33586 - DNA, 426 bp, Homo sapiens
  chr11:1770262-1770688
  hyper
cgcgcggccggaccccctgagcctcggtgcgcgcgtccttccgccgtcccgcgggccgctgtctgtccactgatccgcctcccagcggcccaaccttgagggggtggggagcgcgcggggctcggcggcggcgccgctgcctcccccgccgcctgcgctccctccgcagcgccagaccggccgcgcggctgcagcccagagcctgactcacggcggcagcgggcacagccacctccccgcctccgcctcctcctgccaggagggtgggggcctcggaagccgcgaccctggggagttgcaaggtcccgcagggatgggacccctacagcccccgaccagggtgtccgcgccacctccatctccccggacccactgcgtcttcctccccaccccacccggccccatccctctcgcggagcccccagc

SEQ ID NO: 33587 - DNA, 52 bp, Homo sapiens
  chr11:2291148-2291200
  hyper
cggggtggtccctggcggcccgcggggcgcagacggccgcacggcctgcggc

SEQ ID NO: 33588 - DNA, 74 bp, Homo sapiens
  chr11:2291420-2291494
  hyper
cgcctccggtctctgcggtggccggtcgccgccgccggctgcagcgcaacagttccggggacgcgggtctccgc

SEQ ID NO: 33589 - DNA, 74 bp, Homo sapiens
  chr11:2291984-2292058
  hyper
ccctagcccatcccccggacgcagtccacagatccccagtgcgcccaactggcgaaatctgcgagttcccggtg

SEQ ID NO: 33590 - DNA, 255 bp, Homo sapiens; identical to SEQ ID NO: 10680
  chr11:2292105-2292360
  hyper

SEQ ID NO: 33591 - DNA, 374 bp, Homo sapiens
  chr11:2292391-2292765
  hyper
cgcccggccccattgaggaagcgcgtacgcgtggcgcgtggctcacggggagcatcgctaacaaagctgggttcctgctgggccccgccctgctcctcgcccccgcgactgggctgggcgcgctgtcccctagcgcagctatgtcccgagcgcgcccccacctgtgcgttaatctactgggaatgggggtggactgcgccttacctggggcggggtggggcttaaggagtggtcgagactgaggcggggtgggaggttcaggttcccggggcgccttccccaacccgccccgctttccccgtccctccacgcgcaccctgcctgtggtttccgtgcgcccccggcctgagggctctgggcggcaccttaacccg

SEQ ID NO: 33592 - DNA, 107 bp, Homo sapiens
  chr11:2398287-2398394
  hyper
acccccttgggggctcggagcgcgacagcagcttggggacgcctcccgcgcccagcacggtgcacctgggccctgaggtcctggccgaaacgcgccaagttgggggt

SEQ ID NO: 33593 - DNA, 9 bp, Homo sapiens
  chr11:2465439-2465448
  hyper
cgacccgag

SEQ ID NO: 33594 - DNA, 59 bp, Homo sapiens
  chr11:2465461-2465520
  hyper
cgcagctcgcgcgcctgggcacccgggggcgctcacagtgatcgcggggccagcacacc

SEQ ID NO: 33595 - DNA, 150 bp, Homo sapiens
  chr11:2466681-2466831
  hyper
cggctggaaatgcttcgtttaccacttcgccgtgtgagtatcgccaccggcgacggccggcacgaaggtgcttcctgagagctggtgtgggggagctctgtcccagcgccacctgccccgtcggagctgcgaccccggagcagaggaggg

SEQ ID NO: 33596 - DNA, 30 bp, Homo sapiens
  chr11:2554518-2554548
  hyper
ctgaaaaagccatttcgggaggaatctggt

SEQ ID NO: 33597 - DNA, 394 bp, Homo sapiens
  chr11:2883606-2884000
  hyper
cgacccccagaccttcggggtgcccagtccgagcctgggccgctaggggccgcgggcctggcgggcggggcgggggccggggtcgggggtccggcgagctttaatgcgcgcacaaagcctcatttgcaggtcaatgccgcggcacactcgcctctcccctcgcccggcgccctttgtccggccgcgcccgctcctcgcgccagatggccgcggaaatgctaatttcgggcgcccctgcccccccacccccgcgtttaattgcgcctttgcagatgggccgcgagtgtgcgcttcatgcagatgagcgcggcctcgccgccttcctcggacctccgggagccgcggccgggcgtgctggggccgagggcagggagggggccgctgtccctccact

SEQ ID NO: 33598 - DNA, 49 bp, Homo sapiens
  chr11:2905392-2905441
  hyper
agggcggggccggcccggagacccgagagggggccgggagagggcgcgg

SEQ ID NO: 33599 - DNA, 145 bp, Homo sapiens
  chr11:2905874-2906019
  hyper
cggggcggggccgtgcggggctcaccggagatcagaggcccggacagcttcttgatcgccgcgccgttggcgctggcggccgcggtgccggccgcgggacgtcccgaaatccccgagtgcagctggtcagcgagaggctcctggc

SEQ ID NO: 33600 - DNA, 258 bp, Homo sapiens
  chr11:2906322-2906580
  hyper
gcgcctcctcgaggccgtcgagggactcagcggccggctcgaggggcgggctgacagccaccgcgaccgcgacgggccgcggcgccagcagcaggcggcagcgccccacctgcaccgtctcgcggtagaacgcgggcaccgagtcgctgtccacttcggtccactgcaggcgtccagggccccgcagcggcatgtcctgctggaagtcgtaatcccagcggttctggtcctcggcgttcagctcggccaggcgggcct

SEQ ID NO: 33601 - DNA, 49 bp, Homo sapiens
  chr11:3224699-3224748
  hyper
gctctgctgcctgtccgggtgccggaggcacgaccgctcccctccaggc

SEQ ID NO: 33602 - DNA, 258 bp, Homo sapiens
  chr11:6280415-6280673
  hyper
aggagatggagggtgcggagacagatgcaggagctaccccaggcccgcagcgaggagctgcagggaactacggtagcaatagtgtcacggtcactgcggccactgcaacacagtacggtaaatgcggctctaggctcagactaaagcatccgcgcctcagcaggtgacgcacgcagacctggtctccaacgccacctccacgttccctgatacaccagagaaagatgctggatccgtggcagccgtctctacccaacc

SEQ ID NO: 33603 - DNA, 61 bp, Homo sapiens
  chr11:6281259-6281320
  hyper
gggcaacctcagctgcgagccccctcgcattcgcggagccgggacacgaggtgggtgcctc

SEQ ID NO: 33604 - DNA, 15 bp, Homo sapiens
  chr11:6676538-6676553
  hyper
cgcaccccacacccc

SEQ ID NO: 33605 - DNA, 203 bp, Homo sapiens
  chr11:6676627-6676830
  hyper
cgctcacgttcacgcccgcccgggtcccgcaggcccaggccccccctcccccattgtctccggctcagaacaaagcccccggctccgccgccgctgccgcagcccaggggaggccggcgggcagggcgggcgcggccagacgggccgggcgggcgcgggcactgacctccgcgcgacgcgggctccctcgcccggtgctgggg

SEQ ID NO: 33606 - DNA, 109 bp, Homo sapiens
  chr11:6677219-6677328
  hyper
ccccggctccggatccggccccagcgccgcgccgcgcccccgtcccggttcccttcccttctccccgtcacttctcccgtcctctcctcccattcggttctctacgccc

SEQ ID NO: 33607 - DNA, 673 bp, Homo sapiens
  chr11:6947606-6948279
  hyper
gttccaagtgtgcggcgtgggcggggcctgcagaaagggacggggcctgcagaaagggacggggctggcaaaggcctggtctacctcaccgatccgggtcgcgggggctcctagggggttccttccacagctggtgcgcgtgcgcaagagtgcgtcgaggttgttccgcggcaatttatgaaactcggagccggcagtgagttgagggttcggcgaggtcagggattcctagttgcagcgtgattaccaacgccagctcccttcactgtccaagacagcgattccgcggctcctctgagaactggcgcttgtgagtgactgaacgggccactggagaggagcggtgctcacgggtatcgttctcgtcagcgggcggtggggacgcggggtcttggaattgggaatcacgcttgagggcgtccatgcggaacgtgcagcttacctcagcttgcttgcagttacccagtttccacgctgccctccaaggtctgtgccggaaaacctggaggagggcgcgagctgacgggagggatggaaacgtgggctgcggaagtaagacaagcgttgagagcagcgacagagggcgagggggtgggcggcgggacggctggggtcaggatccagctccgctaaagcaaggatttaaccacactcctgtcgcctcttccactct

SEQ ID NO: 33608 - DNA, 66 bp, Homo sapiens
  chr11:7273082-7273148
  hyper
ggccccgccccccggcggccgcgagtagcgggcggagcgcaagcagagaggcgctctgggctgtgc

SEQ ID NO: 33609 - DNA, 111 bp, Homo sapiens
  chr11:7273149-7273260
  hyper
gcaccgcctctcctcggtgtctggggagggacggagggaccgggcgggagagagagaaagcctgaccgaccggctggcgaagagctgcatgcaaccggtgggaggccgggc

SEQ ID NO: 33610 - DNA, 220 bp, Homo sapiens
  chr11:7273679-7273899
  hyper
cgagccaggagagtgatcaagaaccagcgcactgtggcctgatgctgtaaccaggcggggacccgggcggtggctactgcacggaggccgactccgggtcggctagggcagggttggagggaccacgcccgccacctgcgctcccatcgccaaggctcctgggggcggctccctagctccgagctacgctctccacttcccgggctatctgcactcagag

SEQ ID NO: 33611 - DNA, 173 bp, Homo sapiens
  chr11:7274075-7274248
  hyper
cgcgatccggcgttgggccggggacagggtgcttctggccttgggcagacgggcctgaacccgttcccggcgggtcgcacggcatggaggtggcctgggcctgggcgctaggctcgaccagcgactaccgccggccacgatggggttcgtagactcgtcggtcctggcttgtg

SEQ ID NO: 33612 - DNA, 126 bp, Homo sapiens
  chr11:8040298-8040424
  hyper
ctggggaagaagggacggggagacggcgggaatctaggaaattgggggatggctatttccattcctgagaaggggggaacttgattgtgggaggttggctgaagactcccacgccggaaaggaggg

SEQ ID NO: 33613 - DNA, 108 bp, Homo sapiens
  chr11:8040668-8040776
  hyper
acgggcccgggtccccgcagtcgcgcgtccccgccattggcagagccggagggggtcaccccccggggggcgaatggtacagtcctccgcccgcgcctcggccgggcc

SEQ ID NO: 33614 - DNA, 100 bp, Homo sapiens
  chr11:8040960-8041060
  hyper
cgggagaagcgggcctccgggggctaggactggcgcgagcgcccgacccccagggtgggcttgggcacccggaccctcgggcatccgggacccagagcct

SEQ ID NO: 33615 - DNA, 67 bp, Homo sapiens; identical to SEQ ID NO: 10692
  chr11:8041504-8041571
  hyper

SEQ ID NO: 33616 - DNA, 428 bp, Homo sapiens
  chr11:8102616-8103044
  hyper
gcatggagcgtggatcgcgacgatttcgggggagggggcaagggcgctccgcaggccctgagccggccggggggtggggtctctgcggggcggggcggggcggggcgagggagaaggggcaggccgccgctgccacgcagtactcccgccttggcgccagaggggcgcgggacggtgcggtcggcctccccgcctccacgcgcgcgcacgacccgcgcactcccggagcttcgcccatctcgcctcgccgcgccgcgcaggcagccgctcgcagagccagcagccggggccctggcgtgcagcgcgggcctcggcggggcccagcgccccggcccgggaggatgcggcccggggcggcccgggagctgagcagggcccccgcgccggcccctccgggccccggcctccagagccgcagccaccgcccc

SEQ ID NO: 33617 - DNA, 794 bp, Homo sapiens; identical to SEQ ID NO: 3689
  chr11:8189946-8190740
  hyper

SEQ ID NO: 33618 - DNA, 56 bp, Homo sapiens
  chr11:8284256-8284312
  hyper
gagacagggagctagcgggccggcacaagaggcggctctctttctcaccgagtcac

SEQ ID NO: 33619 - DNA, 13 bp, Homo sapiens
  chr11:8284313-8284326
  hyper
ctcatgcagatgt

SEQ ID NO: 33620 - DNA, 369 bp, Homo sapiens
  chr11:8284592-8284961
  hyper
ccgcggcgcagcacacggccagtgcacagctcctcggctcgcggccgggacccggggggcgtgcggccccgggcgcgtgcagcccggggctcgacctcctccccccgcaagttccgcccggctgtcccccggtacttccccccgccccagccccggcccccagcgcgccgcccgccccgcaatccccgcacagcccagcaggtgtgcgcccgtgtccccgcgtgtgtgtgcctgcgcgccgcggcagggggcgagggggtgaggggcgtcgagaccccggcccgccacctaccgtcctccttgtccagcaccatcatctcgggcgctccgtgtccagccgcagctaggctcggccgggagaagggcgcc

SEQ ID NO: 33621 - DNA, 245 bp, Homo sapiens; identical to SEQ ID NO: 10698
  chr11:8289527-8289772
  hyper

SEQ ID NO: 33622 - DNA, 366 bp, Homo sapiens
  chr11:8290057-8290423
  hyper
cgccgccggccgcctgcgctgctcccgccggccccgcgcgggcgccgagtccggagagccgcgaccgccgacgggggcagacggaccggagtccggagcgcagccccgcgggcagggagcgcaggaggagggactggggggaaggcgcgggggcgagacggccaggccgggatcgcgggagcctcgcgagcagcagctgcccgggccgggccgcagccggagcctgagccgcgcgcgcgtccttcctccgcgccggccgtactcgcctcagcagagtgaaggctgcatttcccagggcccctcagattcccctgttaattaaatcaattcattatgctcagatctgattagcggcccttccccccc

SEQ ID NO: 33623 - DNA, 130 bp, Homo sapiens
  chr11:8615288-8615418
  hyper
accccacagtaagttcgcttctaaactttcaaaaagtttcacgtcccaagatggggtgaaggtgagacggtggagatgaaccggggcagacagagaccaccccaaataccggacccgggggaaatggggt

SEQ ID NO: 33624 - DNA, 125 bp, Homo sapiens
  chr11:8615762-8615887
  hyper
gaggacaaacagcggcggcgggtgcaaagccccttctccaagccgcggggttggccgggaggtgccggctgcacaacggcgcccacgtgacccaggtgcagccccaggcgcgcccaagggcagct

SEQ ID NO: 33625 - DNA, 1268 bp, Homo sapiens
  chr11:9025080-9026348
  hyper
gggaggaggcacagccgaggggagcgcaagctagaaaagctacgacggaatccccaccgaaaccgcagcaggggtactggaaggggaggaatccgcgacgcagcgaccgcgagccaagggcagcggcgggccgggccgtgactcagtgaaagccgcaacggccgggcctcggaaaacggcgggcgcgaagccgccggggccggggcgagaacggcggcgggggctcaccatgtccttggacgagcccagcttcttgaggccgtccaggggcagcaggtcggcggagtccttgtggatgaactgcaccgcctgcttcatccggcgctgctgtcgcagtgacgccgcctcccgcatgtcggtctccttgcggccgccctcagtgaggagccctgagtaaaacatcgctgaggcgccggcggcccggtagcccacagccccccggcagcctcagcctcgagctcctccagcgccgcaagggccccgagccgcgccttttatagccgagcgtgacgtcgcggggagcagccagtgcgcgcgcggggggcggggccggcacagagtccacgccccgcgcggctccctcgcgtcccgcgtcccgcgtcccgcgtcccctgctcacccggtggcaaagccggcgaggaggcggcggcgctggtggggactgacccggcagtccgagaatccaccgcggccttttcacccaaccgccccctcctgcgtgggggccccgcatcccctggactggcgtgggctctggggcccgatgccctggcagccccggccatctctgccgctggccgcgggtacctgctcacctgtccacgccgtggccgacccggggatcaccgacagccgggccatgcctcgagtcccgccgcccgcgccgctgctcggcttctcagaaacgcacctccacgccgccagccggggctccagggtccaccgcccgggcccggaggactggcgactccctccgaggttgggagcgctccggatttctccaacttcaggtcggtccccacccaccgggccacgtgactggggagggggcagccggtgcaggcgtgtggaggaggctttcgggacctcctcccccgggcaccctctgcctgcagcccggcacccggcccgcgtttccgagccgggggagcaggtgcagtcggaagcccgcgggtgggcgtggggcgggggagtggcgagggtcccccgcctccgcgggagcgcacgcggctgcgagccctacacctgctctccgaccaaagaagcac

SEQ ID NO: 33626 - DNA, 140 bp, Homo sapiens; identical to SEQ ID NO: 3690
  chr11:9112446-9112586
  hyper

SEQ ID NO: 33627 - DNA, 681 bp, Homo sapiens
  chr11:9112639-9113320
  hyper
cgcaccctcctgcctgctcgccggcgacggtctgactagcaggcgctctggaggcatccggaccggggcgggaaccgtcagcagctccgggtccgaggccgggccgaaggactcagggccccagcggtcgtggcgccttggcccggccggcgggtgaggtcccggggggagcagaggcccccgcggagctgcagccgccagccccgagccccgcgcgcccggctctggactccgccggggacctaaacactcttcctggccctgcctgctgtgccaggtgcgcccccgcggccggacactcaccctcctgcggccccgcggcacggccccgacccggcgggacggcccccgccagcagcagcagtggcggcagcagcagcagcagcagcagcaccgcccaggccgccccgggacggttgcggcccgcgacccccatggatggctcagcggttgcgggcagaggcggcggagtgcgggcggtggcggcggcggcgcggggaggtgtgcgcggacgccctgcccgctgccgctgccacccccggcccggccccgcccgccccccgagccccggcctcattttcacacggtccctcccgggccggggcgggaagcgcaggcgggagcagtgccgccccgcccggcctcctcccgtcccctccccggcctcgggtggagggggcg

SEQ ID NO: 33628 - DNA, 64 bp, Homo sapiens
  chr11:10472083-10472147
  hyper
agcggtgtggaagcccggcggggccagcgcagttgaggtctggggagcccggctggcatctgct

SEQ ID NO: 33629 - DNA, 60 bp, Homo sapiens
  chr11:10472462-10472522
  hyper
gccgggccctggccccggctggcctcagtgcccagcagccccgctccgctctgcccagcg

SEQ ID NO: 33630 - DNA, 46 bp, Homo sapiens
  chr11:10472557-10472603
  hyper
cggccggcggcatggccctgtcgtccgaacccggtgagtgcgcgcg

SEQ ID NO: 33631 - DNA, 66 bp, Homo sapiens
  chr11:11642602-11642668
  hyper
cagcccagagtcacacgcacatttggacacgtgcgcagcgcgcccccataccgccagctagctgca

SEQ ID NO: 33632 - DNA, 96 bp, Homo sapiens
  chr11:11643016-11643112
  hyper
gcacatacacgctggcgatgtagttggtgacccagcccacgtagagcaggcagatgatgttagtcatgccgctcaggatcacgcaagtggacacca

SEQ ID NO: 33633 - DNA, 362 bp, Homo sapiens
  chr11:12029910-12030272
  hyper
acccacctcttccaccgcgctgcgcaatttgtgctgcgtgtcctccatcagttcctcaacctcgcggaacatctcattgagggtggcctcctcctgcgggtagctgagagccgggccgggcttgactggagccgaggtcgccgtcggagcgggcgcgggggccgtggggaccgccgccgccagcagcaggcacagcagggtggccccaagccgctgcatctccgctctgcgcccgcagccgccgcctgtgtgtcccggaacgcgatcagaggcgcgcggaccacccccctcgctgggcccgccgccccgccccgttccgccccgccgcccgcccctggcgcccctctttcccgcacccgccc

SEQ ID NO: 33634 - DNA, 288 bp, Homo sapiens
  chr11:12030273-12030561
  hyper
gagacgggaggaaaccgaggcccctgaaaacgcagctcccctacacccgaaaagacgcgaccccacccgctccagcccgagccccgatcgccccaggaccccgcacccccatcctcgagcacaagctgagctctgctcctcacctgtgatgctggagccctcgccagagcaaccgaacccggatcctctacgctaatagctcccaagccccagctcacctagactctgtccccggttcaaaccctagcccctcctcgaccaggtcagagtgcccgacccccacttcca

SEQ ID NO: 33635 - DNA, 74 bp, Homo sapiens
  chr11:12030834-12030908
  hyper
gagcgcggcggggtgcggcagcgccggtacccgagggagcccgcaagacgcgccccgcccgcccaccaggctcc

SEQ ID NO: 33636 - DNA, 60 bp, Homo sapiens
  chr11:12132499-12132559
  hyper
ataaaagcctcccaccggcacgccgaactacctcttactccgctccgcaacacccaaacc

SEQ ID NO: 33637 - DNA, 30 bp, Homo sapiens
  chr11:12398995-12399025
  hyper
ttccagggcagagggcggcgcgagggaggg

SEQ ID NO: 33638 - DNA, 92 bp, Homo sapiens
  chr11:12399277-12399369
  hyper
cttcttggggaaactcggagggaccctggcccggaggaagaaagccaaggagggtgagtgcggccaggccggccgggcgggcggtaggagcc

SEQ ID NO: 33639 - DNA, 15 bp, Homo sapiens
  chr11:12695481-12695496
  hyper
acacttgcagacttc

SEQ ID NO: 33640 - DNA, 258 bp, Homo sapiens
  chr11:12695888-12696146
  hyper
cggcaggccgcatgacgtcaccgaggccccacccctccggagcgagttcggtcctggcgttcatttcattcctgtcctcattccgaacattcttagcatcgctcgcgccgcgccgcgccgcctgagccgagccgagcctctgctgccgccgccgcggccccgccgcccgccgcgggcgcccaccaagcactttgcagactcgcttccaccctgcgggccattccgcgcggcggggcccgggcccggggcggccgcgtc

SEQ ID NO: 33641 - DNA, 48 bp, Homo sapiens
  chr11:12696640-12696688
  hyper
cggcccccggccggccgcgccgcgccccccgcgcgccccctctcccgc

SEQ ID NO: 33642 - DNA, 30 bp, Homo sapiens
  chr11:12715647-12715677
  hyper
gcggcaggctgagtccggggaagtgcccca

SEQ ID NO: 33643 - DNA, 173 bp, Homo sapiens
  chr11:13030315-13030488
  hyper
gactgggaggccttccgctttagaggcagcgcttatagcgctagctggtcgtggaatgcgattacagcgtctccattggagaccgctgagtgcctcggtttccctgtctgtgcaaagtgcactccccagacgccgctgcctcgagggaccaggaaatgcgtctgggggcgcca

SEQ ID NO: 33644 - DNA, 380 bp, Homo sapiens
  chr11:13031244-13031624
  hyper
ggcggcgacggagacagcggcggagccggcggctggggtcggccggcgacccgcatggcccgggagagctgcccgaacccccgaacgaggacgacgaggacgacgacgaggcgctgccgcagggcatgctgtgcgggcccccgcagtgctattgcatcgtggagaagtggcgcggctttgagcgcatcctccccaacaagacgcgcatcttgcgcctctgggctgcctggggcgaagagcaagagaatgtgcgcttcgtgctagtgcgcagcgaggcatcgctgcctaacgccggcccccgcagcgccgaggcgcgcgtagtgctgagccgagagcgcccctgtccggcccgcggggccccggcgcggcccagcctggcc

SEQ ID NO: 33645 - DNA, 15 bp, Homo sapiens
  chr11:13032000-13032015
  hyper
agccagaagaggtgg

SEQ ID NO: 33646 - DNA, 219 bp, Homo sapiens
  chr11:13032093-13032312
  hyper
ggcgctgcgacgacttgctgcggcttcaggagcaacgggttcagcaggaggagttgctggagcgcctttcagccgagattcaggaggaactcaaccagaggtggatgcgacggcgccaggaggagctggcggcgcgggaggagcccctggagcccgacggtggccccgacggcgagctgctgctggagcaggaacgggtcaggacgcagctcagtacca

SEQ ID NO: 33647 - DNA, 83 bp, Homo sapiens
  chr11:13032656-13032739
  hyper
gcggggggcggggggcgggaacagggggattcttttttcttgcagaatgcagtgggccagccggctcgcggacttgaaaccag

SEQ ID NO: 33648 - DNA, 216 bp, Homo sapiens
  chr11:13300474-13300690
  hyper
gcctccccgaggggtcgcgagagccggcagcggggtgagctcaggtgcccgccggcaggagctggggagggaaggggagtgctggacaccggcgcctgctgtcaagttctcgccggccggtgagagacccgctgccgccgcgcaccccgcacctcctgacccctctcccctctccgcctcggccccttcccggtcacctagcgttgttttggcgct

SEQ ID NO: 33649 - DNA, 30 bp, Homo sapiens
  chr11:14665073-14665103
  hyper
cttctctttcagtcccggtgggtcttcgga

SEQ ID NO: 33650 - DNA, 407 bp, Homo sapiens
  chr11:15136049-15136456
  hyper
caagggaaacgatcgcggcacattcccttcccctctccagatgttggcatgcggggcaccttgtgggcgaccccgcctggacggcttcgcggctcccgggcgatcaccctggtgcctgccgcctggcccgggggagcccggtctctaattaggcctgaccgcgtccccattccagcgctcctgcagatgggagggagggccatgtttccccccccaggggcaccgaaatagcctcgtagtcccgcggagacagcaggcagccgtggctgacgcgggaccaaggcttggcagggagcgcgctgctgtggaaggtccttgggaggctgcgaccgcctcggagagggcgggcgggggagaacggggcggggggtggggcgggggccaggggcggcctctcgggctgggcc

SEQ ID NO: 33651 - DNA, 101 bp, Homo sapiens
  chr11:15136457-15136558
  hyper
gcagagcggccactttgcgcgcggcctctggagctccagctgcgccccgccaccactggccgctcgcactaccagcctgtctcgcacgctaagtaagtaga

SEQ ID NO: 33652 - DNA, 206 bp, Homo sapiens
  chr11:16625964-16626170
  hyper
gaagaccctagtgggcgggagtagaggggccctctctcatctctactcccccgggttgctggctgggccgtgcagccagggccaaagcccggccgcaggagtacgcggctagcaccggcgcccgggacgcggacgtcatccgagcgcccattgacagtacagcgggaggtccggagcccagcccagtttgccgcaaggacggcttc

SEQ ID NO: 33653 - DNA, 44 bp, Homo sapiens
  chr11:16628305-16628349
  hyper
tgccttaatgtcctacgcacagttatctacggctacaacatgtg

SEQ ID NO: 33654 - DNA, 30 bp, Homo sapiens
  chr11:16628881-16628911
  hyper
tcccggttacctgggcgggctccaggatgg

SEQ ID NO: 33655 - DNA, 156 bp, Homo sapiens
  chr11:16629373-16629529
  hyper
agatgagacaagaggcgagggaggcagcgagccaggcagagaagctgggagggaggagggcgggccgggggaagaaggaggggagagcgggaggcaaaggcaagagagagccgcaaagagagaggagggcagagacatcggcgagaccagaggttg

SEQ ID NO: 33656 - DNA, 157 bp, Homo sapiens
  chr11:16632513-16632670
  hyper
cgcaagaaccccgggcgctgagctccggggaacctgggagggaaggaggggcgagcgggtggggctgacttacctgcccgcagcagtcgctgcctctgtgttgtccgaatgtccctgcgcaccgcaaccagcaaaggcaattcggctttgctaactt

SEQ ID NO: 33657 - DNA, 178 bp, Homo sapiens
  chr11:16634274-16634452
  hyper
tccatttctcccccacgtcaccctcctccattcccctctaatgagacgcggatcaccctccactctcaccgacactgcagctctgcacaagggcagctggaatctgggaaccttacctgcagcaccaatacctaagagaaatcgcgcttccctgacactaacacgccatgccatcccc

SEQ ID NO: 33658 - DNA, 132 bp, Homo sapiens
  chr11:16635795-16635927
  hyper
gctcagagctgactccgtactccctgggactcatctcccgcttcctctccaccttcggaacagtagacaaagggactcagggacgcggccagacccaaggtcacaaacggaggtctccgagacgagaattgc

SEQ ID NO: 33659 - DNA, 73 bp, Homo sapiens
  chr11:17497448-17497521
  hyper
ctcagtggagaggcacgcacgattgtcccggccgtggcgcccaactttgcaagcaagggcgccggggtcgctg

SEQ ID NO: 33660 - DNA, 116 bp, Homo sapiens; identical to SEQ ID NO: 3695
  chr11:17497545-17497661
  hyper

SEQ ID NO: 33661 - DNA, 230 bp, Homo sapiens
  chr11:17497951-17498181
  hyper
gtccgctgtgtttggcgcgggatcgggggcaccgggggagtgaagggatgagctggtgtgcgagtgcggggaccggcgggcaggacacagggcaggggaccccgggaacgaggcggacggcggtcgcgggccggaaggggacgccgagcggtgcggcgcgcagcgcctcctcctccctccctgctctcccgtcccctcctccgcggctcgctgcgcgcactcaccaatga

SEQ ID NO: 33662 - DNA, 93 bp, Homo sapiens
  chr11:17565890-17565983
  hyper
gttccttcgggtgcccggctgccaggagctggaaagagccgcgaccgcgaccgggccagccgccctcggagctgggggcggggcctgagcgcg

SEQ ID NO: 33663 - DNA, 440 bp, Homo sapiens
  chr11:17717334-17717774
  hyper
cacagggtcagtgggcggggagggactggagagcgctgggcagggcgaggaggtgggagccgcgctagagcgtggggaggggacccgcagtgggcgcgcggccttagagaggggccagggccggggccggggccgggccggggctgcggtgaggggaggcgcgtggccggccgcccccagctgtggcgtcgttcaggcccggcttagcggtgccggggcgagggattaggggcagtggccgcacctggcggggcggccgcagggctaatgctgtgtgaccgccgcggccccgcccgacaactggcttcatcccgccctggaggcctgtgggctcgttagccccgccggcgtgtgcgcggggtgcggctgcgggcggcgagtgcacgtgtgccgcggggggccctgccgctggcgctgacggccaccggctgcgcccagct

SEQ ID NO: 33664 - DNA, 176 bp, Homo sapiens
  chr11:17740414-17740590
  hyper
agctgggtttctaagcgtctagggaagaaggactgggcccacgacctgctgagcaactcccaggtcggggactggcggaatatcagagcctctacgacccgtttgtctcgggctcgcccacttcaactctcggggtctctccgcctgttgttgcactcgtgcgtttctctgcccct

SEQ ID NO: 33665 - DNA, 327 bp, Homo sapiens
  chr11:17740835-17741162
  hyper
gaggtttggaaagggcgtgccggagagccaagtgcagccgcctagggctgccggtcgctccctccctccctgcccggtaggggacctagcgcgcacgccagtgtggaggggcgggctggctggccagtctgcgggcccctgcggccaccccggggacccccccaagccccgccccgcagtgttcctattggcctcggactccccctcccccagctgcccgcctgggctccggggcgtttaggctactacggataaatagcccagggcgcctggcgagaagctaggggtgaggaagccctggggcgctgccgccgctttccttaacca

SEQ ID NO: 33666 - DNA, 41 bp, Homo sapiens
  chr11:17741528-17741569
  hyper
cggcggtgcacccggccccgggcgcacgtgaggacgagcat

SEQ ID NO: 33667 - DNA, 84 bp, Homo sapiens; identical to SEQ ID NO: 949
  chr11:17741806-17741890
  hyper

SEQ ID NO: 33668 - DNA, 532 bp, Homo sapiens
  chr11:17741952-17742484
  hyper
cggcatggtaaggccgggaccccaggaagtgaggaagttagggcggcgctcgggatatcagggacgcgtttccgagggcggggagctggccttgcgggaggtttgggccaggatccttcccgagagagaggacccccttgtcctgggcagctgtcactggggtagcctgttttggaagtgtgcgggcaagcgttcgagctgccccattgggggcgctattagaacactgcagcgcgaacgtgaagatctttttctctacttatccctacttccaaaatgtaaatttgcgccccttggtgactgtccgcccttggtttggccctgcatgttgcagacctcatctcctacccacccgtaattacccccccaaccaggacaggtctgggcccggaactagagccttaggctagagttagggagggggcggctacaggaattggtgttcgggcctcgagccgtcccgcgggcctgactcagtcgcccttgctgtttgcagatggactacagcggccccccgagcggcgcccggcgg

SEQ ID NO: 33669 - DNA, 50 bp, Homo sapiens
  chr11:17743742-17743792
  hyper
ccagctgtccctcagcgacgcctgtaggcggcaggcggattgcaaggagg

SEQ ID NO: 33670 - DNA, 49 bp, Homo sapiens
  chr11:17756617-17756666
  hyper
acccccgcctggccccgtgcagctccgcgaccgccgggagctgtccctt

SEQ ID NO: 33671 - DNA, 86 bp, Homo sapiens
  chr11:17756886-17756972
  hyper
agagagggagggggccggagcccgccctgcgtcccgagctgcagcccggccacgcagggaggaaggcaggcggcatccatctcccc

SEQ ID NO: 33672 - DNA, 15 bp, Homo sapiens
  chr11:17756993-17757008
  hyper
cgaccacctcacaga

SEQ ID NO: 33673 - DNA, 77 bp, Homo sapiens
  chr11:17757704-17757781
  hyper
tgacgagttcttcttcgaccgccaccccggcgtcttcgcgcacatcctgaactactaccgcacgggcaagctgcact

SEQ ID NO: 33674 - DNA, 494 bp, Homo sapiens
  chr11:18742646-18743140
  hyper
ttcagctgaagagcccggagcccctgaccctcacccctactctacggcgagtccctccggcacctcgccacccacaatggtcccgccctccatggctacgcccaccgtcttggtcccgcgttccttttggctcactcgccttgtggacacgccccttcgcttccattgcgtcccgccccgccacgttctggctctgcccctgctctgctctgccccgggggtactttgggtcctctgctcattccggcaatatcccggttcctgactcggcctctcttatcctgccgcgcctctcgggcaatgacagctgcttttcccactgcccggctctcgggccgccgttaaggctctcatcggtgagaagactggcggcccgccctgggggtccctgcctctggccttctcggtaactggacttgggcttggcccccgcaccttcagcacgtgttccttgttaatgctgtcgtagaatatcttggcggactccttgatgg

SEQ ID NO: 33675 - DNA, 609 bp, Homo sapiens
  chr11:18812557-18813166
  hyper
gctgggggaggggagcgcgctaagcttgtattctaggggagggtgggacgcgggaggctaaagctaaagggtcggtggaggcgaagcaatgggaaggctgggagccgcgctttagaggccagaaggctagcggcgatttccaatctccctcaggggcttcaggctccggagaggcgatgcagcccagagccgcgcaccagcctccgccggccgcagaggctcagaccccaaaccactatcccgattcctccccggaaccgcgcacgggcttcgtggggagtggctgccgctccctcccggctaccaagcgacaagccccctcctctgcatgggggacccctcccccagcatgcgggcgcccagagccccacgggggcgtggcgggggcgggcgccggctcctcggccgggagggctggagaaggtgtcagttgcggggccgcccgaaggagggacccgcgccctccaccttccggctccgcacacaaaggcgcagacggaggcgccgcacttaccggccagagcgggctccgggcgccggcgagcaggcgggcaggctggcgggaggatgcgcgcgcgagtgtgcgtgtgtctgcgtgtgtccctgctt

SEQ ID NO: 33676 - DNA, 167 bp, Homo sapiens
  chr11:18813376-18813543
  hyper
ccccagccccggctccgccccgcccccgggcgggcttccgccgctcgccgggaattgcgcagggctggcggggcgggggaccgggagagcggcctgctcccggggcacgaagggggccggatcacagacccttaacccctgacctcatctcaggtgcctccctctcc

SEQ ID NO: 33677 - DNA, 442 bp, Homo sapiens
  chr11:18813609-18814051
  hyper
cggaggagtgggagcagcgcatccatttcattcatgattttttctcctcttgggagccccgggtcgggccgcgcggctacggcaactgccagagggaccccggcagggccgtgcgcgctgaacctgggacgggacagacaggcagacagaaggagtaggggccagcgagacaaagggggcagagttgggggagggagtcggctcattgggggcatgccgtggcgctccccgcatgttgccaacacctgcgcaagtggagcggccccatactagggcgcatgcaataccaggtgccgaggactcgttctaggacgctgaggaggcgtcctttttcccagttctccctgttcagcctctggggagctagagcgagtggacagcccctccctccactgagtcttgccctcctgacgtgcggcgcggggcacgcacctgttttggt

SEQ ID NO: 33678 - DNA, 30 bp, Homo sapiens
  chr11:19263461-19263491
  hyper
cgccctgcgattccccgcttggggctatct

SEQ ID NO: 33679 - DNA, 30 bp, Homo sapiens
  chr11:19263848-19263878
  hyper
gagccctagcagggtcggggagacacttcg

SEQ ID NO: 33680 - DNA, 437 bp, Homo sapiens
  chr11:19366698-19367135
  hyper
gcactggttggctggcgggagggaggaggaggcggtttcccgggtaacgggagggcaaggagcggctgcagcggcagcggccgcggctgagaagcgcgggccggagtgcagtgcgagaccggctggaggaggcggctccgcgaagccggtgtgggcgcaggtaggaaccccctatgctgcctcccccaggtcgggtctggctggactgcccggcggcgggaccggcctgggaaagtttgcggtgcaactgggtgggcaaggaggagaggacttggggatgctctgtgctgagctccggggtccagagcagggtggggactgccgttggggagagggccggcccctcattgagaggctcgggggccacacctctgctgcgggactctgaccgagggccagggcctctcaagccacccggccgcagcatagataccggg

SEQ ID NO: 33681 - DNA, 92 bp, Homo sapiens; identical to SEQ ID NO: 10731
  chr11:19367267-19367359
  hyper

SEQ ID NO: 33682 - DNA, 91 bp, Homo sapiens
  chr11:19367846-19367937
  hyper
gcctgtctgtccatacgtgtgtatgtgttggtgggggtggtgtaggtggatcggatccgagccaagccgggggcaactaggccaggcctgc

SEQ ID NO: 33683 - DNA, 39 bp, Homo sapiens; identical to SEQ ID NO: 10733
  chr11:19367938-19367977
  hyper

SEQ ID NO: 33684 - DNA, 120 bp, Homo sapiens
  chr11:19368011-19368131
  hyper
cgcccgagcactgggagccgcggtgcctcccgggtgtgcgctccgctgagccggctcctttcttgcctgcaaagggactcaggcggcggcggtggcagcccgcgtcgcccagctggggcc

SEQ ID NO: 33685 - DNA, 90 bp, Homo sapiens
  chr11:19734976-19735066
  hyper
aggtgtgagacccggcggcagcatccgtccaggtgggacccgctgagcgccgtggccagtcccccattcccatcccggcaccccaaaggc

SEQ ID NO: 33686 - DNA, 30 bp, Homo sapiens; identical to SEQ ID NO: 10734
  chr11:19735404-19735434
  hyper

SEQ ID NO: 33687 - DNA, 30 bp, Homo sapiens
  chr11:19735730-19735760
  hyper
ctgggatggcgggcacgtctgcagcatctt

SEQ ID NO: 33688 - DNA, 192 bp, Homo sapiens; identical to SEQ ID NO: 10735
  chr11:20153699-20153891
  hyper

SEQ ID NO: 33689 - DNA, 90 bp, Homo sapiens
  chr11:20154109-20154199
  hyper
accttttattggagacgaggcgaacctgggcttagggcgccacctagagccaaaaaagaggaagcgacctggccgcgaagcttcgctagg

SEQ ID NO: 33690 - DNA, 145 bp, Homo sapiens
  chr11:20177698-20177843
  hyper
tggaccccacctcttcgatttcaaagcacttaaaaatagtactctggcgtgcgagcggcttctaggacacggtgatttcctcctgttcctcgccctcctcttcctcctcggaatctgagaagtccgaaggtttcccgggactgct

SEQ ID NO: 33691 - DNA, 900 bp, Homo sapiens
  chr11:20178093-20178993
  hyper
cgtcggttctggaaccagattttcacctggaatgtcccggccggcgagaagaagggagaagcagaggtcagatcaggggctccgggggacgcacgggggcggggagtggagtcgggtgcaggctctgtccttcgggctgtgtcctctccccacccccagaaatgagttccggtggattcccgcattgactccgcccccgcctcagctcgcggttccgtttgcctcatccgctgccaccctgccccgaagggcggggttgggggccggtgaggccgggagagaaggcggggagtcggggtggggagagaagagggctatcctgcggagcttcgagggtagtggcccgtgtactcactccctctctaggcctcggttttcccatctgtacagtgggacctaagccgtttccgaacccttgcaattgacgggtgcgccggggaggggtgaagggcgggggcggggggggtgctgtggaggaaatgcgctcacctgcgagtctttcaggcccagcttggccgccagcttcttgcggtcgggcttgctgatgtacttctgcttctggaacatcttctccagcgccttccgctgcacgtcggagaagactgctcgacgcagcatgccccgccgaggcttcccgcgcgcggccagcggccaggagaaggtcccggggatgggcaccacgctggaggaagctgcagggtggggggaggtggcgagtgagtgggcgtacgccccccagtcccaacacggctctccctggctttttgctctgatcccttcatctctttaaaacgctcctttttctccccctggagaataggccacgaacctacaaacctgcgagagtgaaaggcgctttccgcccaaacaactttccctttcaaccgtgcaaacccggat

SEQ ID NO: 33692 - DNA, 173 bp, Homo sapiens
  chr11:20180320-20180493
  hyper
tggagggactagggccggtctgtgtgtggctgcccggaggagctgaccaattggtcatggtgctgaaacctttgtggggaatcgtggccaagtgcactgactctgtgggaaaacggcggcgtgaagggatgccaacagctcctcgccgggaagggaaccgcctcaaattggga

SEQ ID NO: 33693 - DNA, 115 bp, Homo sapiens
  chr11:20180711-20180826
  hyper
cgcaaagaagggggacgagacctacctgggaaataagaagatctgatgaaaggctgaaaagacccttcgaagtagggaaaggcgaaggtcttgggagggacgctctggagcaagg

SEQ ID NO: 33694 - DNA, 459 bp, Homo sapiens
  chr11:20181185-20181644
  hyper
tgtctcctagaagctcgaaggcagaaacgcagacgtccaggagcgtgcgctcagcgttactgcaccagatgactgcgcacagtctccgactgcgtgtgctcaagttcactccgaggatggggcgagcctggaggcttttcttccccggaattgactggactattctcacattgcctgacgtagggtctcagagttcgtgcgtattgtgtgtgcaccgatgtgtgtgtgggggcccgctcgctagaggaaactgaggccaggatgactccgcgcatgcctagtacctgaatgggcccttagggttctgacctcgcttacctgttctgggccccgaggagaggatggcgttcactccaaacttcagaaacgtcgtctcgctggcaggggagaaggcagtcggcggagagccgccccgtcggctgccgggacccggggagcccaggtccgaggcccccgtgt

SEQ ID NO: 33695 - DNA, 269 bp, Homo sapiens
  chr11:20181724-20181993
  hyper
cggctgatgcggatcagatcctccaccaggaagctggagtggccggaaaatgccgactgcaaggactggggcagcgtcaaggtgggcgtgggccgcaggaggctagggtacccggcggggggcgcgaggaggccggggaacatcatggtaggcgcgggcgggcgaaataacccttctttcagtggccggagggtaaacgcctcgcttcccgcccctcccgcccccacagtgtcctctctcttgggcttagcaaacgtctccaagtaaca

SEQ ID NO: 33696 - DNA, 69 bp, Homo sapiens
  chr11:20182854-20182923
  hyper
accttgcgggaggagcggaggagagcggcgctgggctgccgagcggcaggattccgcttgcaaagagct

SEQ ID NO: 33697 - DNA, 30 bp, Homo sapiens; identical to SEQ ID NO: 10743
  chr11:20183391-20183421
  hyper

SEQ ID NO: 33698 - DNA, 99 bp, Homo sapiens
  chr11:20183674-20183773
  hyper
gcccagctccagaggcgaattaatgctagaagatgacgtaagtgcggagtttctgagcccaagaccgctcatgctcatgggcagcgggagaaaaccaat

SEQ ID NO: 33699 - DNA, 32 bp, Homo sapiens; identical to SEQ ID NO: 10745
  chr11:20184112-20184144
  hyper

SEQ ID NO: 33700 - DNA, 987 bp, Homo sapiens
  chr11:20184500-20185487
  hyper
cctgcttcctggggtcggtctccacagcctcctaaagaattcctaaagcgccaaagaggaaaagtgagggcgggggcgagggggcgagggctggccgcccgtgaaaggaaaaataaatcctaaggaagcaagaaatcggacgaaaggatcttactttaagtgatctccttgaacgcgtcttttcaaactccgcgatagcccaaggagctgcgcggcgcggcggctgcggctaagacctgtgactaatgccatttgacctgagcccatggggttttgtgcgtcctgccattcactgttatgtcgttatcttcaagtttatttcggagaaatcactcgcgttctttgtctcaaggctgagctttctgtctatttctctttcaagagaaaagaagacgggaggggaaaagagagaatcggagtccctggtttggggtttaaggtccttgcctacgctgcgggggaggccgcagcagatccggctggggctccccgggcctaggtggccaaagctgccgaaacctgccttggatagtagaaagagcgtgtcggaacgcactctgggggtttcgttccccccgcgcaggggagagcgagcatgttcctgccccgggcgccgtgcggtcgcagcagcagcgcggccctctccagtgcgagccgtgcctggaatgtctcgggtaagcgaagggccagcaagcgaggcgaaacggacactataaagcagagagtggtgtgagcttccccgccctctgaaaagatggcaagtctccgtttcgggaaggctgcaacgctaaggtcaccctttgcaggcttcggacccccagtcctccatgctccctgccggagcagccaacagagtgagagcgcattttggaaagattggccggatgccgggcggcgacagggaaaagcgcccgacgcctggctttggggtggggggtgtggggagggggggcagggagctaacgggcgaggcgaaggaggagggct

SEQ ID NO: 33701 - DNA, 331 bp, Homo sapiens
  chr11:20229236-20229567
  hyper
ctaggattacaggcgtgagccccggggccctgccagaaaggaggctttttaccaacaaattttaaaaagaaacaacaaaccaaagaattttgccatggacagtggcaaagtatctgctgtgctgtttctgaccctccataaaaatcatgttcagaaatggtaaaaaggctaacgaagatcaaacaagaagagacagaatcacgggcgaagggggcgcattcagggttttctggacgtcaggaagggaccgcggtggggtgctttagaagtggccggagcccgcacctgcatgcagctcgcgcagaaagcgcctggacgctcccttaggacc

SEQ ID NO: 33702 - DNA, 112 bp, Homo sapiens
  chr11:20230398-20230510
  hyper
cctagaggccagagccggggtctgcagagacgcaggcactctctgtccccgcgagccccaccactgggttgctgcttttgagccggttgcttcgggccggcagcccttctta

SEQ ID NO: 33703 - DNA, 179 bp, Homo sapiens
  chr11:20618214-20618393
  hyper
atggatgcggatttacggcctccttggctgcggcgcgctgggcctgattatcactataaacaggcgtccgcggagggcgggggcggaggcccgcgtctagaggacgtgcggctggtcttcttcttcttcttcttctttttttttgtttttgttttttaatactgcggttccatcctctg

SEQ ID NO: 33704 - DNA, 503 bp, Homo sapiens; identical to SEQ ID NO: 953
  chr11:20618422-20618925
  hyper

SEQ ID NO: 33705 - DNA, 755 bp, Homo sapiens
  chr11:20619219-20619974
  hyper
cgtcccccaagatgccaagagcctgcggggtgcttctcagcgccagccggaacttgagcaggcacccctgcggaattctcagtcccacccactcagacgaccctcctccagccagagtccaccacagcccaccctaccctcttaaccctcgttcccgacctctccctacgagcgggccccggggagagagcgactgaccctagcgacagcccggcgggaggtggttgggatcttctccagggttcaaaagcgactttctgagccccaatttcctcagctttgcaattggtatagtttctgaaaggccattgctaaatctaaccgagataattcatggatatcccttgcacaatggttgagtattgagatctcaatagacgttagctcaaaactgcaataaaaagcgacctgaaatcctcaaggcgtctcaaaagaaagatctcctcctcctgcccccaccaaaggcaatgcagaccgtgtgtccccagccagctgccctttagaggggctaggcgggaaagccaaccagcggaggcatccaaacactctcgggctctccagaggagcaggagggtgccccttagtgcccccggcgcccgccgcaatctgccactgcagcctacgcctgcggccgcggccgccgcggcattgtcctcccgccgcgtgggacggcccagccgctggcgacggcgcgcaccccgaggcagtgggctgggctgttggcagtagggaagggaaaacgtgctgtctgtggc

SEQ ID NO: 33706 - DNA, 73 bp, Homo sapiens
  chr11:20621580-20621653
  hyper
aggagttctattctgcgtgtttgtgaaagggggttagacgagaggagtgcggtggaggcgaagataataggat

SEQ ID NO: 33707 - DNA, 157 bp, Homo sapiens
  chr11:20622578-20622735
  hyper
tctggacctgagttgcgaacgtctccatatctagatacaggtattttaaaagctgttgtgactttgttttgcacgaacttgacattgtgtttgcaggattgcagtgctcccaaggaaatgaataaactgccagccaacagcccggaggcggcggcgg

SEQ ID NO: 33708 - DNA, 139 bp, Homo sapiens
  chr11:20623258-20623397
  hyper
cgcgagagaggccagccgggccgtggcgggtgcacgtatgctgatggggaaaccggttggcagtgccaggtgatggatgcgggaggcggctttggggcttcggaagctcgcactgcgctggggtcggcagttcagggcg

SEQ ID NO: 33709 - DNA, 30 bp, Homo sapiens
  chr11:20623598-20623628
  hyper
ttcagaacaaagccacgtggtggtggctgg

SEQ ID NO: 33710 - DNA, 490 bp, Homo sapiens
  chr11:20690388-20690878
  hyper
accccaaccacagctcgctccgcctcgaggaccccttttctgcacccccacctcagcgccctcttcctgcacccacaaagagagtactcagtcataggggttcaacaggagagaggagacagaaggtacaggcggtgagcagggactcagccatcatccccctcaggtccctccccacccagttgacagagcgaatcccgagtaattgttttccgagggggtccgtgcgcgctcggtggcgccgcctcggtctgggttcccccgaggaaaaatacccacccgcgagggctcggcggcttttcgactcggcggggatgaactgtggcaacttcggcagcccccaccgcggtgcggaagtaaagagggcaacattggcgactgcggctcggaggggctggagcgcgtgaagccgtgggggcgccgtgcgcctcccgctctctcgtttcggccgcaggtcctgggactccgacttcggtgctccgggtgatag

SEQ ID NO: 33711 - DNA, 104 bp, Homo sapiens
  chr11:20690982-20691086
  hyper
cgcgctcctgcccgggctcccagacgaacgcagccgcagcggggggccgggccccgagccccacgccgccgccgccgcgccagcggtggggggcgggctggggg

SEQ ID NO: 33712 - DNA, 40 bp, Homo sapiens; identical to SEQ ID NO: 956
  chr11:20691121-20691161
  hyper

SEQ ID NO: 33713 - DNA, 218 bp, Homo sapiens; identical to SEQ ID NO: 957
  chr11:20691162-20691380
  hyper

SEQ ID NO: 33714 - DNA, 185 bp, Homo sapiens; identical to SEQ ID NO: 958
  chr11:20691431-20691616
  hyper

SEQ ID NO: 33715 - DNA, 111 bp, Homo sapiens
  chr11:20691747-20691858
  hyper
cgcagagggagcgcttccggctggcgggcgcggccggggcccgggagggcgcggtgcggcgagggcagagagctgcgggagaaccctgggatcccgcgatctcctcctgtg

SEQ ID NO: 33716 - DNA, 490 bp, Homo sapiens
  chr11:20692076-20692566
  hyper
ttctgcctccggagacgcagttgtgaggactctcagcgcatcttcttccttctgcttccaccggctcccttgcccaaaagtcccctggggttcggagactggcttgcagccgccttcttcaaagagctagtagtagatgcggggagactggggtgaggtgaggtggggtgagatgtaggaaattggcaaaaatagggcctgtcaactggggggagtgtcggaggtttgcaatcctacccagccatcctccgtacgcgctgcaccccagaatctgtgtggtcattccctttccctttattctcccccctttaccatccttatttccttctttagaggcgtggccttctctctaggccaaagagcaagttcatctggagagggctaagaaggggcgtctgcacttggttggctcaaaagttccctccgcttgcgcccaggcgcccctctttggcagttagcccgctggaagatctagcgtctaggagctttc

SEQ ID NO: 33717 - DNA, 182 bp, Homo sapiens
  chr11:20692775-20692957
  hyper
tttaaaaccaggacacgctgaaggagtgcgcgcaccccaggaagatcaggacaggcaagactagtgcagagcgtgggctactggctctgagcgcgagagtctggtgctcgtggacatcttacagaggaaccgcagacaggaagaagctaggtagggagggggcaacccgttagtgagttcac

SEQ ID NO: 33718 - DNA, 973 bp, Homo sapiens
  chr11:22214360-22215333
  hyper
gccggccaacagggccggggggcggcgggtcccgaggagggacgggaggctgcatgtccggaggaggtgcgggaggcggcagagcagggacctggggacggcttgagcggagaggagggggccagcgtggagccagccgggccggggggcggggagatggcggtctccgagggtggggcgccggccggtcttgcggtctggaggcggggaaagaggcgtggaaacagggacgcagcgaaggggaaaggaaagctgccagagggcaggagtggaaaggatcctggcgagcaccgggaggagtggcggctgcgggatcagctgccgagcaggcacagggacaggtgcctggagaagtactgggagagcgcccaggagcgctaccggctgagggtggggaagcgcagggccaagcgcgcgaagcaggttgtgggggaccgggtcgagtggaagtacccgccggagaggaaggccggctggctgtggcgcccagagacggtggagtccgaggaggaggagaaggaggcctgcagaaggaagagcaggcccttagaagtccagcagcagcaactccggcggcccacagtcagattcagcacctgcctcagatctccacgtctgtctcagctgcccctctcctgctgcctctcaggcaccagtgccattaacgagctggcgaagatgggcgacccggatctcctggaagtgttggcggaggaaggtaggaccgcgccaagaggcgtcaagggagagccaggctggctgcctgcacccctccacccgcggcgcagaggccccgggggacgttggcggccctgcggcctgagtcctagggaggttcgctgcgtggcgtgctcagcgcgaaaccgggactgcggggcagagtcccccgcctggggtgagtggggttggtttcggcgccccacagatttctctgctgctcctgcgcgccagggacctgcgacctgtgacccct

SEQ ID NO: 33719 - DNA, 15 bp, Homo sapiens
  chr11:22359403-22359418
  hyper
tcttttatttactca

SEQ ID NO: 33720 - DNA, 136 bp, Homo sapiens
  chr11:22359746-22359882
  hyper
ggaaaaggactcaaccgcatctacccaaataccgtggcactgcttgcgctctttgccaccggatcctccccttccaatgagactttctgattgtgtctaccaactctcctattaggaaacccgtgggttgcatgca

SEQ ID NO: 33721 - DNA, 599 bp, Homo sapiens
  chr11:22362533-22363132
  hyper
tcaacttgctagaaacggaaaaggcagcgcgggtgggaaaggctctctagttgggcccgcctgcagcggagcagctctctggtgctgtgttgcaggaggacaccgcggtagtcagggtaaagccctgctgggcgcgtgtaggagtgggaggcgcctactcaggtgcagaggaggcgctggtaacccctgccctcacaaaatgcagaccctgcagatcctgcaagaaagttaggcccaagcggcctgtgtatctcaatcagagcgcccaggggtggatcccgagatggggactcgctaccttaggcctaaaggtgttaaagttgaagagacgccgccgccgcggccaagggcacctgcagaatgtgagagagcctgggaggtcttgcagcttggtgtcaccccaccaccctaatccccgagggtggggggaggtcgacggccctcctcccaaccccgacgggtcctgaaaaatgggaatgggtcagcatcgggggtacctaagccgccaagtccttgactcgcccctgctctgccgcgcagggtgctggagaagaagcaagacaccggggagacaatcgagctgacggaggatgggaagc

SEQ ID NO: 33722 - DNA, 726 bp, Homo sapiens
  chr11:22364821-22365547
  hyper
cgtggggatgatccacggttccttcttttggggctacatcatcactcagattccgggaggctacatcgcgtctcggctggcagccaacaggtaatgcgccaggcgggactggggctcggggcgtggtgtttgtttcctccgaaggggcagcagaagctggagcagagacaacagcccagaggggtttgaggactcccgggcgaagtcttctagtcccttgacacaccctctcagggctggagctgctggtgactccttcctgaattagtcgcctaaacgaatgtaggctctctgggaccagcgcacgcggcctccttccctctgctgtggctgaacttgcttttggcgaaataatcgacgtgctgtatggcctgacaggagctgagggcagaccgggagcaggcagagcagggacagtgcgcctgagtgcacaaaggggtgtagaacggcagatgctgcgctctctcctgcactccccgcaggctcccaggctccccgagggtctgacctcctggcaaggcgcctcgaagacctggccccgtcccccgcccagttggtgctctgggtatgaagtatttgtttctaggggggcaggcaccagcgatgcgatttcacctgttaatgagctgcgtaggggcgggcgttgggggagccctcagctgctttcagtggcctcctgccttgctgcggtgtccacaaccaaggtcctagcgccagttcccagaa

SEQ ID NO: 33723 - DNA, 408 bp, Homo sapiens
  chr11:22688123-22688531
  hyper
tgtcaactgcatttgcgtccaccaaaaaaagtaagcattttacttccgctcggtctatgaggactgatgaaatgtaggaaatctgtttctggcagggagaaaaaatcgttttcccaaacagcactaaaaggagccatcagagaagtatgaagaggggtagtgcggctgtagctgctgccgctgccgccaggctggtggggtgcggggagcggctgctgcaggacctgtgcctggagggggccggccccgagaagctgcaggagcccagcccggagcccaagcgcctctgagagccgccagcagcccagctcgggacgcgggggtgagcacgactggctggcccagttctgcgccaacgccgccgcagcgtgcgcgcaccgcagccggggctcacgggagcccctgcct

SEQ ID NO: 33724 - DNA, 30 bp, Homo sapiens
  chr11:24518383-24518413
  hyper
catcctggggagcagcgggaataaatgatc

SEQ ID NO: 33725 - DNA, 30 bp, Homo sapiens
  chr11:26353691-26353721
  hyper
ggctacagcaggtgtcggattgcagtgcgc

SEQ ID NO: 33726 - DNA, 30 bp, Homo sapiens
  chr11:27720990-27721020
  hyper
atcccaaccactccccgaaagtcaaaactc

SEQ ID NO: 33727 - DNA, 15 bp, Homo sapiens
  chr11:27740193-27740208
  hyper
gctgcaggcttgctc

SEQ ID NO: 33728 - DNA, 53 bp, Homo sapiens
  chr11:27740933-27740986
  hyper
tccaccgcctccagccgcccaggccccctcgcccggcccgctctctggctctt

SEQ ID NO: 33729 - DNA, 97 bp, Homo sapiens
  chr11:27743048-27743145
  hyper
atcatgtgagaagttcggctttgctcagtggatcgcccaccacttggtgtgacttatgaatctaataaccctttgcaatatccgcaagcttaaactc

SEQ ID NO: 33730 - DNA, 274 bp, Homo sapiens
  chr11:27743419-27743693
  hyper
actcagcctgcacaccgctcccttgcccactacgcaggtcacacctggggctccggcgaagctgaattcggctcgggagatttccctgtcgccaggtaagaaaaccttcgccttgtcaggctagggcgggaagaccgctggggaacttgttgcttatcagcgccggcagactaccgctttaataataataccagaaaagcgcagcagggagggggtggggggcggcaacggcgacgactaacctcgctgtttacgtgaccgactcactgtgact

SEQ ID NO: 33731 - DNA, 660 bp, Homo sapiens
  chr11:27743897-27744557
  hyper
gtactgatgactaggcgagaggcaccaaggcgagccactagttgcccacaggaacctgtgtaagccgagctctcgagcggctgagttgaatgaagttatgactgcgtttgctctaatgggttatggcttcccaaatgtgagttaacagccccggtgcgcagctaggtcggaaggcgagccgcggagagcggagccgcgggccaaggcagggacgggaggggaggcggcaggttgggcgctccgctgctgctcggtgctgcttccccggagccgcttcctcatcctgcgggggctgccccgccgccggggtgccggggtgagcgcggcgggagccagggctggggtggcgaacctcggagggggctctcccaggaagccctgcggttagcgcccgcgcttccccaccagtggctgcgcaagctgggaagcgaagaggtcacgtgttggcggaaagtaacttggaggcgaaaggatgaactttgagaagaggaaaaaaagcacaatgaaacaaactacccccttggagtgtctaatagagggggaggcgggagggggggcggaggggcgccgctctccgcgggagatgtggggacgactccggaaatctcgggaaataggcaataactcgagctttggcaacgtcccccagcctagggaggc

SEQ ID NO: 33732 - DNA, 186 bp, Homo sapiens
  chr11:27744558-27744744
  hyper
ctaacgcaaggtatctttccactgaagctgccctttgcctaccctcagccatcgctagcacagcagagcagaagaaccagggatgaatgtagaccagttgttatggagatgtccgtcgctctgaggagcgctagtgccctgggaagtccccagacgcatttcaggtttcgtcgttttggcactgac

SEQ ID NO: 33733 - DNA, 46 bp, Homo sapiens
  chr11:30037706-30037752
  hyper
gcagcaattcagacccgttcaccggctgttcccaaaagaagggaac

SEQ ID NO: 33734 - DNA, 836 bp, Homo sapiens
  chr11:30038294-30039130
  hyper
ttctgttgcctggcccgaggggtgcacagagtcctcgcggctggagcctgggggtgggggttggggctgccccagagaagaccccaagactcctggttcctctggagttcagcacaggagggattgcctgggaaaggaagtcaaggttcccccgaaaagaaacaaaatcctagacagcagcgatcacttgttaagcccgaattcctcctccaacatccatccctctctcgctctcgctggctgcgggagcagcacacgcctcccctggccgcgaacgcgctctgggcgggggcggggccagggccgaaccgagggtgtggcgttcgcgacggtcgccaggggcgcctcccggcgcggcggggcgggtgcagtcacgacgccgcgactccccgcaccccggctgggccccccgactcccaggatctgggatcgattccaggagtctttggctgtggtccccacaggcgaggagcaaatcctggagaagtgtccccgttggggccggaataggggtttcgacggcagcgcgggagtccccagagggcttgggagcggggagctccaatgggaggtgcagtcccgaaaatggggtcctctgggacatctcctctacctaacttgctttctctatatctcccctcgagccccgagccccgtcttcttttccccaccccatcccctcccaaagcgggtttgttgggttgggagccgggtgcatctccggcgaggccacgggcggggagccctcctgtgcctgccagagcgcccagatccctcagtctccgtctcctttgcacacaggagttgggaggcttcagcgccggggttgggcctca

SEQ ID NO: 33735 - DNA, 106 bp, Homo sapiens
  chr11:30040131-30040237
  hyper
ataaccagaagcccacgtggcgacggggtctccctagacacctctcccagctcgcccgatggaccaagcaggcagtggcagcgctatgccccggactgctggagca

SEQ ID NO: 33736 - DNA, 41 bp, Homo sapiens
  chr11:30605841-30605882
  hyper
ggtggtgggcagttgcgcgaggcggggtggggggtgcttta

SEQ ID NO: 33737 - DNA, 84 bp, Homo sapiens
  chr11:30605942-30606026
  hyper
ccttctaggctcacggctggctcttcccggctacaacttccccttccttcctgaaacaccagcgccttactcgctcagtccccc

SEQ ID NO: 33738 - DNA, 76 bp, Homo sapiens
  chr11:30606027-30606103
  hyper
ttgccacctccgtcacctcctcggccgccgctcctgctggcactgctggcgctagcgctggcggccccgggctccg

SEQ ID NO: 33739 - DNA, 62 bp, Homo sapiens
  chr11:30606323-30606385
  hyper
gttccttccctggaacggcggagaaaggaagggagggagccagcgagcgttggaagggggtg

SEQ ID NO: 33740 - DNA, 57 bp, Homo sapiens
  chr11:30606698-30606755
  hyper
gataaccttgttatacgtaaatagcaaagaaactcctgcctctgtagagaagaaatc

SEQ ID NO: 33741 - DNA, 311 bp, Homo sapiens
  chr11:30606795-30607106
  hyper
cgcctagcctcgaccccagcttgggtcgccgggtcgctccgcaggctgcgagcgcggagacccaggcagcggcggagagtgaggttggggcgcggggacggggtgagaaagagccccgagcgagagcggcgcgcgcgggcggccccgggggcggccgcggggcgcagccggagcacaaagctgcgcggtgccttcccctcgtcactgcacctggcctcgggccgccgcgggagcccggggatcgggccaacacaatgcacccaggcctaggccggggcggctcgaacacatcaccccgggactttctagta

SEQ ID NO: 33742 - DNA, 434 bp, Homo sapiens
  chr11:30607316-30607750
  hyper
aaaagaatttgctttcgctcaggggttgaaaatcagccctccccgagcgccgaattgcccgggaggcgcccgctcgtgcggatgtcaggggcaccggggcagcccgggtccgcagcctccgagcccctcgcacgcgcctctgacaaggcacctctcacccgggctccgctttgtgtgtgcatttttttcccttcctctagtgctcggcaccgggctcccggccgcctcctccccctcccccgccctccgcctcccttcccggggcggattacctttcccgggctgcgctccggatcccggggatgccttcagcgcccggcgagcaggcgatccatagccgagcggcccgagccggctggaggagcgctgggggcgcgcgggggcggcgaggggcgcgagcgggccagaaccttcgaccccggaggtcccgccgc

SEQ ID NO: 33743 - DNA, 55 bp, Homo sapiens; identical to SEQ ID NO: 10785
  chr11:31818458-31818513
  hyper

SEQ ID NO: 33744 - DNA, 26 bp, Homo sapiens
  chr11:31818570-31818596
  hyper
cgctttattttcgggtttggtgaaga

SEQ ID NO: 33745 - DNA, 1042 bp, Homo sapiens; identical to SEQ ID NO: 961
  chr11:31819319-31820361
  hyper

SEQ ID NO: 33746 - DNA, 928 bp, Homo sapiens
  chr11:31820460-31821388
  hyper
cgccccaagctcatgggagcccacgcaccggggagagcccggagtggaggctctgggctcagccctcccaggcctaggccaccgtgccctgagtccctccccaagacttctcggactaagtgggccagactcttgtcaggggagggatcaccaggacctcagattgctgggggcggaggggtggacgctcgtgagtgcgaagttcgggtgtcacttgggtgtgtccagtgtctacaagtgggaatcctacggtttcaaaagtcaggcagggatggggttgcctacactcggtggggtcaatcgctagtctcaccagaggcgggagcgggcctgggggccctctgagctcgcggaggcggcgggttcggggcccgtgcgggcggggtcgcccaggggagcccgggccccgcgcgtcaggaggcctccgccggccgagcggccgcgctgggaaacaagaagcgagcgctttgctccctatcttcccagtgtccgtcctatattgttttctgctcttaaaactgacatgtctaattggcaattggtgccgaatcgtgtccagaggtctcttgtggaacatttctacagctgtctccttcaactagacgcttattcatgtcgccttaatgagaaacaaaacgttctctaatgagcaattacagagcgacaggattgttcccataacaaattcttgcgagtgacagaagcatcctttgtaccagatatttcgcatactgttaccgattttcccttccctcgcccgactccatggaggcgccgggcatccggagccggtccgagagctcacggatgcgccggcagcctcctcgcagtcccgcgcgccgcccctggccccgagcccctcggctccgttgtgctcctgggagtgagacgccacgtcccattatcccgcatattatctccttgtcac

SEQ ID NO: 33747 - DNA, 389 bp, Homo sapiens
  chr11:31821389-31821778
  hyper
aggacaacaaataccgattaatcttcggagtaaactgtttcctattcttgaccaagctacctcggggtgtggaggggagcggaggggagccaactgaccctcccctccgccccaccccccccatcccccgctcttcttcctccagcccttctcacagaacctggggtgtttcaggtcccatctctcctcccagaccagagcggctcccggcatcccgccgtcctgctcacagtatcttcacctcaccacttccacatagtcgccacccacagagagtgagaaagtgggacccagaggggcgaacgggggaggggcaaggatagtggggtggttttagttgggagaccaccacttccaatgccccatccccgactcgccctgcatctccc

SEQ ID NO: 33748 - DNA, 107 bp, Homo sapiens
  chr11:31822002-31822109
  hyper
cagccaccttcataccgctcctgacatacacaaccctcacattcccaggccaacaaaatggttcaacaaacaccacctacatacaatgtggtcgatgtgtcccaggc

SEQ ID NO: 33749 - DNA, 345 bp, Homo sapiens
  chr11:31822363-31822708
  hyper
tcgctagccaggttgcgaagaactctgtttattgatgacacctgcaaatcaaaccaaaatcaaaccaaatggtagtgtctcctgaagacacagtcacccatctcagctcacccacaaccttaaaaagcaactctcaacccgttaaaaagctcccagccaccccgggacagtgggtggatttgcagatacaccgtggaaaaaatgatagctatcactttgggcatggaaatttagttggatagagaattgggcggagggggtccttcaccattgcttggtgtctctggtgacctaactcacacggttgctttgctttgttaaaagactgcccgaaaataaaaacta

SEQ ID NO: 33750 - DNA, 40 bp, Homo sapiens
  chr11:31823165-31823205
  hyper
ccaagcaaagatggacgggcactcccgcttatactgggct

SEQ ID NO: 33751 - DNA, 810 bp, Homo sapiens
  chr11:31824154-31824964
  hyper
gtccataattagcatcgtttacagtaagaaatgaagagagggcgttgagagtggagggccgcgggggcggcgagtggggcggcgccgggaggatcacctgcagaattcgggaaatgtcgcacggccgggccccgctgtgagctagctctacaatcttctgccgggtggagtccggcagtggccgcccgttgacaaagacaccaccgagctgattcactccgctgtgacctgaggaaagggagaggagaggaaaggggaaaagaagagaagagagcagagtgaagaggaagaagagggagaagaaggaagaggaagatgagggagaacaagaacagaaaggagaggaggaaggggaagaggaagaaggagaggaggaggagacaaccacaatgcatcctcatccccctgccaacctgtgccaacctcggcggtcagttccctgctatcgatcaaataaaggacaacaggaccaccagccatgccagacatcgggcagcccagtccaagcaaccgtgcccctgcccactgtactgcagcagcaacacagagtcagacacatgccaaggaacaagtacacatggacctcactacagccataaccccagcagtgtccccagcccactgcccctcttcataaacactgcagccagcctctgaacccacaaagcgctaagaaccggctctataaatctcccaaagatcccctctgagtgtcaccgcaaaccatgggttctacagatcccacactgaaccttcaaggtctctgcagtgttgggacagtgatagcaaaccttacagcccttgagtgct

SEQ ID NO: 33752 - DNA, 29 bp, Homo sapiens
  chr11:31826042-31826071
  hyper
acaggcgtttgggggatctgggctccggc

SEQ ID NO: 33753 - DNA, 198 bp, Homo sapiens; identical to SEQ ID NO: 964
  chr11:31826106-31826304
  hyper

SEQ ID NO: 33754 - DNA, 325 bp, Homo sapiens; identical to SEQ ID NO: 965
  chr11:31826408-31826733
  hyper

SEQ ID NO: 33755 - DNA, 407 bp, Homo sapiens
  chr11:31827113-31827520
  hyper
gggcctggtttcgctgggcctccaggctcccaggtcggagctctagactagccctgccgcgtaccagcacccaccacgaacaggaaggtgggtgggaccccacggggtctgggcagaggaaagcagggaggtacaagggccataagtatcaaaagcgctctgggcctgggactatcaggacccaagcaattgcagttgccagggcagggattttccaattcctgggcacctccttaccagacccagtaaaccgtgctctctcccgcgccctgtaacagcgagtttaccacccctaccctgctgcaggcctgggggctcctctccccatcccttctaggcccgtagtggggtgaggaggggaggagctgccctgagagtgacttggggagagaagcccccaaccccgc

SEQ ID NO: 33756 - DNA, 457 bp, Homo sapiens; identical to SEQ ID NO: 967
  chr11:31827597-31828054
  hyper

SEQ ID NO: 33757 - DNA, 329 bp, Homo sapiens; identical to SEQ ID NO: 10798
  chr11:31829116-31829445
  hyper

SEQ ID NO: 33758 - DNA, 80 bp, Homo sapiens
  chr11:31830319-31830399
  hyper
aattacttaagtaaacgtgaacactaagtgcagaagcaacccgggaagtggggcacatcgacacccggaagcagtcctgt

SEQ ID NO: 33759 - DNA, 278 bp, Homo sapiens
  chr11:31831502-31831780
  hyper
aagggagatgagagtcgggggaagcctggggagcagagagttttcaagttccgagctcagcgctccagtggagttgggggcaagagcccgggggctgggtggaagctgacagtcctcccgctcggctctgagctccctcggagcgcgcgttccaccgccttggcctggtggcttccttcccggctcgcgctagctcgctcttccctctacctccagcgtgcggctgccttgccgactgactccactcgggctggtggcgggcgcggtgcccccctcgg

SEQ ID NO: 33760 - DNA, 138 bp, Homo sapiens
  chr11:31832001-31832139
  hyper
ctcttcgtcttttcccgcgggtcgggagcattgggcgacgctggggctaggagccgcggctgctgtcgcgcctggagtctcccttcttcccgcgagctcagcccgcgctggcgctggcgctggcgctggggctgagct

SEQ ID NO: 33761 - DNA, 50 bp, Homo sapiens; identical to SEQ ID NO: 10801
  chr11:31832795-31832845
  hyper

SEQ ID NO: 33762 - DNA, 49 bp, Homo sapiens; identical to SEQ ID NO: 10802
  chr11:31833553-31833602
  hyper

SEQ ID NO: 33763 - DNA, 149 bp, Homo sapiens; identical to SEQ ID NO: 10803
  chr11:31834086-31834235
  hyper

SEQ ID NO: 33764 - DNA, 293 bp, Homo sapiens
  chr11:31834502-31834795
  hyper
tgggcctcaccctctcgttcctgcctgggacccagcagccctgcgaccaaggagcccgggcagggctcccgggaagcaaaggcctccccggccctagccagaggtggggtcgcataaccctctcccctccccgggctggggagggctgccggctctaacccttccccgggagctcgcagcgccgggaggaaacctgggtcagaggtgaaggaggtggcgccgggtgtccaggtccgcggcctcctgggcgaggtttcatttcgcaggagcgcgactttcggaggatgccggca

SEQ ID NO: 33765 - DNA, 162 bp, Homo sapiens
  chr11:31835180-31835342
  hyper
agtgaatgccactgacgtcattgggtggggaagggggctccgggaaagactcctggaaactcctccgcacaaacaaaaaacaaaaaggacttggctgcttcccatgtgtcaatatttggggaggggagttcaaccccagaatgaggccgagttttcaaagtt

SEQ ID NO: 33766 - DNA, 942 bp, Homo sapiens
  chr11:31835591-31836533
  hyper
tgctgccctccaagacgcgggggggcggcggggattgcgctttaggttctgtctcctttccccgcctccccacaggcccctgttcccccctaccctccgccccctgtggccagagggaggacctctcaggccggcgggtgcgttcccgcgggggccgccggggtcgtcccacccggtagcggggctgtctgcgtggagggagtcccgctgggggaccgtggctcgccagagcctgcccagagcttctagccagtattgatgcgtcaacatgaggtgaggcaagcatctcacccgcaccgatccctggcattcccctgtgcccaccccatcaggccttcggggaggcaaagaagtgcccacttctggggggaagtgcctccagctcccagcttcagaaccaagagcctcccatccggagttctgacagttctgacacctccaaactctctctttccccggtcaagcagaggcgcagcgccggcgcgctggaaagggtgaagactggcattttttggagaaggaaagtcttggcagacacctgcgtcactttgtagtgccccaaacgtctctctttttgcagaccctgggaaggtgggatcccttgtccgcggagctggcaaacgggtccagtgagccctaaaggcaaaggctcccatcccggccgcccagtccctggtgcctcccccacttccaggcctttgtccctctcctttctccagcaacctgccggttcccgctaacccggcagcctcgccgagcccagagcctagaaaagccaagaagatcccagagccgccccgtggcaccttcaggctgtggccactgctcggcttggggggaagccgcggtgccctcgcccttcctcgcctcctgccaaatggccagtgctaggggctccctgggttcagtcctcagtcctcttccgttcgctctgggaggcca

SEQ ID NO: 33767 - DNA, 30 bp, Homo sapiens
  chr11:31836824-31836854
  hyper
ttcatcaccctgtgacgatccccccatctc

SEQ ID NO: 33768 - DNA, 159 bp, Homo sapiens; identical to SEQ ID NO: 969
  chr11:31837354-31837513
  hyper

SEQ ID NO: 33769 - DNA, 823 bp, Homo sapiens
  chr11:31837541-31838364
  hyper
cgagaggaaagggaatgaaaaatgaagcaacaaatgacaccacccaggctggcagccctcgttcccggccagaccccgctcctcaggcccggctctggcgccgggtggcgtccagcccctgcacgcgcggcgcggcccgcgggaaagtttgtgcagcgagagtgactgtccttccgcctcgcgcgcgctgcccccttctgccccggaggggcgttgggttcccttcggttttcctttccaattctaaaataaataaataaactccgggccctggggaaatctgaatagtaattccagtcatccaaattctatgagagggtctgaggaaaaaaagacaagcctatcacgggcgccctccgatcacgaagggcacgggcatgagaaggcgacagaggaggtcctcggctcgccctgggcgcggagcgaggactctggtcagaggtaattatgtcaccgcgttttctcgccgtgacagccgaataaacacgatctccaataaacatctctaatgagggaggaggcccgaggatggctgggtttgatttatgactggaggagaaggtccacttcccactgcgaagcaggcgacctgctcgccgcccagctccagggagaggaacccgcggaggagaggatcccggcccaggtaaggcgtgcggccggactgccactgcgctcgtcccccgtttccaggtgaggtgagcagggggcgccaccgctcggagtcgggcggaggtcccaacacctgtcacaggtgactgagctccgaaggtgctcccagaagacctagaaagggggcgcaggagcgcgagtgggagtgggg

SEQ ID NO: 33770 - DNA, 1362 bp, Homo sapiens
  chr11:31838584-31839946
  hyper
ccgcagggtggtgggcgcttctctttcccgggcttggcggcccggctcccatggcgcccgcgcgcttcccgccgaggcagccagcgcagcgcccgcagtaaccggagcccgcgttctagctcagtgagaatcgctaattattaggtcttccgaagtgaagctcaaatcacacgctgggagctttacgcgctgcccagctctgtcggccgcattctttcgtactccgcgtctttctgagaaacgaaccccatctctagactttgttgcggtccagccatctgcactttgcaaccgcgggaaacttctgctgcacctcgcccgacccgcggcagggtgtctttaagcgctccaggcgcgggtacggactttcccaagcgtggatgtcgtgaactgcgatgcagaggaggtctggatgcaaagtgcgtccccacctcctgcatttttcgcggtcgcgagtggctttagcagacagcagcagcagactcccgccccctactcccagctcagggccggactggaagtccactcttaggagtggaacattttgctacttttgcagaagagcacactcggcaaagacaagtccctcctccaccccccttcctatccctccctcagtaactcgcttccatctttgtatgcctccttttaaaagcaaaaatcaagccccggggccacttggggcgggctttgatttggggacagcagtcgctggcagcggagaggccccgcgggccccgagccgggccggggccggagcccgggcggttacctgggagcggagggcggggaggcaggtgagcctggcagcgccggttcccacacttctcaccgccgctcggcaggggaagtggcagatctgacagccgcgttctacgcgaggacctgccccagagtttaaatgtcaatgataagaaaagagggtgctcaggcaggcgctaactttccttaatatccacgccagcgccgtcctcattggctgcccggcccgcgtgacgtcatggcggctagagttgggcacagctctgcgccgactagttttccggccgggcgggagcctgcttctccccacccagggtccggccggctccaacccctgctttggccttccttggcccggcctgtgactgctctagcccggcccggtccagcctgggccgccgtcctgtatggcgtagagtcgatccccaggaaactagtcttgccgagtgcgctcctccgcaccttcgggcactagggccccaagatctctgcccttaggctggccagctacctctctgggtaatcaccctgtcccctcctccgatccccaagggagtcccttcatcggagagacccgaaggccgcgccgggatggagagg

SEQ ID NO: 33771 - DNA, 132 bp, Homo sapiens; identical to SEQ ID NO: 3732
  chr11:31840041-31840173
  hyper

SEQ ID NO: 33772 - DNA, 315 bp, Homo sapiens; identical to SEQ ID NO: 971
  chr11:31841774-31842089
  hyper

SEQ ID NO: 33773 - DNA, 102 bp, Homo sapiens
  chr11:31842174-31842276
  hyper
cgcccagtctgcgtaggctcccaggccagccccggccccagagcttccccatcagccagcagaggctgggtggagagcctggatgggcgtgagaggccttga

SEQ ID NO: 33774 - DNA, 195 bp, Homo sapiens
  chr11:31845092-31845287
  hyper
ggaagcgagcgtccccgggtctgaggctgctgggtggaaagctggcctaggagggcgagtagggagcaaaatagggcctggtccttgcggggccggggagctagaggccgcaggaagctgggagggccctttccaggcaggcagggcagcctcctggcgcggcccaaggcgcgaggcagccgctggctagggagg

SEQ ID NO: 33775 - DNA, 58 bp, Homo sapiens
  chr11:31845842-31845900
  hyper
tgcaggtgctaggcacgggaaatggcgtcaggccccagcagaacgcttcacaaagagg

SEQ ID NO: 33776 - DNA, 1140 bp, Homo sapiens
  chr11:31846162-31847302
  hyper
tcacaaatataatatcggcagctcccggattgcctgcggggttgttcaggccccgggcctgcacagctatgagaagtggggtgcagggtgctatttgcccagcaaaagctcatttcctcccaaatgagtataatgaaaacccgagaggcgatattagtgtaaagatcgggattagtccaaataggagccgcggacttgggcttcaaaggcgacccctactctttttgcccagtctgggggcggagggcgctcgaagggatacttcaaggacaccacatccaacttgtcgcagccccacgttcaggcacaggagggagcgaacattgggcagagggtaatttcaacaaaggacggcaggctccggggatcccggcttttccctgagttctctgggttggaaggagagggtccgggctctgtcggaggagtgggtacagcccagcacatgcttttctgacgcgcagcgctggcctggggagtgggtgcagctgctgcagccagcccccaccccgccccaggctgggaaggacgcagagtataatacgacggcccccttccccaaggggacactagatccagagctccaggcatatttgttgttcaaagttaattatacctgaaagcaaccaaaatgcgcacgccaggcccacggaggccgattgccgaccagcgtagccggcccgcagcgccagagaagccgctcactccggcggagtctctgcaagagaatctgaggctggggaataaaagccgaaactaaatcaggcagcaagagtaacaaaccatctggaaaatggacccacggagccgcaagaatgtactttttttttttatccttgacaacttgtgtcctaaagaaagtgtattgaagataattgaaatgattacaattcattgctgcctgactttgaatatgaacagtcacataatgacatccccgccacacaacaacagtttaatttccattatccgacttcgggatcctagcgccagccgccggggcaacgtggcgctaatgcagaaatcttggctcctgcctgcattattcatttcggggacgtggggatgggataggagtggagagtgggtttcttcccctcccccgaacttattctgaaaatcccggggaccaatggacac

SEQ ID NO: 33777 - DNA, 343 bp, Homo sapiens
  chr11:31847370-31847713
  hyper
cgctccccggctgtctttttgtcccaggggttcccaggcccgcagggctaggatcccccagctcccaccctagtcagtcccagtcagggaggacctaggccagggcctcctcccaaggctgtcatctggcggggcaaacgctcttctctcattccttcgtctcccttccagccctcgcatcctttccttctttctgcttcagagctctcaggctcgcgtgcagggcgggatgggcccggatcgggggccccttcgcagatttgaaagttgcctcggccttgatcttctcccagcctccctgctggggactcacccccacatcccgctaccccccggggaaaag

SEQ ID NO: 33778 - DNA, 104 bp, Homo sapiens; identical to SEQ ID NO: 3735
  chr11:31847769-31847873
  hyper

SEQ ID NO: 33779 - DNA, 76 bp, Homo sapiens; identical to SEQ ID NO: 3736
  chr11:31847895-31847971
  hyper

SEQ ID NO: 33780 - DNA, 280 bp, Homo sapiens
  chr11:31848323-31848603
  hyper
tggcataactcgaaccggagaagcgaggggagcctgagtgactggggcgcacatgacccccctcctggggcctttgggctcaacccttacttttaacttgttctaacaggaataatggagtagtactactaatgcatggtcagaaggggcttttctgtctagaacgcaggcggcgggagttgcaccgccacagcccgggagaccaaagagtctccactccccgctcccggcgcctcctcgccgaccggagccccgagcccagtgagcccagccggtccca

SEQ ID NO: 33781 - DNA, 353 bp, Homo sapiens; identical to SEQ ID NO: 3738
  chr11:31848722-31849075
  hyper

SEQ ID NO: 33782 - DNA, 23 bp, Homo sapiens
  chr11:32009104-32009127
  hyper
ggacagcgccagccccggggtgg

SEQ ID NO: 33783 - DNA, 1 bp, Homo sapiens
  chr11:32009269-32009270
  hyper
c

SEQ ID NO: 33784 - DNA, 42 bp, Homo sapiens
  chr11:32354918-32354960
  hyper
ggacagaaaagctttcgtttgacccaaagctcccccttccgg

SEQ ID NO: 33785 - DNA, 315 bp, Homo sapiens
  chr11:32354999-32355314
  hyper
cgagcaggcggcttctcctgaccggggagacgcgggaggtttgcaaacagaccttggcctgggctgcgcagggacaaagtgttcaagggcagcaggggaggctgagggagtacacggctgggaacaagggacactgccgcccccagccacgcaggagcggtgtctgcaccactgaaagtcccccggggcccacagctctatccaggcggaagggaagcagccaggccgccgcggatctgaacttgaatcccgggtggaccggacgccccggccggcgctcctgacgcgcggaggagctggcgagaacctgcagat

SEQ ID NO: 33786 - DNA, 263 bp, Homo sapiens
  chr11:32448524-32448787
  hyper
acctccttcccttgacgtcagccccgggtccccgcgcggaggggagggaggatggggatgggtttgggggcagccggtgtcaggatccccgagcaccagggaggagggggctatgaggtcatgcgcgcccaatcccgggccgcacaggcctcgcgctgctgctccccggcccccgccccaacttccagccccgtgcgggctggtgtgcgccgcagttactaggcaaccctatcgcagacgcgggcggccggccaagttcaccc

SEQ ID NO: 33787 - DNA, 964 bp, Homo sapiens
  chr11:32455482-32456446
  hyper
tccttccactgcctgcggtagaacctggtcccgcatagcttggactcggataagtcaagttctcttccatccccagaacctgcgtggccgccgcctgagcgaagcccagtgaagatccacttctgtattaccatacgcgggagctatccacggacacgacgctgttccagaaagccatttagttactggaggtgcatgtgctcattctagttctctacgatacttaatgtgcacctaagtgtgtgccaacaccgtattataagggctggaggtgctcctggacattttagcgctgcggaggcagcacagcacaggcgctcacccccgcgctggtcccactccgaatccagagtccagacgtctgaaaagcgctacgcttggtgacaatttggcgtttccttaattaacaaaactctccccaaggcagagccagacactgcgccggtctcctggttccactcccgtggggactagcagtcccggaatctctcggactctaaggggccccagacgccctcccggctcttgcgaacagtcaggctcctagctctgcctggctttggaggatgtcgggggccagtgcctgcgtgcactcccactctccggcctcctccccagccgccgcttccgctatcctcacggcccttgggaagcagctgggtaagagctgcggtcaaaaggggtaggagaggggggtgtcctagagcggagagtccctggcgccactgccccgcgcgtagggggcgctccccggcctacttaccctgattgcgaatagcgggctggctctcgaggcagctgggcaggtagggcgcgttaggaaacatcctggcctggccggatgacgcctggctgggcggaggaggaccgaagggcccgtagcgacaggctccggctgtgccagtgaactggccggaaaagtggacagtgaaggcgctcaggcactgctcctcgtgcggctccg

SEQ ID NO: 33788 - DNA, 154 bp, Homo sapiens; identical to SEQ ID NO: 3740
  chr11:32456758-32456912
  hyper

SEQ ID NO: 33789 - DNA, 286 bp, Homo sapiens
  chr11:32456913-32457199
  hyper
gcgaggagacggcggggcccgggcgcctgggctgccgtcccggctctgggtgggtgggtgggtgaatgagtaggtgggagggagggcgggaagtgggggagcggacaggcggtcgggttgcggagagcccccgggtgtgggcgctgccttgaactccttaccccagctgcctggctgccctcagcttcccaaagctcaaataagaggggccggcggcgcggggaagaggaggagccaggaggctcggccgctccattcactcagcagcccaagcccggccaggcag

SEQ ID NO: 33790 - DNA, 218 bp, Homo sapiens
  chr11:32457219-32457437
  hyper
cgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcaggtaagcagtgagtccgggcagggtcgaatgcggtgggagtagaga

SEQ ID NO: 33791 - DNA, 1099 bp, Homo sapiens
  chr11:32457684-32458783
  hyper
cctcagttgggtggccgggagttgcaccagttataagccgggcgtatttcgatcggctagtagttgtttacttggtgaggtttgcgccaggcggaaggcggttgccgcctacctaaaattggagtcagcagcacttagtttccctttccagtgaggaatatctaattcttctacggttaagccgggaaaacagcggctagtttaggagggaagaaaacccttgggcaaacgcccaaagcctgcgtatattccggccggagcatcctggcgcccagtttggggaggaggggtgaaggggagggtttggatacgaagcccggcagggagcgggtaactcctggagccactccgccgagcactgcctgtggccctggtcgaggataccattctggttgctcagtgattgaccaggaggcggaagccagttaaggggaccaaggagtggagtagggagaacctccatcggcccacgggcgcgagttagtgttcgaatctttgggagctcgaagagcttcgctaaatctgactcccttcgtctagtctctgtttggcagcccccgcgccccagagcaggtgtttggggcgggtagggggtgttttggtttggtttttggatcttctaaaggagtcagtatctattgggaaacaacccctaggcaaggagaagaaccgggggccggagcggagcgtgtttcagaggtgcgtataaaatcccaggggcgccaggaggcagcagcgacggcgcagcgtgggacggccaggcgcgacgggagggaagcaaccggttgcagtccggcctcctgtacctggctggcccgggctggggctgcaagctttccagccaaacttatgtgaagcaaagtagttgcagtttgacaaagaatggcgtttcaataaatgacatagtaattttttacgctttggtttttagcttgcattgcataaacgttgtcgccattaaattctggctgcggacccgaagtgtgtgcgggcccaggacttactcgaagggcgcacttcttgggaatgcgcatcccgtaggcgcaggagaccctgagggtaaagatgcggcacttgagccctccgcttgcctcccagg

SEQ ID NO: 33792 - DNA, 126 bp, Homo sapiens
  chr11:32459684-32459810
  hyper
ctttgttgtgggtaacgttctctgcgggagacctgaggttttccaagggggacatgccagctacactggccttggcgccctgagctaagcaccaggactcacagcctagcacgaaggcaggtagca

SEQ ID NO: 33793 - DNA, 30 bp, Homo sapiens
  chr11:32460192-32460222
  hyper
tccttactggtcaaacgggataatgggata

SEQ ID NO: 33794 - DNA, 47 bp, Homo sapiens
  chr11:32460468-32460515
  hyper
gatacactggcaaagcgcaggcatcccggcctcgaaggtgcataatt

SEQ ID NO: 33795 - DNA, 93 bp, Homo sapiens
  chr11:32460796-32460889
  hyper
ctcgctgctgcctgtcgcgggagaggaacaagctttcgactagcgcctctccccggggcccgcgccccgagccccacgcgcaagacagcccaa

SEQ ID NO: 33796 - DNA, 173 bp, Homo sapiens
  chr11:33037467-33037640
  hyper
tgctggaggagttggcgtccggggagcaagggccatggccaccgtgcaggagaaggctgctgcgctgaacctctcggctctccacagccccgcgcacaggcctccgggtaggtgccgaggactgccgcctgggatggcgcggggcgggctggggtgcgcgggctgggtcccgg

SEQ ID NO: 33797 - DNA, 30 bp, Homo sapiens
  chr11:33850927-33850957
  hyper
ccgcggacacctgggcggaaccccaagccg

SEQ ID NO: 33798 - DNA, 379 bp, Homo sapiens
  chr11:33890236-33890615
  hyper
tggtgcattaactttcgaggttcacatgtccccatcggtggaccccgaggaggggtacacctactcagatttactccggatttcgctgctctagaaatccctggaggcccagagccagctccgaggtggacggtcggacccctcacccgcccgttatccgcaaggctggcagcggctccacctgcggaccgggaaggcggccgttggggaccccggaggccgccacttggaatgttcccctttccaagaccaaatggacaaagagaaaggaccgagaaggagagggaagaagggagcagagtcaagcccagaacgctctccggactgcacctgcgcgcctccaggctctcctcgtgcctgctcccgtgcaaactttctg

SEQ ID NO: 33799 - DNA, 30 bp, Homo sapiens
  chr11:33892097-33892127
  hyper
tgcacgggctggggacgcctagagcagagc

SEQ ID NO: 33800 - DNA, 208 bp, Homo sapiens
  chr11:35440486-35440694
  hyper
atcccctcacccttccgtagatgccatggtctggggaacgccccctcctcttcagcactatccggcagctgtgggcgagggagaaagcggacgccggggtgagcgcgaagtgcggccgggagcggtatttaagaggagcctctgcccgcccttccacccgcctccggggtaagccctttagcgcctcaacgggcgcaggaggctcctg

SEQ ID NO: 33801 - DNA, 93 bp, Homo sapiens
  chr11:35440936-35441029
  hyper
cggtgagcgtgcgtgcgcgtgtgcgggtgtgtgcgcgcctggggaggcggtggaggccgctgcgctctggctcggcgccggccagggagggat

SEQ ID NO: 33802 - DNA, 342 bp, Homo sapiens
  chr11:35441295-35441637
  hyper
gtttcccctgaagcccgcgtggccccaggtcaccccgtgcggggtgaagcgcaggcgaccgcgcggagacccgggatgcccctccgtctccgcctccctggagcagcccctggcgctccctcctcactccccggagcacccgcttcagctcacactcacccccaaactcacaggcaggcacacccaccccatcctcccacgtctgggggtcccaggtccagcggagtcgagcggctgaaacacgcgggtggtgcagcctaaacgcggcccagctgcgctccctcccccgccgaagctcgaataaatctctggccttcaattattcagcgagattaatattaa

SEQ ID NO: 33803 - DNA, 43 bp, Homo sapiens
  chr11:35547532-35547575
  hyper
cgggagatcttcctacgggaggctgagacgggagctggctttg

SEQ ID NO: 33804 - DNA, 42 bp, Homo sapiens
  chr11:35639614-35639656
  hyper
agtttgcaggagacccgcgctgcctaggcaaagggacccggc

SEQ ID NO: 33805 - DNA, 79 bp, Homo sapiens
  chr11:35639657-35639736
  hyper
accaagacacccccgcgagggcccagggcgcgtccctcccgccaggccccagactccggctctgcgccaccccctccta

SEQ ID NO: 33806 - DNA, 915 bp, Homo sapiens
  chr11:35640687-35641602
  hyper
ggcccgttttgccgacggcacccgcgcctgcgtgcgctacggcatcaacccggagcagattcagggcgaggccctgtcttactatctggcgcgcctgctgggcctccagcgccacgtgccgccgctggcactggctcgggtggaggctcggggcgcgcagtgggcgcaggtgcaggaggagctgcgcgctgcgcactggaccgagggcagcgtggtgagcctgacacgctggctgcccaacctcacggacgtggtggtgcccgcgccctggcgctcggaggacggccgtctgcgccccctccgggatgccgggggtgagctggccaacctcagccaggcggagctggtggacctagtacaatggaccgacttaatccttttcgactacctgacggccaacttcgaccggctcgtaagcaacctcttcagcctgcagtgggacccgcgcgtcatgcagcgtgccaccagcaacctgcaccgcggtccgggcggggcgctggtctttctggacaatgaggcgggcttggtgcacggctaccgggtagcaggcatgtgggacaagtataacgagccgctgttgcagtcagtgtgcgtgttccgcgagcggaccgcgcggcgcgtcctggagctgcaccgcggacaggacgccgcggcccggctgctgcgcctctaccggcgccacgagcctcgcttccccgagctggccgcccttgcagacccccacgctcagctgctacagcgccgcctcgacttcctcgccaagcacattttgcactgtaaggccaagtacggccgccggtctgggacttagtgtcaccgggaggaaaagagagagatctggggctggggtatggatgatggggggaagggcggtcgcctctgccactgtcagggaccagccggccaacgcccacc

SEQ ID NO: 33807 - DNA, 263 bp, Homo sapiens
  chr11:36398106-36398369
  hyper
gagaaccatccaggtcgctcatttctctccggtgagaaaacttcctcgggaagaccggaaactttttcctaggcgcgcggagtctggggcggaggcgagcggcgggtgtgcgcgactcggggtgattcacgccggggaccccaaggaggtgagtggtgggtggggggcgtctctgggaggggccggagtcataggctcagcaaccgcgcaggattgagcgaaaattaccgcgcgctaatctgacggggcgcggcgtggcgggg

SEQ ID NO: 33808 - DNA, 32 bp, Homo sapiens
  chr11:36398880-36398912
  hyper
cccggctgcggaccccgcgctgggagtccgca

SEQ ID NO: 33809 - DNA, 162 bp, Homo sapiens
  chr11:36399187-36399349
  hyper
cccagtccctgtcctcggtcacatgctgccgccgcctcttcccccgcggtgccgggagcccgcgttttgtttgtcagcagttaggcggtgagtatttatagacgccacggcagtcctgcggtgcgcaaggtttcaattactgcgatgcgccccacaagacga

SEQ ID NO: 33810 - DNA, 207 bp, Homo sapiens
  chr11:40314716-40314923
  hyper
aatttcataatctcacgttaaatggagtgcggggggcgggggcgggggcgggggcggaggtagtggaggaaaatttcaaggctccgtcagctgtcaagaagaaacccattcctccccccgctactttttttttttctttttaaggctcggggtgcctttccttcctctgtccccgcccccacccccagcacccggtccagatcctcc

SEQ ID NO: 33811 - DNA, 135 bp, Homo sapiens
  chr11:40315465-40315600
  hyper
cggtttgaactctcttcctccccctccctctgctctctcccctctttttctcccaaataaatgctctcccagcaccggcggcagctcttgccagcccaggctttctctcgaccaatgccacgtcctgacgcttag

SEQ ID NO: 33812 - DNA, 115 bp, Homo sapiens
  chr11:43568960-43569075
  hyper
gagcgacctggctctcggaagccgggcagggtgggggagggggcaggtaagtgggttgcctggcaacccggcagacccgcgggtggacaagctcaaggggcagccaggtgccacc

SEQ ID NO: 33813 - DNA, 187 bp, Homo sapiens
  chr11:43569128-43569315
  hyper
cgagcgcagccggagcagtcgagcgggcaggacaccgtcagtgccgggagaacacgcgcgcgtgggtggatggcgggagggtcctcacagccagccgcaccacccccctcccccccacatcccgcaacctggcttctcctcgctctaaatctaggggaacaaaaacccggcgcgtctgggacagcct

SEQ ID NO: 33814 - DNA, 32 bp, Homo sapiens
  chr11:43569580-43569612
  hyper
cgggcggggcggggccgcgctgctacgtaagc

SEQ ID NO: 33815 - DNA, 107 bp, Homo sapiens
  chr11:43596489-43596596
  hyper
ggtgagtttcctcttcgggtggagagcagaggggaaagccgcagtagcaagccggacactcccctctgggcgctccccaccgccagaactgacgccttcgagggcgg

SEQ ID NO: 33816 - DNA, 360 bp, Homo sapiens
  chr11:43596850-43597210
  hyper
gcaggagggagagagcgggagccttagaatctgttatttgcgtcactcgaggagccggggctatctgcccgacaaacacacagaattaatccgagttacagccatagctgtctatgctacagtgaccagatgagaaagggcggggaaaggacgcgcgcgggagcgtgtgcacggccgagtttgcattgggcgtcttgggagagtttggggagggggctgtcctgctgggcacgcccctcggggccccgcttgcccggtgcagactaggctgcagcctgctctgcagctgcccagcccaagcctggggtggcgcccgcctcggccgcctcgcctgctcagtggctgcgtggaacacaaagc

SEQ ID NO: 33817 - DNA, 45 bp, Homo sapiens
  chr11:43598418-43598463
  hyper
gctgcaactctctctcgcgttatgggtcggcgctgttgagctcgg

SEQ ID NO: 33818 - DNA, 30 bp, Homo sapiens; identical to SEQ ID NO: 10840
  chr11:43599075-43599105
  hyper

SEQ ID NO: 33819 - DNA, 114 bp, Homo sapiens
  chr11:43600016-43600130
  hyper
aacaagggcttttaccgatgtgcagaataacacaaataacgctgcaacccacactttgtcttgacaattcagttcaaaccaaagctgctcacagcctctcggcccaccccgcgg

SEQ ID NO: 33820 - DNA, 951 bp, Homo sapiens
  chr11:43600516-43601467
  hyper
aaaaagtgagtaatgcgcgctggctgcgtcatggctctagtcacagttcattccgaactgagaaggaatcgtgacttcgcctggagacgtcccctacatgggagatggggggcgggggggcaccaaatcagtggggacgggggtgggggggaagacctatccaatgaaaaccgctgccaggggggcatttgaactccgtcgcttgctgtctcgctgtcccctctctgccccgcgcacctcgctccccctcccggccggcgctcgcagtggcgcgcctgctcgctctcccgctaagcgacgagtcttcaacaagttggaggaaggcaggaacgcaggggttaagctcggaaagccgcaattaccaagatcgtgaccctcccacacagtacagtaacttatatacttacctggaagaacccgctttgccgccgggcaaacacccgtggggggcggggaggggccggagggagcgggccggcaggagaggggctgcttccagctggctgcagtgcggacgggaccggcgcgctcccgtggcccccagaccgaggtaaggagcagggagtcggcgcccgggtcggctggtggtcggtcggctcactggtagtcggtcggctcacgggtagtctgagcagaacttttttttcccagttgccccgcgccgcggcggcggcgggcgcagaccgcggagcccctctggcgcggcgggcgcgcagacgctcggagggtgtgtgcttgcgtctgtcagtcccggagccgaggggatgccgtgggagggtgagtgggtcgcggagctgcaggagggtgatggatgggcgaagggggtgggtcgacagggacttgaagacagtgcctccaccgtcgagagacgttttctccgggcgtgctgggcgagggtgggagtgtgtgtgcgcgcgcgcgcgcccgcccgcacgtcgattccagggtgcc

SEQ ID NO: 33821 - DNA, 454 bp, Homo sapiens; identical to SEQ ID NO: 973
  chr11:43602393-43602847
  hyper

SEQ ID NO: 33822 - DNA, 189 bp, Homo sapiens; identical to SEQ ID NO: 974
  chr11:43602848-43603037
  hyper

SEQ ID NO: 33823 - DNA, 143 bp, Homo sapiens
  chr11:43603076-43603219
  hyper
cgcaccttcccgaagctgctccatccgagccttacccggccctttccccgttttccacggaagattcggccctttcccccgtcctttccgcggtgcccgaggctttggtcacctgtcttccctccgagcgagtcccccgcccc

SEQ ID NO: 33824 - DNA, 40 bp, Homo sapiens; identical to SEQ ID NO: 3747
  chr11:43603446-43603486
  hyper

SEQ ID NO: 33825 - DNA, 438 bp, Homo sapiens; identical to SEQ ID NO: 10847
  chr11:43603708-43604146
  hyper

SEQ ID NO: 33826 - DNA, 73 bp, Homo sapiens
  chr11:43604791-43604864
  hyper
cctcacttctccctccgaggctaagtgtgggactagggctccagggcccaaggagcaacggccgaacccggcg

SEQ ID NO: 33827 - DNA, 31 bp, Homo sapiens; identical to SEQ ID NO: 10848
  chr11:43963534-43963565
  hyper

SEQ ID NO: 33828 - DNA, 390 bp, Homo sapiens
  chr11:43963625-43964015
  hyper
gcgcgcgcgcgcctgcggaggggggtggcaaggatccagaaggggagcccaccccttcttccgagctcagctctggggagccgggcgctcaggctcgccaggctgcaaagagagctgagagctgcctcgcgccccgcgcagaaccggcggtggaataaccagcgcctcaagtgtgtgcatctgggaccagggggcgggggagggggacctgcggccccgcggccaacccggttggtgcagacttggggatcccagaagggacagtgcccgcccagtcgcggcgattgagggtccctgtccgggcgcagctcgggccagccgcgtgctccggggccgcggcttctcccggaacccccgcgggcggggcctgccttccggagccggttggcg

SEQ ID NO: 33829 - DNA, 207 bp, Homo sapiens
  chr11:43964444-43964651
  hyper
cggaggcgccatggccgccaagcccggcgagctgatgggcatctgctccagttaccaggcggtgatgccgcacttcgtgtgcctggccgacgagttcccgcagcccgtgcggcccgccaagctgcccaagggccggggccggctgcggcggccgcgccagtctcgcttcaagacgcagccggtgaccttcgacgagatccaggaggt

SEQ ID NO: 33830 - DNA, 404 bp, Homo sapiens
  chr11:43964895-43965299
  hyper
cccgcgccctgctcccgggggacccgcaaggacccgggaccgccgctcctcgcgcgctcggactcccgccccgctgcgaaccggtcggtgcgcccctcgccgcgctcgccctggcccgggagcgccgggagcggggccgctttcctcgtccttgtaaatgtttattttttaactcttcccagtgcgaactctgctgtgagtgtgtgcggggaggcgcgcccgcgctgagtcggcggcgggtagccactccatgcccttgtccgatggtttgcaactccgattttgcacaccgctccaccgtgccccccagcgcacacccattcacactcacgccaacactctcgctgaacacttttataattgttaggcgtggccgttgggactttgggcgcagcgcggctgct

SEQ ID NO: 33831 - DNA, 371 bp, Homo sapiens
  chr11:43965690-43966061
  hyper
aagccgcaggaggggcggaggcagagctgacgatggagagctctctcctccgtacagttcacttcccagagctggggtcagggtcctcgccccgcacccgccacagaagacgcatctccctctgcgctgattcctggcggcgggtggggagatgtcggagccagcaatgcgagatgtttgggcgttgggacccgagagtgggctggaggccagcctgggttggtcgagagtgtgggtgcgcgctcgctgtcgcgggcaggtgactccctgaccgcagttgacccagcgcagtgcctggcgctcctgcgctgcggggaaaaccgcggccgctatgtctccagccgttctctgcgctccgcagggttcctcca

SEQ ID NO: 33832 - DNA, 33 bp, Homo sapiens
  chr11:44324942-44324975
  hyper
taggtacttggcagccggtggcccctcttaccc

SEQ ID NO: 33833 - DNA, 30 bp, Homo sapiens
  chr11:44325688-44325718
  hyper
gtatcatcacatagccgggtcctcgcagtg

SEQ ID NO: 33834 - DNA, 129 bp, Homo sapiens
  chr11:44326062-44326191
  hyper
ccaaggcctctgagccgcgggggctccgggcaactatccccctcctctcctggcctcaggcaccccagtccaggggtctgcagagaagcccgaagcccggacaaacgcgccggacgtcaacaacctctc

SEQ ID NO: 33835 - DNA, 81 bp, Homo sapiens; identical to SEQ ID NO: 976
  chr11:44330877-44330958
  hyper

SEQ ID NO: 33836 - DNA, 481 bp, Homo sapiens; identical to SEQ ID NO: 977
  chr11:44330959-44331440
  hyper

SEQ ID NO: 33837 - DNA, 229 bp, Homo sapiens; identical to SEQ ID NO: 978
  chr11:44331482-44331711
  hyper

SEQ ID NO: 33838 - DNA, 48 bp, Homo sapiens
  chr11:44332524-44332572
  hyper
cctctgctgtaagggcgctgggctgggatgtagcggaatctgtgctcc

SEQ ID NO: 33839 - DNA, 122 bp, Homo sapiens; identical to SEQ ID NO: 10857
  chr11:44332922-44333044
  hyper

SEQ ID NO: 33840 - DNA, 45 bp, Homo sapiens
  chr11:44333583-44333628
  hyper
atgcccaatgggaaccgcgcctcactggcccgcagacctaagcca

SEQ ID NO: 33841 - DNA, 136 bp, Homo sapiens; identical to SEQ ID NO: 10858
  chr11:44337726-44337862
  hyper

SEQ ID NO: 33842 - DNA, 176 bp, Homo sapiens; identical to SEQ ID NO: 10859
  chr11:44337882-44338058
  hyper

SEQ ID NO: 33843 - DNA, 440 bp, Homo sapiens
  chr11:44338086-44338526
  hyper
cgctgggacttgcaccccgagtttaggggcttagccatttccggaactcgggctagtggactctggggaatcaggcgctgggagaggccttcgcagctgcgtctctcctgcccagcatattgtgttgaatgaggcaagggagtgagggggtcgtaaaggaaacccgcactcaggggcacaccttcatttatctgggaacagcgcggatcccagaggtgcgggataaaccaggcgttccagctgctcacacgctgtttggtaccccgcgtctatgaagcacaaagcaggagcggattggaggttttacaaactgaccaaccccgccgcccgcgcccgctggagggagacgcacacctttgccctgcatattcgcttccaggctctgcatctctgctcttggggagccggccacccgcttttccgcgcgggggctggggttc

SEQ ID NO: 33844 - DNA, 52 bp, Homo sapiens
  chr11:44341230-44341282
  hyper
catactccccctacccgcccagagcaggcccagagcgcgcaactgcgggcga

SEQ ID NO: 33845 - DNA, 68 bp, Homo sapiens; identical to SEQ ID NO: 3751
  chr11:44341966-44342034
  hyper

SEQ ID NO: 33846 - DNA, 117 bp, Homo sapiens
  chr11:44748226-44748343
  hyper
gacgcagagagggcccgcgagcagagcgggaggtggtcggaggcggaggaaggggagatgggcagagggtgggcccagggacccccagacaaggcctggacgcggggttggaggagg

SEQ ID NO: 33847 - DNA, 106 bp, Homo sapiens
  chr11:44748708-44748814
  hyper
cggacgcgccgccaccgccgggaaggcagccggcgccgggcaagttgcgagcgcgcccctccgaccaggaaagtttccccccggccgccggcgggatttggcgcgg

SEQ ID NO: 33848 - DNA, 220 bp, Homo sapiens
  chr11:45376858-45377078
  hyper
agaaaggagaggaggcggagacggttagtctagcctctctgtggggcctctctgctggtacccagatgctgagcgctgaaattctcatccgccacacacaacatggcggcttcctggacccgcgcccaattttcgcttccgggatggaagctacgtcatttccccctctgttgccctagcgccccttggaagccaagaatatgaggaagtcttcttcctt

SEQ ID NO: 33849 - DNA, 75 bp, Homo sapiens
  chr11:45377121-45377196
  hyper
cgctcgaaggctctgctggccgcggctagccggtgaggagggtggggggaggggccgtcccgcgtgtgggggagt

SEQ ID NO: 33850 - DNA, 187 bp, Homo sapiens
  chr11:45686237-45686424
  hyper
gcagcggtctgggtgcggaggccgggccagggctgggagcaggaagcagggagcggcgcccccgcctccgggtgcagctgggtttggaaagttggtgcgggcgcggggacctcagggtctcaaggcgcctccgcagacccgagccaggcgggtcgtgggacggtgagcccggagcagcccctgagtg

SEQ ID NO: 33851 - DNA, 20 bp, Homo sapiens
  chr11:45686449-45686469
  hyper
cgcctcgggggccaccgcgc

SEQ ID NO: 33852 - DNA, 66 bp, Homo sapiens
  chr11:45686717-45686783
  hyper
cggccaatacctggtcggggacgcgccgggagcagctgcagcgcccagcgccggctccatcctcgg

SEQ ID NO: 33853 - DNA, 119 bp, Homo sapiens
  chr11:46259315-46259434
  hyper
ataatcgggtcaacacgcggcgagtggcggtgcgcgcggggccaaccgcgtggagctgtcgggagggcgataggatgggcgcgcccgggctgcaggcggggagccggaggtgggaggtg

SEQ ID NO: 33854 - DNA, 67 bp, Homo sapiens
  chr11:46299747-46299814
  hyper
acttcctcaacaatgcggtaagatgaagggtctccgttcccgttccacccctcggcacccgtcctcg

SEQ ID NO: 33855 - DNA, 15 bp, Homo sapiens
  chr11:46316818-46316833
  hyper
gtaccattactgccc

SEQ ID NO: 33856 - DNA, 461 bp, Homo sapiens; identical to SEQ ID NO: 980
  chr11:46316895-46317356
  hyper

SEQ ID NO: 33857 - DNA, 290 bp, Homo sapiens; identical to SEQ ID NO: 981
  chr11:46317407-46317697
  hyper

SEQ ID NO: 33858 - DNA, 128 bp, Homo sapiens
  chr11:46354365-46354493
  hyper
cgtggtgggctgggccgggctcgctcccttcgtgccctgagcgggcgggctgggcggagcggcgccctcccctccggaccccaccggctggagagtgtctctaaggtgacactcgggtgcgcggcagc

SEQ ID NO: 33859 - DNA, 165 bp, Homo sapiens
  chr11:46354770-46354935
  hyper
acttgagcgggtgcccgaaaggccgcaggagccgcgggcggaaggcggccgcacgatggccgaggggcagggcggcggagggcagcgctgggactgggctggcggcggccgggcagccgaggaggaggtggtgcggcggcgatgccggcgcggggaggaggccca

SEQ ID NO: 33860 - DNA, 30 bp, Homo sapiens
  chr11:46404027-46404057
  hyper
tcagagggcaggagacggggggcacagcct

SEQ ID NO: 33861 - DNA, 137 bp, Homo sapiens; identical to SEQ ID NO: 10866
  chr11:46414563-46414700
  hyper

SEQ ID NO: 33862 - DNA, 635 bp, Homo sapiens
  chr11:46938439-46939074
  hyper
gccgctgtcccaacacgccaaagaggctacaaataaccttccaggagagagccggggaggggagagcgcagagcggagcggaacgtgggccggccaagctaccgctcttcggagagaaagagctcagtccgcgctagagaggacgcggaaaaaagcccctgaaaacccacaggtagtttaaataagagacatgaaaactctgttttggatttgggaggtaaaccaatctttaaaacgagtgcctagacatctccacgccctgccaggcaagttcggaaatctgcactgactttttccacacgagctgtcctacgtgaaagaaagaaccggtaaaagaccaggcagggtctccagacccctccattctgagccccagctcccttcatcggggctgcgaggcaaatggggagactcggaactcccgccacgatgaatagcgatgggtgaatagggctggggttcaaagatcaaagttctttgatctctgggcacaaactagggaaagctgctcaatcacggggtgcacccagggtcgttaagagcccgcggagaagcagattccatcggagccctagtcccacacaacagggggtacgggcaccaaggagtcctgctgcagccgtccagctcccccg

SEQ ID NO: 33863 - DNA, 605 bp, Homo sapiens
  chr11:47208675-47209280
  hyper
tacatttttccatatcgccacgatgccaccccacgctaaataaatcccttctccctcctctctccctacttccctctccccgctttcccccgggggtgagattttgcagagcggctccgtctgttatttatatccactggagcggtccaagaatgttccgaagctgacctaatcgccacctgctcggcctctccgcccctcccactctctcctgggcccggtgacccagcggcggtgccctgagccttgaagaccagggggagcgcggaccaacggggtcgaacgcccgggcgcagaaggtcccggacgcagaaggtcccgggcgcgcagaatcgcagcgggtcggagagccccggcgctctcagaggagtgcgcccccagggacgcggctctgagccctgggaagctgaggcgcctggctgcgccctctgaagctcgtacttttcctcccaccctcagctccctgaagagtgtgagtgcgtgcgcgcggagttttaaacggcagctttaaaaatagcaaaattatgttgtttctaaatccaggaggaatcactgacgcgttctttacgcagatgaatccgctcacaaaacgggaaagggacctg

SEQ ID NO: 33864 - DNA, 174 bp, Homo sapiens
  chr11:47615713-47615887
  hyper
cggtcgagtcgggttcggtctgagcccgcgatctggctccgggctgcgggctgcgggctgcaggctgcaggctgcgggtgccgggctgcgcgctgaccgcccgcgctgcggcaggggcggcgggggctccggctgcttttcccggctctgaggcggcagcggacagggtgctgg

SEQ ID NO: 33865 - DNA, 60 bp, Homo sapiens
  chr11:49229810-49229870
  hyper
ctccgaggtttgctccgcgaggcgcccccctaccgaagaggaagccgaggagaaagaagc

SEQ ID NO: 33866 - DNA, 556 bp, Homo sapiens
  chr11:57194178-57194734
  hyper
gaagacacaaactcccgctgccaagttggtgttatcttcagtttactgacaatgaaacaaaagctcccatggatttcaggaacttgcccaaggtcacagggctagtttagtcacgacgcaggccattctactgccagaaatacccccaactcccatgaccctcgcctaggactcgcaaacctggtccccgccgcccttcctcgcatcaacttctaccaggaaagcctccgggggccgctccccgccagcctccgcaccccgctccagcctgcggcctgccctccccgcagaggagcccgaggggccaggccgcgctcggcgccccatggcgcccgaaaggggacccttcgccctacccgcctgctccgcgccggggctctccgcgccctttccgcacgggccaggttcgcattcgcgcctctcgcagcccctcccagtcccctgctcgcctccgccccctcctgcccgcccggaaggggctggggcagacctcccactctccatcacttccttcttcttttcccttgctcacagcctcccgcgccctttttacctc

SEQ ID NO: 33867 - DNA, 30 bp, Homo sapiens
  chr11:57243673-57243703
  hyper
ttcctccacgggaaccgcctgcggctgctc

SEQ ID NO: 33868 - DNA, 150 bp, Homo sapiens
  chr11:58668329-58668479
  hyper
cattaagggaatcttcgagtccaagaacggaagctaccattggccttaatcttcacctcccgcttttcttccctgcttcttttctcctccctattccagtaggttagttctctggcgccatcagctggcagcacgcgggaatataccaaa

SEQ ID NO: 33869 - DNA, 467 bp, Homo sapiens
  chr11:58672700-58673167
  hyper
tcgccagcccctccacgaagttggatcatttgcggagcaggccaagtccctctagacctcacgcagacgcgggtgcagcctgctctgcgacttgcagtcagctggaagctgggcctctgcatcatcagggtggagctctctctgctgctgccgctggatcccgcctggatgcacgtcccgccaccgccgccgacccatcagcggcagaagggcagcaatggccacacaccgaagcaccttggcgggctattccccttgcagctctcctcagcgcgctgctcccactcgcaatcaaaaggcggaaaaagcgcgaaaccgccaggcatctcccatacccacccggctgccgcgcaacccctccttggcttccactgggagacaggggacgccgatgagcaggaagaagcagggcagtgactgcttagtttatcctggtacgcgggaactggctgtggaccgagtggttc

SEQ ID NO: 33870 - DNA, 80 bp, Homo sapiens; identical to SEQ ID NO: 3759
  chr11:58673168-58673248
  hyper

SEQ ID NO: 33871 - DNA, 53 bp, Homo sapiens
  chr11:59318986-59319039
  hyper
cccttcacttgaaggcgtaaagaatcccgttcctctatcgagccttttctcct

SEQ ID NO: 33872 - DNA, 241 bp, Homo sapiens
  chr11:59333336-59333577
  hyper
ccccggtccttgttacggtttaaaaagctggacaaagcccgtgcgccgaacgctttcgaggacttctttggccaagagggggcccgggctgtcaccattcccggcaagcccgcgaccaagcaggcagcggaggcggcgcaggccgagagctcccgcccctctgacagtgagagaagggtcgcagcgcccacggctgcctagaacccgaaagaagaggagcggggtgcggggacacagggtt

SEQ ID NO: 33873 - DNA, 191 bp, Homo sapiens
  chr11:60718663-60718854
  hyper
ggcgggcagcaggcccgaggcggccaggtagagcagcaggctgagcgcgaccgcgcggtagcggcccaggtacacgtcggccagccagccgcccacgggcgccagcaggtaggaggcgcccaggaataccagcgcggcgcgcgtcgcctgctcgccggtccagttgaagttggtgctgttgaggtacagca

SEQ ID NO: 33874 - DNA, 187 bp, Homo sapiens
  chr11:60718976-60719163
  hyper
cgctccccgggcacgcggggctgctcccgggcgcgcggcgcgggcatcctggctccgggctgggccccccgcggctcttctctcctctcctctccccgcctcagagccctgcactcctgcccccgggcctcggccctctcccccacccaactggctggccctcctttctcaccgctttggcccaccc

SEQ ID NO: 33875 - DNA, 286 bp, Homo sapiens
  chr11:61062738-61063024
  hyper
aacacacaaaggcaacgccgcccgcctgctgatgcctctccgagaggcgcggagcccggggcgggggcaaagatcagggacccctgggggcggggtttcgccctcggcccacaccccctgccccggtttgggagtcggcttcctgcgaagcgctgactgaaggcgtcagaccgaggccccgggaggaaacagacttcgggaacaaggctagcaccagaggctgcgcgccccgggcatggcccctgtcggtgggacccgagacgccttgttgtgacgaggtgggaac

SEQ ID NO: 33876 - DNA, 97 bp, Homo sapiens; identical to SEQ ID NO: 10877
  chr11:61063061-61063158
  hyper

SEQ ID NO: 33877 - DNA, 73 bp, Homo sapiens
  chr11:61276431-61276504
  hyper
cggtggcagtggcggcggccccggccggggcccgtgaccatgggcatcgccgagtccacgccggatgagctgc

SEQ ID NO: 33878 - DNA, 585 bp, Homo sapiens
  chr11:61276535-61277120
  hyper
cgaccagcagctggagctgagcgggcggcggttgcggcggctgcccagcgcagtgtgcgcgctgagccgcctgcagaagctgtatgtgagcggcacggggctgcgcgagctgccggaggagatcgaggagctgcgcgagctgcgcatcctggcgctggacttcaacaagctcgagcgactgcctgacggcctgtgccgcctgccgcgcctcacgcgcctctatctgggcggcaaccggctgctggcgctgcccgccgacttcgcgcagttgcagagcctgcgctgcctctggatcgagggcaacttcttgcggcgcttcccgcggccgctgctgcgcctggtggcgctgcagtcgctccagatgggcgacaaccggctgcgcgcgctgccggccgagctgccgcgcatgacgggcttgcgcggcctctggctctacggcaaccgcttcgaggagttcccgcccgcgctgctgcgcatgggccgcctgcacatcctcgacctcgaccgcaaccgcctgggcggcttccccgacctgcacccgctgcgcgcgctgcgcgtcttctcctacgaccacaaccccgtcac

SEQ ID NO: 33879 - DNA, 15 bp, Homo sapiens
  chr11:61277327-61277342
  hyper
cgctccaggactggg

SEQ ID NO: 33880 - DNA, 38 bp, Homo sapiens
  chr11:61334835-61334873
  hyper
tgctgaaacagctgtcggccacgcggctccttgtcctt

SEQ ID NO: 33881 - DNA, 213 bp, Homo sapiens
  chr11:61335097-61335310
  hyper
caggacaaaaagggccgccccgcgaacgtggtaaataccacgccccattccctcccgggggcccgccgcactgcctcctggtggctggcgcgggcactgcaccccggcgggcgcacagacggtccccagcggcggcctgggccagcggcgaagcagcggcagacggttctccggcccccgccgccccctcaccgctcccggggcaatctggcg

SEQ ID NO: 33882 - DNA, 72 bp, Homo sapiens
  chr11:61582570-61582642
  hyper
tggcgataagattcacgttggcaggtccggcagccccgggccctgtaagtgatgcggcgtgtggggcggggg

SEQ ID NO: 33883 - DNA, 310 bp, Homo sapiens
  chr11:61583252-61583562
  hyper
cctaccgccccagagcgtaaacagcggtccgctccgcggaatagctgaagacctcgctggcctgcggctcagtggcctccccggcgattcgagaacagctctgggggtcctcgctaagtgtatgccattcccaatcccttatgtacgccagcggccgcttgccctccccggccagcgctgtcccttccgcgtcctccagtcttcacacgacgcaggggtccccaaggcagcggtctccccaagcttcccgtttcagccccatcctcgagaatgggctcctttcctgctccctctccgctcctgctggcga

SEQ ID NO: 33884 - DNA, 498 bp, Homo sapiens
  chr11:61594981-61595479
  hyper
gaggttgcagaaaggcgccagaatgtggatggcgcggacaatgtgggatactggagtctcgactgccgcgcgccaaggaagggcgtcacctagccaagccggccctggagttgagtgccccgcagcccgccggtccacccgcccggccgcttgctggcaccctggtggccgcgccggctttgtgtcggcatcaggtgcaaacccccagagcgccgggcgtgcgcgcacgcgccccggagcgcgcggagcccattcgttgcccccaccgggatctcctctaggatctcctccggcgcccggggccggagagtgggggagggaggaggtcggacacgtagcctgcctcgcagcagggctcgactccacgcgggagggcgggggagccggggacccgccgctccagcccgctggccttcgaaagatcctcctgggccaatggcaggcggggcgacgcgaccggattggtgcaggcgctctgctgatcgctgtggaaactcg

SEQ ID NO: 33885 - DNA, 520 bp, Homo sapiens
  chr11:61596120-61596640
  hyper
ggatccctggctccccgtgggccaaacagacctccggcgctgaatggagcttgggacgtcctgtagggaaggaaagtgcatctattgcactcgtaccccctccccaatcctcctcctcctctgggccgactggggtggagaccggatctgggacccggggaggcggcgctgcggtgaaagtcccagcggtggagaacagggcaagcatctaccgcgcgcgccgggacccacgcgtcctccccttcctcggggtttgtctggaggcagggactccccaagaggggcgctcgggccagacggctttggcgcccccagcggggaagatggccgcccctgcgcgccgctgaaaggagcgggagcgcaggcagccaggtgtgggactccgcgcttgtcccgcactctccatccagactgggtggcgagaaggaaagctcgtccccggccggagatcgctcctgctgggactcttgtctaagaagttcctcaatggccacctgggaaaaaccgcccagcagctcgg

SEQ ID NO: 33886 - DNA, 137 bp, Homo sapiens
  chr11:61722850-61722987
  hyper
agacgttaggtaagacgtcctgccgttagcaatgaaaaccccattttctgagggaagcgctgacatcatggtccctggagcccctgcgcgggaggggagggggtctggcggatttctgggaccagcagggggacccc

SEQ ID NO: 33887 - DNA, 34 bp, Homo sapiens
  chr11:61793162-61793196
  hyper
tgcagtcagcagacacgtacgggatgtgggaggt

SEQ ID NO: 33888 - DNA, 77 bp, Homo sapiens
  chr11:63258635-63258712
  hyper
ccgcggaggggaaagcgccgcgggctgcaaacggcagaggcgcgcggggtggcgacagtggcgcgggcgcagtgagc

SEQ ID NO: 33889 - DNA, 30 bp, Homo sapiens
  chr11:63537177-63537207
  hyper
ccggtcccccagctccggagaagcggagcg

SEQ ID NO: 33890 - DNA, 14 bp, Homo sapiens
  chr11:63768254-63768268
  hyper
gggcctcagcgtcg

SEQ ID NO: 33891 - DNA, 180 bp, Homo sapiens
  chr11:63803518-63803698
  hyper
cccctgggcgccctccggctctggttcccgcccgctccttggaataacccctgaggctccagccgtcaccgcaaagtttcccgaggagacccgcctccccggccgctgcgcaggtagggctggctgcaccgggcgggggtcggggtccgcgcgtctgggacagggcgccagagccgacgg

SEQ ID NO: 33892 - DNA, 60 bp, Homo sapiens
  chr11:64058891-64058951
  hyper
agctgatgcccaggtcggggccctgccgctggccacactgggctccggtccaaggctaga

SEQ ID NO: 33893 - DNA, 216 bp, Homo sapiens
  chr11:64059895-64060111
  hyper
agccaggaagcagggcgaggcgagaggggacggagaagccgcggagatgctgtcacagccgcagcgggcgagcagggacccaccattcccctgtccccgccttgcgctgtccggcctctcctccgggtttcccttcggacgcctccgagccccctcagcctcctcctcgagggccagctccccgcacccccaccaagctccacacatttcctcgct

SEQ ID NO: 33894 - DNA, 33 bp, Homo sapiens
  chr11:64060160-64060193
  hyper
cgccttcctttcccttctcggtgccctcctctc

SEQ ID NO: 33895 - DNA, 363 bp, Homo sapiens
  chr11:64066842-64067205
  hyper
ccagctggactggcacggtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcagg

SEQ ID NO: 33896 - DNA, 229 bp, Homo sapiens
  chr11:64409956-64410185
  hyper
agcgccccccgcccccgggccaaccgggtggccggcatctacagtgccacttaccgtggccgccgcgggtgaggaagggcatgcggttgatggcgatgggcacggtgccgtgcttgctgtggaagtggtggacgtggtgggtggtgctgaggctggaggagacccgggccccctcggccgcccccagcagcaacagcagcaacagcggcaacagcggcagcagaggtgg

SEQ ID NO: 33897 - DNA, 233 bp, Homo sapiens
  chr11:64410203-64410436
  hyper
cggcggcaggggcccagccagggccggggggcggcgcgggcacccccccggcccgctccccccggggggcatttcggcccgggggcgaccgcctcacagccccatggccgggggcggggacgcggggctgcgcagccccgcgaagcccccctccggctccgagctccgggagcggggtagggatgaagcggaggtaaaccagggcccaagcctcggtccggagccaacaaaat

SEQ ID NO: 33898 - DNA, 81 bp, Homo sapiens
  chr11:64410678-64410759
  hyper
agctggggagcggggcggtgcgggctggaggagagaagagggacggagacctggttcccccgaaggcgggagaccgacggc

SEQ ID NO: 33899 - DNA, 196 bp, Homo sapiens
  chr11:64478789-64478985
  hyper
gaccaggggagagaacgtcaggcctgaggcacacacgagctggaagaacagggacgaggggcggggagagacgcgcatgcgccgcccccagaccgatgggggagcccctccccacgcccagccagaccctaatggaagaggctcctcccagtgcttcctctcctcagcgccccctgccccccgacaccacagcccc

SEQ ID NO: 33900 - DNA, 78 bp, Homo sapiens
  chr11:64480253-64480331
  hyper
ccaccgccaaccccacgcgccctcgcccggacacgcgtccccgcagccctggagcgctcgcacccactcacaagccct

SEQ ID NO: 33901 - DNA, 845 bp, Homo sapiens
  chr11:64480379-64481224
  hyper
cgaagcgccccaggccctcacccccgcgcccaggcaccgggcggccgctccccggggctcaccttcgctgcagaacttgccgccgaagcccgtgtggctgcagtcgcagcccacctcgccgggggccagcacggtgcagaggccgccgttggcgcaggggttgcgcgcgggcgcgcacagcgggtcggcggtggcgccgcgcaggccctggctgcccagcagcgcggggggccgctcgcccagcttcaggttggccaagaggccgcggaagggcggctcgtacttgacggtgctcagcgtaagcgccgagaggcgcacgtcgggcgggatgccgcccacgaacaggtcgctggccacctgcatctcgcgccgcttggagcgcacctcggcggcgcgggcctcgccgtccaccgccagcgccgtgcggcgcgcgtcgcgggtcagcagcaccatgtgccagcggtcgtcggccaccggcgtgtccagctgcagcgtggccggctcggcgcacgaaagcgtgaagcgcagccgcaggcggccgtccaccagcagcagctccaggaagtcgcagtcgccgccgtcgtccaggtagagcagcagcgcgcgcgtggcgttggtgcgcaggctgaagctgagctcgccgctgctcgccgcgcccgcccagcgcgcgtagcgagcccactgcccggggccgccgccgaactccaggccgtccgcgcgcgccgccagcgccagcagcagcagcaacagcagcggcggcggtgtcggccgccaccggctcccggacgccatgcctacggcggccccggccccgcccggcccccggcccccgctcaggcttcaga

SEQ ID NO: 33902 - DNA, 129 bp, Homo sapiens
  chr11:64511955-64512084
  hyper
tgccaaatgggggtacgcgggggagggccccgctggaaggtggctgggaaaagctgggtgcaccgtggaggtcctccgccctccggggatccagcgcgccttagctctcgtggccgctgccccctctcc

SEQ ID NO: 33903 - DNA, 405 bp, Homo sapiens
  chr11:64512898-64513303
  hyper
gggacctgtggggagcgaggaatgaaatcgtggctatctggagacgcggccttgatgtctgggaatgggggcggggggcccagttcacacaggaggaacggggccccggaagcctggctccccacagggtcgaatggaaaggggcagccgcatgtggcggtgggttctccgcagctcggagactggagacctggatgcctggccaacagggaggaacttgggaggggcagccgcaggcggttggggtccccactagccgggcctaggagagcgggtaacggtttccgaccatttggcttcagacacactcactgtgaaaccaccgaccccaaacctcccttccgaggcgtgcccctcccagccttggggcgggggatccaggaccgcccccgcacctcagtcttg

SEQ ID NO: 33904 - DNA, 233 bp, Homo sapiens
  chr11:64513515-64513748
  hyper
cctgggtcctgccctcgacagcgcggatcctccgtggtccgggaagcctcagcccaagtcccggctcccagccccggtgggccccacccaggcagacgccccgcccccggccagcgaggctggccgctgacctagtatggacacggcactgggaagagaggcgtggagggtgacgccaggaaaggggctggagaggcctaggccccgcccccacgggtcgccccctccacctc

SEQ ID NO: 33905 - DNA, 475 bp, Homo sapiens
  chr11:64739288-64739763
  hyper
agaaataaacagaaacgcaaagacaacttcccgagggcccgggccgtcgtgtgccgttacctcagccccaggtggttcccaggctcggccaggctatgtctcacacactgactaggggtccttcggcctcagaaaagtggccccggacggaatacccactaagaagtgctctctgaaaaaggcgggcgccaacctcgaacgaagtcgttttgagggactggctcgccagctcctaagcaacttcggggctcgtgccgcgcacccaccaggccttctgcgcacgcgcaagtgcgcttcccaccgccccttcgggcgcagctccaaggcctggccgcggtctgcgcgtgcgcatttcattgtcgacaccgagaggacgccttggcgccttcaggtccctcctggatttaccagcccattgtttatttcgcgcctgctttagcgtggtgtcgtcgggaactagcgactgcagagtcct

SEQ ID NO: 33906 - DNA, 30 bp, Homo sapiens; identical to SEQ ID NO: 10894
  chr11:65185213-65185243
  hyper

SEQ ID NO: 33907 - DNA, 246 bp, Homo sapiens
  chr11:65185467-65185713
  hyper
gagtgctcaggaggacgggggaccaaggcctggggtaaggggcaggtgcccaggcactctagcatggcacggaacaggggacagtcccaggacatccggatgcagggggctgacaccgcaaagttctttcctgtaaagcacagcccgaggcctggggcttggccctgggcagaggaagccccccttagatctgccttggcagtagtgaggaaagggcgtgcacagaccccacgcagcccgaggtga

SEQ ID NO: 33908 - DNA, 190 bp, Homo sapiens
  chr11:65197700-65197890
  hyper
tcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaa

SEQ ID NO: 33909 - DNA, 97 bp, Homo sapiens
  chr11:65600749-65600846
  hyper
ccccaggttttctctcgcagcatcggcacccccttgcagccccgctccagtggcgaccgttcgcggaccccggcctcgcttggggcgccctggccgc

SEQ ID NO: 33910 - DNA, 810 bp, Homo sapiens
  chr11:65600847-65601657
  hyper
ggacttgtggagctccctagtcctcctaggctgcttaccccgccgctccctcccgtccaagagcggaaacctaaacagaccccccttctccacagacattgtcccctgccctcgcccctggtccaccacccacatccccaccactgcttcccattccctgtccccaccctgccaccctcaccctcttccccttccccttccccttccccactgcctggtgggcgccaaactgggcgagtgcgcacgcgcaggccgcacgtggccgttggaaggaggggcccggaacggcggcacggggttgttgtgggggtcagtcccccggggactggagggagacgcggcacgcggcctctgcgaccctatgaactctgaccccagctcccacactgtcgcctatcaccggcccactctccgtgccgcgtgtcccttaaaagctggggcctgggacaggaacgacagacaatgcagccaatggcgtcacgcgcggtgccccgctacccaatcgaaaggcgtggctgagggaaacgcggtgggaaccgcccccgactccaggcgactccttggccgggcgggggagagcgtccccgtcagctgagagcatcctcactcggtcagttcctcgggcgagttacggggacgacctgcgggagcacgcgggcagtggccggacgctgaagcccaggagagcgatggagacgtatgcggaggttgggaaggagggcaaggtagagaaaggatgaagacccccaccccagcctcccctcactccatgaaagcccgtgatgcccaatcatgcggtggtgtgtgtgt

SEQ ID NO: 33911 - DNA, 34 bp, Homo sapiens
  chr11:65640238-65640272
  hyper
gcacagctccctggacgcgcggccccaggaagcg

SEQ ID NO: 33912 - DNA, 73 bp, Homo sapiens; identical to SEQ ID NO: 985
  chr11:65816447-65816520
  hyper

SEQ ID NO: 33913 - DNA, 142 bp, Homo sapiens
  chr11:65816560-65816702
  hyper
cggggtccgagggtgcccggggccctgcgcgccgagtgccggtggcttgcctctcagcgcctggatgggatcaggtggcagcgtccgctaggctcgctcctcccggctctgcccgccccccgccccccgccccccatcgcac

SEQ ID NO: 33914 - DNA, 44 bp, Homo sapiens
  chr11:66186333-66186377
  hyper
actctttcagcaccacggacagcggtcggcgcagtattccttca

SEQ ID NO: 33915 - DNA, 93 bp, Homo sapiens
  chr11:66187374-66187467
  hyper
ccggcgctgccccttcgcttctcagctgctcccccatcttgcccgcctaggcagggcggggagccctccggagcggtgcggaggcagccaggc

SEQ ID NO: 33916 - DNA, 390 bp, Homo sapiens
  chr11:66188095-66188485
  hyper
aattagtgtcagtgccggcccctctctgccctctgcggactcctgccgcgggcttcaggccgccctaaacctggccctgtcgcttccctcaactgaacgcattcagacgccagggtccccacactccattcaagctttcctaacgcagcgccttcctctccgctcagctcccgccaggcttggccccctccgcagcctcctgctcccccctcgcccgcctccctccctctctcattctacgtcatgagatgacgtcggaagccgggcgggaggaggagcccccctccccagtcagcggctcccgctgcagcttgcttagcccagcctcccgctctcccgcccccccggctctaaaacgagccccccacgcctggcaggagctatataagg

SEQ ID NO: 33917 - DNA, 214 bp, Homo sapiens
  chr11:66188570-66188784
  hyper
cggaggaggaagccgccggtgcgtcgggacgggagcgcaggtgctcgggcacccgagctggagctccgcagccgccggtcatgtaccgctccaccaagggcgcctccaaggcgcgccgggaccagatcaacgccgagatccggaacctcaaggagctgctgccgctggccgaagcggacaaggtccggctgtcctacctgcacatcatgagcct

SEQ ID NO: 33918 - DNA, 257 bp, Homo sapiens; identical to SEQ ID NO: 3770
  chr11:66188852-66189109
  hyper

SEQ ID NO: 33919 - DNA, 51 bp, Homo sapiens
  chr11:66726274-66726325
  hyper
gcaagcacaacagttcgcactggggctcaggcatcccggctagacgcagat

SEQ ID NO: 33920 - DNA, 211 bp, Homo sapiens
  chr11:66790706-66790917
  hyper
gcgggctcctgggagcgtgcccggactgcggcgcagctccggtccgccgccccggcccggccgagcccccggcccgcgccgcgctcctcggaggcgggagcccggcgacactgcaggggtggcgttgccgccggcggccgggctaggcgcaggtgcgtgcgcgctgcgggaggcgggccggcagctggagcccagccggagcggcggcccc

SEQ ID NO: 33921 - DNA, 30 bp, Homo sapiens
  chr11:66791312-66791342
  hyper
caccctggaggttcccgaggcaggagcgct

SEQ ID NO: 33922 - DNA, 32 bp, Homo sapiens
  chr11:67232123-67232155
  hyper
ccggtggcccttgaccgcgcagtagatgaaga

SEQ ID NO: 33923 - DNA, 468 bp, Homo sapiens
  chr11:67478815-67479283
  hyper
cacgcggcccgggtccgcggccgacagctgggaggatctggagcggggccgggtcgcaagaagaccctgaccctgctcccgcgctggggcgcgtgctaagggcccgcagggtttcagctgtattttcgaacccctgtgcttggccgaggggttcccaaggctccactccgccttggagggggctgcggaagcccggaggtgacccgggctctgggaggggcgtccccaatgtgggggaggggagacaggggcctttgaatacagcgcgggactcagagggggtccccccgacctaagacgtggtaaactgaggccggcgaggagggaggctgagtccggggaccaggcggcccctcactgctcctccggtccgtctcccctctgcgcctgttcgtacgggcagggccggcggccgagtccagcgggctcggggccaggcctgggccccgcgggcggcgcctcctcctc

SEQ ID NO: 33924 - DNA, 373 bp, Homo sapiens
  chr11:67895795-67896168
  hyper
accctcctcccccagcgctactgcccgggccgaattccaaggccagcggctgcccgctgagaaggaatccggaccaacgggattctggcttccctctggcccctcctggcgagagcggcgccgggaggagggggcctcagaaggggcgggcaggggcggggcccgcggggtaggcggagctcccaggaaaacagcgggcggggcctcgcgcgaggggcggggttggcggcgaggcgtcccaggacccccattcctccctccgccccggggcttctggggagcggcgcagcttgactgccaccgactgcgggcctccctgccctacaagcccccacccccgcccccccttgggacctggcgaggagttgccccg

SEQ ID NO: 33925 - DNA, 371 bp, Homo sapiens
  chr11:68451833-68452204
  hyper
tgagggggggctctccgccgcacccgcctatgatggcccagaggacccgagctcgggtcactcccgtcgccctcggggctcggcgagggtgcaggaggcgggcgctgagccggtgacgcgactccgggcggctcccgggtgcgccgcatatatagcagcggcggcggtggcggcggccacaccgggcggcggacacgtggagggacccggcccgcgccttctgcccctgctgccggccgcgccatgcggtgagcgccccaggccgccagagcccacccgacccggcccgacgcccggacctgccgcccagacccgccaccgcacccggaccccgacgctccgaacccgggcgcagccgcagctcaaggtac

SEQ ID NO: 33926 - DNA, 38 bp, Homo sapiens
  chr11:68452502-68452540
  hyper
aggggacatcagagccggccgggcgtggagggcttcct

SEQ ID NO: 33927 - DNA, 41 bp, Homo sapiens
  chr11:68607302-68607343
  hyper
gccaaacgcagcagccgcagcagtatcggaagggacccagt

SEQ ID NO: 33928 - DNA, 43 bp, Homo sapiens
  chr11:69452211-69452254
  hyper
tgcgggggagagggccgaacgtgacctccgaggtcacccccag

SEQ ID NO: 33929 - DNA, 30 bp, Homo sapiens
  chr11:69452718-69452748
  hyper
tgtccatgtgccgagcgtgtggctgtctcg

SEQ ID NO: 33930 - DNA, 59 bp, Homo sapiens
  chr11:69453263-69453322
  hyper
aacacgcgcctgcagcggaattcgctttctcctgaccgaccatccgcccaggccgcggt

SEQ ID NO: 33931 - DNA, 355 bp, Homo sapiens
  chr11:69517081-69517436
  hyper
aggagctggttgggccggaggcggccccgcctctgcatcctttctggggtgggggccccgggcaggcgcggccacccccgccctggcccctgctccgccagggagtccggggctgcgtgtgaggcctgcgcgggccgagacctcacacagcctcctctgcgcgcggggccgcgggaggggcgcgggttcgttcctttgaactcccagcctttgttcccggccaccagagccccagcgctcgtacacttccggccccgggacctctgcggttacctgggccttccctgccagcccccaccccctgcccccaccagaaagcgtttacaggacaggtgaggcccgcaggaggaaaagc

SEQ ID NO: 33932 - DNA, 55 bp, Homo sapiens
  chr11:69517954-69518009
  hyper
tctccttcaggcctccgcccggggacaggcgccggtcccccgccccggcgcatcc

SEQ ID NO: 33933 - DNA, 392 bp, Homo sapiens
  chr11:69518209-69518601
  hyper
tgtgcttctccctagcgtcccgcgctgtttggggactaacggagggatcctaacgtccaggtgccaaaacctggggttcccaggagttgaggggtccgcaggagcctaagggtggcaaaggaaggaagggcgctggggtggggcgcgcgcagcggggtggggtgcgcgcggcggggcgggcgggggtgctggcgggcactcactgtgcgcgctctggccccgcgcgcagtccacgacgccgtcggcacggatgcgcaggaagcagctggagagcccgtgggggccggaggtgtacaggtgccgcaggcggatggggtcgccccagccgtagtgcacgtggggccccgcgtccgagaaggcgagggggcgcccggccacggccagccagaggc

SEQ ID NO: 33934 - DNA, 37 bp, Homo sapiens
  chr11:69519059-69519096
  hyper
ggaactcctccccaccgcgcagcggccccgaggttct

SEQ ID NO: 33935 - DNA, 243 bp, Homo sapiens
  chr11:69519374-69519617
  hyper
tttccccggcagttccgacagtctcaggttctttcagcttcatcttcttgcaattcctgccccgccccttttatccgggtaaattgccccccgacggggggccgggcgcgctctcggccggcggggaaacaatggaagccgcgcggactgtaggtggcgccgcagcctcggcgtccgcctgggctttgcgctcctggccccgcgcccctgcctgctccgcgctcgccccggccccgcggctgt

SEQ ID NO: 33936 - DNA, 297 bp, Homo sapiens
  chr11:69588887-69589184
  hyper
cagcaggcctgggggcggggcgcaggtcattgcggggcaggtgatccctggcccactccgcccctcggcttgttcgcctccggggaccctatttctggggtggggttggggataaagggccagggttcccggcgcagccgcccccaagggcctccagagcccaagctgccctctagggcctccggagcccaagcctgcgctagctcagattagcttgcctgtgtaggggacccccggcggccgcacccagtcccggaccttcagacgcgagcccgaccccagcggttccccagcctg

SEQ ID NO: 33937 - DNA, 100 bp, Homo sapiens; identical to SEQ ID NO: 10910
  chr11:69589407-69589507
  hyper

SEQ ID NO: 33938 - DNA, 289 bp, Homo sapiens
  chr11:69589824-69590113
  hyper
ctaccgcggccgtcccgggccccgacatcccggcccgagggccgtgcgtcggtcaggcggtcagtgcgcccgggaagctggggggcagagctgcgcctgtggcgtcccgcgggagcgcacggccgacctcgggcaggagtgcgcaaccgaggaggtgcgggaggcaagcgacggggcccccgggcgccgggctctaccccggctgcatggagcggcgagccgggcggaaagcgcgcggctggagctgggactctgaggagcagtgcgcgcctccctgagcgccaggccc

SEQ ID NO: 33939 - DNA, 521 bp, Homo sapiens
  chr11:69590114-69590635
  hyper
cccgaggccgagccgctatatatatagcccggcgccccctcctactcgcccgctcccgcggggggccgttcgcgttctcctgggcgcccggggcgctgtggcgttcgcggctggtcgcaggccgcctgccaatcagggccgggggaagggaggaggctggggactagcgccgcgagtgccacctggagggaccccggcccccacccttggctccgcccggcccacggacctgttcgtcccgccccttggcggctcctacacttctgcttttcagccagttttgcctcttgcactttgtccctgcctgtccccgtccccgtctccctctctgctccggccgccttggcgcagccctaactcgggcatccgaagctcctagtgggcgcagaagccagcggctgctgcctgcccttcgcctttcggaggctcacgggaacttggttcctttgctggggccttgaggaccggcctgggaaggaggggtggataagagcagtaagcgacaccggggcctggctggg

SEQ ID NO: 33940 - DNA, 54 bp, Homo sapiens
  chr11:71274712-71274766
  hyper
ctccctctgcagtcacgcctgagaaccacaagtgagacacggggagaattgcat

SEQ ID NO: 33941 - DNA, 536 bp, Homo sapiens
  chr11:71318274-71318810
  hyper
taggcggggaaggtgcggggcgaggcggccgcggctccctggcatccctctccttacccccaggctaagctggcggtgctgctggtgacgctggtggcggccgcggtctcctacctgcggatggagcagaagctgcggcggggcgtgcgccagccccgcatcccgtggccccagcacaaggtgcgcagttaccgctacttggaggaggacaactcggacgagagcgacgcggagggcgagcatggggacggcgcggaggaggaggcgccgcccgcggggaccaggcctggtcccgagcaggctggactcggccgccggccctgcccgtaggaacaggcgcaggggggcgactggccagaggagcagtgaggggccgcctggtccacggactcagcctccctcctcgccggccttagtttaccacttcttaggtcggggggaccccctccgagtcccgcgctgtcttcaaaggcccctgtctcccgtcccccacgttggggacgcccctcccagagcccaggtcacctccgggcttc

SEQ ID NO: 33942 - DNA, 66 bp, Homo sapiens; identical to SEQ ID NO: 10914
  chr11:71318952-71319018
  hyper

SEQ ID NO: 33943 - DNA, 88 bp, Homo sapiens
  chr11:71951172-71951260
  hyper
ccgccgcgcccttggcgctggccgcgcgctcctgtttgcggaacttggcccggcggttctggaaccagacctgcgggcacaggggcca

SEQ ID NO: 33944 - DNA, 109 bp, Homo sapiens
  chr11:71951583-71951692
  hyper
ggagtgttccagggccgtggagagcagtttagggcgccagtaaaccttttgtctagggcatccagtcaaggcgggccaactgaacatctgtacacggagttgtacaaat

SEQ ID NO: 33945 - DNA, 282 bp, Homo sapiens
  chr11:71952135-71952417
  hyper
atacacgcacctgcacgcgagcctcagtgaggtcgatcttgagcgccagctcctcacgcgtgtaaatgtcggggtagtgggtctcagcgaaaacgcgctccagctccttgagctgcgcgctggtgaacgtggtgcggatgcgccgctgcttgcgcttctcgtgcaggccggatggctctgggaagaacttgtagggcactgcgggtgtgtgcaggggggccggggggggggcaaaaaggatgggggagtgagaagcagagttcaacccgttgtgtccagctc

SEQ ID NO: 33946 - DNA, 72 bp, Homo sapiens
  chr11:71952458-71952530
  hyper
cgtcttggtcccggcagcctggggccgagcgtcctccctattactcaatggagccggcgggataaaggcgga

SEQ ID NO: 33947 - DNA, 231 bp, Homo sapiens
  chr11:71954593-71954824
  hyper
ttgacctgaagggcacgagacagagatttggcaacgagaaaaaggaacaggagagatgagagggtgaggctcattcctgcggaggagaacctcgtattctgggggtctctcggggcattggagggtctggccaaggcaggaatgggggcggctgagggggacagtcgcattcacttggcgagcgggcccagggattctgcaggaattggagggagggttgggccggggctg

SEQ ID NO: 33948 - DNA, 57 bp, Homo sapiens
  chr11:71955068-71955125
  hyper
ggggccgggccaggccgggtcggggtcggggtccgggtggaggtcggaagggaggtt

SEQ ID NO: 33949 - DNA, 264 bp, Homo sapiens
  chr11:71955189-71955453
  hyper
cggccgcactcagcccgggtgcaacgcaagtgcagccagcccggcccgcgcgccttttaacgcgcaggaccccgcggaggggggcggggcggggcgagctccgaaggggcggggcctaggaggcccagacaccgcccaaagccgccccgacccccaccccgaagggtccccgccgccgtcttagggctcagaggtgtggagctgggatgcgcgggaccctatccccggagtccctatcctgccccaatccggaccagaccttcg

SEQ ID NO: 33950 - DNA, 56 bp, Homo sapiens
  chr11:71955705-71955761
  hyper
gggacagggaagggacgtggatagacagaggaaacagagaccgggagagaaagggg

SEQ ID NO: 33951 - DNA, 248 bp, Homo sapiens
  chr11:71956129-71956377
  hyper
agggacagccacaagcgcgggagcagaggctgagagcggagagaaaacgcctccggggagcttagacacgagggctggagcgcagaggggcccagggatgatgctggaggctctggggtgcggcctccacggggctgcggagagggagggtcgtgggagccaggtccctctaccctgacttgtcccgaggcccacacgaccttgcaccttcagggcccgcctgcctctccccccgttccctcagctcc

SEQ ID NO: 33952 - DNA, 30 bp, Homo sapiens
  chr11:72388069-72388099
  hyper
ggagtcaagaaacaccgttttttgttagct

SEQ ID NO: 33953 - DNA, 322 bp, Homo sapiens
  chr11:72432837-72433159
  hyper
agggcctccctcctacgtgcccaacagcaacaacagcaacggcggcacctcgcttaccctcagacgcctgctgggtcttggggctgaggactcccacagctccggccaggcgggctgcgtatgcccaagaatgtcgtgtacctgcccgtgcaagcctgggtcccgcctgggctggtctcgcaaacagcctggcccctggcccctgggtgggtctgaggctgcgttctcttggaggtttttgagcccaggtatggctttgcacctgtgatttatgtctttaagtgtttgtgaatcacttctctacgtgcgtgtgtgtttgttt

SEQ ID NO: 33954 - DNA, 30 bp, Homo sapiens
  chr11:72929613-72929643
  hyper
cgagccggcgtgtagcgcataactggacgg

SEQ ID NO: 33955 - DNA, 109 bp, Homo sapiens
  chr11:73019882-73019991
  hyper
ccgcccccgcgcagccgcgcccgctccgcagcctctcgccgtcggttcgccagctctcccggcgcttcgacgcgccgcgtctggacgacggctccgctgggacccgaga

SEQ ID NO: 33956 - DNA, 36 bp, Homo sapiens
  chr11:74178590-74178626
  hyper
ctctgggctcccacccgcgctcggctcccttttccc

SEQ ID NO: 33957 - DNA, 205 bp, Homo sapiens
  chr11:74394395-74394600
  hyper
ggtggccctgggtagcgagcgcggccgggcgggcgccgtggcctcaggggccctccccgggctgggcacccccacgccgcccgggcactgctcgcggccgcgctttacaagcgaaaacaaacacggccacaagcagcccctgtgcgacgcggccccgcgcccgccagcgccgccgccgcccggtcaaagccggctttgtgcccgt

SEQ ID NO: 33958 - DNA, 167 bp, Homo sapiens
  chr11:74441835-74442002
  hyper
ctcccggtctacttacgggctcgagcgtgggagtccagggggaaccagagcagcgcgagtcccagcaaggaggagaggaccctcacctcgggaaccatcctttccccagggtcaggccgctggtccgggagcggagtcgggaggaagggagacgaaaaggacacgga

SEQ ID NO: 33959 - DNA, 388 bp, Homo sapiens; identical to SEQ ID NO: 10923
  chr11:74442255-74442643
  hyper

SEQ ID NO: 33960 - DNA, 136 bp, Homo sapiens
  chr11:74442705-74442841
  hyper
cgggccacggggtttaacccctgactccccgcgacgccaagaatgcaggagggcagagttgagggagacctcaggtggaactttcaggtggggaaggctgagctgtcggggctgcgggtaccgggaaggctcaggg

SEQ ID NO: 33961 - DNA, 103 bp, Homo sapiens
  chr11:74951674-74951777
  hyper
aggatgaagagaaagcgcagcagccgacagccctgattctcgggagcctcccaccccgcctcccacggcgaggagggcgcggagactccgctgggggcggagg

SEQ ID NO: 33962 - DNA, 303 bp, Homo sapiens
  chr11:74952123-74952426
  hyper
ccaggggctgctgctcgtggcggcggcgctgagccagcccgcggcaccctgccccttccagtgctactgcttcggcggccccaagctgctgctgcgctgcgcgtcgggagccgagctccgccagcctccgcgggacgtgccgcccgacgcgcgcaacctcaccatcgtaggcgccaacctgacggtgctgcgcgcggccgccttcgccggcggggacggggacggcgaccaggcggcgggcgtgcgcctgccgctcctgagcgcgctgcgcctcacgcacaaccacatcgaggtggtggagga

SEQ ID NO: 33963 - DNA, 5 bp, Homo sapiens
  chr11:74952724-74952729
  hyper
gaccc

SEQ ID NO: 33964 - DNA, 242 bp, Homo sapiens
  chr11:74952948-74953190
  hyper
cgcggacagcggcgccgacgctcgcggagaggaggcggaggccgccggcccggagctggaagcctcctacgtgttcttcgggctggtgctggcactcatcggcctcatcttcctcatggtgctctacctaaaccgccgcggcatccagcgctggatgcgcaacctgcgcgaggcgtgccgggaccagatggagggctaccactaccgctacgagcaggacgccgacccgcgccgcgcgcccg

SEQ ID NO: 33965 - DNA, 313 bp, Homo sapiens
  chr11:75141346-75141659
  hyper
cgtagtcgagcaccacggccagcgccgccgccgccccggccgggctcgtgcctggcgcctcgggagctactggcaccactggcaccacggccgggccgcgctcgggccgcccggccgcgaacaagctgcggaagtaggcgctgcccgcgctgagcgccgcgcggtggcacggaaagtcgcgcccgccggcgcgcagcaccacgtcggtgagggtgccgctccgccggtaggcgttcagggcctgcagcacgcgctgcgcgtggcacggacccgcgcacggcgcttcgcagcccggctccgactcctccggcgc

SEQ ID NO: 33966 - DNA, 247 bp, Homo sapiens
  chr11:75294375-75294622
  hyper
cactatccttcccaccggcccgatcccgcgtcccgaggtctcgcggggccaggctgcacgggcggcggagcccggagcccggggcggggccggagatgagcctgcaggcggggggctgtgcgagtgcgcggggacgggggctgctgtttccgagccgagagccctggtagcggggctctgtgggcggagacgccctcccgagcctgggcatcttcggagtgggactctcgggtcggagttccgccgc

SEQ ID NO: 33967 - DNA, 75 bp, Homo sapiens
  chr11:75294662-75294737
  hyper
cgggtggggagcctcccattccagagaccccccgactccctgcccctcgcggcgtaggggcgccctttctgcggc

SEQ ID NO: 33968 - DNA, 848 bp, Homo sapiens
  chr11:75378401-75379249
  hyper
tggagggaggctgcacgctaggcctgcgctggggatcctgggccccgggcagcccgcggggagggtctgcgtggtgactcccccgcgctagcagcggccgcgtctcacctgtaggagctgctcactgcactcgccacctcctcgcggatttgccggttgagggcgtccgccgcggcgcgccccctgccagcctcggggccggtggcctggacctgggcctgggccgcgggcagcggcgtctgctcgtgccccaggccctcggcgcggcgcacaatccaggcaggcccggccttcctgcgcgtgtcgcgctcgtccgccccggacgcctttccggccgccaggccacccgctccgccgggggccgcctcctgctcccgggcctcagcggcggcctgcactggccagcgctcctggctctgcggccggcgcttgggcgccccgagaatgggcgccgacgcctgggaggccgcagagatctgcacgggcttggggatccacgggtggtccccgcggcgcggcagcggccaggcgcggaagtccttctggtactgggtctcgcgctcgaagggagcgtcggagggctggtattcgctgcgcggccggcagctgggctcgggccgctgcaccttccaggctcggtaatcctgccgcatcaccgagtccgcggggccggaggtggagccggagcccaggcccgggcccggcccgctccggccggggcccgccgccggctcgcgctcgccggtaggcccaggcgctggccccgttgcccgggcaactgcatccaactcgccctgggctggctgcgtctctatggcaaccgcgcgcgccgaggggggcgcgagcgc

SEQ ID NO: 33969 - DNA, 803 bp, Homo sapiens
  chr11:75379282-75380085
  hyper
cggcggggcgcccgggtgctcggtggcctccgagtacttggtgaaaaccagcggcacagcgatgtccgctttgtccaactggttccagaagcgggcgatgcagcaggccctcgtgatgcacggccacgccatgatgctagctgaaaagccggcctcctctttcttcttgtggttctaaagcaagtctctataatcttccttcagcctccgatcctgaccggccaatgtggttcccaccgttttctacccccgatcagccggagctagttcgccctcctccctcagcgagcacccggggagagctgtcctaggagagtctgtagagtccctcgattaccggtcgcaaacgcctttgggagcgcagtctgctgcgagcgccgaagggtgagacgcacggcgttcccgagtccccggcgagggtgtctgggacgcgcccctccctgcggctgcggcggcgcacagacctcggtcgagcgaggcgacgtgaggagaggtggctacaggcttaagccatggcgcagaggaggggccgggcggtgtggccgcagggtccgcggaccgggctcgagtctccttcctgccggcgtcctagtgcagccggccacctagcagggctgggaggccatcacctccagcggagaccgagcattgctgcctccgccgctgcccgcgaggatgccgcagccgccgccgccaccgcctcttctcctgggaagcgaccccacccttttctgcagctctcggtctccgccgctgcccgcgaatgatgctgcagccgctgccgccgccgcctctgcctctgc

SEQ ID NO: 33970 - DNA, 358 bp, Homo sapiens
  chr11:75863301-75863659
  hyper
aggacctttgagtcacgtctctgcctgacctcagccctgcgggccccgttcccgccattccttcctgcctctcacgttgactgggctccccctgtcggtcggcactggctgaacagccatggagtggcgctttggggaaaccacgggcgaccaggaaagatctcaggcaagcctcgggtaagtgagctgtaaactgagacctgaacccagacacagcccatgccaggccgagcgaagagcctgtgcaggggcttggagtagagaagagcacggctcctgtgaaggattcagaggctggagctgggcgatgggccaccgcgcggaggaggcgcgggcggtggtccgagttcctcaaggg

SEQ ID NO: 33971 - DNA, 218 bp, Homo sapiens
  chr11:76032896-76033114
  hyper
tgccctgcccatgcccgccccacaaggcccacgcttgcgccctcgggctgcgcagggcgagggtttgggggcgcggtactgacgggtgtccaggcctctcctcgaagggttccgcgcgcagaaaggtgggccggggccagaagacgcgctggaaaggcgttttctgccccctccgggcctcgggaatatttgtgggctgccggcggggcaggcggggt

SEQ ID NO: 33972 - DNA, 127 bp, Homo sapiens
  chr11:76382096-76382223
  hyper
gtccggaggggggcgcggtggctctaggagccgcaggtccacagaggaaatccggcctggccccgatttcccagctgctggcgccgccgcacttaacgcgggggcaaacaggcgaggtgacggcggg

SEQ ID NO: 33973 - DNA, 427 bp, Homo sapiens
  chr11:78672891-78673318
  hyper
ctgatgtttccttctcgtgatgtctgtctgtgcatctttgtcggtacatctgcctgtccgatgtctctcatgggggttggggacagaagcagccctccaactcttgcacactccagcggcgccgcggggcaagagcggggctgcctgagcccgcggagccacgtcaggcccccagctcccccggatcccaccacgcaccaggcccctccgcccggcaagtggcccaagcaggcatccgcaacggaaggacaattttaaaaacaaaccctcaaaagtaggaagagagagggacttaccgttcgccgcgacccccaggctggcggagccacttttaactaagaatgaattagggacaaactcttcctcagagtctgagtccggggttggctgggccacaccgttgcctagcaaccgcctctggctctca

SEQ ID NO: 33974 - DNA, 66 bp, Homo sapiens
  chr11:79148413-79148479
  hyper
agcgcgctgtgagtccgcaggaacgcggccgggccggggacgggagaaaggcgcggccgggaccct

SEQ ID NO: 33975 - DNA, 142 bp, Homo sapiens; identical to SEQ ID NO: 10935
  chr11:79148873-79149015
  hyper

SEQ ID NO: 33976 - DNA, 479 bp, Homo sapiens
  chr11:79149239-79149718
  hyper
cttcagcgttccccacggctgtgtcagggctggggtggcttatccccctacagacgaaaatcaagatttaaaagcatactcttactgtggtttctctatcaaagcccatcaacgtgatacacaggctgcggcgctggagggaagcggcgaaacggggagaataaacgcaacagaagcaaactgctgtctgcagaggcgagaggcgaaggaacggaagccatacccgaccccagccccatcccgtccccatcagcgccgggctagcgcaggaaaccaggaataggtgtaggtaagggtggcagcccggcagagccagcgttctactccctctaacccctcgccagcgtgggcctggatggctgggctgcctgggcatctccaagggggaccaggcaccgcgggcaggtttctaaacacgtgaagggcacagggcttgaaagacaaggaggggcgcccaggaagggcggaaaagaggggct

SEQ ID NO: 33977 - DNA, 141 bp, Homo sapiens
  chr11:79149929-79150070
  hyper
catcgcacaagtgggcgccgtggtgcgaggcgtatcctagctacccaggccggggtgggggcgccccggtacttacactccccaagcaggcaaactttcaggcttgtctttcgagaaccgggagctcgcatcacagttccg

SEQ ID NO: 33978 - DNA, 47 bp, Homo sapiens
  chr11:79150289-79150336
  hyper
ctggctgcctccctgcgcccctttcactgcgtcgatggtttacagat

SEQ ID NO: 33979 - DNA, 180 bp, Homo sapiens
  chr11:79150890-79151070
  hyper
cgggagccctccaagcgtccatctggcggctgcagcctcagttggctcctagacgaacatcaataccgcggccgggcgcccggtgaggagaggcgggcgccccgcgggttgcagagggcgaggagctggggtcgcatctccaggatctgagctccaaccaccgcccgtgcggggctgctg

SEQ ID NO: 33980 - DNA, 40 bp, Homo sapiens
  chr11:79151349-79151389
  hyper
aacagcttgcctcttcggccacccgcgccctagcctccct

SEQ ID NO: 33981 - DNA, 205 bp, Homo sapiens
  chr11:79151681-79151886
  hyper
aggaaggagcaggtccgggctctgcgctcagctccagcgagaccaacaatagctcccgcggggagcggagccccagcgagcctccagccgcgcgcgcacgaccggctcccgctcccggccgctcccggccggcgtccctgccagcactgctgccccacatgaaacagctgcaatcccgaggcttctggggggttggggcgggtgt

SEQ ID NO: 33982 - DNA, 264 bp, Homo sapiens
  chr11:79152006-79152270
  hyper
cagaaagagagggcgagcgagagagagacacacacacacacgcacacgcacacgcaggttacatgaatgggaggcggtagccaatcctacgaggccggcgagccgcgcggcgcactggcgctgggagcagggccgcactccggcgcgggggggcgccacgcaggtgatgggcgcctctccgggggccacgcgcggccgctccctcaccccagtctcggttcctctgtctccttcccccttcctctccgccgccttctccatctt

SEQ ID NO: 33983 - DNA, 30 bp, Homo sapiens
  chr11:79152805-79152835
  hyper
ctcgaatgtttggatcgtgatggcaagcac

SEQ ID NO: 33984 - DNA, 149 bp, Homo sapiens
  chr11:82443420-82443569
  hyper
tttaggagaaacccacggaggcgcggcgctctccacagccgtctctaatgaagggaagcgtgcctcgaagtcagtcccggtgcgccccctcctcccccggcgccccttcccaaaccccgtcggatctccaaaggctggaataggcggtg

SEQ ID NO: 33985 - DNA, 69 bp, Homo sapiens; identical to SEQ ID NO: 10941
  chr11:82443651-82443720
  hyper

SEQ ID NO: 33986 - DNA, 153 bp, Homo sapiens
  chr11:82444032-82444185
  hyper
ccgacgggccacacccgccgccgcctgcccgggacggctccgtgaagaaggacggaggcagattgcgtgcccgcagcgggaccttcctggcccctgggatcgccgtggcccccgcggggcctgccacgtcccctcccgcgcccccagtgcccg

SEQ ID NO: 33987 - DNA, 599 bp, Homo sapiens
  chr11:82444593-82445192
  hyper
gcacgtcccctccttcggctcccgacagcagcgcacccgccggagccccggtctcatcgtcctcgaaacagcagcccttgtccagggctccgaaggcgccccctagcccgtccggggagcccccgaagccgaagggcacgaaagggtgcgtgctgaggagcgccgcctgcaccgccatcgccgcggctcccgggctgtccgcagcgctgcccgtgcgcccccgccagctcctgcccgccgcccagacccagctcccgccccggcgcggcgcgcgcggcgcagcctactagttccgggcctggctcgctgcgctgcctcccgggggagctcattaggtcttgtaagcaaggggcggagggagggagcgcgcggcgaccgtcccggtggtagaggggaggggcttacttagcctggcttggaggagtggggggtcgctttagttttctgagctttctgaagctcaacgccttaactccttcgtttccctttgccccgtggtgtttctcttgactcctctaaccgcaaggggtgaggaagagatggctggtctcaaactccagttcaggcccatgaggccgctgcagcgcttgataggcttc

SEQ ID NO: 33988 - DNA, 83 bp, Homo sapiens
  chr11:84431452-84431535
  hyper
gcggcagtggcagctcgctgggggacccaaacgctgtgctcgccgggcacatggagcgacagcctagaccgagctgccgcttc

SEQ ID NO: 33989 - DNA, 164 bp, Homo sapiens
  chr11:84431536-84431700
  hyper
atcactgccccctgcacccgccgtggccatcccggagccccggtggaagcaacgccgcgggcaagtaccgagcctctcggggtctcccttccctggggaacgaggcgtgtggggggagggacagaaccaagaaagaatttttccccctacggtgaatttggggg

SEQ ID NO: 33990 - DNA, 316 bp, Homo sapiens
  chr11:84431954-84432270
  hyper
agtcactgtggggagcgctggccgggcaagtggggtgggaggaaggggctgagaaagggaggaagcgctgtgcttgccagactggccctgcctttgggcgctcttggtgccacgaaggagtccccagcgtgggagcgcgggacctccccgcgctgacgtgaccccgagactgcatttggcccccaccgctacagccacccgagggtagaagacctccgaggccgacttcccgggaaggggaggcccgctcggagcgcggcagggaacttcctcccagccctttgacaacagcatgccttgccgggggcagagggcc

SEQ ID NO: 33991 - DNA, 78 bp, Homo sapiens
  chr11:86085784-86085862
  hyper
cgagcgagcctttctcgcgtcccagcaacgcgcccttccctctgccgggcctattctccctggtgcccctcccttcct

SEQ ID NO: 33992 - DNA, 60 bp, Homo sapiens; identical to SEQ ID NO: 3775
  chr11:86085931-86085991
  hyper

SEQ ID NO: 33993 - DNA, 257 bp, Homo sapiens
  chr11:86382846-86383103
  hyper
ttcaggggcacagggcgcgccgggccaggcttggagtggcagccttgggcgggcgcggtgggtgtccagcgcgggagggcgccgcaggcccggcccggccagggagccagccgcgtgcctgtccccagcgcggcacccatggtccttggcagacctggcacgggagagaaagcaaggtcagggcctccttccagccagccaggacccacgcgcgctgcggggcaccgggcctgatccggggacgcgccctctgggag

SEQ ID NO: 33994 - DNA, 190 bp, Homo sapiens
  chr11:87908294-87908484
  hyper
actggaaaccggccgcgaggcgctctatccccctgaccccctccccccgcgctcacctgcgatatcccagagctgcaggcgcaccacagtctccgggtcccagtggagcaccttgagcgcgaagtccacgccgattgtggcccggtagtgcgaagagaagttctggtgcacgtagcgcttgatgatactg

SEQ ID NO: 33995 - DNA, 226 bp, Homo sapiens
  chr11:88241750-88241976
  hyper
cagggacattcacaacgacgaggagctctgagtgtaatctcttatgataagagtgtcatatttgggagacgacgggatacagagggccgactcggacactggcgagttgggggttgtgctccccgagtccaccgagtctctgaagggggacggcggggtgagagccaccagctcctccaggtctggcttggcggccgcagcctcgggaccggccgcggggctctcc

SEQ ID NO: 33996 - DNA, 145 bp, Homo sapiens; identical to SEQ ID NO: 989
  chr11:88242130-88242275
  hyper

SEQ ID NO: 33997 - DNA, 266 bp, Homo sapiens
  chr11:88242358-88242624
  hyper
cgggcgccgggaagtgctcctcagcctcggccacatcatacagcgccttggggccggcgtctggggactcgggcccgcctgggccggcgcctgcgcagcccgcaccgcccgtggcccccacgcccccagcgctcccgcctgcgccagcgccagcgcccaggccacggctctccgtgctcttggggaagggcttgatgacggccgtttggttggggttttctttcttgttgatgtggatggacaggcgctgccacaggtgctgcccc

SEQ ID NO: 33998 - DNA, 185 bp, Homo sapiens
  chr11:88798746-88798931
  hyper
aaacttgcaggacctcgtagcgttcctggctctaccagccctccacctgcccaccacttgccctcctgggtctttttagccccagctcccgccccttgcttgattgctctccatccctgcactgggggaggggctccagcggtatcctatatccgtggtaactatagccaagagaaagaaaaagg

SEQ ID NO: 33999 - DNA, 247 bp, Homo sapiens
  chr11:88798965-88799212
  hyper
cgcccccaggcagccgctcctcgagggcttcctgcgctctcgtagcggccttggctgcagctggagcgctagtgtcggcgatggaggcagcggtgacagcaggcagaacggctgcggggcccgcggcggtggcgctcgctctctcgcgccagcgccgggagcacgtgccgcgctcgggcagacgcagctggaagcgcagcgcagggctggcttatactcccgcagcgcgcggcgggggttggcagaa

SEQ ID NO: 34000 - DNA, 124 bp, Homo sapiens
  chr11:89224502-89224626
  hyper
tgccgggccgctgagcgaggaccgagggtcaaagactgagtggaagcccgaaggcccggcgccgagccagcccgggcggggtctgctacccagagccgggttttccgggcgccctgactcccac

SEQ ID NO: 34001 - DNA, 569 bp, Homo sapiens
  chr11:91957315-91957884
  hyper
gaagagattggaccacgttagctgcttagtctagttccctcctccacaaggcaatcggatgaccccaggatctcaatgtttaggaaagtcgtaggagccctcactgggaggcacatttttagtccagaggcacgacatttgatggtttaatcttcacactacaaactagccttgggacgttatataaaccatgttaacctcgatgtgcctcagtttcctctttgtcccaggagagtaacgcgttctctgtcttcacagggatgtggtgcgggtgagactcaatgcactgtgcgaaagctctcccaagccagcaagcaccacgctctccccgcggcaggaaagtacgttggtgtcatcctagagccccagagggctgagggaagactcgagctctaaaattagccgcttccaggcccggcgccgggaatgccctccagttcgccgcgcctcctccgccgccccctcccgcgcgccccctctcccctgcgccacgctcctagatcgctagtcatccccgccgccgaggctcctctccccctcgcccttttcgctcgcggtttgggaggagg

SEQ ID NO: 34002 - DNA, 67 bp, Homo sapiens
  chr11:91958196-91958263
  hyper
ctcagtcccggctagcgcgcggtgggcgctgcggcggcagcagccgggggaccggctcgcccggagc

SEQ ID NO: 34003 - DNA, 626 bp, Homo sapiens
  chr11:91958569-91959195
  hyper
ccccgcggcgggagccgggaggtttacacggagagttggccaagtttggggctgaggatctggggaggggttgcgaggggggttgcggatcagtgcacccatccccggctcccagccgcccctgcaggtggatgagaaggttcaggtggcgagcctgcttggcagccggtgcctctcgggcgcagtgggggatgttcagatgccgatggatgatgcacttaggggaccccgaggtgcaagttgggtcatcgctaggcgaggcgcggcgcagagagggagcccagcctccactttcgctaggaaagggaaagggttaccagtctgcgggtccgttccccacgcctgactcgggcttgcggggcttgtggtcagggtgagatgtagtgaacggcggcggcggctcttcgactggggacgacatcctttacggagtggttggggacagagactgtccctgctatcttgacaaggagagggaaccggaatgctttgcgagagtgcatgatttttggcgggcgtgtgggaaggctgcttgtctttgaaaagaaagcagcgcgggtctgaccatccccaggagtgcggaggagctgtctccggattgggggcgagaacgccaggggcaccag

SEQ ID NO: 34004 - DNA, 120 bp, Homo sapiens
  chr11:91959509-91959629
  hyper
catgattgggctttgcggaaagcaacttttattcactttccaccgttctcctcttgtgggcggggggtggcgggggcgtgcttggggcaaggatgcaggggtggccggagtttggctgcg

SEQ ID NO: 34005 - DNA, 58 bp, Homo sapiens
  chr11:91960056-91960114
  hyper
cctctcccctcctcccgctcctctccgcccccagactctggcgcgtttgttttccaag

SEQ ID NO: 34006 - DNA, 101 bp, Homo sapiens
  chr11:91960369-91960470
  hyper
ttctcccacttgcctcggacatattaattttctggccccgacgctagtcttttcaaaggcgagtccggggtagtgggaggaaggggcgggggagcaggcct

SEQ ID NO: 34007 - DNA, 73 bp, Homo sapiens
  chr11:92675236-92675309
  hyper
tgtaagcaaaggctccggagagctggtgaaagatgcttccttcccttctctcctaccccgacatcactgaatg

SEQ ID NO: 34008 - DNA, 365 bp, Homo sapiens
  chr11:93063583-93063948
  hyper
agagggggcactggacgtataactgcgggacagcgaggtcgcgctcgcgcggggtgaggttggaggcagccgaggagccgcacagggcagcgcctgccgccgccgccgcgcccatcccccactccgacggccacgagttcgggccgcgacgtccccatggcaacacgcggcggcgccgcgcgcggggagggagaggcccaactgcctcgttggtcgcgcggcgggagggcccaggcggcgggagcgcggcggcgggtggcggggccccttggggcgggcctggcggggcgggaggtgacatacgcggtcctgcgccctcgcctcagacctctcgggcgagcgcggcgcagcgcaggtaatggctc

SEQ ID NO: 34009 - DNA, 415 bp, Homo sapiens
  chr11:94134049-94134464
  hyper
gcgtgatcattatgtcggcaactgccaggttgacgatgaagaggctggtggccgagtgcattcgctggttcttgaagatgacatgacagaccaggacgttgccaaagagtgagaagacaatgatgaaggagtaagccacaatgagcagggctttcaccgtggggttctgggactcagcgccgtagcgcctcctgcccacaaagttctgccagtcggagaaggtgtagttgttccaagagaagaagtgcgaggcattgggcacggccagggccgcctccgcgctctgctcgtcggcccggccctcgtggggctcggtggctcgcaccaaggggaggagacagagcagcaagaggtgagggaccattttgcaggagccacccctcccctgggagcctgcgggccgggcgtcccctcc

SEQ ID NO: 34010 - DNA, 171 bp, Homo sapiens
  chr11:94134682-94134853
  hyper
cgacggtgacgcgctctggctctgacaagcctggctccccccaccctaccgggtggcgccgttgctgaccccacgcccagccgttcccactcccgcctgaaactcctccgacagggcttcgcttcgggggctcagtccccagcgcgtacacactcgcgtggtgtcggctta

SEQ ID NO: 34011 - DNA, 52 bp, Homo sapiens
  chr11:94277933-94277985
  hyper
ggctgcgcttcaacatcagcggctgccgcctgctcaccgaccgcgcgtccta

SEQ ID NO: 34012 - DNA, 248 bp, Homo sapiens
  chr11:94473423-94473671
  hyper
agcccacagaacaaacgatttcccaagcatcagaggagggcagacataacataacagagcagggaatcgggttagaacgggttatgctctgattttttggaaaatgggcaaacggggcggggactagggaggattccgccagccgggagttgggaggccgcgcgcgcctctgcggagcgtgacggccacggtcgcctagcaacgagcggggatgcgcggggcgcctgggtgggcgaggggtgctcgcc

SEQ ID NO: 34013 - DNA, 97 bp, Homo sapiens; identical to SEQ ID NO: 3783
  chr11:94473672-94473769
  hyper

SEQ ID NO: 34014 - DNA, 96 bp, Homo sapiens; identical to SEQ ID NO: 3784
  chr11:94473802-94473898
  hyper

SEQ ID NO: 34015 - DNA, 58 bp, Homo sapiens
  chr11:94474489-94474547
  hyper
ggcttctgaaacctgcgctcatcttgccgggaggacacagcggcgactggttctgact

SEQ ID NO: 34016 - DNA, 577 bp, Homo sapiens
  chr11:94501445-94502022
  hyper
gtagggttctagtgacgagcccgggcgaccctccccggcccgcgcgcggggagcggggagcgcggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaaggtaaccagcccccactcgaggtgccgggagggcgtctccgagtctcccacgcgaagaacccagtcgccccgggctccccgggcccctgctgctcacggaagggggcagcttctgggggcccggggctgagatcccagattgttgtttttaagcgggttcccttgccccgctccaggtccagttgcctgcgggccgggcctcagcgtcttgccgccccgcgacccacgttgactgaagttgtggccccggggtttgggccccggggtgctgcgcgcccgacgcggggctggcctttc

SEQ ID NO: 34017 - DNA, 15 bp, Homo sapiens
  chr11:94502757-94502772
  hyper
cgaagatttttgcct

SEQ ID NO: 34018 - DNA, 34 bp, Homo sapiens
  chr11:94884262-94884296
  hyper
cctggaccctctaaccgctcggtggggtcagagc

SEQ ID NO: 34019 - DNA, 522 bp, Homo sapiens
  chr11:98891367-98891889
  hyper
gttgcagagcagaaacgctcggggaaggggggcaggtcctctgtacttagcagggaaggaaaatgccggttgactagtgagacgagtggagaaacacagagcaccctccgggaggcgcacagttcgttaagcccagggacatgctcaatgaacctttgcagcaagaggcagtgaggcgctggacgcgggcgccggtgacagcgcgggcggccggggaggggcgaggggccgccccgggaggacacagccagtcagaggcgcggggcgcagggcgcgcggacgcattggaggaaaacacgcgagccccaaacacaccagccgcaggaggcgccgcacctacttcccaatataaccaactacggcgtgggggagcggaactgcgagaaggcggcagccaaagtgccattaaagctcggggcggagaggatgcgttacctgggtcccgtctgctgcgagaggcagggcaagctggaggattccctctgaatgattaagaactccgcaattcgcctctgccacagg

SEQ ID NO: 34020 - DNA, 762 bp, Homo sapiens
  chr11:100997659-100998421
  hyper
gctttcggttctggccggccacctctcaagtcccacccctcccgggggaacggtgccttaactcctctccaagacaagcactcctggtaaacgtccttcttctaagaaagaagcatttcataaagcccccaactcgccgcgcactttctgccccactgggctacagcggacctagtgtgacgctgcacgttttaaatcggggttggttctgcttcggaatctggaagattcggaaagttaaaaaacaaacaaaaaaacagctttcagggaggcacgccccaaaaatagtatattctgcgcccaccttcgtgtccccaagagtgaggagaggagggaagaagaagggaggcaactgcccctgtgctgtgtcccgctgcccaccctctccggccgccccggggagcgcagcggtgcgctggggctggggctgagggttggcggccgccgccgccaacggaaccgctactcccggacgcgctgggcgtgccccgtcccgggccctcacctcaggtagttgagatagggcgggtagacctgcggcaggccctccttgagcacggcggcctggtagccgagctgcgggagcccgttgaggccgagtgcagggtagagcgcgggggccgccccggcggcggcggcagaggcggaggtggagggcaggccgtcccgcgggagcaggcagccgctcgcgcccggcgccttgcagggcggcggcgcgaacgggccctgctggggcggcgcgccctccgctttgtacaggat

SEQ ID NO: 34021 - DNA, 78 bp, Homo sapiens
  chr11:100998667-100998745
  hyper
gctatagagagggtacgcgtcgtccttgggctcggcgtcgggcgggtacgcgcagtcggggaagtcgcctacagcgac

SEQ ID NO: 34022 - DNA, 88 bp, Homo sapiens
  chr11:100999617-100999705
  hyper
gagggaagagtagcccgtccagggagataggtatggccgaaacttcaggcaaggtgtccgaggtctggctccccgggaacggacctgc

SEQ ID NO: 34023 - DNA, 428 bp, Homo sapiens
  chr11:101453090-101453518
  hyper
tagagctgagaacctcgggaaaccgcttgcgggtggatgtgacaagtcaggaaacttgactacccaatcacccaaaggggcaatgggacagaaatgctatctgcccgctgcacatgtggtcacagcggtgtcggggaagcggagtcttttcttctggagtccactctgcttactccctacctcccctcccgccacccacccagctaaaaaaaaaaataccctagattcataaacaaaagcttgcagttacccacagcccaatacaaacgacccgacgccctcacttctatagcccgtgagtctcccagcccctaacaggctcgtctccccagacgccccgggtgaaaaggttcgcgccgccggtggagagtcctattggttctatttctgtcttcactccaaggccccaggaccggggagaggtcctg

SEQ ID NO: 34024 - DNA, 187 bp, Homo sapiens
  chr11:101454510-101454697
  hyper
gggcagagagggcacaggcggggccgctggtggtagcgaagcgtaagagcggagagcaagggagacggagctgaagagttactatgtcaacagagactctccagccctcagctcccgccttcatcccccgcactctccgtcaagatccccacctttaaagggatccgagcgacgttctagaaagcag

SEQ ID NO: 34025 - DNA, 154 bp, Homo sapiens
  chr11:101918352-101918506
  hyper
tcgcggctgtggaggcgcaggccgggcgtcgaggggcccgcgcgggtcggcgccattctgagtgaaccctgaggcttcctgagtgaaccccgaaccacccgggaagggcggatgctgtgggtgggatcggttatcggtgcgctctgagagggtg

SEQ ID NO: 34026 - DNA, 30 bp, Homo sapiens
  chr11:102980458-102980488
  hyper
ggtgcagcgatccgacgcaggaatctcctt

SEQ ID NO: 34027 - DNA, 34 bp, Homo sapiens
  chr11:104034042-104034076
  hyper
actgctagattgaaacgcacgatttctcctctca

SEQ ID NO: 34028 - DNA, 345 bp, Homo sapiens; identical to SEQ ID NO: 3787
  chr11:104034409-104034754
  hyper

SEQ ID NO: 34029 - DNA, 463 bp, Homo sapiens; identical to SEQ ID NO: 3788
  chr11:104034755-104035218
  hyper

SEQ ID NO: 34030 - DNA, 312 bp, Homo sapiens; identical to SEQ ID NO: 10977
  chr11:105481005-105481317
  hyper

SEQ ID NO: 34031 - DNA, 1 bp, Homo sapiens
  chr11:105481318-105481319
  hyper
c

SEQ ID NO: 34032 - DNA, 2 bp, Homo sapiens
  chr11:105481320-105481322
  hyper
gc

SEQ ID NO: 34033 - DNA, 238 bp, Homo sapiens
  chr11:105481323-105481561
  hyper
ccagtgtttgtgtgtatgtgagaaagcaaggggcgagcgcgagtgcgagtgaggcaaagatagagcgcatgtctcatccctgcgagcagccactagacgctccaccaccatcttttgcatgtgcaacatttgcagccggacagaaaacctctcccagggctatggagactgcgggaaaaatctggcggctcgcgatggattgctaaggagaactagtcataatcttaaaccaccgaaa

SEQ ID NO: 34034 - DNA, 256 bp, Homo sapiens
  chr11:105481621-105481877
  hyper
attttaattttagcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtaaggtgtgctccgatggggtgtgcatgtggctggttgtagcagatatccgaaagtgagttaaa

SEQ ID NO: 34035 - DNA, 808 bp, Homo sapiens
  chr11:106888283-106889091
  hyper
tgtagtcccctcttccgccctagcctaggggatcctctgtcgccggagccactggaaccctaggccgtgcagggtaaggccgggccgccccccagcggtcgggctctgcgctcgcgccccggctcgcccagcgccaactttacagatccgcgttctctcccccgaaggcggtccccccttccgccccccgctcaccgagggcgccgtcaggcggctgatgctctcgcccagcgagtccaggttgacccgcctccggcgctgcaccctcctggccccggcagtggcagcggcggcggcggcagaagcagccggggtcggggccggggcggcggcagcggcagctgcggccgggctgggctccagcggcccgggcgggctccggctgccattccagcagagcctagacagggggcactccccctcctcctccgggctggtctccaggtagtcggagcccagggagctgaaggactcggacgaaatcttccttcgagacatgctgccggcggagctgcagcggccgaggcggtggcggcgaggacgcgagcggcggcggaggcggcggtggcgggaccggcaagcgacaacgttaagcgcgtcggggccgcggggcgctgcggtcgcgcccggcggggcgggagtccccggggccgcggagccccccgagccggctgctcatggcgggaacttggggcgccgccgcaccttggggcccgggctcggcggcggcgccgggctgggctgggggccgccgccgcctctgctgctgctcgcgcggcgccgcctcagcgcccgcctcggcgcatcg

SEQ ID NO: 34036 - DNA, 32 bp, Homo sapiens
  chr11:106889400-106889432
  hyper
cgttgctgtcctctgcgcgccctccctgctcc

SEQ ID NO: 34037 - DNA, 494 bp, Homo sapiens
  chr11:106889690-106890184
  hyper
ccactccagaggagacgctttcaggggaagggaaggacaggggcaacattttggcgcccatcctgctggagcagctcctggggacttgtgttccccgcctcgtgcgaggccgtgtgggcgcggagcgagcccagaaaggggcggcagtgaggacagcgtctgctctgacaagacagcactgttgctgagcctcagccgggcggggtgcgcggggctcccggctccgctggctcctcactagtgctggacagctccgcttgccacctatagccgcctttgcaggcgttgagaactggagaacagttcctcctcaaacgacctagcacctggcccgggggaaaccggggaatgatcccacgtccctcatcctcagggctctttgcgccaaatatgcgatctgtttgcacctgactgcaaatgctgctcagaaagctaaggggagtagggataaatgcttctcgaactgactcgccacagcgcgagcatgtcttgcc

SEQ ID NO: 34038 - DNA, 847 bp, Homo sapiens
  chr11:107461623-107462470
  hyper
tcaccatcttcctgtcgtgggctcctccagggaggccacccgggagcaattaaactgggccacaccagccacctcccacagcagcggggtccgcagatttaaccctttccccccagattccggcactgggtgccgcgctctctcccccagcaccgcgcccgcgcccccggctcccggactgggcatgctcagtagccgcccgcttcgtgctcccagggaagcctctgcacgccctcccccgctgctctcggtcgcctcctcgccgccagccgccccgggtgcatcccggcttgctccgctccacgcgacccagattcctgccccgcccccgccccttccgcgcccgcagccagtgcggcagccgcggccgcccctgtccagcctcggcgcccgggaccgagcgcgtcgctcgccgccgcggagcgcgtagccggagcgcctggggaaggcggagatgaagaccacgccgccgcgcgccgggagctgctgagcctaccgccgccagagtccaggtgattggcgaccccagaggagcctagggagtaggggcgaatgcccttggggaggagagaggtgcggcgaggacgcgaggcatcacgcaagctgcgctgtgcctgggaggcagcagaaatgctaagcatcgggggcagagagggaacgggaatgaaagtgcactctgccttggtgcaggggctccggggtcacccaggacagtgatttccccttctatcctgtcctcccaattaacacccgagaggctgcaggtcggcgcgagaggctgtttgcatctcggcccgggcgtaggtcgcctagcgacctaacgccgagggctcggggaagggatccc

SEQ ID NO: 34039 - DNA, 499 bp, Homo sapiens
  chr11:107799306-107799805
  hyper
tggatctaccagttccgcctcatcgtgatcggggactccaccgtgggcaagtcctgcctcctgcaccgcttcacccagggccgcttccccgggctgcgctcccccgcctgcgaccccaccgtcggcgtggacttcttctcccgcctgctggagatcgagccgggcaagaggatcaagctacagctctgggacacggcgggacaggagcggttcaggtagggaccccggggaccttgggcaccgcgccgccccctcagcccgcccggacgccccttccccaggcgtccgccccgccggccctggtcgggagaggctctggcccttccctctcgaaagtgcaaacactccattctcgcttcccctttgcccctcctcttccagggacgacttcctcctccgcaatttctcacttctttctttggcgcccatttcctgcgccccctttccatctttcctttcccgcctgaaccggggtcgtcctcgccgccccctcttcccc

SEQ ID NO: 34040 - DNA, 30 bp, Homo sapiens
  chr11:107800015-107800045
  hyper
cttcacagcaaggagcgctccaacccaggt

SEQ ID NO: 34041 - DNA, 43 bp, Homo sapiens
  chr11:109292787-109292830
  hyper
gcggtggctgcctgacgtcaccggcctctctggcaataggctg

SEQ ID NO: 34042 - DNA, 284 bp, Homo sapiens; identical to SEQ ID NO: 10988
  chr11:109292891-109293175
  hyper

SEQ ID NO: 34043 - DNA, 258 bp, Homo sapiens
  chr11:109293506-109293764
  hyper
agaagagatggagcgcgttcctgcgcgtcagccgcggtcgcggacagaggcagagtgggatgtggtgccaggggtatccccctgggaatgggacccaagggatctgacgctgtccagggagggcgagtctggacggggagggaaaggaagggaggactgcgtacccggagcccgcgcggcggcccggagtgggtgctgggaagggtaggatccaggcgaagacatcaaccgagagggcgcagaaaagaggagagccgg

SEQ ID NO: 34044 - DNA, 26 bp, Homo sapiens
  chr11:109293873-109293899
  hyper
cgcggtgccggcgcagaccccatcct

SEQ ID NO: 34045 - DNA, 51 bp, Homo sapiens
  chr11:109294138-109294189
  hyper
tgttcgaggtggtatcggcgaggatctctcgggcgccgctcactccttggt

SEQ ID NO: 34046 - DNA, 647 bp, Homo sapiens
  chr11:110581773-110582420
  hyper
gcgggggtggggaggcgggggacaggcagacagggctagaaacacccaaatcaattcctcagggagcgaaacggcagaggccggcagcccgcggcccacgtgcacttgctcagggaaccgttccagcgaaacctgacccggatcggaatcctcccgcagcacagcggccgtgtttatcggaatggaacgctacaagttgtcacctgcatccctctcccagctttgacagggaacacgcgctgcccccacgcccacaccgacacccggatccctatccagcccggccagagtcccaggggccagggaccagtgcagggagaaggtcccccacctcagccctcaggacccccaaccacagcccacccgcccccaccctgctcggttctaggcccagccgaacctacatgtccccgtagtgtcgagcgttatcatccacagtcgcccctcaaactgtgacccccacctgggagacccggaatcatccaggaccctggtgtggggggcagtactccccatatctgccccccgaaaactgctatggagcagccgcgcctcggcgggcaggtgagggggccgagcccaccagcgccgcagccccgctgcctaccttcttcagcgccggctgccgctcccgggcagacatcgcc

SEQ ID NO: 34047 - DNA, 608 bp, Homo sapiens
  chr11:110582421-110583029
  hyper
gccctgactttggggctgacaccgccaaagggcagtcagtgctcgcccaggccacttcgggaggcccaggggcacggcgaggggtcggggaaaggcgatcgcccactacagcccgcgcgcctagactgagggaggagccgggctgcagaaccggcggcggatggagacgggagggaggctgcgaggtcgctcgaggagagactaaggctctagaaacggagaagcgggcgctctgcgggaggcggcggcgctgccgctggccgtcaagggcgggaagtgttctgggactctcattaggggccgcgagcctcgagcgtcaaattcccgcggcgtccgcctagcgcgctgctgtggcgggcgcggagggcgcgcgccggcagtgggggctgcggcggcggagggcacgggcccccgctcagcgtcctcaccttcttggtgcagctgcctcccgcgagccgagacactcctgtcagggaagaggagcgccccggctgtccccctagagtctcctgctggggggacatcgcttccatgaagaaaatcttcaaacaaatcccagcccaggaggaggctacacgatcatgtccgcgggctgccggccggagggg

SEQ ID NO: 34048 - DNA, 1109 bp, Homo sapiens
  chr11:110583043-110584152
  hyper
cggaggcgcggctgccgtgctcaggcagggagccgagctccgggtgctcgccgcgcgcctcccgtcggggccatgtacctccgcctgcgctcgacaccgcgggctggaggcgagtgcagcggcgacagcccgtcagcgccgcggcccgccccgcctcgggcccgccccctccgctccgggcgccctgcgccggggcccgcccccgcagccctcctcagccctcctccagcctgggccctcctagcctcgtcccagcctgcggcgcgcctggcgggcgtctctctatatatgttagcacaccggccaccggctgaccttttcggtctgtgactccgcgtgggtgcagcccgcaggagctcatcggcctgtgtcacgcacgggggcctctagtgcacggacacgcgcctctcccgccacctgcccactcccaccagaccccatcccttcccgcgccgtgcccgcggcggaaggcgcccctgcagcgcgtgcatccgcggagcggtggcgacctcagcctgagcagaggagttgcagtgattcctgcctcgctttcagcggactgcggagggaatcccccaccccaccccactggggatagggtggcacgtcgcagagtgtcgcagctgtacaaatttggaagcccacagcatcgcctgacctcttgtgcaatcccgaacgctagcctgttcgggtaaccctgagtgggcttctgcagccggtcatgtcagcggcccctgcacatttgcacccgcggtttccgctgtctgcaggctgcagagacgggggcattccaaacgtgaaagagcaatgaaggaaaatgcagacagagcgaggacgccgaaatttggctaagctattgagaaggctacaatatgtggaagtgtttatcagatatctgcgccgagagcataacttcctgtcagcccaaatagaggcaaaaatattttaaaggccaaagaataatcagagggagaggatttggagctgacccgcgttgagctgagtgttgctgcactttgcggggctggttgactggtacggatgattcggtagatggcattcttcccttggagtcaggactagagaagcagtggcggattagtgaggaa

SEQ ID NO: 34049 - DNA, 35 bp, Homo sapiens
  chr11:111170024-111170059
  hyper
acccagcgcacttcccggcgcgattcctggacgca

SEQ ID NO: 34050 - DNA, 390 bp, Homo sapiens
  chr11:111383125-111383515
  hyper
ctcccccacccgccccgtctcgcgcccgccccgcccctcggcccgcggggttccaaggacggttggtcgcccccgccacagtcactcggccgctcagagcggcggggcgcacggggtcgagagagccagctctagggtttggggctgggaactgaagcctggcgtgaaggaagtgggagcccgggccgaggaggcgaaggggaaaggaaaagcgaggggaacctgagcgggagggccctgagaggagcgggaggctgcgggaaggggaggcctggcactcctgggggtcatgggggtcggggcgcggctcccggcctgggagggcgcgggtcctccccggcagcgccgcccgctggcccagctacgcgtgttgtgcgctgcgaggccggc

SEQ ID NO: 34051 - DNA, 16 bp, Homo sapiens
  chr11:111383516-111383532
  hyper
ggggtcccgctgggcc

SEQ ID NO: 34052 - DNA, 348 bp, Homo sapiens; identical to SEQ ID NO: 3793
  chr11:111383557-111383905
  hyper

SEQ ID NO: 34053 - DNA, 30 bp, Homo sapiens
  chr11:111385419-111385449
  hyper
ctggtaccaacttggcggttctcggagggg

SEQ ID NO: 34054 - DNA, 16 bp, Homo sapiens
  chr11:111411183-111411199
  hyper
gattgcctaggggccc

SEQ ID NO: 34055 - DNA, 382 bp, Homo sapiens
  chr11:111411200-111411582
  hyper
actgaagtattcctccgcccagcgcctcgggcaaacgcgggatctcccagggaagctcggagggggacagggagctggttcccctctgcgactcgcccctctctggctggccgagtgtctggcgccaacctcgctggaggaggctgtcgggggcgggccagccagcggggctgccctcctcgcagtgacgtcccagggggcggaggggcgaccgactgactccgcgccctcccccccgcctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaac

SEQ ID NO: 34056 - DNA, 435 bp, Homo sapiens
  chr11:111411821-111412256
  hyper
cgtctgagacccacgccagttcccggagctgcgcagttccctgcgcgtcctggaacgctcgaagcccgttcccagtccagagttatgggggtgggttggagaatgtaggagaggtggggcagtgggcaaacctgccccagtgggtgccccttcggcccgctcctttacacgcatcgaatcagtccttgggaccacccccgcggggcaggcttgccagctggcccccgcctaccgcccgctccgggaggcggccgcagagacagcggggtagggatgctggatccccggtgccgtgggaaccctgcctgttactcctcgtctcttctgcggggttggatggctgggtcgagcgcccggtatgagagcgcttagagatcgggaaagaactccagttagtgtgggacgagccccacctgactccggggaatgactctc

SEQ ID NO: 34057 - DNA, 30 bp, Homo sapiens
  chr11:111412594-111412624
  hyper
ggccctcccacccttcgccttcctgcaaat

SEQ ID NO: 34058 - DNA, 137 bp, Homo sapiens
  chr11:113345029-113345166
  hyper
ggtgtctcttgtctccgcataccaccctagaggggctctcggtccatcatagagccgggccgagagccgggcggtcaccctccgctactgccgccaccgtcgcctgcactgccgggtagaaacgggtctggcaccca

SEQ ID NO: 34059 - DNA, 320 bp, Homo sapiens; identical to SEQ ID NO: 11002
  chr11:113345418-113345738
  hyper

SEQ ID NO: 34060 - DNA, 102 bp, Homo sapiens
  chr11:113346239-113346341
  hyper
gatccccggcctgaacgggtaggaggggttgggggattccgccatcccttgttttgaggcgggaacgcaaccctcgaccgcccactgcgctcccacccacac

SEQ ID NO: 34061 - DNA, 181 bp, Homo sapiens
  chr11:113929598-113929779
  hyper
gtttctcccaggactcgaccttggcctccagcaatcgcgacagctaaaaacgggtgtctcgcttcgacaatagatccccgcggaccttctggcacctggttcactagcgcccgcgaactctgcctcgggagacttattgaaatccggatgctcaagccgggaggcgcgcagtaaccaggag

SEQ ID NO: 34062 - DNA, 32 bp, Homo sapiens
  chr11:113929995-113930027
  hyper
aggtgggggctgctgcgcgcccttcaccctca

SEQ ID NO: 34063 - DNA, 352 bp, Homo sapiens; identical to SEQ ID NO: 11005
  chr11:113930374-113930726
  hyper

SEQ ID NO: 34064 - DNA, 34 bp, Homo sapiens
  chr11:113931033-113931067
  hyper
tgtgtgtttattcgccggccggctgggaagctag

SEQ ID NO: 34065 - DNA, 354 bp, Homo sapiens
  chr11:113931343-113931697
  hyper
cctttcccaccctggcgcgcccgccgctagctcgcacagcgcctcgcacactcccgcacgcgcttgaaatgcgcacggtcccgccggcccgcggaaccacccggacgcacggagcgctccgcaccgactcgctcgccgcctccccgagacgctcgcaccgtgcttgggccgggcgcgctggccgctggcgccgctggccagaggcctgggacccagccggtcgctcccagggggtcacggccctgggtcggagagggagggcgggcagaccccttctcgcctttcctcccacaactcgctgcggggcttttgtgcttccccttcgccgcggggcgggtccgcctcccctgccgc

SEQ ID NO: 34066 - DNA, 30 bp, Homo sapiens
  chr11:113932041-113932071
  hyper
aggcttgtttcagggcgccaagcttccatt

SEQ ID NO: 34067 - DNA, 30 bp, Homo sapiens
  chr11:115373239-115373269
  hyper
aagttgtaaccacaccggcatcggctgaac

SEQ ID NO: 34068 - DNA, 792 bp, Homo sapiens
  chr11:115373755-115374547
  hyper
tcgccgctcgcaccccgcggccccgtgccactcggtcccggcgcccgcctggagcctgcagcaggggccagaggacgccgcgcggctgccaagcgcggcgaggtggcgggaagggaggctgggtgcagcacagccggcctctccgctgaggaagagctccggctcccttttgttagcaaaagcaaacactgccctcttctttcccgaccgcgccaacgcgcccggcacacgggcagccacacatcgggctccagccgagtgctcggtgtcttcagggaaggcaccgggcgtgcagagccgcccctgggcaaattcccaagactgctcttcacgcagggagcgcgcggaggcccgcagggtgcccgcctggccgcagaggccgcgacgccccctccgccaccctcgggccgccgaaagaacgggcagccgggaaatcccgtgtccccactcgtggcagaggacgctgtggggcgggcgggctgcgggctcccggcgccttcccgcagaggcggcgacagcggccgccccccccgcggggccgggccggggaactttccccgcctggagccgggccaaaaagacccgcagcagagccgagggggcggagggctgcgaacggccggagggaaacacgagaggcgtgcagtttggggacaggggagaaaggcagagcgcgttgggggaaggggcaggggagatcagacaagtctggggatgtcctggggaccggggagaaatcacgccgcgggcggctgggagtcagccaccaggaggcttcggggatggagaact

SEQ ID NO: 34069 - DNA, 249 bp, Homo sapiens
  chr11:115375185-115375434
  hyper
gacatgcgctggaggcggagtccgggcagaccaatcacagcgccgcgagcccaacccggctctcggagggcctcgctccctcccccaccccgccccctggcgctggcgttcggcggcgcgcccgcgccacctaggggcggggccaaggggaggggcgtatgcaaatatgtttatgttaaaattcgggttttgctttccccggatcaaggaaaaagtgttctcccgggcgcctggcgtgcaaggactcgg

SEQ ID NO: 34070 - DNA, 72 bp, Homo sapiens
  chr11:115530024-115530096
  hyper
ggtgctctcgggccacggggaagggacactcgggaaagacaccagagaccgggagggtgcagctgggctctt

SEQ ID NO: 34071 - DNA, 201 bp, Homo sapiens; identical to SEQ ID NO: 994
  chr11:115530221-115530422
  hyper

SEQ ID NO: 34072 - DNA, 63 bp, Homo sapiens
  chr11:115630411-115630474
  hyper
ccccttctccagcctcgcctccccaatgcgcttcccgcctctgcatcgccgccggccccttca

SEQ ID NO: 34073 - DNA, 99 bp, Homo sapiens; identical to SEQ ID NO: 3799
  chr11:115630530-115630629
  hyper

SEQ ID NO: 34074 - DNA, 259 bp, Homo sapiens; identical to SEQ ID NO: 3800
  chr11:115630630-115630889
  hyper

SEQ ID NO: 34075 - DNA, 474 bp, Homo sapiens
  chr11:115630890-115631364
  hyper
gcggccgggtcatcagaagcacagtggagccgccccctgctttgggaggagcaaaagagcctctcgcttgcctcccgctcgagctccttctcctcttccttttcctagcgcttctctccctccctcggcggggtccgcagagacagctgggcaggcggaggctgcgcgcctctcgcacctccacgcccaccctcccgccgcccccccctcggcctgaaagatctgcgtccacaccaccctgcacccagggcccgtcaggttttgcagaagtttgctgagggtcctcacagggggtctcccaggggaaggggtggagggctggaggggccgcggtgggaagaggtggcagacgccgcctggcaacggagaccctaccctttctagaaattcagaacgcagagaaaccagtgcccagccctgctcttcagcaaacggtgtatttcagcccgagtttccttccgggggtttggctgt

SEQ ID NO: 34076 - DNA, 35 bp, Homo sapiens
  chr11:116451313-116451348
  hyper
agacctggagctttgcggttcgcggcccgggttgg

SEQ ID NO: 34077 - DNA, 264 bp, Homo sapiens
  chr11:116706504-116706768
  hyper
gggggcggcggcgggcgcctcactgggtgttgagcttcttagtgtactcctcgagagcgctcaggaagctgaccttgaagctctccagcacgggcagcaggccttggcggaggtcctcgagcgcgggcttggccttctcgctgagcgtgctcagatgctcggtggccttggcgtggtactcggccagtctggcgccgccgttctccttgagagcctcaaggcgcgcggccaagcgctggcgcagctcgtcgctgtagggggcca

SEQ ID NO: 34078 - DNA, 227 bp, Homo sapiens
  chr11:117667351-117667578
  hyper
ctaggtcaagagtcacggcctgaggacccctcgactcggagggcactccggggtcccagtgccaccaagccgcaggaagagggcaaggggctgggggaggggtccagggcagaactgccgccgtgcagggagcagggagatgaggggctcctttgccaccacccctacgggcgcgccccaaaacggcagacgcgggtggctggcggagcggtcgggggctgactctc

SEQ ID NO: 34079 - DNA, 197 bp, Homo sapiens
  chr11:117667865-117668062
  hyper
cagcgcgctcccagccgcccgcactcggcgccccgctctctctgctcctcagcccagcgctcggctgcggcggcggctcctccctcctcggctccccggctcctgtcatccgcggggctgggctaggcggccgctctccccgcccccccgcggcaccccgggtggtgagcgccgcgcgagcccggagcccagacgga

SEQ ID NO: 34080 - DNA, 178 bp, Homo sapiens
  chr11:117746361-117746539
  hyper
cccagccagacagcacgaagccacagagacaaaggaagtagtggcagagagcacactggtggggagaagcctccagtagccacggtcccgcgagcgtgcaggcttgcagcaggtgacgcggcagacccatgtttccagcgaggctgctcccagctcccaccctcgggtgcctcctcta

SEQ ID NO: 34081 - DNA, 220 bp, Homo sapiens
  chr11:117747536-117747756
  hyper
tgggtagcggccgcgcgcagaccccctctcctcctctccctgtccgtcctcccgctctgtgctcgcgcgcgtcctctgctcctctctcctctcgaggggcggagagatttttccaaagggcagtcaagctccgagaagcaacaggagactgccgccgaggaggcgtgcaagcgccggagcggatttgccatcagctgttgcttttcggtttccctctggt

SEQ ID NO: 34082 - DNA, 64 bp, Homo sapiens
  chr11:118024161-118024225
  hyper
caccttctgccccatcgctcagcaactccggcggttgttttaggaagcccggaacagagctttc

SEQ ID NO: 34083 - DNA, 90 bp, Homo sapiens
  chr11:118663112-118663202
  hyper
gaagagttagtagggcgcaaccgtcttctcctgccctcgaagggcaagactgaagaaagtaggggcggaggaggccgggccctccactaa

SEQ ID NO: 34084 - DNA, 52 bp, Homo sapiens
  chr11:119191797-119191849
  hyper
ccataaatgctcaggcggctgcgggtggatgggcgcgcggggagcctggggc

SEQ ID NO: 34085 - DNA, 510 bp, Homo sapiens
  chr11:119210471-119210981
  hyper
gcaccgagcactccccggcaggcccggtgggccccgcgggtcccgcctctcctcgcggcccggggtcccctcgaggtcccggcagtcctgcggggtaagcggggcggcagggtgagagtagcggcggctcagcccgcagcggggcggcgactctaaggtcaccgtacccctccccgcccctgcctgagcttcggccagcgcctcctcccgcacgggtacctcctccaccccttcccgcagggcagatctggggggctggccaagggggctcccgccgcctgggcccctcccccgctcagggctgcaaagcgcggggagtggcgccccctggcgggagacccgagtcccggacaccgggagctggagctgcggccgcgcctgctcggacatcgccaccgatagccgcggcggtgccttcttacccggcctcccgccctcgcctttctctcccggagccccgggcgcgccgtcgcggccgtcgcggccatcgcggcccggcaagccctggct

SEQ ID NO: 34086 - DNA, 44 bp, Homo sapiens
  chr11:119211198-119211242
  hyper
cctctctccccaccccggcgcggcccagtcggtccccaccccac

SEQ ID NO: 34087 - DNA, 83 bp, Homo sapiens
  chr11:119234852-119234935
  hyper
ccgcctcaacctccccggcgtgcgccgccaacagcccgggtcccggctctcgcgctccggccgactggcggccccgccggcgc

SEQ ID NO: 34088 - DNA, 40 bp, Homo sapiens
  chr11:119292779-119292819
  hyper
cgcagggcattgcctcggttgagtgcgcccgggtgcgcag

SEQ ID NO: 34089 - DNA, 15 bp, Homo sapiens
  chr11:119293305-119293320
  hyper
agctctcccctcccc

SEQ ID NO: 34090 - DNA, 33 bp, Homo sapiens; identical to SEQ ID NO: 11021
  chr11:119293352-119293385
  hyper

SEQ ID NO: 34091 - DNA, 562 bp, Homo sapiens
  chr11:119293386-119293948
  hyper
cacccagcccgccgcgaggtcacccggcagattccctctagctcgccatcctccatcctctccccgcagtttcatccgtcctcctccccgcctctgcgagctgggtttggggacgtctgggtggaatgtagacccacaggctgtccttggtgcccttcctccctgttctccagcgccccagccccagacaccagtcccccagcgggcgaaagcccgggagcgccttccccgaaagacatcagggtgccacgcggcccctgccctgcagaagcatccccctcccgcccctgcctggaaagcaggcccctccctaagctctgcgcccttcttccctgggcgccctcggaccgtggcccgaagcctagtgttgggaagtcttgcatgggcgcctgacggcggtccccgagccccaggtcccaccggctccagttcccacctggactggggtcttccgctgctgcagcctcctccagacgcgccgccgcctccggttgctgcacccagctcggagcccgcagttttcaccggggatggaggagagggggagcggggagccgggggc

SEQ ID NO: 34092 - DNA, 146 bp, Homo sapiens
  chr11:119612122-119612268
  hyper
gcgcctgggaccctgcggggcctcctggaggcgggacgggcacggcgccacctagcggtcgtgggccgcggagagagcgtccctgtccttccccgtgtgggacctgcaaccgccccatagcgcagagtccgggaggctccagccac

SEQ ID NO: 34093 - DNA, 109 bp, Homo sapiens
  chr11:119612323-119612432
  hyper
cgtacttttactggggtacggggagccctgccccacggctgtcagctcgggtcgggcgcgccgggtgcccaggaggcagcctcccaccctcccccgcacacgtcgttcc

SEQ ID NO: 34094 - DNA, 442 bp, Homo sapiens
  chr11:119612977-119613419
  hyper
acacacagaggcacacacaggtacaccccgcctcctgccgcgcctgacactccgcagggcccgggggtgggtgggcaggggtgcgagggggcgtggggctgggcgcgccggcctggggggaaagccccgcctcccggatgtcgtctcttcgccccctactagctcttgtctcctccccaacccctcgccccaccccctgcctaatttttgccagtggatcatcggcctttggatgaatccgcagcaaatggctcattcggggcgggcccgcctccccatccccccagtgtgcggtctcctctccccagcaaagatgttcggtggcacttacggcccctttttaacaccaggcgaagccaatattgttaggaaggaagaactgctgtggcagctgctgcaaagacaaatcatatgcagtaatgcatcacgggctgagggaggg

SEQ ID NO: 34095 - DNA, 94 bp, Homo sapiens
  chr11:119884295-119884389
  hyper
aagttgtgctgctgccggtgctcggatggaccccggggagcagcagccactgctcagagcagtctgttttgcctgttgccggaggctggggggt

SEQ ID NO: 34096 - DNA, 118 bp, Homo sapiens
  chr11:120110849-120110967
  hyper
gtgtggcaatcctggcggcgccgagtgttgcccgggccggagcagcggagcgcgcgacagtggcggcgacggctccggcagcggctcccgcggcggcggcggccgggaactggaggaa

SEQ ID NO: 34097 - DNA, 131 bp, Homo sapiens
  chr11:120382817-120382948
  hyper
ctgcgtctccagattcgccgccgaaccccccaccgctctgctcccgtagttcctccagtcttcaccccggtccgtctccctccctccgcatcccttccccgggctcgcggtcctcccgctctggtcctccc

SEQ ID NO: 34098 - DNA, 476 bp, Homo sapiens
  chr11:120435401-120435877
  hyper
gcaccctaaagggcacggccgccgccgcagcaggtaattagctggaccgcggcggagcgcgcggaggtggctgctggctgcaaggactgcgcccagcctccgcctcgcccctcgaggctcccgcgtgggccggcgggcagtgcgtgggccacaggaagcgggctgactggacccggctcaggacttcgcacaagggcagctctttgtttacagctcctctcccagctccccgctttcctttcgcccaccgcctcccttttccggcgatcggctccgccggctgcgggggggtggggggggtggggtgtcctgtgtagccgcccacctcctgtcccggcctcgtgctcccgctggggactgtttgcggtgagtctgtcgcacgcacgtcagggccgaggcagtgatgcggggcagcgtgggaggacgggctgcggagcccgcgtcatcctgcctgtggggagcgctgtgcctgctct

SEQ ID NO: 34099 - DNA, 129 bp, Homo sapiens
  chr11:121298044-121298173
  hyper
gcgcccggcccagcccggcccgcccacctcgcgcggaaacttcgagctgcgcagccgccgcgccggcgcctccccagcaaagctccgctaagtgcggccggcgggggtgcggggcgttgggcacctgac

SEQ ID NO: 34100 - DNA, 163 bp, Homo sapiens
  chr11:121593473-121593636
  hyper
ggggtggggggcggccggagagaaggggcccgcgtctccgccgcttccatcaccgccctggaaatagcatctgaacgcgcacggcccgaccaggcttcccccaagctgctaagatttcatttcacctccgacaggcttcatggggactcgctgttaaaagatc

SEQ ID NO: 34101 - DNA, 1143 bp, Homo sapiens
  chr11:122847170-122848313
  hyper
gaaactgcctagggccgaggggagggggcgtacgcgtaggagaacgcggtggcaaaccattcctggaaacgcgtgatcattcccagttttgccctgcgagcctacaaacccggtaaaagaataagagacctcccaggggaaaaggagaggggtaaagcgcaaagtcaatcagacccccgccccatctattccccaaacaggtgcacgcccggaacgcctttagccttaaccctttggccttcatcttgatttcctaaaatgcactgagaatgaatatttccacacacaacccgaggaacactcacttttaaaatatcagtagcccgtggaacgtggaagcgttgcgggacaggagcgcaacaagttcgggaagcagaaattgctctaggggttttctgtgcccaagtttcccgccgcgcgctggcgccgcgcagtacgcgggaggcagggcgtaaggggcgtctgcgcctgggggctacaaactcaggaagggtgccaggatgcagaaccgcgagctctagaggagaacagggacgggagaggatggaagcgccgcccagagaaggagggagtcgccttagtatttgagtcagagatgggactctggggatgggggatgggggcgagtgggaggttagtgacgagcagtgcacgagtctgtcctgaaactggacgttttaaagatcagattgtggttctatctggatctcggcggagcggaggccccagagacctggtccctttgcagccaaacggactgcccaagaacgggcaaggacttggcgtggagaggaaagaacagagctaggggcaagttgctgaaaggcgagggagaaaggggtctatgatcggagaaaacagagagccgagagctgaatttccagtctgggacgcggtacttgggctggtccctgaccccaaggacgacggacgcaggaaaatgggcgcccgggcgcacagtctcccgtggctgggaccgggagggctagaggggaggcgggaggccgggccgcgggccgtgctggctccgcaccggcctggaggacaggtgggttttgtttgtcttccaggagcggatttccaaggcccgccacgagactggagtctgagtcttccggtccaggagggaaccgcgctcggccc

SEQ ID NO: 34102 - DNA, 391 bp, Homo sapiens
  chr11:122848368-122848759
  hyper
cggccctgagcccagctccccctcgtctccaatgtccacctcgtcctctggctcggtcagcacgaagggaccggcgggcaggctcagccgagcctcggcggcggtggcggcctctgaaccgcgggggctgccctcggggctttctggcccgtctggtgctttgggttcgtcttggcttttccgcagttgctttttatgcttcatccgccggttctggaaccacgttttcacctgatttcggggagataaaaataaaatcatgtcattcctccaaatctgagccatcgctggggtttaggaaaatgggctgcagtccgttgatgaagtatccaagagcggtgatagcctcaactgctcataagttatcgccttaagccgaatgagaatcgaa

SEQ ID NO: 34103 - DNA, 331 bp, Homo sapiens
  chr11:122849793-122850124
  hyper
gagccaccgcgcccggccaggtgtaggtaattttacgaaagctcttgggaaaggcttagaataagcgtcagcggggtctatttctactcgaactccacaaggtcccgaaggtattaagacttgaaggcagagaggaacgaagcagagatcagggcctccctctcctcccgcccacctgcgtctcggacaggctgagggccgtggccagctccactcgttctggcgtggacaggtagcgctggatctcgaacctcttctccaagcccgagagctgcgagtcagagaaaaccgtgcgggctttgcggcggcggcagtgcttccccggcagctc

SEQ ID NO: 34104 - DNA, 1116 bp, Homo sapiens
  chr11:122850148-122851264
  hyper
cgctgggactggcatccctgcagagagaagagcaaccaagtgggcagagcgtgggtcgccggagagcaatctccgctccgctcccctcccctcccctagcccccagtgccttcctccgcccctcgcctccgtcagtctgctcgccccaaagcccctcaagcctttctctcaggaatccagggcagaggaagaaaaaaaaaaaaagccgcaagaatagcgcttggagatctttatctggaaagtcatctagaaatacaaacaacaaacagtaaataaaacagaaaagaaaatcggaaaatagatccggaggctgtttaaaaatgtcttcttggagagacttccgtagggtcggccagcgcggagtcttcagttgcgcctggccaagttttttgcaaacgtcaaatggcccaggagcagtcctgtccccagcccccacctatcctcctagacccctgatgacactcattgctgttctggggctggtagatgcatggatataatcttgcctccaaaccttactgaaaaatacctttctgtttcccaagccacccctatccccctgcagccaaagggagagcaaaactgccttatccggagaagccccggagccgaaacagaggagcatttctcgcctctcacgtctcctcgtccgtttcggggtcgcgctagggacccagctacctaatatagtcctcattctttttctcattctttccctctcactccaagcccagcgaagcagaagggtttgaggggtttttccatggccgggtccggggagacttgtctttcctgaccctcgcaggcttgactctgtctgagacgcaccaagcagagagaagctgccacaagcaacatcggccaatcccagagaaaataaacaaacataacaacaaccagtgcgggtacttagggctttggccactgctgtatgggaggaccaccggagcagctgagaatagattgtcaccggcgggtggtgaagccagtgcagagatgcggacctggatttacaaacacttttagctttgttctggattccagcgcgcacaaactgcctcctgtcttgcccccagcccctccaccgaccatggttgttgccgcctctgagctatg

SEQ ID NO: 34105 - DNA, 482 bp, Homo sapiens
  chr11:122852370-122852852
  hyper
gagattcatcttgagcggagcacctgccacaggacaagggccgggacgaagtggaggacgcaggcagagtctccaagcctgctcgaaagccggcaaccaccctccgaggctcgaatctccgctgctctctcccgggcctgggctaccccgggcgctggagaggcaagaagacaagctcctgggtaggttgggtctctgtgttggagaattggcagcttggagaggggggccgggagagccaatgacgaggctgccagaggcagaggggagggtgcgggaggctcggggcggggcggggagctgtccgcggtgctgaacaccaccggccgagcctgggaacaacagagcccgcagggttcttgttcctaccaggtttctcgacctcaatttctgccccgtcactgcaggggctgctttgttcccagtcgtttttaaaagaaagccaaaaggaaaaagtctctgttgtccggcaaactcctctt

SEQ ID NO: 34106 - DNA, 114 bp, Homo sapiens; identical to SEQ ID NO: 11039
  chr11:122854915-122855029
  hyper

SEQ ID NO: 34107 - DNA, 18 bp, Homo sapiens
  chr11:122855030-122855048
  hyper
ccccgcctctgccggggc

SEQ ID NO: 34108 - DNA, 17 bp, Homo sapiens
  chr11:122855721-122855738
  hyper
cgcgggccccagggctg

SEQ ID NO: 34109 - DNA, 440 bp, Homo sapiens
  chr11:123065493-123065933
  hyper
cagggactgaaaagccggctgactccaggggctgcagggacacccggtcagaaccggcgtctttcccggacgcagggctgcgtttgcccacggccatccaaactcccgccctcccagaggcactcacctagcaagaggagaaggaggagggacatcccgatccccggacgcgggcgcttccccgctcagctgctgcttggctccggggcggccgggcgcctccgacggacctcgggcgagctgggcgcggcgcctcggggtgcgcgcgaggtggctgcagccatgtgccgggcgggagccggccccgcgccccgtgcccctgggggcagatgggctcccggcgctcgccccaccagctggcgcccggacgggagccgggaccagggtcagggaggaaaacgcgaggcgaaaaggcgctaccgcttcgtggaacacttttc

SEQ ID NO: 34110 - DNA, 53 bp, Homo sapiens
  chr11:123066144-123066197
  hyper
ggggccgtgcagaggcgggtgggttgagaggcgccgggcgtaggattgattct

SEQ ID NO: 34111 - DNA, 381 bp, Homo sapiens
  chr11:123172482-123172863
  hyper
gggcaggcggcagcacgggaagaggccagcaggtggcgcggtcgcccaacccggccgccccccgggcgccgagggaagcgggtcaggggcgtccccacctgcccaagcgccggctctcccaggcagcaggggcggcggcggcctggctggctgcgctgcagagcggagagcaggagcggcgtgggaggaattcggagcactttcgccgcctgcctccttttactgctggttgccctcaaaggagccctctccctccacacgcctttgggccttaccagccgccggaagcggcggcatccatcccagcaaagcgtgcattccatcctctggaaaaaaagtctttgagcttcctttacagtgaccttactttggggactgaac

SEQ ID NO: 34112 - DNA, 75 bp, Homo sapiens
  chr11:123172915-123172990
  hyper
cgtggttgacgaagccattccctccttgctacttgccttgtgtgatacactgtcacggcccgggcttctggcttg

SEQ ID NO: 34113 - DNA, 80 bp, Homo sapiens
  chr11:123228636-123228716
  hyper
atcgtgaagatcctccgggtcacctatgcactcctgctaatctctgccatttgccttcttacaccctttccataccttcc

SEQ ID NO: 34114 - DNA, 392 bp, Homo sapiens; identical to SEQ ID NO: 999
  chr11:123228788-123229180
  hyper

SEQ ID NO: 34115 - DNA, 226 bp, Homo sapiens; identical to SEQ ID NO: 1000
  chr11:123229181-123229407
  hyper

SEQ ID NO: 34116 - DNA, 8 bp, Homo sapiens
  chr11:123229461-123229469
  hyper
cgcccgaa

SEQ ID NO: 34117 - DNA, 151 bp, Homo sapiens
  chr11:123300811-123300962
  hyper
cctttacttggaggtcgagtccctccccgagggaatccgtgtacagttacactagcggtcgctgccagtgctagcccattcaggatagcccccctcaccccgcccccagcccccgctcctcctcctccttttttgtttttatccagtgtct

SEQ ID NO: 34118 - DNA, 7 bp, Homo sapiens
  chr11:123301022-123301029
  hyper
ttcctcc

SEQ ID NO: 34119 - DNA, 990 bp, Homo sapiens
  chr11:123301082-123302072
  hyper
cgcaaaccgctgagagtttgctgcaccgccccctggggcccctggctgccgagtcccgctaaggcaaagacgccagcaagcgaggaagcgcagcggaagaaaaacaagcgggcgcgcgaggggagccccaggagggctgccgagtggctggcaggcggctcccgcccctcccgggtggcctcgccggcggctgacggcccggaggacgcgcgctccgaaaagttagactccgggcggcggcgcgctacgccgcgtcccctcgcgtcccttcctcgctgcgctccgggaaaggaacttgttccttcggccccaggattggggagtgtgccgcggggccgagggtggggaacagccagagggagacgcgaaccaggccgctggcggagggctcagggggagcgcagaggcgacggcccccatgccggcggccaacatgatggagaaccggccgctgcccgccctgcaggtgcccgagccgcagggtgcgcccgagggcagcccggtctggtccagttcgtcgacccccacgcttcgccgccggcgcttcaagatgcgccgcatgaagaacgtacaggagcagagcctggaggccgggctggcccgggacctgcccgccgtcttggcccccggcaaggagttcctgcagctgccgtccatcgagatcacgccctccagcgacgaggacaccccgtggtccaactgctccacacccagcgcgtccccgcgccgaaaacgcttcctcctccgcaagtggctgagggtgagggagcggaaggagtgcagtgaaagcaggtacgtccccgttccgcccgtctccttcccttccctcccgtcctctccagagccgtccagggccccggggcattctgggggaaacgtcctgggggagaacaggagcccgtcaccagaggcgcttctggagggcgctgcgcctggtcccagggatggtggcattcagcttccacgcgtgccacccgctccccaactcag

SEQ ID NO: 34120 - DNA, 30 bp, Homo sapiens
  chr11:123524569-123524599
  hyper
cctctcagattctttcgaggaaaccctttg

SEQ ID NO: 34121 - DNA, 150 bp, Homo sapiens
  chr11:123524827-123524977
  hyper
ctcgcgcccctgcctcgctcgtttgcgcccagggtaagctcagctcggaagggagtcgcactgctggcctagcagccaggctgtggaagggtccaggttgattcacctctcgcctccccaggatcggttgcgttccgactggaatcctcc

SEQ ID NO: 34122 - DNA, 61 bp, Homo sapiens
  chr11:123525412-123525473
  hyper
cgcgccgagcgggggcggagccgggagcggcgcagacacttccagccgggatatctttgct

SEQ ID NO: 34123 - DNA, 20 bp, Homo sapiens
  chr11:124629399-124629419
  hyper
ctcggccctctgcctcggag

SEQ ID NO: 34124 - DNA, 15 bp, Homo sapiens
  chr11:124629499-124629514
  hyper
cgccctaggagagcc

SEQ ID NO: 34125 - DNA, 214 bp, Homo sapiens
  chr11:124631577-124631791
  hyper
gcttgtatgtggggtcggggatgagagggggctagagttaagtccttaagctctttagccagtgtctcatctagcggctcagctcatccggctctgctgggtggggggtggggagtggacagggtgaggaatggttccgataactcaccccagaggtatccaggtcttccgagagatgcccttacctccccccgccatccgcccccacacccaa

SEQ ID NO: 34126 - DNA, 46 bp, Homo sapiens
  chr11:124709117-124709163
  hyper
ctgcaaaccagaagacgcggcctgggaggggcgtagagccctcccc

SEQ ID NO: 34127 - DNA, 183 bp, Homo sapiens
  chr11:124709482-124709665
  hyper
cgcctaatccccgcacgcggacacctgggtgggagcgcgggcgagtggagggcgcgcctgcacgcaggatcccgggctgggcaacggcctagaccgcctctcgccaaacctcccacgccagcgccagtccgacgaacaggagctggtccagcgaacaataaaaggccccggggctggggaggg

SEQ ID NO: 34128 - DNA, 156 bp, Homo sapiens
  chr11:124712781-124712937
  hyper
gggacttgatgcaaacgaccgcatggcagtaggctcgctgggcagatgcccaggagatattagggctgctggggctgaggtaatatcctgcgaggccagccgggtctgcagccctggctgggtcacgacccaggctctgcctggctcggacatcct

SEQ ID NO: 34129 - DNA, 336 bp, Homo sapiens
  chr11:124713057-124713393
  hyper
gcctcctcccgctgggaggataattaaagcgccaaacggcggagcgggcgggcagcgttcccgggggcgcatttcatcggggctgattaatgaggccggggagttaatgaggagaaagctaaacgcagggagctgagccgcggaaggcctctccgaggccctggagggggtcctccgaaggcatctcccgccctctctttctagtagcggcttagcgcaagccacatggtgccccaggctcctctcgccgcctcaagccaggggcgggggggaggaggggtcgccccaagtcataccggccgcactgaagtcggtctcctccgcttgtggctaacc

SEQ ID NO: 34130 - DNA, 49 bp, Homo sapiens; identical to SEQ ID NO: 11053
  chr11:124735054-124735103
  hyper

SEQ ID NO: 34131 - DNA, 1075 bp, Homo sapiens
  chr11:124735382-124736457
  hyper
ctgtggaggggcttacggctcccagcccacgggtctcagacccaggggctgggcccccagcccccagtcccgatcccagctgggtcgagccatgctgcgctacctgctgaaaacgctgctgcagatgaacttgttcgcggactctctggccggggacatctccaactccagcgagctgctcttgggcttcaactcctcgctggcggcgctcaaccacaccctgctgcctcccggcgatccctctctcaacggtgagaccctgcctcttggggatatgggatcctgggatggggatgaggtgagagggcggcgtggaagggaaggagaagcgctcctgtcccgaggtccgggattgagtggcgcctcccagcgcctccctgggtcgtggggtctaagggataatttggagcttcgagcacatgagtgggggtacccgcgggaggtcgagggcttgggagaagatggctactgagtctttttacacctccttcccttcccctacaacgcccaccccaggtgagaagaaccgttgctggtaacgggcagggaagtccgagctaagaaaggcccgggcccagcgcagggagggcagaggagggggcacagtctcccgccggcctcggccaagccaggtcactcggtgacccacccaggcagctggtcttcggaaccccgaagtttcccaagaactcacttaggaccagaggaagccaaaatgctggatgtgtttgctacggaggggataggggcggcgatcattttaaggaaacttagaagtttgtctttcagcggcgggactctcagccggcccaccccggcagagctgtggcgggcgggcggagctggcggcgaggtcgttaccgctaattacggtgattaataaatgactgggacagcgcgctctcccctagcgccgcggggaagctgcgggagccggccgccgccagcctgcggagaggccggagcgcgccccctgcctgccgcatcgggaacccccgctttaccgggcgctttcgcgtgtggttccctccaggtgcacgcggtccccatccctctgcctcgacccactcgagtc

SEQ ID NO: 34132 - DNA, 558 bp, Homo sapiens
  chr11:124738461-124739019
  hyper
gatccctctactaaccggcctgtctgtaggcatcttcctttgagacgaggaacgcggaacgtctgccaataaggacatattggatcctgcagagggagagggtaggcaggtggggactgagctccgcagagaagcataggagatggaacgaccagaggattctctttccctctggagcctcaatctctccccacaatttccctgtctgaacgctctgcgccaccccctgtccccagggtcaagggtaggaccggaggacgctatgccccgcatcgtggagcagccgccagatctgctggtctcccgaggcgagcccgccacgttgccctgccgcgctgaaggccgaccccgacccaacattgagtggtacaagaacggggcgcgtgtggccactgtgcgggaggatccgcgtgcgcaccgcctgctgctgcccagcggcgccctcttcttcccgcgcatcgtgcacgggcgccgcgcgcggccggacgaaggtgtctacacttgcgtggctcgcaactacctgggggcagcagcgagcagaaacgcctcgctggaagt

SEQ ID NO: 34133 - DNA, 60 bp, Homo sapiens
  chr11:124739403-124739463
  hyper
agcagtactggaatgcgtgcccccccgcggccacccggagccttccgtgtcctggaggaa

SEQ ID NO: 34134 - DNA, 252 bp, Homo sapiens
  chr11:124933396-124933648
  hyper
gagatcaccccagatcggccccggcgtcgccgcgtggccaggggtgctggggggacttggtcccgagctcctccagcggcgcccgcctcggaggttgataaccctccctgcccaactccgcccgcgctcccccagaccccgcgacgctggctcggtgacactggggaagaacaggctgccagggagggtctccatcgtttcccgtttccatcctcccctcctaacacacatccggggcgccttcagagcgcc

SEQ ID NO: 34135 - DNA, 77 bp, Homo sapiens
  chr11:125034228-125034305
  hyper
aatctcacctcatctcggtcccctcagcaccggtgatatcttggaactcggccccggttgttcgctaaggaggactt

SEQ ID NO: 34136 - DNA, 50 bp, Homo sapiens
  chr11:125034731-125034781
  hyper
cggcggctgctgctgcgggcggctgcctcagagcgcgtgtgttttattcc

SEQ ID NO: 34137 - DNA, 969 bp, Homo sapiens
  chr11:125035368-125036337
  hyper
tccagcggctggaggcgggagcggtcccaggctggggccaggtgaccggaggagtcgaggagccgcggccgcggcctggggaggcagggcgaatgagggtttgcagacggatcagtggagacaggggaacaccggcggggcccgggaagccaggatccgaggggctacacgcacggaccctcacccagggaggagcgagaatgtgtagggtcaccggctttccatgattgctggggatctttggtgaggcgggcgtaggggcccgcgcgaggcttgggaatcgggagcccttctggctcgagaactaggggatgagttcgtaaaagagggaactgaaagcgatcgagagcggagagctgagggggatggcgcaggatcccgaatctgccgctcaaagtttgcatttctttcgggttaggagacgggctttcctggctcccgatccccaggaagaaacgagcgaaatgggccgtcctttcccggggctcttcacgggggagccgggggtttccgcgcggtggggagactcgggttgggaattgaggggtaggggcttgtggatcggcctgaattagggctgggttttaggaccagtctagagttcggtttataggatccagactgtttacggaatcgggatcgaggggccgataagtagtttacacgccggccagagcagagggctggaggtcggagttgggggctggaggaacgggtggcgtttttaggattcagtaacaggatcacagctttttcttgtggtggaagctattggaatttggggagggtagcacgaggggtcctgcagctccgcgtgtgaaaaagcgtttaggtaggcgatgaaagtagttgatctgagccatggcaggcgagccccgaatttttgctgcttccccctgaaagtgtttctttaggaggagaggacttgggccacacaggacccggtcctaagagagcgattccgggaag

SEQ ID NO: 34138 - DNA, 30 bp, Homo sapiens
  chr11:125133214-125133244
  hyper
agcagtgggggaagccgcatgaggaggagc

SEQ ID NO: 34139 - DNA, 584 bp, Homo sapiens
  chr11:125365065-125365649
  hyper
ctcctccccccagtccggtggggtaaagaaagcctcctccaggcagcacaatggctggcactctgaggaagccggactcatcccgtgcaggccgcatacacactccactgcccttccggccaaacaagcccggacacgggagagggatgagagtcggggatgcctagcggcgaggagagaagggataggcaaaagggaagaagagcgggctgtgatacctcctcgacgccgtcaaacactgctccccgcattccagagcccggggcccacccgacggcagcgcgccccgccaccgcgcagccgccccggtcccttctcccgcccgtctgtagtaaaacaatcgctctcccggcgtctgcggccgctgccagcggttctgacactgcaggaatgcgcggtctggggaaggctccgcactctggggaggggcacgagcggggtcgggggtaagtttttagggacaaagatgatcttggggcgtttacggtgactggaccagataacggtcccgggacgaggtaccgacccactgccccagcgcgatcgggcggcgttcccttcttcccccagcccccatacctcgc

SEQ ID NO: 34140 - DNA, 583 bp, Homo sapiens
  chr11:125365709-125366292
  hyper
acacacacacacacacacacaccaggcctggctggagggccgatgctgagatgatactggaagtgcccatcatcccacatctccagggcctggcgcggcgtcccagctgcgctccctgaagggctgggcaggaaggcgacggcctcccgttgttcctttctaatcccagaatgggaccaggtgaggggagctgcggcgaccccagaccgtcctgtcagagaatcccggggcctccttaccacccccaccagaccccacccccagcagtgagtcgggtcctaactaaagtcaacccccgcgacggcacctgtgcgggtcctggcggagggaggcggatcccggggctcagccggacacccccatccacgggccgcgggagcggccggagcgcagcgcagcgcagcggagagccagccagccagccagccagcgagcgctccccgcgcagctccggcggcgcccggctccgctcccgcctccaccccaccccttccccgcgctcgtgcccgggctccgggggcgcgcccgcgctcgggcacccacccaactggcacgcgcgggagctggacgtcatcccctcgtt

SEQ ID NO: 34141 - DNA, 181 bp, Homo sapiens; identical to SEQ ID NO: 1003
  chr11:125773880-125774061
  hyper

SEQ ID NO: 34142 - DNA, 327 bp, Homo sapiens
  chr11:125774122-125774449
  hyper
cggaagctgccccctctgccctccggtccgcgccctttcgccccgctctctgccctccgccccgctctctgccctccgccccgctctctgccccccgccccgctctctgccctccgccccttccgcgcgccacccagccttccagcgcctgcgcgccgcaccgcggtggtcgcgggcgcggacgcggacgcctgccccctaaggaagcccattggccagcggatggggccagcaccgcctcgcgccggtggtggaagcacgtgctgggggcgggagcagcaatcgcagccatggcgtcgttactgtggggaggcgacgcaggggcgg

SEQ ID NO: 34143 - DNA, 15 bp, Homo sapiens
  chr11:125774480-125774495
  hyper
cgccaccgagccggg

SEQ ID NO: 34144 - DNA, 58 bp, Homo sapiens
  chr11:126226052-126226110
  hyper
cacctccagcatcctcgagcgatggtttctcccacaactaccccggtcaggtccagca

SEQ ID NO: 34145 - DNA, 30 bp, Homo sapiens
  chr11:126870182-126870212
  hyper
ttgcattcgcaaaggcgaagaggcaatgcc

SEQ ID NO: 34146 - DNA, 16 bp, Homo sapiens
  chr11:126870413-126870429
  hyper
gcagcgaaggaaagcc

SEQ ID NO: 34147 - DNA, 71 bp, Homo sapiens
  chr11:126870430-126870501
  hyper
gcggggtaacttggctgtggttagtttctcttccttggcggctctcggtgctcagcctccgccggtcctct

SEQ ID NO: 34148 - DNA, 216 bp, Homo sapiens
  chr11:126870524-126870740
  hyper
cgtccgtgggtccctccgggtggcttcggtctctttgtgcctctgggtatctgcagccagccgacacaaactgcctgttcttagccgcctcgggaagccgggattgtcagcaatgtccccactcggagaagatccattctctggctcttggcatcccaggcacacggcttcctcaggcgggctcctcccacagtgagcgagcgagctagtgacgag

SEQ ID NO: 34149 - DNA, 764 bp, Homo sapiens
  chr11:126873058-126873822
  hyper
aaaaggaccaggaggcgtatcaagcctgagtgccggaaaacccacggcaatcttcagcagccaccacgtggggcagagaacgcgagcagtacctgcaggacccacagccggtcgggctctggcgccagcctcgacggcggccccgccatctccgcccggctgcccgcggcctcacctcctccgggggctcggttagcctcctggcgctgcaaggctgcctgcgcgcggttcgctccgggggagggaggaggagggaggcggcgaggagccgacggctccacctgatggagaagcgcggagagtccctagacctcggagtgcgctgcaagaggggagaggagagagaccgccgcccctgctggaagccttcgcgtccgggggcggcgcgcgggggaaggggtctctggacagtcggtggaggcggcagccctacagagacagccgaaagccagcaacttggaaaaccgcccgaattctgggtttctgcacatccaggctggctccaggtctcttgtgcccaccgtgcaagccggcgggatgccagcaggtggcatcctctccagcgtttcttcgccaggcgtggagtccggaggccgaatccatcagtccccagccccctccccaagcctccggtgccaagtgctgggtcctgtgagcccctggcccgccccccacctccgccagcggggcgagccggagctgggtgacccagaccctcgcggaggcgggagcctacagaggatgccggccggccccaggttctg

SEQ ID NO: 34150 - DNA, 106 bp, Homo sapiens
  chr11:128556994-128557100
  hyper
ctgtttgcatgtgggcgtgtgtatgtggggttgtgtgcgggtatgcgggcgccacgcgcttctcctacaggtgagacacgcgctcagtcctcgagcccaccttctt

SEQ ID NO: 34151 - DNA, 423 bp, Homo sapiens
  chr11:128562763-128563186
  hyper
aactggggcgcgcggcggcccaggagggaggcggggaggtctccgggttgggccggggaacgccggcctccaggctgggtagggaggacggtccagagcgcgggcctccgggtctcaccccgggaaaagtctgggtctgctctgcgctgttgcgtgctgcgctcctgggacctgctgactgtcctagagggaacgtcccgcggtagtgtcagttccctggggaccaggaagggcgactcttgcctgggagtcagtgcttgggccgtcgggtccgggtaagcgctgggggtttggctcgagaagatgcggataggtggcctagggcgccgcggatctccgccctctgcgggcaccgggagcccagggtcgaggcgcgccgccccgaggggccccttctcctaacaatgcgcccggaatggagtc

SEQ ID NO: 34152 - DNA, 484 bp, Homo sapiens
  chr11:128563336-128563820
  hyper
cggttttcgtccgagtcttccccggcagtaggcgctgggttacccgcagccctagccaactctccctccataccccccctaccccacccccaaaaagtttgtctccggctggaaaaagcattaatgaacgtatctgtgggaagaaacggaaagtgaatgagtcaggagggccaccttcggccaaccgcctcaggaaaagcaaagaagccaaaggtctttggctttggattttgggggaaggtgatggggggaggttcagacttcgggaatcagggcgcggacgctgggcgtggaccccgtcattgttcccggctagctcttatctcccaggagcaagtatcctgtgtgcgcagcgcatgaatgtgtctgggcatctccgcgtatatttatatagtgtgtgatgcgaaaagcaggaccagcaggggaggaagagggggtgtggggggggagggaagacgagggagagcagaggggagagaagaga

SEQ ID NO: 34153 - DNA, 516 bp, Homo sapiens
  chr11:128563880-128564396
  hyper
gagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggtaagcggcggggcaacggacgcgggcggcggggaccggccggggaggcgaagcggcgggcgggtaggtgcggggcccgcgtcccggaagacgtggcctctctcccttccctccgcgccccggcttcgcgccggctcctccggcgctcgggtggcgagtcctactcgcgggccagccggccaggcgcccgcattgagggcgaccctcccccgaaatcccagcccc

SEQ ID NO: 34154 - DNA, 223 bp, Homo sapiens
  chr11:128564651-128564874
  hyper
gtgggtaagtggcctcgttgcacgagggtaggggtgcaagtgagtgtgtcgggggatctatctgagcgggctcctccagatggaagcccctgtttacatgtcagcgctttcccttcctctcggcactcagtcgcccggctctaggcgctggagagccgccggctccgcgggactcctgggccggcctcgccgcctctccggcggggaaccttccccagccccc

SEQ ID NO: 34155 - DNA, 2 bp, Homo sapiens
  chr11:128564875-128564877
  hyper
tc

SEQ ID NO: 34156 - DNA, 542 bp, Homo sapiens
  chr11:128564991-128565533
  hyper
cgcctccgttgcaggggccggctgtgagcccgcgccccgcgcccgcccggccattcccaccccagccgccgccgccaagcctgggtctaggttgcaaagtgcaacccaggcggaaaggtgagggtttgggttcgcgtctcacttcagaaaagttgactgctgtctctgaaagggttcgccaagtagggccaggagcagagaggagggacaccccctaacgtgacgggccttagaggacctaggggaatgaatgggaccaggggttagcttcgaggctgccgcgcaacaccaagcgggagtctgtctggaaaaactattaggctggcgaggtggggactggcagagcccgccattccccagaacccgaaagaatcgactccctgctcagggctcagcaagagaaggctaagatgttgggctcagagaattcaagagatttttatcttctgggtggggtcgtggtttttattttctaagttttttttatgaaagtttgaaatatgctgacttaggtaaaagacaccaaccgaaggaacttgcaa

SEQ ID NO: 34157 - DNA, 462 bp, Homo sapiens
  chr11:129242780-129243242
  hyper
gaagagagaaaacagaagcgggaaattcgacagaggaggagaggcccaaagggcggggagcaatgcggggaagggagaagtgggagggaagaagaggagaggagtcagtggcggtggaaggaaggggaagaaccagagagaagaaaagaggttaaggaaaagaagagcaatgcaaagtcggggccccgaatagtgccgcattctgtgggcacacgccgggcagatagaaagtatagacgcgacgcgctcggcccctcgtcgggcgtcgggtcctggtgctgtcgctcaggtgctggtccccagctccaagcccgcctcgtagtcggcgctgcgggtgagatcgcccgcaagcactcagtttactggcggctgcctaccagcggctcactttcctcggggcgcctaaagctccccgcccggcattgccccgggagcgaacgctgagcccctgggacccagccc

SEQ ID NO: 34158 - DNA, 380 bp, Homo sapiens
  chr11:129243304-129243684
  hyper
cggacggcgatgccagggctgagcggtgagctgtcccgggtcccgcgctttgaccgcggaccagcctcagggtcccgccgcggaagcagggggcgcgcctggggccagcctgtagaccccagagtccggcggcaggacccccggcgccacccggacacctggcagcagttctcgcctgccctgcagccgcctctgcatggagaaagagaatgaaagaaaacaattctagatggagaggaggggaggggaggccagtttgcaaatacttcgggaatgaagttcctcaaagacgcgttgcgggccttgtctaatgctaggctgtgacttggcctcttaacatctattttctcacgcctgtaatcccagcactttgggaggcg

SEQ ID NO: 34159 - DNA, 377 bp, Homo sapiens
  chr11:129243924-129244301
  hyper
aagaaaaaatctattttctctaacagcctaatgattagtcctctgggcgtgtccctccctcctagtttaatcaccggcccaggcgccctcatttacttgcttccgcggccaccagggccccctgggcaagcagctccgcagagagcccgccggcactcgcggacgcttctaggctgggagcggggaggaaatgtcaccggccccaaactcggccctagggaaggccatccgcgtctatacttctcagtgtccctgtcgtgcgttttccttccaaccccatgcacactcattccaacataaagtcgtggaaacgggcgtgcactgggctgttcccgccgaacaccgggcgcgactcaggctgccggaggcttcccggg

SEQ ID NO: 34160 - DNA, 204 bp, Homo sapiens; identical to SEQ ID NO: 1011
  chr11:129244440-129244644
  hyper

SEQ ID NO: 34161 - DNA, 30 bp, Homo sapiens
  chr11:129245832-129245862
  hyper
gcggggcccaggccccgccgtcgcgccagc

SEQ ID NO: 34162 - DNA, 206 bp, Homo sapiens
  chr11:129565510-129565716
  hyper
caacaggtaaagcttcggatggaacctgctgtgttctgtcctcttccagctgagccaggcccgcgggccccctccaggagctccgggcaagcagcccctcatggcccgtggtggaactgcaccctcagcactggagagggcggtcgcaggagcctgcgaggaaggtggggtctcagtgctttcgcacagggcgagtggagctggaa

SEQ ID NO: 34163 - DNA, 308 bp, Homo sapiens
  chr11:130297447-130297755
  hyper
gctctcagtcctacctgcaggtcggccccgtagaaggcagccatggacgcatcggccaccagcagcgtctccacgaagcgcgcctcagacacaaaccgcttggtcctactcgtggcccccaggggcggtggcggctcgctagcgccttctgcctcctcttcttggctctcctcctcgctgtcctcctggtggtctcctctctcctgcctctgaccctctcccgtctccacctcccactcgggtcctcgcgggagggggcgggctccggcgggaccccagcgctgcaggcggtgcggctgagccaggga

SEQ ID NO: 34164 - DNA, 91 bp, Homo sapiens
  chr11:130298269-130298360
  hyper
tctctccaggaaaagcggaatcaatcgggtgcaaggccgactcggcccgcggggcccggcggcgggagcgctcccccggcggcccctctgg

SEQ ID NO: 34165 - DNA, 68 bp, Homo sapiens
  chr11:130318554-130318622
  hyper
gcggttgcgagaagccgcccggcaccttccgctagttctcggctgcaaatcttcgtccttgcacttga

SEQ ID NO: 34166 - DNA, 30 bp, Homo sapiens
  chr11:130319107-130319137
  hyper
cactgagcatctgggcgtccccctccaggg

SEQ ID NO: 34167 - DNA, 37 bp, Homo sapiens
  chr11:131558038-131558075
  hyper
tgcagctccccagaacggccaccggagggcacccgcg

SEQ ID NO: 34168 - DNA, 69 bp, Homo sapiens
  chr11:131780262-131780331
  hyper
cctaatttggaagcgcgtaaatggttaaactcctggcctgggctgggctggtgcacagcctgggcccgg

SEQ ID NO: 34169 - DNA, 203 bp, Homo sapiens; identical to SEQ ID NO: 1012
  chr11:131780876-131781079
  hyper

SEQ ID NO: 34170 - DNA, 15 bp, Homo sapiens
  chr11:131781572-131781587
  hyper
tggtttgtatggggt

SEQ ID NO: 34171 - DNA, 43 bp, Homo sapiens; identical to SEQ ID NO: 11082
  chr11:132813715-132813758
  hyper

SEQ ID NO: 34172 - DNA, 294 bp, Homo sapiens
  chr11:132813907-132814201
  hyper
cgcggactgcgcgctcatcccgacgggcgggcgcccaccttaacctccgccgcgcccaccgggctggggatgcctgcggggatgagcccgcaccgcgcccacttcgctccgtcccgacacccgcgccagcggagagaacgcggcgcccctcgcagcggcttcccctacagaggggcggggtggggggagcggggagggagaggggagggcgggagagggagttctggggaaagcagcaaactgaaaactgacactggcaccttccctcgccgatgccagcgcagaagttgacaa

SEQ ID NO: 34173 - DNA, 75 bp, Homo sapiens
  chr11:132864134-132864209
  hyper
gcgcgggagcacgtccggggcttttacggccggaactcgggctattaaaaagcccaggcgcgattttctaattaa

SEQ ID NO: 34174 - DNA, 86 bp, Homo sapiens
  chr11:132934044-132934130
  hyper
gagtgaggggtggagcggagcccagccgagggagggaaggagaggaacgccggcccactagccgaccccagcgcaacccagcgcgg

SEQ ID NO: 34175 - DNA, 185 bp, Homo sapiens
  chr11:132934388-132934573
  hyper
cctaccagagactgtcgctggcgtcctcaggggccgctgcagggccaccttgtgtgcttgccctttccccacggtagactgccccgggagggggactgtgctgcctgaattcttgtccgggtgggactggcctcggtgaaggatccgggaatgggacttccgggccgggccggaggggaagtgtc

SEQ ID NO: 34176 - DNA, 449 bp, Homo sapiens
  chr11:132952542-132952991
  hyper
gagtggcacagccctcggcacggcacggccctgtcagctacgaagccgggcgaggggctcaaggcccctctggagaccgcttctcccccgcggcccgtcccgccgctgcggaccccatgcgcggcctccccgccccggcgcctgggcctcctcgcggcccgggcggggcccaccaacccggagaggtcgccagcctgcagggtgccgggggcccctccgagccgacctcgtcccaggcagacgcgctgcccggagaccgccgcaagggggcgccaggggccggggcggacgtcgcgccagtgcctcgccgggaccgcacctcgtccgcgcggccgccagagggcgcccgtcagcgccggagcccgcggcggacgccccagccgagcccagccactgcctggtggagccacagggcacccgcccggaaacaccgcctgcgccccgacggc

SEQ ID NO: 34177 - DNA, 88 bp, Homo sapiens
  chr11:132953232-132953320
  hyper
cgcatgcgtgtgtgctcccactgccccagcctgagtcccggatactggtgcccctgtctcgggtcgctggctgcggagagggctggcc

SEQ ID NO: 34178 - DNA, 122 bp, Homo sapiens; identical to SEQ ID NO: 11088
  chr11:133402168-133402290
  hyper

SEQ ID NO: 34179 - DNA, 330 bp, Homo sapiens
  chr11:133825189-133825519
  hyper
gaagagttttaaaaccgtccggaccaacatgtcagttaacaaaatcacccttcgcttcgccctctgctcgttctgttttcagacaccaccacccccctcagaagcagaggcgacatattcattccattccggaaagtttcctgaagcacgcccccctgcacagacgagtgacgaggggaccccgtgagaggcgcctccagcccacccggcgccccatgccgctgggagagggttctctgtcggcgagtcctgcctgctgactcccacccacagcgggttctctcccgccgccatctcctccggcttggtgaacttgcccgcagccgggtc

SEQ ID NO: 34180 - DNA, 183 bp, Homo sapiens
  chr11:133825520-133825703
  hyper
tgtctgcgcgctgacagccctgagctcacagtcctggcaccctccaggctccgctcccacttccatacaagggccgagagccgggggtgccacccagaggcttgtaggtcgctctgcccatctccaaagcaaaagcccgcgcgctcacgcacgcatcacccaactcggtggctccccccttgc

SEQ ID NO: 34181 - DNA, 622 bp, Homo sapiens
  chr11:133825704-133826326
  hyper
tctcccccagctcagacccaggaaagcggaaagagaaaatcccccctccgctcggattcacagcgtggggacccccccttccccgcccctcccctcccccgccgccgcccccagccagctctgcctcgcagcctggggagggcggcgtggggcccgcgcggctgcggcgcgctcccggggaacttttgcctggccggggcccaggtgcggctgagaggcgcgggggccggcggggtccagccaaaagcggacacacctcgaagctggcctcatcaatcctcctctcaccgggcgcccctgctagggggatccgacctccagctgccaagatgtgtgggcaggaggggcgcgagcggagcgatggacgcccgcagggccgcgcgaacccggggccttagacgcgggtgccgccagtcccagggatcctccgggtcgcgcctccctgcaggcgctcctcgcggcgcggggctctagcgtgctgcagcctgcccggagaccgcaaactcccgcagccagagtttcccgcagctctgggaggcggccgccgggcaggaggcgacgggctaggcgcgccggtgtgcaccgtggggcccgtggtgggcgaagtcgacccaggttccac

SEQ ID NO: 34182 - DNA, 619 bp, Homo sapiens
  chr11:133826744-133827363
  hyper
gcgccgcctacgccccgcgccggtgctcctgcagcccgggtggccagctctccatccctcctaggctccgctcggctcggcgcgcgcctccccggccccggcgcagcggcacctgcactactcgcccgggcggagcgcagccaggtccacggtgaagcctagccgggccgggcctccggaaccgcccccgccgcccgcctattgggcgccgcccgcaagccgggggtccgattggctcagccttccgcccgtcgcggcgcgaaggaggcgagcccatttcaaggtgcgttgaagtgtggcgagcacagagccgcagaatcatgcgcattgccggggagaaggtggtatagcgtctctgcccgcttctctctcggctcacactgcgtggcaagtttctggtgagggaaatggtagcttctaacgggaccctggcgggtctcaattaccccggacaggtctgagggaagtggagcccccgcccactcatggaacccaacatccggtttccatccggcaaaaagcagttcccgagaggaccatgctgattctatgatggggaaacccaggagccggcggcccgggagagccggggaacgtccttcgccggagatcttttcaa

SEQ ID NO: 34183 - DNA, 223 bp, Homo sapiens
  chr11:133906745-133906968
  hyper
cgcccccacccccaccgccaagccgaaaacccaatcctgggcccacccatttgcgtggatgccacagctcggccggaaggcttcagcgtgggagggggtgggggtgacaccagggctgccccttgagagcgacaccggcctgaaccccgtcctccccgcgccccccagccccgcctcgctgcagacggttcgccttgtccactcttctcgactcttctcgact

SEQ ID NO: 34184 - DNA, 16 bp, Homo sapiens
  chr11:133938772-133938788
  hyper
agagaacccatgtgcc

SEQ ID NO: 34185 - DNA, 275 bp, Homo sapiens; identical to SEQ ID NO: 3830
  chr11:133938789-133939064
  hyper

SEQ ID NO: 34186 - DNA, 372 bp, Homo sapiens
  chr11:133939065-133939437
  hyper
cgtttccgctgttgggagactagggtctgggggcgacggaagcagagcgggccgaagctgctggagccggtccgggcgaggatagcggtcctggctccgagggctcccggggtcccgggccggaggggcggcgcgcgcccgcgtccccgcagccagggctgggactcgggcctggctagggcgggggccctgggacgcccggcagttggaccggggcggggagctaatttgggatggggggcccgtcccaggcagtgagtcggtcccggacagccgtcggaccccgggggcgggctcttctcgggcggggtcctgtgctgggcggtgggctcatcccccgggtgggctcctcccaggcggggtcctgtgctg

SEQ ID NO: 34187 - DNA, 50 bp, Homo sapiens
  chr11:133994694-133994744
  hyper
ctctaagcttgtcagcgaaaacgctgtgctgagcccggcagaagtctgcc

SEQ ID NO: 34188 - DNA, 953 bp, Homo sapiens
  chr11:134145474-134146427
  hyper
ctgtgttctttgcaacggaagaagcaaagacttcaaagggagaaatcggaagatttcttttttcatcgtagggacttcacatcagcgtttccaaaaccgagtccatcgccttttccctctgcgcagcctctatcccttcctgtgtttcgcatctcaataaacgtccccgccaagtgacttcagcctgaaacatgcggcctcccggactcctctctgtgtcaccgacctcttgcgctcagttctccggagctgccggtttaacctcgcaagtcttcccggaacccgtgccctcctcctgggcagcgttaccaccacgagcgcctacctgagaggacgcctgttctcatccagcctccaccctgcagccgagcaatctccgtaaaacgaacacctggcttagtttctgctggaaaccgttgaatagtccccactgtcttctggaagggtctgggcagctcggcgtggcgtccacggccccaccaggcctctgcctcctgcaggtcccgctacttcgtcaccaaagcgcccgccgcgctcgcatctgctgtgaggctgtgctcgggccgctcccgccgagggaacggccctcccaaggctctgcgccccaattctcgctcgtttgccaagaggtagccgtgtcggggagctagagttctccggggactctctcctgcccctcgtggccctctgtggaaccctcgttttaggatctgcacgccgtttccagtcgcgcgcgcggcacggagaccgcccgctgtgccccgcgctgcgctctctccgcccctctcccgcgcaggcctccctgtgccagccggctgtcgacccaggttaggaagcccgaggtcggggcgttaccccaagggccctcccgcttcccctccgagggcagagaggcgtccgcgcccggacgcactgcgggaacacctggagcgccggcggagctcggctgtccc

SEQ ID NO: 34189 - DNA, 232 bp, Homo sapiens; identical to SEQ ID NO: 1015
  chr11:134146444-134146676
  hyper

SEQ ID NO: 34190 - DNA, 236 bp, Homo sapiens
  chr11:134146677-134146913
  hyper
tcccgggctgcccaccaccccggcgcgtgcccgggagcctccaccctccccgggttctgtggccggccacgcgccccaggcacgcgccgcgccgggccgcgccaccaagcccgctgtccccagctttcctcggcagatcccctggctacccccaccctgcggaggggccgttcaccagatgccagaaaatcagggtggggcacgcaggccaggggctccagcggctgggcaccgtg

SEQ ID NO: 34191 - DNA, 336 bp, Homo sapiens
  chr11:134201818-134202154
  hyper
gccccagccaatgagcgccggcgggccggttgcccaggcgaccagtgcgcggctccgccccccgcggcgaggctcccgcgcgcggctgagtgcggactggagtgggaacccgggtccccgcgcttagagaacacgcgatgaccacgtggagcctccggcggaggccggcccgcacgctgggactcctgctgctggtcgtcttgggcttcctggtgctccgcaggtgagagagagcttcgcgcagcacctgccggaccccacattccccagccctccgcacctcgggttctctcctcccgcgacccgcgaatcccgagttcccggggggagcagccc

SEQ ID NO: 34192 - DNA, 209 bp, Homo sapiens
  chr11:134281434-134281643
  hyper
ctcttcccctaatcccggtcgacgagggcaggctgtgccgggttttgtttcgcagcccctcggcagcagcgcctcccagcccgagctcggttctcggccccctttccagctgcccccagcgcgcgcagcgcacacacacacacacacacacacacacacacacaccccagcgcgcgcccgggaggacatggcgtgggcaccgatgggga

SEQ ID NO: 34193 - DNA, 71 bp, Homo sapiens
  chr11:134281706-134281777
  hyper
cgacgagtccggagcgtctccggtgcggtccatcgcgggcaacggcccctacgccccggccccggcgcccc

SEQ ID NO: 34194 - DNA, 70 bp, Homo sapiens; identical to SEQ ID NO: 11103
  chr11:134282862-134282932
  hyper

SEQ ID NO: 34195 - DNA, 221 bp, Homo sapiens
  chr12:298173-298394
  hyper
cagcagagaggatggcgaattggtgcagggcgaaggaatctgaaagagggctgtgcggtccgcagagagcgaggcttgggagcccgacccaaagcgtgccctccagggtgcagcaccgacgggtgccgcggcgtttgcaggcggggagaaggcggcgggaagtactggactagctgcgggcaggggccggctgaggcgcgcgcccgcgtgctaggggcccc

SEQ ID NO: 34196 - DNA, 198 bp, Homo sapiens
  chr12:570015-570213
  hyper
gacgctggcggagaccgggcccctccagccgctccgggcttgcggttcccggggaggaggtccgtggggtccacgcgcgagctagggattcgggtgcgggatgccctcggccgtccacacccaggcgcgcgctccagtccgcgcagcccaaactttgcccaccgccttctgtttggctcactccgtttcctctcctgc

SEQ ID NO: 34197 - DNA, 68 bp, Homo sapiens
  chr12:1059279-1059347
  hyper
gaccttcccagattccgcccgggccgaggcagcggtggacctggtggttctcgcggcctctcaccacc

SEQ ID NO: 34198 - DNA, 349 bp, Homo sapiens
  chr12:1639033-1639382
  hyper
cgcgtagcaagaaagcggaggacataactctcttcccctctcagagcctcgggccccgcagacgccgaggtgggcgctcgtgccaggatcgcggggcgcgggtacgggctccttgggcgccccgagggggctgctggccggggtaagagccgcggtttcttcggaggatcgggtcgagttccaggagaagggggcagcaggcgtgcggcgccgggagaagggggccgggcggcggagactccccgtccgcacccccgcggcgaggcccccgggccgctctgcttaggggccgagggagccgggcgggaggcaggtgcggaggtcgcggtcccagcgcctgggaggagcc

SEQ ID NO: 34199 - DNA, 30 bp, Homo sapiens
  chr12:1906030-1906060
  hyper
tccccggggccagggcgggttataactagc

SEQ ID NO: 34200 - DNA, 556 bp, Homo sapiens
  chr12:2161498-2162054
  hyper
tgtcacttctacaaccgctctgattataattgatcaaacagaatcacggaatcacggctcatcttgccgttttgttcagtggcccgatccgaaacgagactctggtagtcgggcaaattgtattcctcctccttggaattccgctcacagaggccttcccggcgtggccggcccagcagggacgcgccgccgcagcggaggagagaacgcgggcggggggctgcaggccggcgcggggggcgcgacgccgccggcggggcgcgagggggtgtgtccgcgccgcggccaccgcggccaccgcggctggcgcccgggtgcgccgcgcgccccggcctccccgggggctcctcacgccgcccctcgcccgccggcggccggggcccgctccctttgacgtcatgcgggcggagggctcgctcgggcggcgctgccgcgggcgccgggagggggcccgacttcgggctccagtccgccgccgtgcgccccgcgccgtgcgcccggctccctgcgcgccgccgcagccacatctggaagcgttcagcgcgtctgcctccgg

SEQ ID NO: 34201 - DNA, 1443 bp, Homo sapiens
  chr12:2162067-2163510
  hyper
cgggcgggcggcgcgggcaggggcgggcgcgggcgcggcggggctgggccggggggagtgagcgcggcgctctcgcgcgcccggtgtctccctctcgctgcctctgcagaaacagctcctgccagagcggcgctcggcgcggcgcggcgggcccggagcggcggcggcggctcttcctgcctccgcgcccaggagttgccggctccctttgacagcagagagccgggcaggggcctcaggaggactcgctgggagtgggcagaggcgcctcggcccctgccggcccaggcgggccccgcgcgccccccgcccctcctctccgcctcttctcgccctgcctctcccgatttattttttcaaatggtgtagccgccggaggtgcggtgctcagttcttggaaggggcccggatgtactgaggatgcgttacagtttcactcgaggaggcagtagtggaaaggagcagtttttggggtttgatgccataatgggaatcaggtaatcgtcggcggggaagaagaaacgctgcagaccacggcttcctcgaatcttgcgcgaaagccgccggcctcggaggagggattaatccagacccgccggggggtgttttcacatttcttcctcttcgtggctgctcctcctattaaaaccatttttggtccatggtcaatgagaatacgaggatgtacattccagaggaaaaccaccaaggtaaggctggaccccgccgcctcgccggggctccctgccttttccaccgggttcctgccctacccgcgctccccgcggccccggggccggtccctgcggagtggcccggggccgcgtccgcgaggggcgcctccgcctcgtcggagcgcccgggagcccggcgggaccggggcccgaaccgccgcgcgagacggagcggaaaattcccgcccctccccctccgggccccagcttctccagagcatgtgtttcctgtgaaattccaggcgaggggggaaaagttccccaagtggctgccgccgcctcgctttctcgcgtccgcctggagagcccggctgcctggccagccgcgcggggggcagagggcgccggcgccgcggagcccagaggcccggggtccctcgcccggctcggggcgcggctgggagcgcgcgcgcgcgcaccctgcgccggcagagcccggcgcccacggccgcccctggggcgccctcgcgctgcccggcgtccactctcgtccaggcgcccctgccctgggcggcgcgctccaggtggcgggtgggggcggcggtgcagatgtgaagcccagcgcgcccctctggttccccctctgtaggtccccttcttcctctctccctccctcctccgccgctcacctacacccacccacctctccactgctgttgaccccgagcgcgcccacgccgcgtgtgttctcattcgcacccacatgtgg

SEQ ID NO: 34202 - DNA, 63 bp, Homo sapiens
  chr12:2800100-2800163
  hyper
agatcccaagttcatcgaggtcaccacccaggagctggccgacgcctgcgacatgaccataga

SEQ ID NO: 34203 - DNA, 402 bp, Homo sapiens
  chr12:2861741-2862143
  hyper
ccatctgctcctccccgctcactcaggtctcctgctcaggacgcccttgccgagggcgcggggcatttgtactgaagaagggctgcaggagagtcggtgacccctccttctacttgtatgtagcggccccaagtgtcccgggagctggtggggcgcttgggctgtatgagcccggccgccaggaggctggggctgcgtcaggagctgtccgtggtgcttaagcggcgtctgctcgggcgcggggtgtggcgcggcgggtgagcgctgtccctggtcctggagaggttcctggcccccagtggcaacggtgagagcagtggcccagaaggccagtaccgggaacgacgatggcgggcacaagggtgggcttgcagcagctgctgctggtgctcccacaggctg

SEQ ID NO: 34204 - DNA, 324 bp, Homo sapiens
  chr12:2862267-2862591
  hyper
cgcgcaccgggttttccagcaggctctcgatgccacccaccgccgcctgcgccctgcctgcccctgggctggcgcctgggagcgcgagggcgcgggaacccagcagcccagcggtcctctcccacgggcccagcctccctcccgccgccagcgccgcgtcaccgccaccccgattgtcacacactcaccacggggagaggccgcggcccagagcaccccttcctgtctcttggtgtccagaggaggctctgcctcccgctgggcagagaggagagggaggaggccagcgagagggagcctgtgtcggggcgtgggagggaagca

SEQ ID NO: 34205 - DNA, 405 bp, Homo sapiens
  chr12:3474894-3475299
  hyper
tcccgggagggcacacggcccccagaggcccagagctcttcccaaggcacaagtgcagaaggcggactcaggcgtgtggttaaggaccccctgctgcgggcccctgcacacaccaacgcgtgctcccacgcgccgcgactcccccgggatgcctgccccacccctatccgcagccagcgtccccctgcccgccggccccgccacggtccatcagggactgcgggcggcggaggtggcggcgccttgccgggacccccagcctccctcccccgcccccggcgccccaccccacgcgggcgcgcttctcccgccgcagccgcccgcgctcacctggcccggacacgggctccgccacgcggtgatggaagctgagcctagagaggcggagagcggcggctcgcaggg

SEQ ID NO: 34206 - DNA, 62 bp, Homo sapiens
  chr12:3475605-3475667
  hyper
gctttcaaacctccccgcgctccgcagcccccagcccccgccctacccgccctctcagatcc

SEQ ID NO: 34207 - DNA, 256 bp, Homo sapiens
  chr12:3599973-3600229
  hyper
caaatcgtaattcgccgaggaaggatccaggaactggcagaggagcgggagagctggggtgggccggggtggggagggtgcgagttaactgtggcccggtctcgcccggacctcgccctaggtgggagcacgcgcaccgggtctgagaacctgcaagagcctcgcccggcgccggctttctctgggccccccgcgcgggcctggcctccacgtaagttgtgtgcagcgccagggagtggaggcggccgagaccctc

SEQ ID NO: 34208 - DNA, 115 bp, Homo sapiens; identical to SEQ ID NO: 3839
  chr12:3600230-3600345
  hyper

SEQ ID NO: 34209 - DNA, 15 bp, Homo sapiens
  chr12:3600768-3600783
  hyper
tcaccaaacccttgc

SEQ ID NO: 34210 - DNA, 8 bp, Homo sapiens
  chr12:3600974-3600982
  hyper
cgctcgct

SEQ ID NO: 34211 - DNA, 214 bp, Homo sapiens
  chr12:3601042-3601256
  hyper
tgtgtgtgtgtgttggtggggggtgggggggaagttcatgtctcaggtcccctccctcttgaaaatgcaaaacagtcactctcaccccatcaccctctcctgccacccgctgctcccttctcccgcccccaagtcccaaaccccgggcagccgcgctcccctgccctctcctctgggctccgtgagggctcccgggtcccggctttgtgcagag

SEQ ID NO: 34212 - DNA, 62 bp, Homo sapiens
  chr12:3601510-3601572
  hyper
acccggcagggcacacgggccgcggccaccttcagcaccagggacagcgtccgcccctgcag

SEQ ID NO: 34213 - DNA, 696 bp, Homo sapiens
  chr12:3602021-3602717
  hyper
gtctggtggggctgccgcacatttcacatatggttacccatatgcagcggggggcggggatgggggtgtggcgcggggattgtccctctgtcttgccggaatgcaaaaaggtagagagacccttcctggtcttcttccctcgagttcttaactctgcgctaaaacccctaccccacggcgtaggcagcaaagctttataaatcccccttctctgagagactagaagcagcatgcatctgacaattgtcaatttcaaaacaaacacgctccgggacttgaacgcagcggggcattcagtagcgaatgctgtctccttgagttagggcaaagcctgcgtgcccgccgtcccctcaccacttcctcttccccagcccccacctgagagcagacattcggaatgatgtgtagtgcgaggcggctagcctcccagcagaaagccatccttaccattcccctcaccctccgccctctgatcgcccacccgccgaaagggtttctaaaaatagcccagggcttcaaggccgcgcttctgtgaagtgtggagcgagcgggcacgtagcggtctctgccaggtggctggagccctggaagcgagaaggcgcttcctccctgcatttccacctcaccccacccccggctcatttttctaagaaaaagtttttgcggttccctttgcctcctacccccgctgccgcg

SEQ ID NO: 34214 - DNA, 15 bp, Homo sapiens
  chr12:3602864-3602879
  hyper
cgctcccccttctca

SEQ ID NO: 34215 - DNA, 329 bp, Homo sapiens
  chr12:4140405-4140734
  hyper
actgcctgagcctcccgcccgcccgccgcgcccccgcccggggccgggaaacgagcagggacaactccccgcccgcgcctccccgcgcccggcggcccggctagcaacccagaggcgcggcgctgcgattggctgcgcgggggagaaggggcgctgcgctgctccaatcgccggccgcgcccggaggccgcgccgccaggaggccgcggacgcgtgctcgcatgcctgtggtatttgctcagaggggcatgaccacttcgggcaagcctttaaatgtgagtcagctttcggccgatccctgggaaaaattccttcggtgttgtcaggca

SEQ ID NO: 34216 - DNA, 419 bp, Homo sapiens
  chr12:4274001-4274420
  hyper
cgtccgccccggggagagctggaaggtgggcccggatctcccacatcactatgagctcattccagccccggccaagcaaagcctggccctactcgctccacatgcatttcagtctcctctcgcctttcatgcgcggaggagccgggagggagaggatgtgacctcatctgcgcggcatctgagcccaggggtgccccagctcttccacccaggccgctccccgagcccagctccccgcgcccctctctctatccaggagagacgcattggacagccaggagggctcgacgtggaaggaaaggaagctgcaattctgggacaggggcagacgggagaggaagtgaacgtggctaaacgctcactttatgtaaaacgtcccccagactagaatctcgtccacagagctgcacacatacact

SEQ ID NO: 34217 - DNA, 577 bp, Homo sapiens
  chr12:4377981-4378558
  hyper
gcagcaaaattcatccgatatcgctcacaatgcatgcacgggttatcttacatgtaatagccatcgtattaaccaacccagctgatactgagatggtgaatggggcgggggagcagggaggaatatgtcgcgcatgaaaaactccgggtgtaaaagtcaatgcagaactcactccccgaggaaccgaaaaagacattcacgactctcaagtggagagaggatagaaagtcaagtggcgggggtcgcgaccagtgatcgggatttcagtctgatctcagtacccagcggaacaggaccataacctaaagaaatgagctttttccggagcaaagagcggccccgatttcaaagtagaaaaaataaactgcttgggggtggaagatggcgaggggcggggggcggggagggaggcgggtcgcggcgctggctccggggtccgcggcacggcctcctctgccgcgctgcccagggcccggaccctgcccggcgctgcgcccaccgcgagggtgccagacccgccgcgccgccgccgcgctctcccagccgcggccccctcccccgccgcttcctcttgctc

SEQ ID NO: 34218 - DNA, 1118 bp, Homo sapiens
  chr12:4378802-4379920
  hyper
ttccagagctattttcggccgcgtgaggcgtgtcctaagctgaatcagacaggaagagggggaagttcgggtcttttaattttttttttttccgaagggaggggagtgagatgctaggtgggtgacagacggcaggcgctcgccttcttaactcacgcctgtcgcatctgccgcctcagtaatccagccccgtccaagccgaaattcgccgaagggagtgcggatgcacaggcctggcggactctgcccccctccagaacgcagcggcccagcgccccggcgggcgcggctgcgaccagagggtcccggaagcgagtgaacacctgcaatcgcactgcccgtccccacccaccctgctcccccgtgctctccgcttcccgacgttttcctcttctccttgtccgcatttttctactttgcctgcactccctccttcctcttgatgtgcctcctatgtgtcccctcggatttatgtgtcccctcgcattttgccagtcgggttttcggttttgattgaccgtccatccctccacggagaaacacaaacacagctccactctttgggggagccgaggggaaggcagtggctcccatttctgagcctgaactcagtcactacccgctccccacctggcctaggcgcccctgcgcggagaaggcgggactcgaactcgcgctgctcccgggccttgagccgaccgcggaatcacctggctgggaggcatcctccaggtaagcttgggagtatgtgtgcttagtgctgcaggctcctgcagaaaagtgcctataaacacccaacaccctgctgcaccctccacctccaggctttgtacactttccaaccgaaactccaaaacgctagcgtagagggtggggagccggccggaaaaagaataaaagtccaataaaactggcgttcgctaaagtttatcaccagtcctacatgggatatatatatatgtatttttttttccgtgaagggtgaaaaggagataaggaagaaccaacaatctaccccctcccgccgccccccacccccgcgccacggtgatcagtttggacttcaaagccagagcacaggctcttgcgctttttcttgaaaccgaagtctacactga

SEQ ID NO: 34219 - DNA, 30 bp, Homo sapiens
  chr12:4380166-4380196
  hyper
ggaacagtcagtaatcggaaggggaagtgg

SEQ ID NO: 34220 - DNA, 139 bp, Homo sapiens
  chr12:4380525-4380664
  hyper
ctggatgcctttccccggagaagggggggtgtgcggagtcggggtggaagagaccttgctcgcagagctatatcaagtgatgtccagaggctgggagccccggcggcctctgtcccttgcctgtcgggttagatttata

SEQ ID NO: 34221 - DNA, 41 bp, Homo sapiens
  chr12:4380888-4380929
  hyper
acacggtattcggcccgggtgtcatccgcggcgctggactg

SEQ ID NO: 34222 - DNA, 508 bp, Homo sapiens
  chr12:4381878-4382386
  hyper
gggcgaaggaccgagcgtggaggcctcatgcctccggggaaaggaaggggtggtggtgtttgcgcagggggagcgagggggagccggacctaatccctcactcgccccctccccctcccgggccatttcctagaaagctgcatcggtgtggccacgctcagcgcagacacctcgggcggcttgtcagcagatgcaggggcgaggaagcgggtttttcctgcgtggccgctggccgcgggggaaccgctgggagccctgcccccggcctgcggcggccctagacgctgcaccgcgtcgccccacggcgcccgaagagcccccagaaacacgatggtttctgctcgaggatcacattctatccctccagagaagcaccccccttccttcctaatacccacctctccctccctcttcttcctctgcacacactctgcaggggggggcagaagggacgttgttctggtccctttaatcggggctttcgaaacagcttcgaagttatcaggaa

SEQ ID NO: 34223 - DNA, 802 bp, Homo sapiens
  chr12:4383224-4384026
  hyper
gaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtaggtcggggggtggcgctcgccaggagccaggacccctccggatgctcgggtccccggccggagccctaaacctgggagagggcaatccccgcgccggcctcccggctcctgtgcgggagtttaccgcgcgccttctggcgagacgcgtggctttatttctgttcctctccagataaactggggaggcagaggggggaggaaaatctgggagaagcgaggctgtcctgggcgggggtaggggagcatcccgcgcgcgtgttcctgcatgtggctgcctcttcttcccacccccctcgcgacctgtcttttgcgaagccgccgcggctgcttgcgctgcggccaggaagagagtcggggcctgaaatcgggaccccgagtagaaaggcaaccccccccaaaaggccagagcaaattcgtcttggcctcaggtccccgcctgtggtcgcgactccgcgctggcacttcaccggggaggtggagggaggagggagaaggagagaaacggggaattcgggagccccggaagtcccattgaagaaacgcgtgtttcaggggaacccaaaagaaccgcttcttgcccctcactccaagtctttgcccagcgagccgtgtgcccacgtat

SEQ ID NO: 34224 - DNA, 808 bp, Homo sapiens; identical to SEQ ID NO: 1018
  chr12:5017990-5018798
  hyper

SEQ ID NO: 34225 - DNA, 6 bp, Homo sapiens
  chr12:5018799-5018805
  hyper
cgagcc

SEQ ID NO: 34226 - DNA, 229 bp, Homo sapiens; identical to SEQ ID NO: 1020
  chr12:5018806-5019035
  hyper

SEQ ID NO: 34227 - DNA, 659 bp, Homo sapiens; identical to SEQ ID NO: 1021
  chr12:5019084-5019743
  hyper

SEQ ID NO: 34228 - DNA, 521 bp, Homo sapiens
  chr12:5019793-5020314
  hyper
cggctgttgggcattggggaaagtgggatggaagagccccaaacttggatttccgggtgtctgcgtgtcgtctgtccgtgtgtgtgtgatagccctagcaaacgtccagtgctttctcaagctagaggtctgtgttcttcggtgtctgtaggtccgtcccatctgaatgcttctgattttctacccccgtatcactttctatttctctgcagcgtgcatcgatcgccctggtgggagcttagaaggcggcaggcgaagaggggtaggaggggggagagccgaggagaagcagagagggtggcaggcgtggggatctgccgagccggcactgcaccgggtcctaggaaggctctcggaggggaggggaggccagggcgacccccgaagcaatggcccagtccgctagaacggcactgcgttaaggcacctgggatcaggaagaaatatctaaacaacaacaacagaaaaccaacaaacccccaaacccaaacccaaccctctgcaaaaagctgcacccggcc

SEQ ID NO: 34229 - DNA, 372 bp, Homo sapiens
  chr12:5152915-5153287
  hyper
taggggccccagctgcgccctccggggagacacccgctgccacgagacccgggaggggaagcgggaggagggggagaggaggggaaggcgggggaggcgccgagggtggaggccaagcgcggcgcagccagagaggggcggctgaaggttgcatctgctggaaggaggcttttcggctgcttggtaacgggctgccagaagagagagaggcagagagcagggcagcggcttcttgacgtcagggccaagcgaggggatcgcgccagcaaccccagctctccccagagaggggccggccgaccgctggagcggagcctgacgccaggcgcccgcggagcgtgagtagggggcgcgggagccggtcagctgggg

SEQ ID NO: 34230 - DNA, 104 bp, Homo sapiens; identical to SEQ ID NO: 11129
  chr12:5153357-5153461
  hyper

SEQ ID NO: 34231 - DNA, 102 bp, Homo sapiens
  chr12:5541088-5541190
  hyper
aaatgaccccttccccgccacgggtcccgaagtgagggcggggggggggctctggggcgcgggcgcgcgcggcgcggcgcgggccggcgggggagggcggcg

SEQ ID NO: 34232 - DNA, 205 bp, Homo sapiens
  chr12:5541504-5541709
  hyper
cacggtaaggggaggcggcgggcaccttgggtgggcaggtttggggatgggggtccacgtggggagggattttccagtggactggtgcggggggccccagatccgcatcccgccccacccccatcgcgccgcgctcactcactttcccgggcttgtgtcttccccaaagtttgcgctgggatctgctcaggccgaagcgcaaccg

SEQ ID NO: 34233 - DNA, 896 bp, Homo sapiens
  chr12:5542015-5542911
  hyper
tggcagacagaactccgggcggggaggtgccgcggcagctcccctgcacacgccctgcactctgccggccgctgagcctgattctcagctcgccccagcaccactctggcccgggcgtgggctggggggaggggacgcgcagctcaggacccggaacctcgcgttccagttttgggagttgggactcactgccacgcgccgcgtacctgcgttggagttccccgaaagggttttttcagaaaagacctcgcgccccgggctcctcttggccagcgcccacccggtggccaccccaccctgggcctttgcgcagatgttggagctccgtacgcagcccgcacatctgggacccctccggggagcggcgggcacccgggcccggccatcccaggggatctccttgcggtatcgtccagcctgttctcggactttgagcggtggcgtgggaggccgggagacctgggcacccgcgcagccagccaggtcggagtttaaaggtcccacgacggaccgaactgtcccattgccccagagctttactcagtggtggatgctcctgatgaaatttgggacgcttgggagttgaaggttagggacaggaggggcgagggccgagggcatgggatgggggagtaggattctgcttgttgctctccgcgggagtgggtgcgcgtccaggaggcgctgcttctttgcgggagtttggctgctgcgttcattcgtcgtctgcgcttcagatgcacggcactgagacccttgcgtccgacggtgtcggggctgtggactagaaaggatcccttttgctggaatcgaggctggggtgggattgccggtgggggaaacaccgaaaagatcgtctggcctcggcctctggcggcgggcggcaggttctgagt

SEQ ID NO: 34234 - DNA, 116 bp, Homo sapiens
  chr12:6444922-6445038
  hyper
accaactccacatttcggagcaggaggccagtcaccctgagtcagccacggggagacgctgcagctgtaagctgtgcaggcccggaagttcaagcctcagccgcaaacaggggaag

SEQ ID NO: 34235 - DNA, 30 bp, Homo sapiens
  chr12:6450544-6450574
  hyper
gacagaattcagaaccgtctggactccccg

SEQ ID NO: 34236 - DNA, 90 bp, Homo sapiens
  chr12:6472461-6472551
  hyper
acttttttttttgcccgcgagcccacgaggccccgcgtggtgtcactgggctgcgcgggcgggtcaggaaaggagcggagcccatgggtg

SEQ ID NO: 34237 - DNA, 46 bp, Homo sapiens
  chr12:6472854-6472900
  hyper
ctcctctttaatttccgggtacctgaaggggcgaggggaagagggt

SEQ ID NO: 34238 - DNA, 153 bp, Homo sapiens; identical to SEQ ID NO: 3849
  chr12:6664370-6664523
  hyper

SEQ ID NO: 34239 - DNA, 65 bp, Homo sapiens
  chr12:6809448-6809513
  hyper
cgaggaaaaggaggtcggcgaagggaccccgaggcagggagtgccgagagcggactggggacccg

SEQ ID NO: 34240 - DNA, 30 bp, Homo sapiens
  chr12:8088887-8088917
  hyper
aatcttgtgatctctcggaattctgtgtta

SEQ ID NO: 34241 - DNA, 386 bp, Homo sapiens
  chr12:8123142-8123528
  hyper
ccgcgctctccctttcttgcactcgtctttatcttctaagccctccacatgcttttaaactgtcagtcttttcatttttatttcttcctcttggacgcatttacccaaattggcccgagggaggctgagacagcagatacgaaagaaaaatgtgtgtatgcgtgagtctttgggtggcgaagaaggaggaggaggaatgtagctcggggctcggcccccgtgctgggattccgagggcgggggacaggatgcgcgcgcggcgggtagcgtgccacacggcacgtcccggccgctgcaggaaggcggggctcaggtcccgccgactcccacatgctgggggacaccgggagcgcctcccactcccagcccgccggagagccttgcaa

SEQ ID NO: 34242 - DNA, 592 bp, Homo sapiens
  chr12:8171294-8171886
  hyper
aatctggccccaggccgccgccgccgcgcccggcagtgacagcgaccgcgccgctgcgctcccgccggccccgcccgcagccgctgggacccactaactgcctcgaaaagcctaggattcgactttgaatggtccgttaatgtggtcgcaaaacgtgactcggttcatcgggcgctccctgtaagcaagacaagcacccacctgcggtcagagcaggggtccggctcgcggtcggggttgtccaggccctcccggcttctcacctgcgcaccacacggtccagccctggcggctgcaggggatccctccgagcgccccctcaggcgtcttcctgcgaccggggagagggaaccctttacggggaaacagttttggggcccaccacccttggcgccgccgttaggagggtgtgaacatttctgctttaagagatacccgagcccctcaccgcctgcggcagggaggtggtgccccggctatcgccgcgggctggccggctgggctgggaagaaggctcagggtgagatcaggcaaagagttctttcggactcacgagctctttttggatgaaaagccccgcagttctctccac

SEQ ID NO: 34243 - DNA, 92 bp, Homo sapiens
  chr12:8548890-8548982
  hyper
tcagaatgaaggccgccctcccaacttcaacccggggcaggccacggagcctctcgccgcccctacccctcgttccccgcatccccgcgcac

SEQ ID NO: 34244 - DNA, 160 bp, Homo sapiens
  chr12:10306356-10306516
  hyper
cccagccagcacatccgccatcctgcaccccaggttccggcacgggctgcgacggggcctcggaactgctcccaagcggctgggaaagaactcagtcaggcatgtcggcctgcaaagcacccaggatgggcagtggagtctgcaccgttgacaggctcct

SEQ ID NO: 34245 - DNA, 279 bp, Homo sapiens
  chr12:11653509-11653788
  hyper
cgacgagctggagcggcggctgaacgagctgagcgcctagaatcgcagcctgtgggagcatccgcagctgccgcaagcgcagcctccgcccggattccttacctcgtagccgtccccgctgccggccctcctaggcaccgctgccgccgccaccgccggggcccaggaacatcttcaggaccacggacagcgctcatccgcccggccactgcccgcgcccgagctggcatcgtttcagaaccacgaacagctcctggcgcaacccgagccagaccctgg

SEQ ID NO: 34246 - DNA, 30 bp, Homo sapiens; identical to SEQ ID NO: 11139
  chr12:12869188-12869218
  hyper

SEQ ID NO: 34247 - DNA, 43 bp, Homo sapiens
  chr12:13069440-13069483
  hyper
cagacacccagtaggcgcgaggcaaatgcgtcccattttaaga

SEQ ID NO: 34248 - DNA, 208 bp, Homo sapiens
  chr12:13154576-13154784
  hyper
ctgagcgggggcccccgaggtgacggccagcccggcgcccacctgggacgcaaccccgggcaatgcctccggccgcggggagcaaatcaagaaagggccgagaaagttgtgatcggctctgtcctgacgctcatctctctgcgatcgcgggcaactgcctggtggtatctccgtgtgcttcgtcaagaagctccgccagccctccaac

SEQ ID NO: 34249 - DNA, 51 bp, Homo sapiens
  chr12:13431314-13431365
  hyper
caggggagcaggggccgctggccgggaatcgcaagccggtctcctgtacat

SEQ ID NO: 34250 - DNA, 30 bp, Homo sapiens
  chr12:14133113-14133143
  hyper
ccagagtaattattccgtgtgcatgtgagg

SEQ ID NO: 34251 - DNA, 30 bp, Homo sapiens
  chr12:14133343-14133373
  hyper
gagaaaaatgcattccgaaaaagatatcaa

SEQ ID NO: 34252 - DNA, 1668 bp, Homo sapiens
  chr12:14133587-14135255
  hyper
gaagggggggagaagcggcaccatacagcaacacacactcacacacacgcagaaacacaattcccacttaactcgccagcgagtgcggcccccagccccatctgcattgctgctgacttgtctcgctcgctctccccatcgcctccagcagcagcgccgcctcccaccccgggcttgtgctgaatgggttctgattgtgcacggggtgcacactgggcatttcttggaaggggcacactgacgcgcgcacacacgcccccgacgcgcacgcgccccgcgcgcactcacactcacccccgcgcacactcacccccgcgcacactcacgctgccgccgcgctgaggtgcagcgcacggggcttcacctgcaacgtgtcgattggacggatgggctcggcgcgtgggtccggcccggggcgccgctgccctgcccctctgctaggtgaagggatgaaaccccccaaaagaccagagacagccctacccagtcacagcaccccctcccccacaaaaaaaaaaaacctttaaaaaagccacgtccaaattagcaagtgccgggttctgctggatttcagagctttacctcatgccagattcgttcacgatttcacggcttcgaccctttatctgcctgacacccccaaacccctacattcaaaggagagactccaaagcccatctttacgtaccggctccgagcgcctccgcggttgcagtctgcggagaggggtggccggtggctgggaatggagggttttcctttcctgcaaagcaggattaatgatccgtctcgggggttttgaagttcatgactcttctttgcaaggcaaaaggatatgcattcggacgccagcactactggatggtggtgatcaagaatcacccttgacgagcactctcgatagagcgaagccccgagatttcctagaggtgaagaagccggaggaagtggtttttgaaagggggtggggggaaccttcctttctcaaaaagaggtggggggtggagaggcaggagcccagattccagttggtgaggatcggagccgggggaagggaagcgggcgggggcaggctgtgcaagtcaaccgcgcggcagccggagagggagagcaggaggggaggaggggagcgtcagaaaaatgggtattaatcaccggggacggggggaggcgcggggaacgcaggttgcctggtctggatttgggtctcacactcaaaaacgtgccgcgcacacacacacagacacacacacaccccctacctcgcacaccctgactccggggggaggagaaacccacgaagctggggaagatactgcttctgctcccaggggcgggtgtgagcgcgcgtgtcctctttctccacaccccccaccccaccccacccccaagcccctgcaccccctcactcctcttgctaagactctggcggaggcagcttcccacgtcatgtgctggggaagtggggtggtaaggtggatggaagggggacggaagggggaagaagcttagcccgagtccgtggcgcctcctcccggccgcagcggggaacagcaccgacggagagcggctgaggggcgaggggagctagacagtgccccccgtgggcggcccgcgggctgcggaaagcatctccaaggcggagctgtagttcgaaattgaagaccc

SEQ ID NO: 34253 - DNA, 333 bp, Homo sapiens
  chr12:14927056-14927389
  hyper
ttatgtgcttggaagcgagcgtggtcgtggaaaacccgtaaccgctaaattcatctgggtccccaaagactgagccggctggcctcgttatttatgtgagcggctatgtaaatgaggattcggagattgctctattgattggagagagctggaggaggcggtctctcttccagagcgctagttgggagcggagcctgcctgtcattggtcaccagagccaatggaaaggggctgccgcgcggccgtaaagagtttgtagaggcagttcgggtgcggtacgttgcattccggtaccggacgccgagagcggtttgtctccgtctctggagttgt

SEQ ID NO: 34254 - DNA, 83 bp, Homo sapiens
  chr12:14927697-14927780
  hyper
gggcaaagtgaccatcgctcagggcggcgtcctgcccaacatccaggccgtgctgctgcccaagaagacggagagtcagaaga

SEQ ID NO: 34255 - DNA, 30 bp, Homo sapiens
  chr12:14928130-14928160
  hyper
gggtggaagccacctcgctgtcagtagggc

SEQ ID NO: 34256 - DNA, 328 bp, Homo sapiens
  chr12:15374199-15374527
  hyper
agccctcccacactgcgcagcccaggcttcaggttgcgtttgcgagttgctgggctgcggtcgtgggtgggactcgccgcagaagcaagtgccagtggcccggcgggggtctcctcactcgcgctcgctccgactagcggcggagggactgcggcaggacgcgagctgagcccggccaaggccgctgcgctcagcggccaggatgctgcagtgcggcgcttcggcgccccctactgggggcaggggcaggctcctcccgccgcgctgcctcccaggcttgcgagcttgggtctttaacgtgctgcacccaagacgggcttcccttttt

SEQ ID NO: 34257 - DNA, 70 bp, Homo sapiens
  chr12:15475751-15475821
  hyper
acccctttttcccagcggtccgggcggcagccgcgctccggcgccctcgctctgccgttgggagcggcgc

SEQ ID NO: 34258 - DNA, 41 bp, Homo sapiens
  chr12:16500483-16500524
  hyper
tggcgaggttggggtcgggctttaaacgtgggagggctaat

SEQ ID NO: 34259 - DNA, 119 bp, Homo sapiens
  chr12:16757916-16758035
  hyper
agtgtggacctggtgcgcagcctacaccgccgaggaccgactattgtgaagccactttgggagcgggtcggagtggcggcagggggtgggggaagggatgaggacggccagacaagaca

SEQ ID NO: 34260 - DNA, 30 bp, Homo sapiens
  chr12:16758398-16758428
  hyper
acagccacttttccacggcaaaggaacaac

SEQ ID NO: 34261 - DNA, 89 bp, Homo sapiens
  chr12:20521231-20521320
  hyper
cttaaagaaagaaagcggaattgtcgatcactccagttgccagttttatacaattttaagcagtcgtcgccactcgtttcccctttgca

SEQ ID NO: 34262 - DNA, 74 bp, Homo sapiens
  chr12:20521767-20521841
  hyper
gaatggcccggagcccgccctgcgcccccggctcctccagcgtcagcggctcctgcgcgcgggatgcattgggc

SEQ ID NO: 34263 - DNA, 425 bp, Homo sapiens
  chr12:20522347-20522772
  hyper
cgtggctgctggggagacctggtgctgcagccgctccggagctctcggaaactttcctccgcgctgtgcgcgggctccctgtcctttctgctggcgctgctggtgaggctggtccgcggggaggtcggctgtgacctggagcagtgtaaggaggcggcggcggcggaggaggaggaagcagccccgggagcagaagggggcgtcttcccggggcctcggggaggtgctcccgggggcggtgcgcggctcagcccctggctgcagccctcggcgctgctcttcagtctcctgtgtgccttcttctggatgggcttgtacctcctgcgcgccggggtgcgcctgcctctggctgtcgcgctgctggccgcctgctgcgggggggaagcgctcgtccagattgggctgggcgtcggggaggatcactt

SEQ ID NO: 34264 - DNA, 620 bp, Homo sapiens
  chr12:21680400-21681020
  hyper
cagtaacccgacctccgctccaaagcgcccttgcggcgtccggtcaggcgcggggctttcctccagagctccagggcccctggctcagcccggggttgcgctgggagcgctggaaactcggcagccccgcgcgaccctatcctggagcaacctgccccctccccacgcccggggactgcgctgtgccgggaggagctgaggtttaagcccgggttgtcccgggccaggctgtcgctgagccccaggtctcgtttttgcagagggtcgccgcttcatctccgaccagagccggagaaaggacctctccgaccggccactgccgggtgagtgaccaagggtgcaagggcgctagtcctgcgcttttggaataggatggggcgggcagggcttgctccgcgctggtgccgaaagaaagcgtctcctcaccggaaagacgcggctctgaggcgccctcagatacagtccgcccgagggcagcccgggttggcagcagcagcagctggatgccgagcgccggagctgggagctcgcgcgtccagccccgcgccaatggtggcaagggcggcccaggctggcgctgcggctccccaagccttattggcttgcggctgttcagccag

SEQ ID NO: 34265 - DNA, 479 bp, Homo sapiens
  chr12:21810495-21810974
  hyper
gcacggccccccctgcgccccaaactgagcggcaaagtcagggcccgcggccggatgctcagagctaaaggccgcggaggacagatgtgcttcttcctccttcccgcgtctccccatacaagtactaccccgcacgtcccatcaggcttgcctgtgggccaggattcagggtcctgagccgaaacctaccaggagagagaaggctctggagacctctgtaacagtcgtgcggagaagacaaagtcagctgcgtgcgtctcctccggcgccggctctgcaaggagggaggagggggcggggccccacaaccaccgcagcctcttaggtttctccattgtgattggaaatccgagtaccgcctacccctcccctcggctcgctcaatccccttcaaggacaagggctcaagtatgcacactccctcccccaccctccagatgaggaggtctccttccagaggcttccgctctcagctggtc

SEQ ID NO: 34266 - DNA, 208 bp, Homo sapiens
  chr12:21927174-21927382
  hyper
gaattattttaaatgcgaaagaagtatgagttgcatctaaaaagagttaaaaaggttcctgtggaaatcataatattataaattgaaaacttttttttttttttttttttacaacgaaggaatcaaatatacaaggtgcgggggggaaaaaacccaagacaacagcctgcgggttgcagtagggagtgtgccccgaaaagtccatcca

SEQ ID NO: 34267 - DNA, 30 bp, Homo sapiens
  chr12:21927596-21927626
  hyper
acaaattgggggctgcgtgtcctaaggaga

SEQ ID NO: 34268 - DNA, 45 bp, Homo sapiens
  chr12:21927907-21927952
  hyper
ggccagagggagggacgacccgggggagggcgggacctgcagagc

SEQ ID NO: 34269 - DNA, 34 bp, Homo sapiens
  chr12:21928417-21928451
  hyper
taccccaaacagggacggccgttaacacttcagc

SEQ ID NO: 34270 - DNA, 71 bp, Homo sapiens; identical to SEQ ID NO: 1024
  chr12:22093889-22093960
  hyper

SEQ ID NO: 34271 - DNA, 308 bp, Homo sapiens; identical to SEQ ID NO: 1025
  chr12:22093961-22094269
  hyper

SEQ ID NO: 34272 - DNA, 471 bp, Homo sapiens; identical to SEQ ID NO: 1026
  chr12:22094577-22095048
  hyper

SEQ ID NO: 34273 - DNA, 83 bp, Homo sapiens; identical to SEQ ID NO: 1027
  chr12:22486799-22486882
  hyper

SEQ ID NO: 34274 - DNA, 326 bp, Homo sapiens
  chr12:22487133-22487459
  hyper
cgtttgtcgccgggcccgcccgcaggggctcatcgcagccccggcgtcccaggggcgggggccggggcctcagcacaaagctaggcgaagtggcagcggagggtcccccaccgccagccccccatgcacacacacctttggttctcttacttgcaaacgcacgcacgcttcttcggccccgtcggccccaaaggtcagcgcaaggattttttcaaatgcaacttttccaaggatttctttctaggggaagtggctgggggtgaagtcacgatctatggccatggtcgcttcccctgcagaaggcgggcgctggggtctccgagtgc

SEQ ID NO: 34275 - DNA, 807 bp, Homo sapiens
  chr12:22487460-22488267
  hyper
cagagagcggcggcggcgagtcgctcccgccggttctgcagcatcacggtcgccctcggcgagggtccgggagaaggctcggctccctcctaaacatgtggcccgtggcgtccccttgtcccctccgagcgatgctcctgcgcccttcgccgcctcccgcgctgctgcgccgccaggcaacccccccccccccaccccgccccgagacgcgctctctgcgccgcaccaagtccttggaaatttccacggcggcccgggaccgctatcctgccccgggctcctccgcctcgcccgccgggaccctcgctccccacccctcccggagaagaaaagaactcgctctcatcagttaattcagcggcgcgccgcagccttccgctgcgccccggacttcgcagacaaacgcccggggattggtggaaatcaaggtctccccctccctcccccacccgcaaaattgcctccttcgacccgatccgagccgcgacactcgcccagagcgcgcacccctcactcgtgcccttgttctttggagataacggcagacaataaaaaccaacagccccccgccaatagaaatatatcagtccctgagtgtggcggagactggctaatatcctgatccttcgacaagcggccggtgtgcccaggctgtcaccctgctgccgtcaccctagtctttctctagctggttggatattaacccgcagccaggcgcgaggaggctggcggagatttattccttcctgggcccccacccccattagccggtcccggagccgcggcccgtgtgtgtgcgcgcgcgcc

SEQ ID NO: 34276 - DNA, 340 bp, Homo sapiens
  chr12:22488339-22488679
  hyper
cgaggaggtgcgtgcactccggggtcctccgcctcgcctcctccctgaaaggaagtgctgcatccagatgtgcaggcagctggtgcccaaacactagacctcaagatgtcacattgccttggaggcgcgcggccttttagattaaaggaccgttggttcttagacgtccttcttgcccttcttgcttgtgataagcgataagcttatcgcaaccccgaccttggaaaagcaccacccgccttgacccaccgagccgagagagtcgctgttagccatttctgctcgccccggcggccgacgcatagctcgggtacctcctagcggtcgcctattctatttg

SEQ ID NO: 34277 - DNA, 302 bp, Homo sapiens
  chr12:24714636-24714938
  hyper
ttgtttcagaaattccgggcgggagggagggggagtggtagggagaaggattgcagaaagcgaaacaaaaagacgaaagagtcgggaggtgggggtgactaaggttagggggtgggccaggggtcgctctgatatcctagaagggttaaggggctttgtccaacttttagggtctggccttggacattggccgcgatgcccagcacagcccagggttctccccgcactctcctctcgcatcaaccacctccaccgccaccacttacaaaacaataccagcaacagtacgcaggcttcccaac

SEQ ID NO: 34278 - DNA, 225 bp, Homo sapiens
  chr12:24715158-24715383
  hyper
gctgagtggcgggcccggcgagcggcagaggggagctctgcgccttggaggtctgcccacaacaacatcgggacgaacaacaaagttaaaacgcagcgattcacgcaccttacccggtctcgttaatgcctcctccggcgtgggatgcaaagtggcacagaggcgggctgggggcccccgggaggagactggagatgggttttggtggctcgcctttttcactct

SEQ ID NO: 34279 - DNA, 447 bp, Homo sapiens
  chr12:24715757-24716204
  hyper
ctccttcttgcagctcgccgcccggccgccctctctatccatccgaagggaaggagccccagagttttcttccccgtctgctgcagagtaactagattgtaaataacgcggcgattacccacaccgtgcaggaattttttttttatctgccctccacttaaaggagcgataaaaatgaaatggcaggagtggaaggagccagggagagcgggatatctctagatctcgatggagctcgcatctataaatacgcattcatgtttagtcaagtccctttgtcaacttcttcccggcgcctgagcctcagccgctgctctgcgcccaggacctggcccctcccggccccctagtccagtggtcaggcggtcgggccggcagggagggcgcgcgcggggggctgcggggtccgtggaacctttccgggaggcgagccgcgggctgctgggc

SEQ ID NO: 34280 - DNA, 212 bp, Homo sapiens; identical to SEQ ID NO: 11164
  chr12:24716205-24716417
  hyper

SEQ ID NO: 34281 - DNA, 245 bp, Homo sapiens
  chr12:25056242-25056487
  hyper
cgcgagcatccttgtttattaaacaacctctaggtgaatggccgggaagcgcccctcggtcaaggctaaggaaacctcggagaaactacattagggcagcttttccaccgactccaaatccaactgacaaaaagcagtttctgccctcgagagtttgcgggcggggattgacatttgtgcgtctgctcttgtctgccactgaccgctatgtgcaaactgaagggggagaacgtgaatccagcttt

SEQ ID NO: 34282 - DNA, 623 bp, Homo sapiens
  chr12:25101375-25101998
  hyper
taacagtgaaaagatcgttctccctcccctctccacccgggtcaactcttccagccgctccctcctgcatcacgaacacacgctgcaggaaagcgcatttacagcccgggacatccccagacctcctctccaaaattccccacctcctgtgcataggagaaactgagagaagccctcacttcctttccaaacttcacaagcaggggagggagctgtagcagactttcacctccgttcccaaaagcgaatgtgaaaaagtccgagaaggcacgtcctgcgagtggaggttaaaccgaaatctgaacagaatgcacggtccccgcaaactacgattgataaagaagatactgagacgtttgcgggggatataagccatggttgtctcgccttcctcccctccctgccaactatgtttcttggagaaatcgccggttcgattcacgcacacatttttgtaaaacacggacaaaaccataagtagttaccttcattgttccgtcggccacgagggaagctcgagctgagcggagggcagatcccaagggtcgtagcccctggccgtgtggaccgggtctgcggctgcagagcgcggtcccggctgcagcaagacctggggcagtgcc

SEQ ID NO: 34283 - DNA, 77 bp, Homo sapiens; identical to SEQ ID NO: 3860
  chr12:25102009-25102086
  hyper

SEQ ID NO: 34284 - DNA, 57 bp, Homo sapiens
  chr12:26348245-26348302
  hyper
agtgaggaaaacagacgccccgcactcgcacacgcgcgcactcgcagcctgtctgaa

SEQ ID NO: 34285 - DNA, 219 bp, Homo sapiens; identical to SEQ ID NO: 11168
  chr12:28122168-28122387
  hyper

SEQ ID NO: 34286 - DNA, 35 bp, Homo sapiens
  chr12:28123589-28123624
  hyper
gccggcggtccccggcgcgccgagctggacgagcg

SEQ ID NO: 34287 - DNA, 660 bp, Homo sapiens
  chr12:28127648-28128308
  hyper
ctgccctggtgtttgcgctcccactgcagcaagggaggcctgagtctcttagggcaggggtccagggtcttgggagaggccttagggcaagggggatgatctttttcagcctcccctcccctcctcccacccagcgtcctcatccccaccgcctgcgatagacttgggtcgcccattaggaagctgatccgcagggacggggcaggcttggctcctggggatcttaggctccatgggaacttcgggggtctcggggcccgtgagcggatctagctactacttcccctaggttctcctcgggcttcagtccctaagagtctggactccggactgccgcacagaatccttcttgcccggagcggtattattgaggtctttgcgttctgccccgccctgtcccgccggcttgggtgcttggtttctaacccgagtatactcggagtctctggtcctgcgcgcccccctcctcccgggagagccccgtatctggctgcgggtaagggaaaacttcgggaaccccgagacccaaggacagggtcggagggagcgcgcgaacttcctctgagcagggctcttcctcccctcccctctccctccaggtcaatttatgactcaaacatgagataagccctaggcagacggtgacgctgacttccccgt

SEQ ID NO: 34288 - DNA, 537 bp, Homo sapiens
  chr12:28128547-28129084
  hyper
aggagaggatatgaacggacgtggaacgaagttctgtctgccaactccctccgtctgattcttggaatccggtggcatcttaaaggacggaattgagggcaaggagaagattattaatccccgaagcccgctctgtctatatataactgctcagtggttacagttggcgatcgcagggtgggggttgggggtgtagaccgtgggccatggaacacgtggcatctctccagggcataaaaatcaatctagctggtggctcctatggagtttgtaaattgcgcagagctggctgggggaagccagtgagctgtccatggtggttaaggctcgttgatgtgcgtcctcgggctgtcctggtgaggcacagacccccctaccccaggggccgcaacgccccagagccccagcctgccagcgatccagccggtgtgcgcccgacacgaggctggacgtgtgtttgcacaactccaggacgcgctcttgcacagaggccgaattccagagatagacggaaaaatctcccgattccaaattgtg

SEQ ID NO: 34289 - DNA, 421 bp, Homo sapiens
  chr12:29935902-29936323
  hyper
cgtctcatctgaacgaaacccttaaggggctgatacacttctcatctgcaaagctgcccaacagcctccgagaaattctctacttggaagcatcgccaccaccgccacccctccggaaccctctgggtccgcgctagtcccacttggtcacgatccggcaggcgaaggggtgcggaggcggtttcaccagcccgctcccagccctgcctcgagagagaagcccgctgagagggcagacagttgagaaactcgatcccaactccccagccggcgcctcccgaaccgccccgagagcccagattagccgggcagtggatcccggagcaaagtgccatgcacatcctggagaggagggaggcgtggagggaaagggcggcaaaaatgaaatgcccccaagtcagtcccgcaacttctcccggtc

SEQ ID NO: 34290 - DNA, 348 bp, Homo sapiens
  chr12:29936995-29937343
  hyper
ggcgccctctgcccccggcccgccttgcttgcaggtggaccggggttcgcggcgcgcggctgcccgggagctgcggggaaggacaccccaggttcccacttgcggtgtccggctgtgctcacccccacgcccccgcccccatccttctcccccgaatggggctgggaaggggcacatctggcggacccctcccgggggacccaggagggtttagcaggtgcgcagtctggaacccccacacccaccttccagggagaaaagtgccgctgcttcccgggaagttcccggcttttcagcacccgggacaacagcagcggcgcccggagagacgctctccacccgccccgc

SEQ ID NO: 34291 - DNA, 58 bp, Homo sapiens; identical to SEQ ID NO: 11172
  chr12:29937344-29937402
  hyper

SEQ ID NO: 34292 - DNA, 156 bp, Homo sapiens
  chr12:30322769-30322925
  hyper
acgtcccagccaaggcgcggcggggagccttggacaggagtgcacttgaaggtgagggtgcagagtggccggtgggacttgtggctggtgttctcggccatgccctggccccagaagtcgttggtgaagatgccccagcagagcgaggcgctgggc

SEQ ID NO: 34293 - DNA, 426 bp, Homo sapiens; identical to SEQ ID NO: 3863
  chr12:30323014-30323440
  hyper

SEQ ID NO: 34294 - DNA, 24 bp, Homo sapiens
  chr12:30323502-30323526
  hyper
cgccagcttcgtgatcttctgccc

SEQ ID NO: 34295 - DNA, 68 bp, Homo sapiens
  chr12:30354049-30354117
  hyper
gggggttccaggcttcgcacctgctaaacctgcctcgtcacctgggaggggtccgccagatgtgcccc

SEQ ID NO: 34296 - DNA, 15 bp, Homo sapiens
  chr12:30975310-30975325
  hyper
cacaaaacaaaagag

SEQ ID NO: 34297 - DNA, 551 bp, Homo sapiens
  chr12:30975388-30975939
  hyper
cgccagctcctttctcggctgcctgcccagctgctgggctggagctccgcgtgctgggtgtaggtcaagtgatcccgtcgcgggcgggcggaggtggccgggcagccgccgctgtgcccgggtctggggtgagctgcactgctgccctgggccccggctcccacgcctgtttcccggagctccgcggctccggctgcttcgccctccctctgtgggctgggctggggtcctcgcgagaagtcctgccccgctcccttctccaaatccacaggccctgtttctctggagacagggaggctcatacaggatatgtgcaaatgcttttattacaagctgagttgaaagacacccgtttgctctcgggtccttttggtgagcgccgcaggaagccgggctcctctctccccagaggcggccgcaggttcgcggcgcagggcctgcagtgccaggagcaggcaggggcctctgccctccccttcgtccctgatctcccgcctcctcctcacccgccgtctctgcgaactcaccctgggctgcggcctttcttccct

SEQ ID NO: 34298 - DNA, 110 bp, Homo sapiens
  chr12:31079258-31079368
  hyper
gcagggagacctaagcggggagctgcggagcgcggggagtttgaaagccgctccaccgccctactagtccgtccttttgccccgccccccttagggatccccccggcaac

SEQ ID NO: 34299 - DNA, 247 bp, Homo sapiens; identical to SEQ ID NO: 3867
  chr12:31079417-31079664
  hyper

SEQ ID NO: 34300 - DNA, 117 bp, Homo sapiens; identical to SEQ ID NO: 3868
  chr12:31079693-31079810
  hyper

SEQ ID NO: 34301 - DNA, 30 bp, Homo sapiens
  chr12:33048755-33048785
  hyper
ggtgggggtaggaagcgcagctaggcgggc

SEQ ID NO: 34302 - DNA, 64 bp, Homo sapiens
  chr12:33049326-33049390
  hyper
caggtgggcagaacacggggtcccgcactcccagcacgcggggtgagggcgggataggaggagg

SEQ ID NO: 34303 - DNA, 239 bp, Homo sapiens
  chr12:33591774-33592013
  hyper
agccgcgggttacctcggaggccaaggcagccacctctgcaagggagttctgcgtccaagcatggcttgtccgtcccgcctggcccccatcaacaaggccgggaccagcggccggtggaacgagcgagagcagccctagtcccacaggtgagccgcccccacaagcagccaagccgcgagccgtcccggcgccgtcaccgcccgcactcacttctccactccgggagggagatgggagg

SEQ ID NO: 34304 - DNA, 28 bp, Homo sapiens
  chr12:33592057-33592085
  hyper
cggcgccgggaggcgggaagcggaccag

SEQ ID NO: 34305 - DNA, 64 bp, Homo sapiens
  chr12:33592578-33592642
  hyper
tgcgccgctgagagccggcaactcttaggagccccacgttggccccatggcgggagcggagggc

SEQ ID NO: 34306 - DNA, 205 bp, Homo sapiens
  chr12:33592643-33592848
  hyper
taggggaaggagaggcgcgcgaggaggctgcggctgccgcgaggtttgcgccaactctcccgccgcgcgagcgagccgaggcgcgctggaactagagacccggcatggagtgctgaggggaggggggagccgtaaaaaagccaaagcaagccctcgactcgcaagcacgcccccctcctctccccagcgcactggtgtttctggc

SEQ ID NO: 34307 - DNA, 102 bp, Homo sapiens
  chr12:33592932-33593034
  hyper
cgtcctctgaagaagggactcgcgagggagggagggagggagggcgggcggcccggcgcccctgccgaggccggggatgctcatcgttgcccagagttggcc

SEQ ID NO: 34308 - DNA, 40 bp, Homo sapiens; identical to SEQ ID NO: 11185
  chr12:33593092-33593132
  hyper

SEQ ID NO: 34309 - DNA, 66 bp, Homo sapiens
  chr12:39298564-39298630
  hyper
gccactgcgcccggccgagagtcagtttttacaagcactcagatgtgggcccgaaaacaaatcaaa

SEQ ID NO: 34310 - DNA, 206 bp, Homo sapiens
  chr12:39299436-39299642
  hyper
ggcagaagaaggaggcggaggcagcgcgcgggatgggggagggaagggaggaggcggacctccgcgcagagccacgagggaaccgctagccagtcctgggtgaaactgacgctgccaggcaagtggcgcgcggggatcccggtttcccagcccccttccggcaggcagcagcccgggcgggggacacactccgtgatcccctcctg

SEQ ID NO: 34311 - DNA, 111 bp, Homo sapiens
  chr12:39299877-39299988
  hyper
gggggcacctctgcccgttcctaactgccccgttataaggtccccctccccacaattggttctcacctcgccctcggagctcttgggagatccctccgtccctcctactgt

SEQ ID NO: 34312 - DNA, 30 bp, Homo sapiens; identical to SEQ ID NO: 11188
  chr12:39300375-39300405
  hyper

SEQ ID NO: 34313 - DNA, 32 bp, Homo sapiens
  chr12:39539440-39539472
  hyper
caaggctctgggaagcgcgctgacaggatttc

SEQ ID NO: 34314 - DNA, 291 bp, Homo sapiens
  chr12:40618404-40618695
  hyper
gggctgcgcactgcgcgcctccgctgcggggctccgggcctgtggactcagcggagtccgctgagtcagtttcttcccgcgcgactcccggccgcgccgccgctgcggtggaatctggtcccaggaggcggcgtccgcccggggtccggtctaggcgtgcgtgggggccacggtcacggtcatcccagccaggcccggctccagcagccccacggccgccgccagagttctgcgcggcccgtcgcctcggcggagcctctggcaggcccctgagctcgtttttggggcctg

SEQ ID NO: 34315 - DNA, 30 bp, Homo sapiens
  chr12:40619018-40619048
  hyper
gaaaacagatagaaacgctggtccaaatcc

SEQ ID NO: 34316 - DNA, 30 bp, Homo sapiens; identical to SEQ ID NO: 11190
  chr12:41086182-41086212
  hyper

SEQ ID NO: 34317 - DNA, 259 bp, Homo sapiens
  chr12:41086824-41087083
  hyper
cccatcccacctgggcgcctggctagcgcatcccggaaaacctgggagcggttgcggagaggggaggaagcgacttgtttgtcccctgacccctctgttaagatctagctcccttcaggagatgggggtggggaagaatccctgcaactcgaagggcacgttccgattaattacgtctccgttgagaaggcaccggcccttctccacgatctgcggcaggtgggagggagagaccgcggagccacggccccttccctcc

SEQ ID NO: 34318 - DNA, 412 bp, Homo sapiens
  chr12:41582427-41582839
  hyper
gcccttggcgcccggcgagctgtaccgggtgctgccgctgcgcagcctcatccagaagctgcgagtccagtgcgactaccgcgcccgcggctgcggccactcggtcaggctgcacgagctggaggcgcacgtcgagcactgcgacttcggccctgcccgccggctccgcagccgcgggggctgcgcttcggggctgggcggtggtgaggtgcccgcgcgggggggctgcggtccgacacccagggctggccggggcgggggcgcgcgcggggggccgccgggcggccgctggggccgcgggcggggacccgggcctcgggtcctcgcctggaggcggcgcgagaaggcgctgctggcgcagctctgggcgctgcagggcgaggtgcagctcacggcgcgcaggtaccaggag

SEQ ID NO: 34319 - DNA, 241 bp, Homo sapiens; identical to SEQ ID NO: 11193
  chr12:41583049-41583290
  hyper

SEQ ID NO: 34320 - DNA, 35 bp, Homo sapiens
  chr12:42326337-42326372
  hyper
ggaaaccagcagcagcgcggcgctgggcaggctgc

SEQ ID NO: 34321 - DNA, 74 bp, Homo sapiens
  chr12:42326647-42326721
  hyper
tgcactacacctttgcgcgcaccgggcccagccggcccagtccctcaagcatcagtagacggaaaatgctcctg

SEQ ID NO: 34322 - DNA, 559 bp, Homo sapiens
  chr12:42983315-42983874
  hyper
ggggctgctgggctgcggggctgcggggctgaggagctgcggtccgcggcgtcaggggtgggcgagggtgagcagcgcacgaaccatccagagcccagaaagtctccgtgccgaccgcggcgcgtctcggggaagtcagcgcaggctgcgcgaggctggcatgttccgggcgcgctgtcgggcggcggcggccgcgggagacggcgctggcagctgggctgcaggcggagtgcgctcgggctccggagccgcgcgctgcggcgccgccgcgcaccccgccctcggccgcggggcccggcgcgagcgaaaacgcggagcgcggacgccgccgcgggatcgaggccgctgggcgcgcgcccacgcgtaccccggctcggccctgaaagcgaggtcgggcccggctcgggccgcgcccgggggcagggctgcgagcaggcctgggaccggctccacgcgcagccagtggggcagagcagcaggcggattatgcgcagggagaaaaaagttcaccaaccgcggtccagagtcgcaagtgcggctcgctcggagcctctgcccc

SEQ ID NO: 34323 - DNA, 42 bp, Homo sapiens
  chr12:42984438-42984480
  hyper
agctgggctctcaggcgcactcacccacgttgaactggggct

SEQ ID NO: 34324 - DNA, 15 bp, Homo sapiens
  chr12:43945109-43945124
  hyper
cgttcctcattgtcc

SEQ ID NO: 34325 - DNA, 15 bp, Homo sapiens
  chr12:43945365-43945380
  hyper
ccaactcgttccctc

SEQ ID NO: 34326 - DNA, 365 bp, Homo sapiens
  chr12:43945416-43945781
  hyper
cgtgtggtcctgggagtgcgatgcgtcttaggcgcgcgcgattcctcgaaacccggcgcagtcgcgacctctccggctgactggtccgggagtcccgggagctccagcagggccagcgttccccaacgggctgagccgctcgtccccgcgacctgcatgtcccactcgggccccgcgcccccacttagccgctgaaggcgtctcgcggtgactttaccttgcctggggtggaagtcaacttcccaagacctggtgatgaagagcgagagatggtagagcagcccagtcagccacttggccacccacatggttccaccctggggaccccgatcggggaggcccaccagagccgccggcagccaagc

SEQ ID NO: 34327 - DNA, 217 bp, Homo sapiens; identical to SEQ ID NO: 11197
  chr12:43946202-43946419
  hyper

SEQ ID NO: 34328 - DNA, 376 bp, Homo sapiens
  chr12:45269011-45269387
  hyper
aaagagaaaggctttcgtcccattatgcagccccgggacctgacgcactccggtcgtggactccccaagttctaactctgttaagacgtcaatctgtagggaagggtccacaccaagcccccaaactggtgaggggtatgaggtgggagagagaaaaaggaaaagctccatcaaaatgcaagtctcttcctccagggcagcaaagaaccgcgttttcgcgacaatattgggaactgaagatgagaggcgactgcctcctcctccgccgagagccttacctgagatcagcagccaagctttaaatagcggagcacccagtcccgtttccatgacctcctttaaacccttctctctgcaaagttccccctcagccctc

SEQ ID NO: 34329 - DNA, 486 bp, Homo sapiens
  chr12:45269416-45269902
  hyper
cgcggtctccaaggcaagcacagaaaaaaaaaaaatccatatccaaacccgcccccttactccaagcttcccactccagacctactttgggtccgggaaaagcgaggcttccccagccagcccatgctgccccgaggcgggagccatccctttccccagccccagctctgcggccactcacctgctccgagaccgaagatcaaacagaatgttctcagtaagacccgagactccatggtgcggatcagctcagtccatcgtctccctctttaaaaataaaaataaaaatcgaagaggttcttggaatcaagcgggaaaataacgtttgtctctcctgctgctgcctcggatttactgatcagtaggattaatacgctttggttgcctaagaaagaaaagggaggcctccccaggcgcgtgaagaacttagaccctccaatgcgcacatcattcccacacgcagggccgaggcggcagcgcggcccg

SEQ ID NO: 34330 - DNA, 233 bp, Homo sapiens
  chr12:45270680-45270913
  hyper
ggagaggttccctgccgggggcggggcgctggagagcttccccggcgcggagagcttcccgggcgcggagagcgcagagaacttggccaggaggtgctggacagctccggaacccgcgcgccccctgccaaataaagcgtggagacccggactcgggctctctgggaccagcatacagcagaaggcaaggggaactgagccagggcgtctgttcacgccgaaatatctaccta

SEQ ID NO: 34331 - DNA, 32 bp, Homo sapiens
  chr12:45443857-45443889
  hyper
ctccccaagttgggccgcgcaaagctctcctt

SEQ ID NO: 34332 - DNA, 386 bp, Homo sapiens
  chr12:45444296-45444682
  hyper
agctggctcacctggcgctgaaggctggaaggtacagtctcggtcccccggagcccggcccggcagcctcgcactgtccgcagagggactgagcacttgaaaagcccaccgcgttccgtagggcgccccggcggggctaacttgttcggctgcggggcacagctttaggggaactgggctagcaggcaggggccggagctgcgcgcccgcggtggccagggcggtcgccgggtcgtggggcgcgggcggctgcagcctgggcgttggggcgcccccgacccgcagcaaattctcgatcaggaaactcttgcccaggttgccaaagccgggcgcagcggggaggttgaggagcgcggaggaagccacaacgtcccagtacgcaccgg

SEQ ID NO: 34333 - DNA, 129 bp, Homo sapiens
  chr12:45444714-45444843
  hyper
cggcgccaaccggtctgctgcgcgcccgccttgcgcccgcctgtcgcccgggcgccccgcaccgcacccagagccgcagcttctcgccgccgcctcccgcagggctggagcgcgcggagccaggcaggg

SEQ ID NO: 34334 - DNA, 237 bp, Homo sapiens; identical to SEQ ID NO: 11204
  chr12:45445162-45445399
  hyper

SEQ ID NO: 34335 - DNA, 86 bp, Homo sapiens
  chr12:46767304-46767390
  hyper
ctcttatcccaccaccgccgccccgggcaaaggcactgccttgtctgaatgcgggtctgaggcgctttctgcggagcctggtcctt

SEQ ID NO: 34336 - DNA, 276 bp, Homo sapiens
  chr12:47225027-47225303
  hyper
cgcgctcgccacctctcctggactcaagggtgctcccggcttacgcttctcggggcttcccgggtccgggttccctctcccccgtctcactttcttccttcattcgctcttctctcaatttttcctccatcagctctaacctgtaatcaattcccgccttctgcccctcctccctaggcttctcttagctcggttgccgcgaccccactatccgtccccgttcgcatttctgcaccgccctgcccttcactccagcgcgcagcaggccgggcaatc

SEQ ID NO: 34337 - DNA, 158 bp, Homo sapiens
  chr12:47225319-47225477
  hyper
cgccctcggaaccgctggcgcagttttcagactcgcccaccgcccagagaccaggggcccacatccagctctgctctcgccttctcccttgaaagagactccttgggggctccccaggtcagagtaccccgcccggggaatcatgctggtctctgggg

SEQ ID NO: 34338 - DNA, 90 bp, Homo sapiens
  chr12:47225550-47225640
  hyper
cgggtccagggactcgggtaacaccttgccagcaggatcccgggcggtcgcggagccagctcccgcgggggaagtcgggcctctcagcca

SEQ ID NO: 34339 - DNA, 30 bp, Homo sapiens
  chr12:48395941-48395971
  hyper
ccatctggaagccatcgctgccaatctccc

SEQ ID NO: 34340 - DNA, 327 bp, Homo sapiens
  chr12:48396748-48397075
  hyper
gggcccacagagcctcgaaggcagagaacttttattccccccgccgaagagtttccctctgcgattgatttacaatctgtaacatacaaagacagggctggaatcccagccgtcggaaacgtgcccaaacacgtggaaaaaaaaatcctctctacctaatacactttccaggcttcgtttgtcctgaatataatcccagacagtggaccttaccaaaggaggggtagaaaggtgcagtccgaacagcatttggacccgactacaagagccatctctaactataccggttgaaatagttgtagcaaccgtagcaatcgaccagcctgc

SEQ ID NO: 34341 - DNA, 1466 bp, Homo sapiens
  chr12:48397135-48398601
  hyper
ctggctcggtgagttccagaatttagaaaagtaactcattgtagtacctcggggcggcggggaatggggtaagaccgcggggaagggggcgctattttcgggggcatttgaaaagcacggtctggttggaatgttatcgtctttcagatggcctctcctactggaagtttctgtaccctttatcagaagagaggcgcaggcggacggagggaagtcgagatgagcgctagggctgcaccttgctccagggccagctgggagggggagggtaccctaaagaggcgctgaggtctcagagggcctatcggaagccgttctttgtggcctgggatttcagcccaccagtgtcagagtgttagtcccctttgtctaactctgctttgagcccaccagccaccaagccttggacaggctgtgaagtcaaccctttggcgtttgcttgctccctcgctcgcgctctctctttcctacttcacctaagttcgatgagttgagatctgtttttgctgaactcgaagtgcttcgaagaggcgagctgtgtgcatgtgcgcctaattatcaaagctggtggaaaagagcccatttatatctgtgcgcaaacttctccgagccaacactttgcaagttcagtattctagcgcaacgtagggacctgcaaatacttgcaactgcgatgggcaccgaggaccctgggacagagtccttgattggcagaactcttcttggtgaacttctgcgtgtcctgtgcctaagtcggcgcgctacgaccccgggagccgttttagcccggagccgcgggctccagagctggagcgggccggggagaaggatgctgagggacgcatggaaagcaggcaggcaggcaggggcgggggaagacttacggacatcctggccctgacaccgaaggacagcggcgacgagcagcgtcagcagcaccagcgtctggggagccccgaggcgaatcatggctcaccgcggggcctggctgagccgggcccgggcggagcgcagcgaaacggcaggagcacggcgcgggtccgggtctctaccgcgccctcatgcaggaggcccttggagcaggagggggaagcgggagacccggcagcccagcagcgctctgcgtcttctccccgccgcggcgcccgttatatgcgcccggcccctttcgaggctggcgaactcgcccaaaccgcgggccgccccctgccccccgctgggctgtaacctgaaccgcccgcccccggagcccgcctgggccctgccagtgcccgcacctgcccaagccggacccccctctctgggagtcacgcttcccgccctccacccctagtgcgccgagtggcctgatcgggcggggcgcagagatggcccctgccccccaaacccggggctgcggcgctgcccccctctgaccacaggcgggaagggtggcctccggcccctcccctcggagttctgccgga

SEQ ID NO: 34342 - DNA, 188 bp, Homo sapiens
  chr12:48576788-48576976
  hyper
actcccagagacctgcgtaggagcggtagggtctcataaaggagggagtcccatccttcccccgctccggtgatttctatagctagagggctgatttactgcagaaacctccgtagcgccctcctcctgcctctgcaccgtcaggcccggtgggtccggctccagagcgccaccgtgccccagctcaa

SEQ ID NO: 34343 - DNA, 44 bp, Homo sapiens
  chr12:48577469-48577513
  hyper
ggcctgggggagtcccgagtccgacgcgccgctggcctcagcct

SEQ ID NO: 34344 - DNA, 432 bp, Homo sapiens
  chr12:48577898-48578330
  hyper
ccactcaatggaggacggtctgctggagatcatgaccaaggacggcggcgacatgccggcgcccctggaggtgtccaccgtgccggcagtgggggacgtgatctccggggagtacaacggcggcatgaaggaactgatggagcacctgaaagcccagctgcaagccctgtttgaggacgtgagggccatgaggggggccctggacgagcaggcctcgcacatccaggtgctctcggacgacgtgtgcgccaaccagcgagccatcgtctccatgtgccagattatgaccactgcgccccgccagggcggcttgggcgtggtcggcggcaaggggagcttccagagcgacccccaagagccggagactccttcgcctgggatcggggacagcggcttgctgggtcgcgatcccgaggacgaggaggaagagga

SEQ ID NO: 34345 - DNA, 197 bp, Homo sapiens
  chr12:49297738-49297935
  hyper
ataaataaataaataaataaataaataaaatgcactgaggagacagatttttgagagttaaaaggaccctctcaaaaaccgaccgcggtcctccactgggtagggggcgctccaagacagggactcttctagcctgttgcctctccatgttagcgatatcctcgttgctaggagactagacgcgtcttacagtggga

SEQ ID NO: 34346 - DNA, 95 bp, Homo sapiens
  chr12:49363823-49363918
  hyper
ccaccccctagcctccgcggcagcgccgacccgcccagccaggctcaccgcgcttgaggatggcgctgtggtgcggcaggcggccgccgccctca

SEQ ID NO: 34347 - DNA, 30 bp, Homo sapiens
  chr12:49364135-49364165
  hyper
tgggaaccaagaaggcgtctggggtctgcg

SEQ ID NO: 34348 - DNA, 150 bp, Homo sapiens
  chr12:49366374-49366524
  hyper
gagacccagtggcagcgaacgggttaggcgccaccgtgctcccgcctgactcaccctcgaagctctaaccactgtgggctatttttgccagagaggggccccaggctttccagccgccccccgcccctgccagaccgcagcccaaggcac

SEQ ID NO: 34349 - DNA, 39 bp, Homo sapiens
  chr12:49367954-49367993
  hyper
caggagggatggatgcgcccgtggcggtgagctcagctg

SEQ ID NO: 34350 - DNA, 30 bp, Homo sapiens
  chr12:49373373-49373403
  hyper
ggggatcctgcacagcgtgagtggggggct

SEQ ID NO: 34351 - DNA, 693 bp, Homo sapiens
  chr12:49373730-49374423
  hyper
agataaagaaagtttcgggtcgcggacgccggctgaccgccgctttcccccagcctctctcaaaagcgcctgggaagctgctctctgcaggcgtgtgtctggcctctcgcccagcaaggcttgcaccgccaaaatgggccgaaagttttgggctgcgaagaagtcttggggatgtatggttcttccgctcccctctcttcggtttgtctctctggggctgctccacttccgctatcgagccaaaatgcgccctagaatctcccagtaaggtgtgattacgcccgtggacgtggctgcgtgcccacgcacctgctttctctactagccctagagaccagctttccagcactgccggccctggctctcaggactcaaagtgcggagtcgggggtgggattccggtcccaagcccttcatgagggtgctggccgcgccccgcgtaccccctcgctgatccccgctcccttctcccacaggctgtcgagaaacggcgtttatcttcgctatcacctccgccggggtcacccattcggtggcgcgctcctgctcagaaggttccatcgaatcctgcacgtgtgactaccggcggcgcggccccgggggccccgactggcactgggggggctgcagcgacaacattgacttcggccgcctcttcggccgggagttcgtggactccggggagaaggggcg

SEQ ID NO: 34352 - DNA, 346 bp, Homo sapiens
  chr12:49374681-49375027
  hyper
caagcacagtctcttcgctgtacagattcgaaaaataagcctgagaggccgagactgactcgccgcggcggagcagggttgggcagggtttccaaatctcagcggaacatttcgcgcctcccttcccctgggctcagctaggcctgggcctttgctgaggtccggcccccgtggcgtccgggagagggcagtgtctgggagggtgactctggcccggtgccctgggacactctttcttcccctatccccgcagaccgtattctccgagatgcgccaggagtgcaagtgccacgggatgtccggctcatgcacggtgcgcacgtgctggatgcggctgcccacgctg

SEQ ID NO: 34353 - DNA, 414 bp, Homo sapiens
  chr12:49375115-49375529
  hyper
cggagctgctgcgcctggagccggaagacccggcccacaaaccgccctccccccacgacctcgtctacttcgagaaatcgcccaacttctgcacgtacagcggacgcctgggcacagcaggcacggcagggcgcgcctgtaacagctcgtcgcccgcgctggacggctgcgagctgctctgctgcggcaggggccaccgcacgcgcacgcagcgcgtcaccgagcgctgcaactgcaccttccactggtgctgccacgtcagctgccgcaactgcacgcacacgcgcgtactgcacgagtgtctgtgaggcgctgcgcggactcgcccccaggaacgctctcctcgagccctcccccaaacagactcgctagcactcaagacccggttattcgcccacccgagtacctccagtc

SEQ ID NO: 34354 - DNA, 241 bp, Homo sapiens
  chr12:49388730-49388971
  hyper
ggcagtgggaagagccgacaggggtgggctgggggcaaggaagggagagtcccggctgggggagaaaagaggtgggccaggagctcccaacgaagaaagcagccccctcccctcacacagagcgggaagtagcagaggagtcccgggggagggccactgtggggaaagggtcagtgaaaggaagacgatgccaaggctggataaagggaagcttagatttattgagcgcctactgtgtgcc

SEQ ID NO: 34355 - DNA, 267 bp, Homo sapiens
  chr12:49390838-49391105
  hyper
tagggccctggggtccgcgcccagccccggccggcgcgccgctggaccaccgccacttccgacccctcggctctgccctgggctcccgaagctgctgggcctaaggcttggtgctctgggctacctggctgcgtgggggcgtcccgcaggtttacttcgggggccgggagccccaagatgcggaaagtgcgctcctccagtgtggagtcccccggcctcccgccctcagcttcgcccccgcggcccccgccgggctggtgtaaaagg

SEQ ID NO: 34356 - DNA, 940 bp, Homo sapiens
  chr12:49391146-49392086
  hyper
cgtggccccttcaccctcctccttgccgggcttcgattggctgggggaatcccccaccacgcgtgtcaccccagagggcaaaagctgcacctgctgggttcggggggttggaacatattgggatcgtatcactacgcacgtggcgtcaatgacaaagacgccttccccacgggacaggccctgggaactgcggggcaaggtgtgggcacggcgggtcgccttccaaccctccagggtctccggtcctgccccctctccaagacccagagattctctccatccggtgcctccgggagcccagggtctggggagtgtctggctatggcggggcggctgctttttaggggagggaatccagcatttgggaaaccagatctgttctccttctttcccttccctcgagcccttgaggtggtgcctggatctgggagcgggatgcggggcacagggagccgcagttgcagaccccgcaggagctatctcggtgcctgcgctccctgtagctttggcttggggatggctgtcgctaccactgttcaggtcagcagcagccagccccaggcttttctccacgacccccttgccgggctctggccttgctctggccgctccacagcctggggatccccccaagagaccttgcccctgtcggagaccccaagccccgaggacgtcccggtagatccgaggatccagcctcttctttgtgcgccctccgtctgtcctggctggagtcgcagctggggctgatgaagtgggcacctgagagttcccggggcctctcttagtccccaaggtcctatgggggccttcgtaagaaggtggagccacgtagggtggcggccggtcccagcggcgtcgtggggcggtcccggcagaacctctcagcagcaggtgagcctcgtagcttgggggcccgggccgccgacctccccagggc

SEQ ID NO: 34357 - DNA, 44 bp, Homo sapiens
  chr12:49392556-49392600
  hyper
gtgtgtgagtgtgtgcgcgtgtgcacgtgcgtatatgttaggac

SEQ ID NO: 34358 - DNA, 530 bp, Homo sapiens
  chr12:49483686-49484216
  hyper
ccaatgcatgccagtcggctggacggccccgccggggagcagcgcccctagcgcgtgcagcagtctcaagggggcaaaagcgcggtgcgcccactggtgactctccagaaccgcgtagcaagaggccaggacatcgttcaccagcagcgtcccgtgcgcggtgagcggcgcgaacacgcccacggcttcctcccgcgccacacgggccacgcgcgctggccgaagcgcatccccgccgggcgccagcaccgagtccccagcgcgtagccggcgcgcgaacaccggtgcaaagtcgcctggcgcgggcgccggccctcgagcggcaaacaccaggtgccagggcgtgagcaacagtttgcgtggaggccactcggtctccacagccacaaatgaagcccggcgctgcaagtcccggtccaggaagagcagcaccggcgtgggcaccacccggcctgacgcatcggccgccaaaacccagtctccgcggtgcagttcccgcagccctttccgctcgccgctccacaggcgca

SEQ ID NO: 34359 - DNA, 170 bp, Homo sapiens
  chr12:49485716-49485886
  hyper
ccaagaggagctgtgcgggatcaaggctgctggaaaaaggattggggtggcgggggttgcgcgaagtacaatggccattatccgggatgacttaaccgagcgagaatcctgagcccaggccgggaacgcgctgggagaagcggactcagcagctccggccacaaaggcgc

SEQ ID NO: 34360 - DNA, 30 bp, Homo sapiens
  chr12:49487666-49487696
  hyper
tgggtggctgacccccggtccacgcctcag

SEQ ID NO: 34361 - DNA, 30 bp, Homo sapiens
  chr12:49688858-49688888
  hyper
gtgggaggagctgcccgtgccccccctgag

SEQ ID NO: 34362 - DNA, 72 bp, Homo sapiens
  chr12:49690983-49691055
  hyper
caagcaggagatgaacgagtcccgacgccagatccagagtctaacgtgcgaggtggacgggctgcgcggcac

SEQ ID NO: 34363 - DNA, 36 bp, Homo sapiens
  chr12:49727091-49727127
  hyper
cgaaggcggccgggcagccgccgcaggggctgggga

SEQ ID NO: 34364 - DNA, 649 bp, Homo sapiens
  chr12:49729713-49730362
  hyper
ggcatctcacctgtccgttcttcatgaggtcggcccacatgctggtgccgtcgccgccgcgcatgagcacgtggtaagcgaagaagtagacgcctggcatggggcaagtaaacttgccgctggctgcctcgtaggcgttgcccacgttggtcaccacgtcgtcgaagcgcagcacctcgtaaccctcgtggggccgccgcaggcccgcgtagaaagcaatgcgaggcacgtagccggcagcgggcgccaccccgcccggacctggaccgggagggcccggggggcctggcctgccgggttctcctgggggccctcttggacctggtggtccagggggcccccgcaggcctgctttcccgcgccggcccacctctcccttggcgcctggcgggaaggggggcacggaagcaggcgcgccgtcgggaccagggccacggggcccatgcgggtcgcacaccatgcggcagcgacccagcatctcgtagtgcgctggcccgcgggagctgtgcaccagcagcgggatggccaccagcagcagcagcaccatggccactccgacggccgcgcccgccaccctcttgcggcggctcagccgcgacgctgccagggccagcaaatcttcctcactcttgggcgcaatggctgccgg

SEQ ID NO: 34365 - DNA, 55 bp, Homo sapiens
  chr12:49735987-49736042
  hyper
gacaaagagcagcttcggatggatgagggtcccagcggatcggaaatgtgaaggg

SEQ ID NO: 34366 - DNA, 36 bp, Homo sapiens
  chr12:49736792-49736828
  hyper
gggggcccgtggccccgagcgcgcattcattactcg

SEQ ID NO: 34367 - DNA, 94 bp, Homo sapiens; identical to SEQ ID NO: 1035
  chr12:50297461-50297555
  hyper

SEQ ID NO: 34368 - DNA, 115 bp, Homo sapiens; identical to SEQ ID NO: 1036
  chr12:50297973-50298088
  hyper

SEQ ID NO: 34369 - DNA, 186 bp, Homo sapiens; identical to SEQ ID NO: 11223
  chr12:50355598-50355784
  hyper

SEQ ID NO: 34370 - DNA, 92 bp, Homo sapiens
  chr12:50426787-50426879
  hyper
caggcgaactgtcatcgacgatccctggacgcgggcgtcgggggcagggaggcttggctaggtccctggctgccaaccgtctggccacagcc

SEQ ID NO: 34371 - DNA, 241 bp, Homo sapiens
  chr12:50444182-50444423
  hyper
ctgtgtgaggtgcagcggacaccagcctggtgtccgttcccaaagagtatgcctatgtgcccggagctcctgtgtgtgcacatacatgtgcccacgtgcaagccccacacggcctggagttccagctcccgacaagctgagcctcctgtgagccgaggctgagagggccgcctattaccctgtttccaaacaactcccctttctgcgccagcgccgctgcctctcccgtctgtttgcccct

SEQ ID NO: 34372 - DNA, 85 bp, Homo sapiens
  chr12:52208668-52208753
  hyper
cgccgccatccctggcgggaaccagggaccgaggactgtgcggggacggggacgtggacgggctccgcgccggtgatgggggagg

SEQ ID NO: 34373 - DNA, 109 bp, Homo sapiens
  chr12:52241703-52241812
  hyper
cccctgactctgagacgcgggctctgttctcccgggccagaggagaagacatgaagagggtgggtgttaggggcgcggggaccctaagtagcctcggcctcctgtcact

SEQ ID NO: 34374 - DNA, 133 bp, Homo sapiens
  chr12:52242262-52242395
  hyper
gacaccctgaccgaacggtcacctccccccgccccatcccggcccgcccgcggccccgtacctcggcatcacggccgggtcctaggtgagtgtgcgcggcctgggggcgcgtccggcccggggaccggggcgg

SEQ ID NO: 34375 - DNA, 610 bp, Homo sapiens
  chr12:52262803-52263413
  hyper
cgtgtgcacgccagccgagcgagtggccgagggacacccccgtgcttcccaaggcctggctccacgaggagcagaaccccagcggtgggattctgtcgcgcaatgctgtgtggctccgactagggcccgccctccagcaaagagatgctggtgggtgctctcggttcacccccgcactcgccccaggggggctcgcgggccacctggagctcccgcccctcggtggccagggctgcgcgtgaaagggggacgttcggacgcgggggcgcggagccagcgcgcgagcctcggagcctcccccaggctgtgggggaagaggagggaggagggagcagatggcagcaattaccgctcggaccctcccccgccgtagcctggggccggaagatcggctcggcagctcgctcctgcgggaggggcggcggcctccccggccgggaaccggcggggagggggtccgggaggggcggctctggccgccggggcgcgggcatcccagcttctaggggagagtgatgtgagggcccggtggagacacctccttctcccgggacgagggctgagagattccctttggaaaggccgagtctccggccgcccccacccccag

SEQ ID NO: 34376 - DNA, 159 bp, Homo sapiens
  chr12:52301147-52301306
  hyper
gtcctgcagccccagcgaggggcgagcggcggccagtcggcgagctgggcaataaggaaacggtttattaggagggagtggtggagctgggccaggcaggaagacgctggaataagaaacatttttgctccagcccccatcccagtcccgggaggctgc

SEQ ID NO: 34377 - DNA, 32 bp, Homo sapiens
  chr12:52317406-52317438
  hyper
tccccacacagggaccgcggggcctttcccgg

SEQ ID NO: 34378 - DNA, 37 bp, Homo sapiens
  chr12:52400452-52400489
  hyper
cccctccaggtatcacgcagccccgagccccgagccc

SEQ ID NO: 34379 - DNA, 391 bp, Homo sapiens
  chr12:52400516-52400907
  hyper
cgcgtccgcggctcgttttcccccactgagcgcccagctcccgcagtttccccggccgtcgagcgccgtgggcggggctccagggcggcggcgcctcgcggggagggtcctccgtgctgggggcgaggccacccgaggcagctccccgcccgcccccaaccccgccccgctctcggagcctataaagggaggcgacccgcggcccgcccggctggcatcccccagccgccgccagccccgccgaggggagccagcgccgtctctgaggggcgtccggcgccggagccatgaccctccgccgactcaggaagctgcagcagaaggaggaggcggcggccaccccggaccccgccgcccggactcccgactcggaagtcgcgcccgccgctcc

SEQ ID NO: 34380 - DNA, 629 bp, Homo sapiens
  chr12:52400908-52401537
  hyper
gtcccgaccccgggaccccctgccgcagccgccacccctgggcccccagcggacgagctgtacgcggcgctggaggactatcaccctgccgagctgtaccgcgcgctcgccgtgtccgggggcaccctgccccgccgaaaggtgcgtcccccgcccgccttcaggatctgctcagcccctctccgactccctacagggcctgctgactccgcagtgccctctcctcggcgtccgcggagtcccccaccttcttccccggcccgctgggtgcctcgactccccgcgttccccgctgctgcgaaggccgtggccctcgcctgcacaccgcgcccaggctcggtggctcttaactccgcgccccatgcacgccccctctctccctccttgactcctcccagcaccccccttctcctacccgctccatctggctttctgccccccatgccccgcctccccgtggccaggtgtcctgggtccccaggagcccctcgcccgagggacagagacagccccaggcaagttgaaggtccgagagcccccggtgggagaagcgggccggtggctgcgccgcgtgcgttctcactctgaggaagtgcgtggggagccgctgactccggatagcacaccct

SEQ ID NO: 34381 - DNA, 30 bp, Homo sapiens
  chr12:52615930-52615960
  hyper
ttggggtgctggagccgactcatacggctc

SEQ ID NO: 34382 - DNA, 182 bp, Homo sapiens
  chr12:52626865-52627047
  hyper
tgaaagcctgggcttcggcggggcgggcgggcagagggcggagggcggccccaggaggggcctggcagcagagaaaggtggcccgcggcagccccgcccctacctgtggaagcccagccgcccgctcccgcggataaaaggcgcggagtgtccccgaggtcagcgagtgcgcgctcctcctc

SEQ ID NO: 34383 - DNA, 14 bp, Homo sapiens
  chr12:52627272-52627286
  hyper
gaggtcaccattaa

SEQ ID NO: 34384 - DNA, 82 bp, Homo sapiens
  chr12:52652138-52652220
  hyper
tgcgtccgcaggagccggcgcggaagcccccgcacacgctgtggctgccgaagcctccggtgaggccgcggtagcaggagac

SEQ ID NO: 34385 - DNA, 37 bp, Homo sapiens
  chr12:52652599-52652636
  hyper
gagtggaacccctccacctgtccgcccctccgccggg

SEQ ID NO: 34386 - DNA, 30 bp, Homo sapiens
  chr12:52701983-52702013
  hyper
gcggcactgacctctcgccttctctccctg

SEQ ID NO: 34387 - DNA, 211 bp, Homo sapiens; identical to SEQ ID NO: 11234
  chr12:52702362-52702573
  hyper

SEQ ID NO: 34388 - DNA, 30 bp, Homo sapiens
  chr12:53084893-53084923
  hyper
agtttgaggagagggcggtgaggggcaggc

SEQ ID NO: 34389 - DNA, 402 bp, Homo sapiens
  chr12:53108074-53108476
  hyper
aaggggactggggtccgaggacgcccctggcgcggggttcagaatttgtggcgggaccgccagctctaggaggagctttgttctctctggcggcgctgctgccgccgccgccgccaccccggctgacggcgcaggagtcccggagccagagaagccccccgagcaccgcggagctcccgcccaagccccagccgctgcggccccggctaccgccgcgggcccgggctccgactcctcctcccagggcgcagccgccgccagtgctgctgtggccagtctctgcaaagacggtcggggtcagggagcctggcagtgtccgcccggcacgccagcccctcccacagtcccgagccgcaggtcttcccggggtgacgccccgccgagatccggcaaggcgtgggg

SEQ ID NO: 34390 - DNA, 41 bp, Homo sapiens
  chr12:53359275-53359316
  hyper
cctccttaaagatctcgcagtgaggttagggagctgctccc

SEQ ID NO: 34391 - DNA, 210 bp, Homo sapiens
  chr12:53359385-53359595
  hyper
cgcgctcccattgggtggtgcctgggtgtccccggctcggcagctgcggctgcttcccagccccggggtctcagggccgtcccgccggtcccagggcaccgctcctgtgccccacgccgccgcttccccagttgccccctgactgcaagagtctcctggttttcggcttgtcctgggactcctgggagagcccaccgagagttctggggc

SEQ ID NO: 34392 - DNA, 183 bp, Homo sapiens
  chr12:53719608-53719791
  hyper
gtggtttttgttcttcggctaactccgtggcgggcacgactgattgcagacccagggcagggggcgggttacgtgccaggcccagtctgcccgccgggagccgcaccaccgcccgactggggccgcgcaggagtccgcactgcaaccgcggtgcccgcgctcgggtcgcgtcactgccctgac

SEQ ID NO: 34393 - DNA, 564 bp, Homo sapiens
  chr12:54089081-54089645
  hyper
ttttttttttatcagcggaaacagagacggagtcctcatcagcttcaattacaaatattaaggtcccggacagcactttgacagagaggcggccagccccccacttcgtaccacccccctaaatcatctccgaattaacatcacatcggcggctggcgcgtgttcagatttaaatggtggcatattgttcgcggacggtctagctcagaaccgcgagctcgcagctcccgcggcgggccccgcctctgcccacaccggcccctgcggcctcccgggaggctgtgactcaggagtcgcgggaggctccgactcaggagtcgcgggaggctccgggccctgtctccagcagggggctgcaggcgagggcgcgctggggcgggggcgggcgggctgcacagaggggtcggatgtggggcgagttgggcagaggaagaggaaccgcagatgccgggtggcgggagaggggctggggctgcagggagacaggtgggtttggtcggggttgggggttaggaggggaggacatgctctctgcaaattaggtgcaaacgaaggctcagaatg

SEQ ID NO: 34394 - DNA, 106 bp, Homo sapiens
  chr12:54132252-54132358
  hyper
tgcgaggaggaaagacgcagaggctgcgcactttccttcctctcccccagacccgcgcaaggcgctgagggggtcctccctccggcaaaggcggagggacggcctg

SEQ ID NO: 34395 - DNA, 763 bp, Homo sapiens
  chr12:54144857-54145620
  hyper
acacactcactcctgcgcacacaggctgctccgcggacacgcttcacggagcaggtgtgcccacgcgcaataccctcctggcccacaggcctccgcacgcacaggacacacacacacactctctcctggcctccctcccgccgcccctcctctgagccctgcggcccggccttccgcacctcccaacgcctgcaggggttgggggcgctggggctcggggcgctcactcggacctcggagccaatcgccagagatctaatggctcctttggcagtgggaaggggtgtgcgtgggtgtcctctccttcactctttccccagccctgtcgcctcccaccccccttccggccgcggcagtttccgaaatcgcccggcggccgcgaattcattagtggggggcggatgtaaacgcagcgcggtggaacgttttaattaggcctgaacaataaacaagctaaacgaggcgcgcaggactccctggtgggccctcagcctcctccgcgcggcgcggactcattacggctgcagccaatttcatgccagcgccgagcactggctgggccgggagtggggtcgggggtgcgtgcgggtgcgatccgggcctgcagggtgcggagcgggggcgtcccggggcgagggcagcgggccggttcccgcccgcccggggccgcggcttccgcatttctgcaccatccacctgcctttttcagtgtccttgagatgacgctccctccccacaccagagcggccggctggagagtcta

SEQ ID NO: 34396 - DNA, 15 bp, Homo sapiens
  chr12:54145843-54145858
  hyper
ggtagactctgcagc

SEQ ID NO: 34397 - DNA, 92 bp, Homo sapiens
  chr12:54145880-54145972
  hyper
cgctgcctacacccccttgggctcccctccaaggtcccctccgctcgcccctctctgcccgctgccgccgccgccgccgccttccaggcctc

SEQ ID NO: 34398 - DNA, 656 bp, Homo sapiens
  chr12:54321250-54321906
  hyper
aaatttctgccctgtcgttccaatgccatgatggagaaggacccctaaaatcgcctttggcgtgtgcagctcgagcgttacaacgatgcaaagtgcggtctttggaggatgcgggagtcggtaacccctcaattcactctcgccgttccttctctccagtctgcgcgaaagccaggtccgagggcttcgaagatctgggggacccgagctgcgcacagtggcgggaaacgagcgggctcagctggccgggccgcgtcccctagccaccgcccgcccgcccgctgctttggcctccggagaagcctggagaggggcctgcgcctcttgaaaaatggcttttgggggcggtaggtctcgggagggcgactggggaaagtgacttgccgcggcttcgagtagagacgttggtgcgggacccaactcctggggaaggcggggagcgctgggcggatgcctggccctagtgcggcgccaacacatacaagttccgctgtgaatgtttgaaagtgtaagtttctctcggattgatttttttttcctttaaatgtatccccttcaaaaaaaaaaaaaaacaaacaaacaaaaaaaaaaaaaacaaagacgtggacaggcaggcgccacccggtctgggagctgaggttcgtgactgctgccga

SEQ ID NO: 34399 - DNA, 83 bp, Homo sapiens
  chr12:54322131-54322214
  hyper
agtcgggagcccccacgcgccagtcgagcctacgcagctgtggggtgggaaggagaagacaagtcctccgccaagaactcccc

SEQ ID NO: 34400 - DNA, 421 bp, Homo sapiens
  chr12:54324544-54324965
  hyper
gggcgcttcctagtgcgggcactcatcctgccgctctccggtcggccatttattgtcttgtggggaagggctttcgccaagaaacttggtctgggttagtgaaataaaatactaaacaattactatatgtaaaattttaaaaccagcatattaaaataaactaaggaactctctgtcgtgggagaaatccacaggaaaaggaagagaaggagttagatgctggcgccgagttcctggcggagccaggcggcggtgactcctcaggctgagcggaatcgccatccaggcgccggaaacgacccgaatcccaaaatccgtggaagaaaattgcgctgaaagaacagagccaacgcccccgtcctgccaagtttggcgagacggcaagttggcttcaggagcacaatgccgctaaatgatgcct

SEQ ID NO: 34401 - DNA, 203 bp, Homo sapiens
  chr12:54329276-54329479
  hyper
acgcacatacacagacgcttcccgtgaaaaagcatattaaatatctcctttctgtgttggatcatttaaaagaaaacatttcagagttgaacttagccgagagcttggttcatgagctgtagctgagggcagagtggcttctgccgctccgcggttgtagaagtccctttgaaaaagcagccgagagcagagccggggcttcc

SEQ ID NO: 34402 - DNA, 302 bp, Homo sapiens
  chr12:54329604-54329906
  hyper
cgaaggccggcggggcgcgcccgggtgagcaccgcagccgagggtttcagcgccaggccctggaaaggctttctagggcgagatcgccttggagatgtaattactacgtttctagtggtgcatattctcctggagtgtttaatttgattttacttgtgtctcagcgagatccacatttttttttcgggggagggggaagaaaccaccccaggcttaaagttaattaaccagcaaggctttactttccaccgccctcctgcaggctcttgcctcggcgcctcccttcccgatcccggctcgcc

SEQ ID NO: 34403 - DNA, 144 bp, Homo sapiens
  chr12:54330304-54330448
  hyper
tctggttcccactcccgccattctggttcctactcccaaaggctggggacgtgtctttgagtcctggcccgcggaaaacgggtccggcgttgggcctgaccggggagggagccccaagaatggggtgggcgtttcaggcccttt

SEQ ID NO: 34404 - DNA, 241 bp, Homo sapiens
  chr12:54330856-54331097
  hyper
aatgccagcccagcccgcagcctgctttctgaactctgagctgacccttctggatgaagatcacgcagataagaattactatcctaactcaccgatgtccgggtgctctcaaccgtcaaacaccaccttctccccacaaagaggagggaggtggcccgaaggggtttctgcagacctgtccatttgctctccacttgaggggtgcagtaggtctggctgagcgaggcgctgctctgtggcc

SEQ ID NO: 34405 - DNA, 770 bp, Homo sapiens
  chr12:54332944-54333714
  hyper
gggcgcccctcagggcgccgtctatacggacatcccggccccggaggcggcgcgccagtgtgccccgccgcccgcaccccccacctcgtccagcgccaccctgggctacggctaccccttcgggggcagctactacggctgccgcctgtcgcacaacgtgaacctgcagcagaagccttgcgcctaccacccgggcgataaatacccggagccgtcgggcgccctgcccggtgacgacctgtcctctagggccaaggagttcgccttctaccccagcttcgccagctcctaccaggcgatgcccggctacctggacgtgtcggtggtgcccgggatcagcgggcacccggagccgcgtcacgacgccctcatccccgtcgaaggctaccagcactgggctctctccaatggctgggacagtcaggtgtactgctccaaggagcagtcgcagtccgcccacctctggaagtctcccttcccaggtaaggaagggacccgagcgccgccgccgccggggacccctccccgccctgcctgccccggggctccgcgccccaaccacccccgccgtctggccccggcgcgcccgctcggctgggctgcctatggagccggccgggcgagctgcactgaggaatgcgccggggaagaaatctgctccgacacgttctctgtagctgcccggccgagaatgaagcaatcacaggcgcccgaaagccgggccgccggctctgctctgtccggtagctcgcctccgcctccccttgcag

SEQ ID NO: 34406 - DNA, 152 bp, Homo sapiens
  chr12:54338666-54338818
  hyper
gcaatcctctggccccgttgagcccctgccagaactctgtgcctaggcagcctcgggtcctctatctcagtccagccgcttgcctcacttcttcccgcttgccttatctccccgcagacgtggttcccctgcagcccgaggtgagcagctac

SEQ ID NO: 34407 - DNA, 597 bp, Homo sapiens
  chr12:54338978-54339575
  hyper
ggcgggtcaaagagaagaaggtggtcagcaaatcgaaagcgcctcatctccactccacctgaccacccacccgctgcttgccccatctatttatgtctccgctttgtaccataaccgaacccacggaaagacgctgcgcgggtgcagaagagtatttaatgttaaggaaagagaagaaccgcgccgcccggaggcagagaggctccatggccgtgctgctgggccatccccaactccctatcccatccccagcctccacccccatccagatgggactcacgtggcttcaacagctttggaaatgggtcccgagtgggccgtgcgaggaaggctgtcgacctctactcctccttgcgctcaccttgccagaaagtctggtggcagcgcagagcccaatcattccaaccaaagcagggttggggaatcccgaatggccccaattcttgcctcatcctatgaccaggcttttagaggaccttccctaagggcgcagcttcggagcaggatctgtccagctcatactttccttcgctgtccctcccgcactccttaggcaagatttcccagtaaagattttctgtgcgtattttaaaagtc

SEQ ID NO: 34408 - DNA, 261 bp, Homo sapiens
  chr12:54343569-54343830
  hyper
aaggccttgatcttccggtggccagcgaaggggagggctgcttgcccccttgacgcgccatcccccttcccgcaggagcccgccgcctctgtttacacacagaggaggtgtcgtctccagtctagacaagggcgctaataacgcccataaaaggcggcctctccagagatgctctggcaactccgctcccgcgcgcctgccgctggccgctttctccacctccccccgccccgcccttctctgataccttggcgaggccgg

SEQ ID NO: 34409 - DNA, 40 bp, Homo sapiens
  chr12:54345186-54345226
  hyper
gcagtcactcacagccgattccccgcggtctaagccgcca

SEQ ID NO: 34410 - DNA, 85 bp, Homo sapiens
  chr12:54345574-54345659
  hyper
gcaccaatcgctccacggtttgggtgcctcggcctgaccacctatagttttgcgcatggtcagcgaagtgccggcgggttaagcc

SEQ ID NO: 34411 - DNA, 67 bp, Homo sapiens
  chr12:54345965-54346032
  hyper
ggtgggtctcagggagcaggacaccggggatgcgaattttgctagtggttgtcgacagctctccctg

SEQ ID NO: 34412 - DNA, 210 bp, Homo sapiens
  chr12:54348787-54348997
  hyper
cttccccaacttccgcgcgtccggggcgcagcttcccgggctgccttcgctgtcctacccacgccgcgacaacgtgtgctccctgtcctggccgtcggcggagccgtgcaatggctacccgcagccctacctcggcagcccagtgtctctcaaccctcccttcggccgcacgtgcgagctggcgcgcgtggaggacggcaagggttacta

SEQ ID NO: 34413 - DNA, 120 bp, Homo sapiens
  chr12:54349255-54349375
  hyper
cgccggcgcaggcgaccccggcagcttggtatcgccgttgaaccccggcggcgggctctcggccagcggtaaggaccccggccactcaagcggcggattcaaacccgacctcttaccagg

SEQ ID NO: 34414 - DNA, 180 bp, Homo sapiens; identical to SEQ ID NO: 1042
  chr12:54354514-54354694
  hyper

SEQ ID NO: 34415 - DNA, 273 bp, Homo sapiens
  chr12:54354814-54355087
  hyper
cggaaggttccggtgtaattcagcgggaggtggaaggcaggccccgatcccacagcgcgcctatgctcagcctttggtccgagcggccgccctcctgcgtgtgcctcggtccagacggcgctgccgattttccaaggagaggccgtggcccgcgtccgccgctgcaggactccccagcttcgccctccgctccgcgctgcagccctgcgcggtgctctcggttgccactctagccgaggcctcgagacaaagacgcgccgggcactggtggac

SEQ ID NO: 34416 - DNA, 40 bp, Homo sapiens
  chr12:54359643-54359683
  hyper
ggcagaagcaagggtcggctgttgctctccctcgcccggg

SEQ ID NO: 34417 - DNA, 342 bp, Homo sapiens
  chr12:54359742-54360084
  hyper
cgtaccttataaggaaggcgccggtcctccatttcagccttttctctgccaggacgcggccgtggcatttctggtcttgtaaacatcagactctttggggccttaaaaaaataaagacgcccctccttcctttaccgggggtgagccggccggggaaagcggcggacagggaaatcaactaatgaagactccgggaaacttttctctctttttctctctctggctccgctccccgccagctggggacccttccctccctccttcctccccctcccttcccccgcctctctttttctctatctcccagtcttctgtacctctcgccgccgtctgtaactctgg

SEQ ID NO: 34418 - DNA, 30 bp, Homo sapiens
  chr12:54363641-54363671
  hyper
ctcctttccctaccacgatctgctctctag

SEQ ID NO: 34419 - DNA, 376 bp, Homo sapiens
  chr12:54366919-54367295
  hyper
agagagagactaagacggataacgcgtcatctcgccttcccaaattttcccccctcgctagaccgggtccaaaacctccatccggagccggcaggagaggagaacgatgtttaactcggtcaacctgggcaacttctgctctccgtcgcgcaaggagaggggcgcagatttcggcgagcgagggagctgcgcctccaacctctatctgcccagttgcacttactacatgcccgagttctccacggtctcctccttcctgccccaggccccctctcgtcagatctcctatccctactcggcccaagtgcccccggtccgggaggtctcctacggcctggagccatccggcaagtggcaccatcggaacagctactcc

SEQ ID NO: 34420 - DNA, 105 bp, Homo sapiens
  chr12:54367525-54367630
  hyper
cgagcccccctgctccggcaagggcgaggccaagggggagcccgaggcacccccggcctcgggactggcgtcccgggctgaggcgggtgccgaggcggaggctga

SEQ ID NO: 34421 - DNA, 72 bp, Homo sapiens
  chr12:54368360-54368432
  hyper
aggcgggggtctgggcgtttctcccgggtccgcggccttagtgcttgcctagaactgcggtgtggaaggcgc

SEQ ID NO: 34422 - DNA, 355 bp, Homo sapiens
  chr12:54368647-54369002
  hyper
agcagacagggggcccgaggggacgcacgtgtacctggagggctttccttctgtcccagaccctgtcagccgcggctctcgcctgagaactggggacggggtggcgcagtggcgggggggtggggacccgctagacctggcagggggtcgaggcttgcccgggtgctgcggctgcaggagagccagccgcctggcgggagggctgcccgcggtgggctaggagaagggccgctgagcgctcagcgggctggggtcgcccgggtctcacgtgtctctctcccccctctcctcgcacttgccccctcccctccctccagacgccccccgcacccgcaagaagcgctgcccttattcg

SEQ ID NO: 34423 - DNA, 75 bp, Homo sapiens
  chr12:54377164-54377239
  hyper
ctcgcccgtttcccgcgggatgggcggtgggacaaatggctccctggattgactgctgcccggactgtcccaagt

SEQ ID NO: 34424 - DNA, 157 bp, Homo sapiens
  chr12:54378041-54378198
  hyper
tggtgacccaggagccgcccaccctgccaggcccaggccacagctctcgggtcggggatcgggtgcctctggtctctggcttcctctttcccctaccccgcgtccattcggaacctccttttccgagcagccatgaagtgaccgtgaccccctccct

SEQ ID NO: 34425 - DNA, 1117 bp, Homo sapiens
  chr12:54378814-54379931
  hyper
cgctgacgtcacggccgtctgaatcatcaaggccattttcaaatcccattggtctagccgtcacatggtgagaaccgaatgcgcggataattacggagctgatatttccccccctccccttctttttcctccctcccctccaaccgcgccccccctcccggatggggaaaaaaaaagatgtcagctcctccgctgtagtattgctccttaaaaacccctctctctgaaaatgacatgccctcgcaatgtaactccgaactcgtacgcggagcccttggctgcgcccggcggaggagagcgctatagccggagcgcaggcatgtatatgcagtctgggagtgacttcaattgcggggtgatgaggggctgcgggctcgcgccctcgctctccaagagggacgagggcagcagccccagcctcgccctcaacacctatccgtcctacctctcgcagctggactcctggggcgaccccaaagccgcctatcgcctggaacaacctgttggcaggccgctgtcctcctgctcctacccacctagtgtcaaggaggagaatgtctgctgcatgtacagcgcagagaagcgggcgaaaagtggccccgaggcagctctctactcccaccccttgccggagtcctgccttggggagcacgaggtacccgtgcccagctactaccgcgccagcccgagctactccgcgctggacaagacgccccactgttctggggccaacgacttcgaagcccctttcgagcagcgggccagtctcaacccgcgcgccgaacatctggaatcgcctcagctggggggcaaagtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaaggtaaggccgcctgggccgcgggcgccactgggacgttccggcacttggtcttcgcggccggggaggggggcaggggagagggttgggcccaggaggccccagaccatttcgggaatgcgaccctggctttcgactag

SEQ ID NO: 34426 - DNA, 434 bp, Homo sapiens
  chr12:54379958-54380392
  hyper
cgtcacttagctggggaaggtaagcggcgacgtggaggtgtcggccctgccccggccatgggtgctaaggcgggggcggtgcgcaccgcgggccgcctgcaggcgcagtgtgctgcaccggacgggtggctgctcccaggcgcgtgctggctgtggtttgctttctcaatgctggtgtcctggggagctgacgtcccccagctcaggtcaggggcttgcaaaaagcctaaaatggcgatcttgggccagggactagggaaggctggggagatggggggagttctctttactgcgttttcccagttgaaaattgtttcctgcgaaacgcgatttgttgtttgtgggtctgatttgtgcgtgcggcttgggctcctgcggcttttggctcggccgggggccttgggcagcgaggctggagccggaagaggtggagg

SEQ ID NO: 34427 - DNA, 505 bp, Homo sapiens
  chr12:54387842-54388347
  hyper
gtctctgagatctctcgtcggctgctggggctccggctcagcctggcagatccgctgtggcctctctgggacctcgccccggcccacggcctgacttcggctcggagatgcagcccttcccgagaacaggtgaagaagacggcggcagcggggactgggggcttcgggtgggaacgccagggctcagggctttgtgtgggtcgtgcagggggcgaggttcgaagtcctgggctggaccgcagcacgagtgtggcccggacggctgcgtggccagaaggggtgttcgggcagggtgcgagagcaccggcaaggtggattgtgtatggactttggccgcagacagagcagagcgggctcccgggctgtggccggcggcgaggcgggcaaccgcatgttgagtctatagaaaggaccttgaggtctgctgggtgtttgggctgccctgggggcggcggcccagagtgtggagcaagcggcgcgcggggcgcggcggtcagcgtgggag

SEQ ID NO: 34428 - DNA, 208 bp, Homo sapiens
  chr12:54388627-54388835
  hyper
ggcggccgtggtggccggggcttccctccccaggcgggagccgcctgtcctgtatctatggccgtggggagcgaaggaccaggtaacgaaggcgcttccgaagcgggattggaccaaaccagagggacagagtcttctgggtctctctgcctgaggccctggagggagagaaggtagggagatcggcgcccgccgggcctggcaaaga

SEQ ID NO: 34429 - DNA, 95 bp, Homo sapiens
  chr12:54389157-54389252
  hyper
tgaggccagacagctcgcagtcgggcagggagggcgggggagagacgagcggctctggccccttaattgtacttcgggctcgtattgtctctcct

SEQ ID NO: 34430 - DNA, 26 bp, Homo sapiens
  chr12:54391298-54391324
  hyper
cccgcggcaaaggcccggcaagccag

SEQ ID NO: 34431 - DNA, 260 bp, Homo sapiens
  chr12:54391399-54391659
  hyper
cgcctccctctctgcacgcctgcctttcccggctctcctatctcttttcatcttgccttccttcttttaattctcccccttttttccctttattctaatgctccgcttccttctttcctctcttgggcctgactccatgtttcagttggtctgtcccaggctgtctcgggttcagtctctctcaggctctgtcccctgatgtcctcttggtctcagtctggccccgggccccgctgagggctaaacgtctctgctcatcg

SEQ ID NO: 34432 - DNA, 9 bp, Homo sapiens
  chr12:54393451-54393460
  hyper
gacagagac

SEQ ID NO: 34433 - DNA, 263 bp, Homo sapiens
  chr12:54393461-54393724
  hyper
gattacgtcaagaaatagttcctccacctacctcggtcggcctccccgcccctgcggggctcccgcgcccagctcggccctgggggtccgagaaccctggcttcggggactggcattttcaccccattaaaaaatcctcatggttggggggaggccatctgcttatgggtggacatgggcacaggggcttctcagatgagctaggagccgtcctgagggggtgaccggtgccttgggtccagagttccggacccccaggaaat

SEQ ID NO: 34434 - DNA, 621 bp, Homo sapiens; identical to SEQ ID NO: 11268
  chr12:54393798-54394419
  hyper

SEQ ID NO: 34435 - DNA, 195 bp, Homo sapiens; identical to SEQ ID NO: 11269
  chr12:54394466-54394661
  hyper

SEQ ID NO: 34436 - DNA, 77 bp, Homo sapiens
  chr12:54398709-54398786
  hyper
cctctctcccctggtcgggagcgctgggatgcgggcttctctcccagaccgagagcggcgtttccgggcttccaccc

SEQ ID NO: 34437 - DNA, 208 bp, Homo sapiens; identical to SEQ ID NO: 11270
  chr12:54398888-54399096
  hyper

SEQ ID NO: 34438 - DNA, 312 bp, Homo sapiens
  chr12:54399355-54399667
  hyper
tttgtctatggcccacggagaacaggacctcactggctgagagggagaggtggagagcgcgcgcgcgagagggatgggctacaaaccaggggtcaaacagcctggagaagtccgagtcccaccccaaagtcctgcaggcggcggcggaatagtcggtgcggggccagcatcagggtaagaggagggaggactttagggtgcgcgccgcgggcaagccgtcgtgggagcctcggagcgtgcatccgcgttcgcggagatgttccaagcccagaaatgcgcctgaatggggggagatcgcggcagttgctttgc

SEQ ID NO: 34439 - DNA, 120 bp, Homo sapiens; identical to SEQ ID NO: 3895
  chr12:54402676-54402796
  hyper

SEQ ID NO: 34440 - DNA, 624 bp, Homo sapiens
  chr12:54402856-54403480
  hyper
ccgcgccccagccccgggagctctgctgatccggccgagctcagcaccgaggcgccccccaacctgcccagcccccagcccaccagcccagcccagtcccggggagccagctggcctggggttcggtcccggggggaggggagtttcgggggtactgggcggggtactcgtgagccagaggggagggggccgcgggttttcatgtacccagcatgagctcctacttcgtcaaccccctgttctccaaatacaaagccggcgagtccctggaaccggcctattacgactgccggttccctcagagcgtgggcaggagccatgcgctggtgtacgggcccggcggctcggcgcccggcttccagcacgcttcgcaccacgttcaagacttcttccaccacggcacctccggcatctccaactcaggctaccagcagaacccgtgctcgcttagctgccacggagacgcctccaaattctatggctacgaggcgctccccagacagtccctttatggggctcagcaagaggcgagcgtggtgcaatatcccgactgtaaatcctccgccaacactaacagtagcgaaggacaaggccacttaaatcaaaactcgtctcccagcctca

SEQ ID NO: 34441 - DNA, 410 bp, Homo sapiens
  chr12:54408316-54408726
  hyper
ggcccagtagcctagcggaatgaacccagcattaaatggctccgaagggcctcgccgccttttccccacaccaaatgtgccatttatcccttgtcctgttcagcaatgtccgtggccccaagcccggcgcgtcggagggcggggtgcgtctggcgcccggctttactcgagatgccaggcatggagagggctaagccgagggagccccagccaccccctcatgcagtacccgctcccccacccctcctgcccaccgcctctgttttctcgtttggaaagaaatggaggtaaaaacccgttttatgggggaacgtaattgtgagcgggatgcgctctctttagaatcgcgtcctcccaaatgctcccgccgtcccattaccggaatggggaccattcggctgctgcagata

SEQ ID NO: 34442 - DNA, 61 bp, Homo sapiens
  chr12:54422441-54422502
  hyper
agaaccggatctactcgactcccttttattcgccacaggagaatgtcgtgttcagttccag

SEQ ID NO: 34443 - DNA, 110 bp, Homo sapiens; identical to SEQ ID NO: 11275
  chr12:54425031-54425141
  hyper

SEQ ID NO: 34444 - DNA, 300 bp, Homo sapiens
  chr12:54440853-54441153
  hyper
cttctcgcccgccagcgcagggcccaggtgtttgaggcgaaggggctctagctccccgcaagcctggagccaggcgtcgcgcttcctccgggcttaatccagacctttcaacacacacctcattcgggggaggagaaaagcacaggaccgcggagagcccagctttgaggccaggcctgaagggataacccacacagggaacgttttcctatcagagaataatggagcacaaaataattcagaaagcgaatgggcaggaccacagcctgagagtcccgcgccgcggggccgctgcagagc

SEQ ID NO: 34445 - DNA, 30 bp, Homo sapiens
  chr12:54446784-54446814
  hyper
cagaaaatagcaggccgggctgaatgggga

SEQ ID NO: 34446 - DNA, 124 bp, Homo sapiens
  chr12:54447898-54448022
  hyper
cgccagtatagctgcaccagtctccaggggcccggcaattcgcgaggccacgggccggcccaggcgggccaccaccaccccgagaaatcacagtcgctctgcgagccggcgcctctctcaggcg

SEQ ID NO: 34447 - DNA, 68 bp, Homo sapiens
  chr12:54500146-54500214
  hyper
tcgctccatccttcccgcctgacggatgcgtctgctgcgcaggcacaagctgtcgggccaggccctgc

SEQ ID NO: 34448 - DNA, 193 bp, Homo sapiens
  chr12:54520001-54520194
  hyper
tggggcacaccagcacggcagaaactggagaaagcgagagacgtcgccagggacccagggacctctccctccagttccccgggcccgcccggccctgatggccactcacgctatagcgcccactctgtcctgggccatcccgcgccagcagtgtagcccccagcccgggcgcctgaatgctctccctccggat

SEQ ID NO: 34449 - DNA, 790 bp, Homo sapiens
  chr12:54520221-54521011
  hyper
cgtgcccccgagtcctgcttccccggggcctgctctgtatcaggcgcctgcgccttcaagggtacccggcccgcctgccctccccaagagccgagtttgcgctcctcccggaatcgtttgagagaaggacaaacttttggcaggatggaaatctagatgagcctgtccggagcaggtaagctgggcccgggacgggtgcgattcagcccgagaacaatctgtctctccccgtcccggtctctccctccccttacccctgtttcccctgcaggctgacatattaatctgccttcccccgggagaaatttgggctggggttgggcttctgtcagatgcatggggtcagagcagctttcctccccgagtttagggactaaggtggtagctggcaggggagggggagggttgcttccgaaactgaggattgaggggagggttaggggccgagaaacccagagtctgagggagacgacttctttcctcaaacgcaacttgggggaacttcggaaaagttttttgaggggagatggagaagggagcggagttggggtttcgagggctaaagtgggagagagggtgctccgcttcccgtactgaaggaaggatgtgtgtgcttattccccagtcgggaccgattaccagcctagaaaaacccagccgcgtcccaaacccgctcaccccagcaggcccttagagacgcttggagatccccagacacgccccgcggaaagggaaggaaatgccagcccgagttgccgactctgccgggacggggcgggggatccgccca

SEQ ID NO: 34450 - DNA, 85 bp, Homo sapiens
  chr12:54611458-54611543
  hyper
gcagtgaaggaaggacgctcagaccaacaggggctcaggtattctgggtgtcaggacccttcctcctgcacgcatcttacgcagg

SEQ ID NO: 34451 - DNA, 588 bp, Homo sapiens
  chr12:54812034-54812622
  hyper
gcccttggctgagttcgcccccagccccagggccccagtgccagggtccccgcactcgcccccagttctcggatcccctcgcctgaacagagattgggggcggagggaggagtaggagacagaggagaaaggagagggagccgccgtcctctctcgggtctttccccggtctgagttgaggggggaggggaggatgaggctggcccccatttaaccttccgaccccctcagtctttgactttcctcctactacacgtagctcattcggcttctacccgttctctcgccgcacaatggcccctacggatcccgaggtctcctggagcccccaaaagcccttcccggcctctgcgccccctctgcgcccccacccgccccaggtcccagcagcccacagacttcagccagagaccctcagctctccattcacgcgctctcctctcccttggcccggagacccctgcccagacttctccagctccgtgtcctctccccaccggacacatgtctccccactgatctcaaacgccagggcccctcctcacccgccacggtgccctccctactccagcgcgggcccccaactct

SEQ ID NO: 34452 - DNA, 30 bp, Homo sapiens
  chr12:54943058-54943088
  hyper
gaaactcaaaacacacggagagaacccaca

SEQ ID NO: 34453 - DNA, 52 bp, Homo sapiens
  chr12:54943371-54943423
  hyper
aggcggctctggcagcgcgcggcggcggcggcggtagcggcagcagcagcgg

SEQ ID NO: 34454 - DNA, 30 bp, Homo sapiens
  chr12:54982627-54982657
  hyper
gagttttgggcagggcgttggggtggggag

SEQ ID NO: 34455 - DNA, 166 bp, Homo sapiens
  chr12:57613840-57614006
  hyper
aagatgtgtgggatccgtgagggacagggcaacagagagggggcagggtcataggagagggtcccagggctcaggcgcaggaggagtcgcagggcgtggggtgggaagcagctgcccagtggggatggggagcagggagcgctgccttgagcgctggaaattggcg

SEQ ID NO: 34456 - DNA, 30 bp, Homo sapiens
  chr12:57614370-57614400
  hyper
cccaccagcggtccccgccccctcatgcag

SEQ ID NO: 34457 - DNA, 64 bp, Homo sapiens
  chr12:57618647-57618711
  hyper
tcttcgtgcacaggccgtcagtgcccagataccagagtccggaaggccgcagtacctggggctg

SEQ ID NO: 34458 - DNA, 47 bp, Homo sapiens
  chr12:57619110-57619157
  hyper
gggcctgtcccccaccctctgcagtctacgctcgccctggagggggt

SEQ ID NO: 34459 - DNA, 33 bp, Homo sapiens
  chr12:57632036-57632069
  hyper
tctcgctgatacttccgccgccccctactctga

SEQ ID NO: 34460 - DNA, 64 bp, Homo sapiens
  chr12:57632479-57632543
  hyper
ctttgttctgagttccggtgaccccggccaggtcccaaattctccgtcgcgctccttttccaga

SEQ ID NO: 34461 - DNA, 60 bp, Homo sapiens
  chr12:57635046-57635106
  hyper
gagcagcagaccgggcggaccccactgacccaaatcgggcagtttcgtggagggagagcc

SEQ ID NO: 34462 - DNA, 256 bp, Homo sapiens
  chr12:57869962-57870218
  hyper
aggaaactgaggccacggtgttgtttccttcactgcttccctctccccggtgggctgtgaggaggtgggaggcttcctcacttctttactttcctctgcaccgccctccccgctgccgcccccacattggcgtgaggcggtaggcagcgcccgcacccatcctgcgcctctcgctcacactcacccagcctgaggagggcgctgtcggcggtggctctcggtagaacaccaggctgttacccgttaacaccaccca

SEQ ID NO: 34463 - DNA, 405 bp, Homo sapiens
  chr12:57943780-57944185
  hyper
cgcccaggcccgcagcgcggcgctgcagcgcgaggggcggagaggcagagagcccgaaaggaccagacgcccaggtcgcccgcatcccgctgccgcaggagagagacagcgcgccccggccctgctccccaggcttcgcccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggt

SEQ ID NO: 34464 - DNA, 30 bp, Homo sapiens
  chr12:58004572-58004602
  hyper
tgagacccatttaatcgcagagacctccac

SEQ ID NO: 34465 - DNA, 133 bp, Homo sapiens
  chr12:58004814-58004947
  hyper
aagactccccatacacgcaccccgtaccagggggcctctgtccactcggccggggacagccccaaacccagaacatcttcgcacaggccaaggccccatccactgagtcctccttcatcgcagaggccaaggg

SEQ ID NO: 34466 - DNA, 383 bp, Homo sapiens
  chr12:58014820-58015203
  hyper
cgctcaacgggttggggtagccgcggccgtggccttcgggagcggggcgttgatggtgagggaggacccggggaggaacccggggggatccctgctgaggggccagggaaattgggccggggaagagggagggaccagctttcggcttgggttcgggagggcggaggtgcgcggggttggtttgctcctcctctagatggtgacagcgcgtcttctcccccacagctggggatgttcgtgctgcagctcggcgtcttgtccacctttttgtccgagcctgtggtcaaggcgctgaccagcggggccgcgctgcacgtgctcttgtcccagctgccgagcctcttggggttgtccctcccgcgccagatcggctgcttctctct

SEQ ID NO: 34467 - DNA, 166 bp, Homo sapiens; identical to SEQ ID NO: 3900
  chr12:58021293-58021459
  hyper

SEQ ID NO: 34468 - DNA, 263 bp, Homo sapiens
  chr12:58021713-58021976
  hyper
ggtgccttcgggggtacccctgccccatcctcttccgcttcacccctgcaggacccagacagttcccaggccccacttcgtggttctctctttgtcctagggctggccgttcctggccgcagcgcccccgctgtggccttagcctgttcaaggcccttctccacccccacatcctgcagcccctgccctaccaggtccagcggcgtccgctccagcacgtccacaagcctctccagccgcgtccgcgccgtgaagacgaagtc

SEQ ID NO: 34469 - DNA, 154 bp, Homo sapiens
  chr12:58025580-58025734
  hyper
tcactccacacagcccgttaggagaatgcaggcatctgagcccagcagtggagaaaacaaaagcccccagaccacccccagcgagcgctgcgctgcgccgccgcggtcggcactcaccccactacttgctccttgatcctgaccgggatgtgtg

SEQ ID NO: 34470 - DNA, 140 bp, Homo sapiens
  chr12:58025869-58026009
  hyper
cgagcagaaggaccagagcgcacagggcccggcggcccagccacatcctaggtgggggtagggtggggagtgagaaagggagggaagaagggagggcaagggatggggcccttggcccccgcgtcctcagaggctcctgc

SEQ ID NO: 34471 - DNA, 230 bp, Homo sapiens
  chr12:58026065-58026295
  hyper
cgcggttttcccggtacccctcccctcacttcccaggccccagggtctcccggcctcctttcttctcgccctctcctgcatctcggtttcctcacacacccgaggcctggcatcttaatgctgaagacatttggatgccgcggtttcgacgcggccgtgcgtaagcggaaaagccccgctctatcagggcagtggcagtccccaagcccgccgcccgccctggccggcgc

SEQ ID NO: 34472 - DNA, 97 bp, Homo sapiens
  chr12:58159773-58159870
  hyper
ggcagagaagactcacgcagtgagcagtccgcaagcccgctggcggcagcggcggtgctccgtccagggcgagaagctgcagcgctcgggccggggt

SEQ ID NO: 34473 - DNA, 82 bp, Homo sapiens
  chr12:58160215-58160297
  hyper
cctctctgatcatctcggtcgaggagaaatctctaaaagttccatgtctggactgtccatctcaggacgagtcctcagtgaa

SEQ ID NO: 34474 - DNA, 48 bp, Homo sapiens
  chr12:59313895-59313943
  hyper
ccccagagggctgcccgagttccccgcgaccgccgctgtctgaccggc

SEQ ID NO: 34475 - DNA, 243 bp, Homo sapiens
  chr12:59990053-59990296
  hyper
aggaggaggaggtgccggctaagaggagggcgagcctgcgtctgcgacccgagctgcccgcggagccgcacgcgtgtgtgcaaataatggccagcctgtgacaaacgtgccaacgcagagttggccagcgagcccttatatagacaaaaaaatcccgaagcggccgcgggagcagagctcgcgtcagccagtgcgcgccgacagctgcccgggaactgagggggcgcgcggggtcctgggcaa

SEQ ID NO: 34476 - DNA, 30 bp, Homo sapiens
  chr12:62584322-62584352
  hyper
attctgaacgctgttcgttaagagaatcat

SEQ ID NO: 34477 - DNA, 336 bp, Homo sapiens
  chr12:62584677-62585013
  hyper
gtctgggtgaggaatcgaattacaacccacttcaatcctcgacctggtcgtttgctgttattaggagaaatggggcagagagggagggcaccgctcacggagcctcatttcgcatgctccgatcccctctcggcgtccctctactccgcccctaccctgaccgcccgcgagggagacgccggccgatggacccgcatctgccctcacctctcgccttccccgggcgatccctctacagtcccggacccccgagaaaggggaagggagacgtgtgcacacgggggcttccgggaccgcggtcctgcagttgccgctccggtccccagcgctggccgg

SEQ ID NO: 34478 - DNA, 1172 bp, Homo sapiens
  chr12:62585030-62586202
  hyper
cgcacctacctgcagccccgcttcccggtggcggcaacacctagcgatgctcctgcagcttttgcgggccggcgccagccttatcgctctcgcatcgcttccaagatgccaatccgccgtcaccatccaggggcatagggaaccgaagtctggtgctgtgtgatcgtggagggcggcgtgtgagtgtggccctgagcgtgcgagtgtgcgcgcgcgtgtgtggatgtgtttcctcctccgatggcaaagacggttcaggaatctgacatccaagctggaatccccctgaagcgggtgaaggtgagcctgatccttctccccgcttctttattccacagtgtcaaagtaatcaaaagatttgtttactgaggaaaagccaaagtcccgcagcccttggcagcgcccgcggtcgcctcctgtcctcgccggatgcgcgcggtgcgctcagctccctggactgcaagaatcaaggcggtcttgctgcaattaccgctcttattccatctctgatttgtttgcttttaaggccgactaaagacttttcctctcgcctcacgtcgtctctccctctcacacacacacacactcacacatcctccgttccctctctcccgccctccctcttgttctctggggaaaggcaattggacagaatgattcaccttcaggaaagcagcctcggccacgcacttctcgagttccctggctctcgcaggtaccgggtctccaacgtggcggagttgctgggaagctcgggacaggaaggaggagaggctctgagctcagccgatgtcccccctccagacgcccgcgttcctccgtccaggtgcccctgttcccactgctcgcagataggtccccgctggtgccctcgcggagacttggcgccttccactcgaatccacttagcagcaactcctggccagcttcagcccctcaatcccgcctcgaagtgctgcgggcagagccccacgcagcccacccgctgcccttctaggcatcgtgggctggaaggaagggaaacccgccgatgtccccctggtagcagtgccctggcaccgtcaccaccgaggaggtgcgagttccaacatcgaacacaagcgagcaggtgtcgcctgtgtcactttgctaaaggcgggaggggagaaagaaaggagcggggggagggggcc

SEQ ID NO: 34479 - DNA, 140 bp, Homo sapiens
  chr12:62829159-62829299
  hyper
gtctgcatccctaagcgaactgctgcgatcctaagcgcggggagctcccccacccagaggtacccaggcggtgcttgggcggtagtttggagaccctgagagggcaatgcaccagacaggaaactcgccctgggtctctc

SEQ ID NO: 34480 - DNA, 422 bp, Homo sapiens
  chr12:63025738-63026160
  hyper
actggcgctgcctcccgggtccaggttccagccgctcccagctgttggcggcgctgctgagatgatggcctggatcccccaggttccgggactccccaggtggctccccgaggctatttacagctgaggttcggccggtgattgctgggacggaaaactcatttctcagcctggcttttatttacactcttattaaggaggctttcattcgtgttggaatggcagcgagaggctgcgggccaggcggccgaatgggtcgtgcccgagcgacagcggccgcctgcgccgcgaccttgagggcagaggagcgtgggcggcgtgcggggacaaaggcgcgcggggagcctgggtcacggctctgcagcagacacgggacctccacgtttctaccaccccggaaagttgagcgccttgggggctgc

SEQ ID NO: 34481 - DNA, 86 bp, Homo sapiens
  chr12:63327187-63327273
  hyper
gagctgattggttcccggacgaaccaatcaaccagcgaggccgtgcacggataggggagggccaaaactaccgaggggatggggtt

SEQ ID NO: 34482 - DNA, 562 bp, Homo sapiens
  chr12:63543840-63544402
  hyper
gcacccttgctctggcgcgacgccgtcttcccgcggacgttgcaccagatgttgtagcagatgaagccgtagcaggtacccaagatgaccacgggcgccacaaagatgccgcccgtcatccaggtcacgtaggcacgagaaccccagggctggatgaaggtggcccagcagtcgcgggccttggtgacattgttcacctcgatcatggagaagacgaagtactgcggcgtgctcagcacgaagctcagcacccaggcggccgcgatcatgaggcgcgagcggcgcgcgggctgttgcagagtcttgagcgggtggcacaccgcgatgtagcggtcggctgtcatgactaccagcatgtaggccgacgcaaacatgccgaacacctgcaggtgcttcaccacgcggcacagccagtcggggccgcggaagcggtaggtgatgtcccagcacatttgcggcagcacctggaagaatgccacggccaggtcggccaggctgaggtgtcggatgaagaggtgcatgcgggacgtcttgcgcggcgtccggtgcagagccagcagta

SEQ ID NO: 34483 - DNA, 102 bp, Homo sapiens
  chr12:63544498-63544600
  hyper
cgttgccctccccgagggcttcggcctcccggcttgtgttgccagcgccggtggccagaggccaccatgggctggagttgcccgagggccccgcgtcgggac

SEQ ID NO: 34484 - DNA, 152 bp, Homo sapiens
  chr12:63544728-63544880
  hyper
cgctcgcagcttgccgggctctgcgatccctccagtgggcgtctcccggagcagcgtcccgcctgcccactgagcagctctcagcagggtgagctggcccctctccctgctctgccttttttcaacttcggcgaggtcgggaaggtgagctc

SEQ ID NO: 34485 - DNA, 50 bp, Homo sapiens
  chr12:63545313-63545363
  hyper
cctgaacctggctctcgacctcacctcctccagtccgggtttcttccttc

SEQ ID NO: 34486 - DNA, 720 bp, Homo sapiens
  chr12:64061778-64062498
  hyper
aagactcaagaaaagcgccatgcggctccctcctagggctctcctgccctctcctcaccgatgccgagagtggttctgctggagaaccgccgcgcctgcagttcctgcaccttttcccggagctgcgccagggaattacggacgaactggaaggggccgagaagaaaggtcttggccaccacctctagctccaagccttttcgctctttcagactttggatcctccccggggaggacctccaggagccccttggcagtttcccgccgcctagggccgacttttccatctcctcctctacctccggctcccgggcgagggaggccccgcgccgccccttagactggctgcggccggaagattgcagccgctttgagcttactccttgttttctcataatcaaggagtatggtggagctgggtcaatttcaggcacagcccagccgagtcaggcgaggtccagagagacctgactcgcctggcagcctcaacggacttgtccccgcagccgttgcggacctcccggtcgtcatggcgactgtgaaatgtggggtggggcgcatgcgttggaagccattcgcgcgggcagtccctgagtgtcccctcacgtgctccccagcgcgagcagcacccccgcctctgcgcttcccagagcgtgcagcttccggtgagggcagccccacgcacagccccccacaccctccccagcgcctgcagcctcc

SEQ ID NO: 34487 - DNA, 27 bp, Homo sapiens
  chr12:64062499-64062526
  hyper
gtgcgcgcaggccccaagcccacatgc

SEQ ID NO: 34488 - DNA, 624 bp, Homo sapiens; identical to SEQ ID NO: 11301
  chr12:64062527-64063151
  hyper

SEQ ID NO: 34489 - DNA, 570 bp, Homo sapiens
  chr12:64784107-64784677
  hyper
cgacgtcccgcagagccactacccgccggatggacttgggcgggttctcggttaggtagacgagccggtcgcttagcaccacatacttgaggatgtggttctcagagttggacaccacgatgcatggctcgtaggcgcggaccgcgtcgtagacctcgggcggcagatgccgccgcaggaacacatccaggcggctgttcctgcgcgcggggaagccggacggcaaggggctggccatgcccggcgcccgcagcgtggcggagtgctgggactcgaggccctcagctcgccctctccccgcccccgcgctggaacccgcgcgccacaaagccgccggccacgcgtcgcctcctctccaggcgcggggacccgggccgcaactgcaggaatcgacgctaggtcggcttccctggagcgccctccccagccctgtccagcctctcgatctttgtcctaacctcagacggcgatgggcggggcaagacgctggtccttcaggcccgagttgatgggcacctcgggctcatcaccgtgaagtcccctgcggccgaagggcggtggatttttagg

SEQ ID NO: 34490 - DNA, 232 bp, Homo sapiens; identical to SEQ ID NO: 1051
  chr12:65218319-65218551
  hyper

SEQ ID NO: 34491 - DNA, 317 bp, Homo sapiens
  chr12:65218900-65219217
  hyper
ggggagctctggggaaagtccgcgtgccacctggtgcggggcaccgcgttggcacctgcagggagcgattggtctggaagggtagagggcagacgggggcctgggtggggcagcggccaccccaggcgcggagaacccgctgcttccaccctctccccgcggacccccaccctgcggcctgtgtgctcggctttctccgcgtggcggggaagtgcgggtggctgcccgggccctcagaggccgcaccacctattgtgttccaggctcgcaggaagccagaccttgcgagaggtgtgtgggggcggagagtggcacag

SEQ ID NO: 34492 - DNA, 71 bp, Homo sapiens
  chr12:65219457-65219528
  hyper
cagactgcataactccgtgtcggctccatcacccggcatccctccccgggattttaagagcctggccctag

SEQ ID NO: 34493 - DNA, 288 bp, Homo sapiens
  chr12:65219605-65219893
  hyper
cgctcacctgttccctggagtggcaccggctgcgttccaggcgggttcacggtccccggcccccgccccccagcgccagcgccttggggacctgctgtagagccgcaggagaatcgagctgcagagtcccaaagggtgggatgcggcactgcctttcccaacctcgtggtttctttgttgttctcccctaggaagtgtctagttgcagaggctgtagtatttattcaccatcttcctttacctcttttttttttcttttaaatctccttcccacgttaaaagtaagtg

SEQ ID NO: 34494 - DNA, 327 bp, Homo sapiens; identical to SEQ ID NO: 3911
  chr12:65220112-65220439
  hyper

SEQ ID NO: 34495 - DNA, 715 bp, Homo sapiens
  chr12:65514835-65515550
  hyper
ttgcctggtgagcatcgatccataggtacaggctctcctcctgcggcggcccggcctccgcccgcagtgccagcaggcacaggaggatgctccagagccagagcgcggcggcagggaaggcgctcctccgggccatgctgctcaggacctcctcgctgccgggaaaactcctcgtgccgcacctacgcaacctggcgccgtcagatactctgctgcgctgcagctccctcagccagggctgttcccgtttagacggctgggcgcgtcgcctcccggcctgggtgccaaggagcctgcgagagcaggaggagggggcaggcaggacgcgggaggaggagggggggaccagcgggcgcgagtcgcgcaagaagatggggcgcgggcgggagtgggggcggcagagacgtaagactggcaaagctggcgaggccagcagtcagcggggcaaatagagcgagaacagaagagcgggaagggctggcgcgagcgaggtgcgagcgaggagtggggcccgcgaggcctgggcggccgccacttgggggcgctgtggggcccccccgggggcggggccgcgagggacccccgaggctgcattcacagtgcggtgcgcccagtggagcgcccgcgaagtgggcgtgtagggctggcggacccggagaagggcactcagagacccctgggacatcactcgccacctcctcgggccaagggaggc

SEQ ID NO: 34496 - DNA, 73 bp, Homo sapiens
  chr12:65673227-65673300
  hyper
tgggccagactccagcgggcccgcctggcatttcacaggccaaaatcgaacagaaccccgagtttgccaggta

SEQ ID NO: 34497 - DNA, 151 bp, Homo sapiens; identical to SEQ ID NO: 11310
  chr12:66122419-66122570
  hyper

SEQ ID NO: 34498 - DNA, 208 bp, Homo sapiens
  chr12:66122788-66122996
  hyper
cgagaggtgtctgggcgcaatactctccggcccgaagcaaggggacgtttgcgaggagggagaaatttaaacccccttcgctccgcgccacctgggagcactttggcgccgcagactcaggagccgacgccatctccaggacggcctcggtggcctcggcaggaggcaccttcggggagcggtcccgcactcctccttcctcagtccc

SEQ ID NO: 34499 - DNA, 139 bp, Homo sapiens; identical to SEQ ID NO: 3913
  chr12:66123380-66123519
  hyper

SEQ ID NO: 34500 - DNA, 196 bp, Homo sapiens
  chr12:66135151-66135347
  hyper
tctctggcccagctgcggagggggaaaggtgatcgatcttgctgggggccaccgctagcccaccgcttcctgccgcgacctgccgcggcggccggagcccgggagcttcccattggctcacgggccgacgccatgcagtctgggggggcgtggccgggcggcggggcgtggccaggcggtgcggggaactgcggag

SEQ ID NO: 34501 - DNA, 195 bp, Homo sapiens
  chr12:66135407-66135602
  hyper
aggggagggcaggggcggggcggggccgggcggcgggggcgcacaccccaatctccctagcgctgtgggggtggctgcagctccccgcgcgctccctcctttgggggggtttctgggctcgtgacttttttttaaataaagaatgagcggatgcccgtgacaagttaatagctctcgccgcgctctaaagttaag

SEQ ID NO: 34502 - DNA, 330 bp, Homo sapiens
  chr12:66135863-66136193
  hyper
cgcagggcgcacgcacgcatcccggccccctcacactcacactgcgtcttctgtcacaccccctgtcgcacacacactgttctctgactcccaccatctcctgtctcacacccactccagtttcgtgttgagcggccgccagttctccctcggtcgcgccggcgcacgctcgtccccttctgccccggagcccgcccgcgccgcacggtggccccttgcgctggcctgatcgtgggaaccaggcggggccccagcgtccctgcccctgcccggtcatccatctccctcccggtcggccagccgagacttcaaaggcgcctcctccggccg

SEQ ID NO: 34503 - DNA, 72 bp, Homo sapiens; identical to SEQ ID NO: 11316
  chr12:66217530-66217602
  hyper

SEQ ID NO: 34504 - DNA, 410 bp, Homo sapiens
  chr12:66218917-66219327
  hyper
cgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagtcagtacgagggcgcggtgggggcaccagcccaccccgtccccactgccggggcccagacacgcgcggggcggccggagtgcgggagcccagtcgccgcggccgtcgcacactgcccgccggccggccggggggagcggcgcagaccccacgagtgcgccgcgcg

SEQ ID NO: 34505 - DNA, 30 bp, Homo sapiens
  chr12:66219897-66219927
  hyper
cagggtagccagggtcgcttccttgtcagg

SEQ ID NO: 34506 - DNA, 232 bp, Homo sapiens
  chr12:66582816-66583048
  hyper
agaggtgtgaaggggcgcaaagccagcgaagggagaacccgggtcgggtaacccccaggcctggccaggcggacgcaggggcatctcgggcgaggcgcgccttgcgtcacgtgggcaccgcccctgcagtgaccggagaacggcgtgttcctagggctctgctgccgtcgtggaagcaggatttccgcggttgtgtaacggcctgtcgcaggcgtgcagggacctggactcc

SEQ ID NO: 34507 - DNA, 280 bp, Homo sapiens
  chr12:66583049-66583329
  hyper
cctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctgggtgagtcggcggggaccggccgggggcggcgggggagcccagcgcgccgcggggcccgctcggcgtcgccctgcatggctggggtccctcgcggggctggcgcggcctccgggaagt

SEQ ID NO: 34508 - DNA, 144 bp, Homo sapiens
  chr12:66629273-66629417
  hyper
gcgcggggcgagactcgagcagctcgggcagccgccgctctgcgtgccatggacgggagttcgcgcgcggagctggcggcgtcgccgactctcccggcggcagcggaggagcagcgccgccgcgtcctccgatattattaagtt

SEQ ID NO: 34509 - DNA, 30 bp, Homo sapiens; identical to SEQ ID NO: 11320
  chr12:68759101-68759131
  hyper

SEQ ID NO: 34510 - DNA, 61 bp, Homo sapiens; identical to SEQ ID NO: 11321
  chr12:69326653-69326714
  hyper

SEQ ID NO: 34511 - DNA, 507 bp, Homo sapiens
  chr12:69327014-69327521
  hyper
ccccggacgtccctccggcccactccggagccgcgcgggtgcctcccgggcggggcctcagccgccttcgcacctaggagagacggcgcccgcgcggtgcgccctttcgtggcgcggctgctggtgcccgcggccgggcggctgagctgggcggagggctgcgggcatggagtcgccgctcgcggacagtctttgctggagccccaggtcagaagtgtgtcctcgcctcggccacggctgtagcctgggcagccacagggcgctccaccgagggacactctctgtcgcagactgcagccgcttgggagacgtttagggctcggcgggtttcctgcggttggcggtgccggggcccacctggagccgggacgcatgcggagtcctgagtgccctgagccccgcgcgggctcctgcgggacgggcggcgtcggccccggcagggcgagccaagctcccagcagtgccaagctgcccagcgaggctaagcaatcacggggcttcgagaaa

SEQ ID NO: 34512 - DNA, 55 bp, Homo sapiens
  chr12:70761007-70761062
  hyper
ggagccccagggctccggtcttttcaggtgggtttacgcgcggcgaccagtggtg

SEQ ID NO: 34513 - DNA, 411 bp, Homo sapiens
  chr12:71003634-71004045
  hyper
ggacgtgggacggcccgagggccggggcagggggtcacctgttgcgcgcgctcagcgcgccccgtgggcgcagcgcgcttccctcggggctggcgacgcgcaggggccactgcggccaccgctgctgctgctgctcctgccgccccgggcgggctgcggacgcgagaggcggcggggacaggcagcgcgccgcccttcccacgctgccattctgacccgcgctgcctcgccccagccccgtccgctgacttccgcaatcaaaaggcaatttcctcgtctcccggcaaaggaacaatgcgccggcgagggagggagccccgaggagccaacgcctgagcctgccaaggggcccgatgtgggccaagctgcccccgctgccccgcgccgataccttcccggccaggggtccgg

SEQ ID NO: 34514 - DNA, 176 bp, Homo sapiens; identical to SEQ ID NO: 11323
  chr12:71314436-71314612
  hyper

SEQ ID NO: 34515 - DNA, 63 bp, Homo sapiens; identical to SEQ ID NO: 11324
  chr12:71314613-71314676
  hyper

SEQ ID NO: 34516 - DNA, 30 bp, Homo sapiens
  chr12:71832897-71832927
  hyper
acaaatgagtcacttcgacttcctcacccc

SEQ ID NO: 34517 - DNA, 554 bp, Homo sapiens
  chr12:71833313-71833867
  hyper
gggggtcccctattccggcgcgcggcgttgagcactgaatcttccaggcggaggctcagtgggagcgccgagaactcgccagtaccgcgcgctgcctgctgcctgctgcctcccagcccaggacttgggaaaggagggaggggacaagtggagggaaagtggggccgggcggggggtgcctgggaagccaggctgcgctgacgtcactgggcgcgcaattcgggctggagcgctttaaaaaacgagcgtgcaagcagagatgctgctccacaccgctcaggccgcgagcagcagcaaggcgcaccgccactgtcgccgctgcagccagggctgctccgaaggccggcgtggcggcaaccggcacctctgtccccgccgcgcttctcctcgccgcccacgccgtggggtcaggaacgcggcgtctggcgctgcagacgcccgctgagttgcagaagcccacggagcggcgcccggcgcgccacggcccgtagcagtccggtgctgctctccgcccgcgtccggctcgtggccccctacttcgggcaccatggaca

SEQ ID NO: 34518 - DNA, 30 bp, Homo sapiens
  chr12:71834228-71834258
  hyper
gaaatgcacgtgtctcggggagtagcgtgc

SEQ ID NO: 34519 - DNA, 55 bp, Homo sapiens
  chr12:72332641-72332696
  hyper
cagggttctggacagcgccccaagcaggcagctgatcgcacgccccttcctctca

SEQ ID NO: 34520 - DNA, 160 bp, Homo sapiens
  chr12:72665266-72665426
  hyper
tgtacttcttgcaggcggctcagcaaccccctctgtggctgtgggtgtctggtgtgacagagcggagaaaagctctctaatctcccagtgcctgcctctgccgctcagtcgctcccctccctcccgcctttcctgcctcctcgcgcgctccctctccttt

SEQ ID NO: 34521 - DNA, 62 bp, Homo sapiens
  chr12:72665709-72665771
  hyper
gtttgccgccaccgccgcttaaagtgcccagggtggagaaggcttttccaggacggatctcc

SEQ ID NO: 34522 - DNA, 26 bp, Homo sapiens
  chr12:72665772-72665798
  hyper
tcgtagcttcgcggccctgggacttc

SEQ ID NO: 34523 - DNA, 52 bp, Homo sapiens
  chr12:72666342-72666394
  hyper
gatgcctgctctggctgtggcccgggtggcccgcccgcggggggtgccagag

SEQ ID NO: 34524 - DNA, 134 bp, Homo sapiens
  chr12:72666674-72666808
  hyper
gcttgtgctggccttcgctgtgtccctcgtggcattgctcgcggtcacaatgctcgctgtgctgctcagcctgcgcttcgacgagtgcggggcgagtgccacgccaggcgccgacggtggcccctcaggctttc

SEQ ID NO: 34525 - DNA, 389 bp, Homo sapiens; identical to SEQ ID NO: 3915
  chr12:72666997-72667386
  hyper

SEQ ID NO: 34526 - DNA, 38 bp, Homo sapiens; identical to SEQ ID NO: 3916
  chr12:72667387-72667425
  hyper

SEQ ID NO: 34527 - DNA, 41 bp, Homo sapiens
  chr12:75601190-75601231
  hyper
gcccagcctcttggccgccaggtcctcgtcgtcgccggggt

SEQ ID NO: 34528 - DNA, 122 bp, Homo sapiens
  chr12:75601378-75601500
  hyper
cgtctgcggggcagtgcagcttgccggtgcggtagtaattgagcacataggcgaagacgcccgggtgccggtcgaagaagaactcgcggccgccaccgggatggtcgctggccctgccgccg

SEQ ID NO: 34529 - DNA, 345 bp, Homo sapiens
  chr12:75601695-75602040
  hyper
cggtaggtttcgtgccgggtgcccccgacattgaggatcaccctctcgttgttctcgatcttgcccatctctgtgactcagacatgactagggggaggcaaacacagcgccgagttaaagatcttagccgtcaaagacacaccatgacccccaccaccaacccagagcgagtccagggatgcagagttggcagacaggcacggggcaaagaccctccccgggaggggatcagcgtccagcgctgtccccgcctcttgcatcaaacctttcccaggtttccagagaactacagagatagcagtcctagtctttcttgacctttcatgacaccgttttccctgcctc

SEQ ID NO: 34530 - DNA, 619 bp, Homo sapiens
  chr12:75602875-75603494
  hyper
tctacattcctattgcggaaaggcggagcggggggatgctggcctgcagggtcaacatgccctttccaggaaatcgcccctttcaccacccccgcccccatttccagataccttaacgagaccgagagaaaagtggttctgctttggtttccgagtggacgaggttctctgggcagcgggactgagtcttggcgcccaggtgagccgcccttctccgacgagaaactacttgttggcgttttccggattcaggtggttgagccgcttccctgggcgctggggtgggggagaaagcccccgccggccgccggccgcgctccccgccttcattctgtgatctgcggatttgccagtcgccaacctccgcgcccagagtcaccatcgcgcagggttgggcaaaccatggagctcggggcgggtccagccggcactgcccgacccctccgggagcgggcagatcggctggccgtgaatggagtggagactggccgcaggtcaggagagctcaccacttgaaggtgaagtcgccctgctcggattccatctgcagattttgtttctcccccaaatcagccactgctggagctgtcccttcagcaccactcgccatcaacctccc

SEQ ID NO: 34531 - DNA, 393 bp, Homo sapiens
  chr12:75728110-75728503
  hyper
atagtgctttgcactcgactggcccattgtcagcatcccgcacttgttctttacctaacttgtgtggcttgcatattgcaatctgtattacaatccagacgcgctctgcagattacagattggatccacagaaagcagtttggatggttgaaattccctccaccagagggcgactcagagctttcccctgtagctcagagctttgtggaaggggaaccctgctgcctgttcttccccacagcgacactgacaagttgatccagccgcgctgggctcgagcctgtgcggcaggatggagccaagggagagcgtggtgcgggggcgtggggaaatcgggttgccccagccgttactggtccgcgcagtcagggcatcctccgcatcctccacatc

SEQ ID NO: 34532 - DNA, 287 bp, Homo sapiens
  chr12:77719293-77719580
  hyper
gatgggggtggccagcgcggtcctgggagtggcgggttcggatgggctggctgcggtgggccactttgggcatctcggcgtggcctgcgccggggtcacggggagggctgtcagcgccagggcggcggaacccgaggtctccagacgagtgagggagggatgcaggcttgggggtgatggagcgcttggctggtggctggtgagcgtccatacatcatagctctccttcccactcccccgcccctcttcgggattctctctttctctttccccgtcctcatttcttt

SEQ ID NO: 34533 - DNA, 212 bp, Homo sapiens
  chr12:79257259-79257471
  hyper
ggaaatagttctctccgttttgaaatcctttcacctgtggagcagataatggacgggcccctctcccagctgggctccgctcccgcccctagcctggcgcgcggtcccttcccccacccgctgagccttcctgttcggtatttcggtattaccaagctataaattgcctgagagcttagagacaatcaggtcaccaccgccctcacaagaga

SEQ ID NO: 34534 - DNA, 375 bp, Homo sapiens
  chr12:79257722-79258097
  hyper
gtggagtcgcgctcccggccccacctatgggacggagctgcttctcccgcatctcggctccaccgcacccttcgcgggaagtccccaggcttccagcaaagctcagcttatcccgcccccgcttccaacccggaaccccagaagaacagcatgatgagcctccggcagccaggtgggccacctccccgcggctcagtttgaggacacttgtgcggaaccctttcacatccccaccctacccagctttcacaactccgccgggttaaatggccaaagacaaacttctacctctcctgtccccggtcccagcttttcaaaaacccacagctggcgaacccacacacatcgaaactcctaggtcgctgttgcagtctg

SEQ ID NO: 34535 - DNA, 141 bp, Homo sapiens
  chr12:79258297-79258438
  hyper
aacccgcctccaccccgcttcccaggtccctgtccgctgtggggatggagagacactaacagaactgggatgggcgatgttggctgaacggatccacctattattagtgcgcggggattggctccttggcgcagcgtaccc

SEQ ID NO: 34536 - DNA, 437 bp, Homo sapiens
  chr12:79258439-79258876
  hyper
aggtggagccaatcaggatgctggggctcggagatgatgggcggccgcctcctcactggagggattcctggagaagctgcagtgtggggatgctctagaccgagtactgcccccagtgtctttccacctcctcctgcagcagcggcagcggcagcagcagttagcagcggcaacttgaggctgcaccccgggcaagtccccagggtggtgctcagccgagaggggggcttggcgccccgaaggggtgtgtgtagggtgggggcgaccacgtgggaccagctggtggccctggaaaacctcccacacacccacacccacacaccccttttgtgttgcaggctgcccctccaagagcggaggcagcgagagtacgcgtgtgcctcgcgccggtccacgcggggagagcactggggaccgagacccggcaccacctcccg

SEQ ID NO: 34537 - DNA, 261 bp, Homo sapiens
  chr12:81102185-81102446
  hyper
aataggcaggaaatgcgtacccggcccgaggaagcaggaaagccgccccccaccccaccccaaccccggaaccgatgtttctttcctaatctgccgctgccttggttttccctccagcttgagggtgcggatttcctgcgcacctgcagctcccagtggccaagtgtttccgatcattccagggggctcgtgataacggctaaggaaggtaaagtaaaagggctctgggccgcaccagagaaaatccgggaggtggatagg

SEQ ID NO: 34538 - DNA, 30 bp, Homo sapiens
  chr12:81330218-81330248
  hyper
ttttgccttgcccatcgttcagtttaatcc

SEQ ID NO: 34539 - DNA, 573 bp, Homo sapiens
  chr12:81330746-81331319
  hyper
gaccctcgccgctttcgatctcgaagccgcggagagccgatctcggctgctggggctcggctccccgcgctctgccttgccctttcggcagagggcagctccctgcctgctgcagccccgccactgtgcgcccggcagcccaggggtgcgcccagcccgccccccgagtggccgccgggactccagcagttggaccgaccctcgccctccggcgcctggacaaacttccttcctcccgggcccctgcgccaagcaagctgacaggcggctccctcgccggtctcctctgggctctggccgggcgagcttgctctctgcccctctccaaccccgagcccctggcgcctatagccgtccccgcgcagcggctccaacaaagccagaggaccggagacgacccggcgaggggctgggagtggcagcggggaccccagagccagaaggaggcgtcccctcggcggggcgagtacagtgggaaggggcagcgggaacgtagcggggagagaaaggggaagaaagtgttctgttctcggcgcgaacgccttcctggctcgtcctcgttccccttctcct

SEQ ID NO: 34540 - DNA, 48 bp, Homo sapiens; identical to SEQ ID NO: 11341
  chr12:81331829-81331877
  hyper

SEQ ID NO: 34541 - DNA, 160 bp, Homo sapiens
  chr12:81471455-81471615
  hyper
tgccacctccaccaacgaccttccaaagattaaaccagccgtgtacaaactgctggattgaaaattgagagatgggccgttggcctcctcctaggagtacttgtgtgttgaaatcggaaggacgttctggagtttgagcgcgatttttcccggaaggctg

SEQ ID NO: 34542 - DNA, 18 bp, Homo sapiens
  chr12:81471753-81471771
  hyper
cggcgactctagtgtggc

SEQ ID NO: 34543 - DNA, 109 bp, Homo sapiens
  chr12:81472010-81472119
  hyper
gtggtcccgggcccgcggggcggtctcgggggccggggatgcagggcactgtcctccggcagtggcagcgagtacaagacccacttcgcagcctcggtgaccgaccccg

SEQ ID NO: 34544 - DNA, 44 bp, Homo sapiens
  chr12:82153211-82153255
  hyper
tgcagtggtttccaccggcccttaaataaattctgaagtaatca

SEQ ID NO: 34545 - DNA, 195 bp, Homo sapiens
  chr12:82153283-82153478
  hyper
cgcccgcggatacactcgtctcccccagagccgctcccgggctgccgaggctcgctctgctcccagtgccccctgcgaaggcgagggccagggatgggcaaagtgggaagggggcacacgcttccccgcctgggcttctttcacacaatgggctctacagccttcgcttgtgtcagcctgcgctggtggggatgg

SEQ ID NO: 34546 - DNA, 191 bp, Homo sapiens; identical to SEQ ID NO: 11344
  chr12:85305054-85305245
  hyper

SEQ ID NO: 34547 - DNA, 156 bp, Homo sapiens
  chr12:85305657-85305813
  hyper
cagccacgtgcctttcgtacggcgaaaggccccctttcgggccatttatcacaggatacctcaagcaaaggggaactgtggtcacgtgaaaacactctgtcctcggtagtcgccttctgcctttgctaaagcgaacggaagcgaatgaggaataaa

SEQ ID NO: 34548 - DNA, 99 bp, Homo sapiens
  chr12:85306458-85306557
  hyper
ggttttgggggtcgccgccctgcaggctggcaaggagagactcgtgagcgcctgtgtgtctgccagggaaacagcacgggatacaggcgcgcgggtgcg

SEQ ID NO: 34549 - DNA, 8 bp, Homo sapiens
  chr12:85306789-85306797
  hyper
cgagcggc

SEQ ID NO: 34550 - DNA, 158 bp, Homo sapiens
  chr12:85306798-85306956
  hyper
tcttcccagagcccggggctgtgcccgcccgatgcaggatgcaactgaggaagcccgctccaaagcaaaacaaaacaaattcctccagccatgccgtctttctccaacccactcaagcgaaagaatggacaccagttaccagccgctgacttttgtct

SEQ ID NO: 34551 - DNA, 505 bp, Homo sapiens
  chr12:85667226-85667731
  hyper
agtttccatgagaagcgaaacttcattctctttgctcagaatagagactcctccacctatgcgcgtttaaccacagagttgttcttgattgtaagggacttcgcccacttggttgaagtggagagccggtcctcattccagacgtcccgcacggcagtcgctcatggctccctccaggccgggagccaggaaggtggtccttcaccgaggtgcgcaccaagcggcggtccacccaggcaatggggtgcaccaatttgcctccaaaaatttgctgcgcacacaacctgttcacagttcctgatcagaaagggctaacgagatgtctgtctacagctgtctctgggcgagggcgcaggctttgggaagtggttcagcgcgatcggggacaccgcttgcagcccttggtcctgcacccctaggaggggtgtcccacaagctcggcttcccttttgcgagccacagagagctttttgttccgaaactctcattacgacagatagtattt

SEQ ID NO: 34552 - DNA, 848 bp, Homo sapiens
  chr12:85673067-85673915
  hyper
aggcactgatcctaacgggttttcttaaaataatttgggtctaatgataaaatcgtggaccaaagggaagggtggcgaagagggtgtagggaattggttggcattagtataatggcttcattgcctcttgctcggcttctctctcccacccatcgccaccgcgtccacactccgccgcattccagagaaaaagaaaaggccacggcctcgtaaagctcccagctggcccggaccccgagctcctcccggttagaagccgaagcggcccctctactacggcggctgcgattaacagttgccaatgcatctggttccttgggcttcggattaatgtgaatcttccacgtaaacgatttacggatgaaataaaagccttttagagcaatatttcctttcaagttcttaagacgcctctaaatctttctggtagtgagtggccggcatgggggcggggtggggacgggtggctcaggaaggcgcaggcagtagggagtggaggtttaactgctttgcgatctcaccaagatcttccgaaatgccagtccactgtcacggcggcaatgaatctgggtgtcaggggctcgtctctcctggcatttgtctgaaatggagctgtctgtctgtctatcctaggcctggacgccctctgcccgggtaagtggggaaaatgggggtggggtaggggcggagggggacctggggtggagttagtcgcccgcctattttcatattcattagaactgggaggctgcccgaggaggccagctgagtttcaagatataaaagcaacttcgggtgctccttttccagccgggacgtattaaagggaccggagcggggcagttccc

SEQ ID NO: 34553 - DNA, 968 bp, Homo sapiens
  chr12:85673916-85674884
  hyper
acgccgcagcgctcgctttcccttccctcctctctggccctccctcctcccacccactggctccctcccccagcgctctccagtttctgtgccccaggagctacgcgacagtcttccaggattatggagtttctgagcgagaagtttgccctcaagagccctccgagtaaaaacagtgacttttacatgggcgcaggaggtcctctggagcacgttatggagacgctggacaatgagtccttttacagcaaagcgtctgcaggcaaatgcgtgcaggccttcggacccctgccccgcgccgagcatcacgtgcgcttggagaggacctcgccctgtcaggacagcagcggtgagtcgctagcgccccagccggagccgccgcagcccttccgcaatcgaaaatgcaggatcggtctgatcaggcagggagggagaaaggagaaaagtgggagcgagggacctggaaggtggaggaaggtagtggaaggtgctcgctttatgaagcggtgttactgctgctgcagcctttgggggcggagggcggagggagggagagatccagcaccgggttgcctctgagcgattctcctttcgctgtagggtctggtcgcctacggatccctgagtccttctgtaatattggttcctggagtaaactgatagggcgctaaatagagcgtaattgagtcaagacagaacgcttcctctgcgagcccgccttgcagtccgggcggtaggaactgaaatcgatcacagctcgttagagtacgtcactgtcgtcacgagtagggaaaaaaaaaccggaaaacaaaaacaaaaaacaaaaaaccctttgagctcctttaggtaaagataaatctttttaattttccaagacgtggcgatatattttcaaagtttgaggatccctagatttctagcgtgtgtgaatttgtaatttctgcttttttttgcgtttgcaatacaac

SEQ ID NO: 34554 - DNA, 16 bp, Homo sapiens
  chr12:93966301-93966317
  hyper
agagctgggccagggc

SEQ ID NO: 34555 - DNA, 898 bp, Homo sapiens
  chr12:93966318-93967216
  hyper
ctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccggg

SEQ ID NO: 34556 - DNA, 426 bp, Homo sapiens
  chr12:93985172-93985598
  hyper
ggagcgaggagaaagcgtgtgtgcgttcgtgtgtggctgtctgtctgtctgtctgcggcaagaggaatctcagagtttcggttatttctccttgaagaattttcaaacggagttcctgcaggggctggctctagcgtctacgatgtgcacacactgtctctcaagagggaagtgatcctggcgccacggggtgatgcagcagaagttctttttgtctgtggccagggtagagtgcggagccccacggagctgtggcgtggcggctcctcccagacgcgtccggggcgccgctcgggtctcccaggaccttatgtaacccagcgtcggcagcaaggagccggtcacaggctgaccaacgtcaaggcgtttcactttggaagcgcaccagatgagtgtggtattgagagcagacggctgggtgcaatg

SEQ ID NO: 34557 - DNA, 829 bp, Homo sapiens
  chr12:94543118-94543947
  hyper
caccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcgtaagtcctgcccccggggcgccgcggagagcgctgctgccggggagccgccgccgccgccgaggcagaacgagctgggggcgagcggcggggcgggggtacagccgggtgacatttaccaggtctcaggttcacacc

SEQ ID NO: 34558 - DNA, 23 bp, Homo sapiens
  chr12:94543948-94543971
  hyper
cgggcggccgtccgaaggctcct

SEQ ID NO: 34559 - DNA, 332 bp, Homo sapiens
  chr12:95266862-95267194
  hyper
agcagccgcagcccccgagggcgccccaggccaggagctgcgcgccgtcggcgggccgtgcctggaggaggctcgcgccttccaaatgccggagtgcaggcatccttcctctccccaaccccagccccggcctcgacctgtcgcccacctggcccggacctggggctggctccgtctctggggtgtgcgccaagggagccccaccgacgcccagcagagctgcccgggctcccaaagaaggaccggggctttgggcagaattctggcagccaggcgggcgtcaggggagccggagaaggggctcgccagcaggcgtggggcggagtgccggg

SEQ ID NO: 34560 - DNA, 44 bp, Homo sapiens
  chr12:95267247-95267291
  hyper
cgaagagtgcgggcccggggtccccgcggcgccccttcccctcc

SEQ ID NO: 34561 - DNA, 114 bp, Homo sapiens
  chr12:95267567-95267681
  hyper
cggggtagcgctggccgcggggtccccggggctctcccgggctgcggcggaggcgcggagccggccaagggcgcactgagctcgcggagctccggggccccggggcctttctgc

SEQ ID NO: 34562 - DNA, 92 bp, Homo sapiens
  chr12:95267706-95267798
  hyper
cgggccgcttcgcccctctcctcttcctcgagttctggccccaccaggagcggagcgagtctccgatgcctgccccgcggcccccagaactg

SEQ ID NO: 34563 - DNA, 16 bp, Homo sapiens
  chr12:95942964-95942980
  hyper
gcgtggcaaactccgt

SEQ ID NO: 34564 - DNA, 311 bp, Homo sapiens
  chr12:96883403-96883714
  hyper
ccccctcgagctctccgtcagacgactctaccacctcggggtctctgccagaactgccgccgacctccaccgcgacttcgaggtcgcccccagagtcgaaggggagctcccggagctcgctgcttcagtggacctgccccgaggactcattgcccctagccgtgttttatgggccgctggacgcgaaaaacccgctcctggcctcttgtgagaaggagatccaggagttgttaggctttatgaggaaaaagaaggctttagccaccacggaggaagagaagcacgaattccgccggcgttggtaagcgctg

SEQ ID NO: 34565 - DNA, 32 bp, Homo sapiens
  chr12:97380005-97380037
  hyper
aggccgtgcactccccgcgcttccgggaacct

SEQ ID NO: 34566 - DNA, 30 bp, Homo sapiens; identical to SEQ ID NO: 11363
  chr12:99287423-99287453
  hyper

SEQ ID NO: 34567 - DNA, 258 bp, Homo sapiens
  chr12:99288150-99288408
  hyper
aaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacc

SEQ ID NO: 34568 - DNA, 316 bp, Homo sapiens
  chr12:99288621-99288937
  hyper
cgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagag

SEQ ID NO: 34569 - DNA, 1 bp, Homo sapiens
  chr12:99288961-99288962
  hyper
c

SEQ ID NO: 34570 - DNA, 93 bp, Homo sapiens; identical to SEQ ID NO: 3927
  chr12:99289161-99289254
  hyper

SEQ ID NO: 34571 - DNA, 128 bp, Homo sapiens
  chr12:101110941-101111069
  hyper
gcgctgggccaaatccgcggcgcgcctctgccgggcacctcccacctccagcttcgcccctcccctctcccggccgcgcgtcctccgcggctggttcaatccccgcggggacccggagcgcggctgcc

SEQ ID NO: 34572 - DNA, 161 bp, Homo sapiens
  chr12:101111277-101111438
  hyper
ccagtctgggcaggacgcgggccaggatggcctccctcaccgcatacggtaactggggccgtcgcgggttcctggggcggcggggcggaagggaggggcccagggagccgtcgaaacacccggggaaacttcggggttcgcctctgcggaggggtctggaa

SEQ ID NO: 34573 - DNA, 32 bp, Homo sapiens
  chr12:103218533-103218565
  hyper
gttttaattaacccacgcgcaggcaaggtctg

SEQ ID NO: 34574 - DNA, 106 bp, Homo sapiens
  chr12:103311184-103311290
  hyper
caccacttcgctgcccgccctgggtaaagggaagaagccagggagcgacgggccacccaagccccgtcgattagacaggtttaggcacttccgggactctcagaag

SEQ ID NO: 34575 - DNA, 32 bp, Homo sapiens
  chr12:103344621-103344653
  hyper
tcagaatgaactttccgcgcaggtcagatata

SEQ ID NO: 34576 - DNA, 60 bp, Homo sapiens; identical to SEQ ID NO: 11370
  chr12:103350244-103350304
  hyper

SEQ ID NO: 34577 - DNA, 239 bp, Homo sapiens
  chr12:103350383-103350622
  hyper
cgccatcactcaacccccgccccgcatctttcttctccgagggtctgggagtatcccagagcactcccttctttatgatatccgctaagctggtccggaaataatctttatggggagggggtggcggtagggggcgatggtacagggggccagaggtcatcctagggggacgtccctgccatatacacccacctacaggacggctcacaaccactcctcggtgtcgcttccccgcggcc

SEQ ID NO: 34578 - DNA, 509 bp, Homo sapiens
  chr12:103351477-103351986
  hyper
acgtggaaggcgcaccgacagggatccggccagggagggcgagtgaaagaaggaaatcagaaaggaagggagttaacaaaataataaaaacagcctgagccacggctggagagaccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcactttttttgctcccactctaagaagtctcccggggattttgtatatattttttaacttccgtcagggctcccgcttcatatttccttttctttccctctctgttcctgcacccaagttctctctgtgtccccctcgcgggccccgcacctcgcgtcccggat

SEQ ID NO: 34579 - DNA, 104 bp, Homo sapiens; identical to SEQ ID NO: 1058
  chr12:103352051-103352155
  hyper

SEQ ID NO: 34580 - DNA, 38 bp, Homo sapiens
  chr12:103352229-103352267
  hyper
gccgacggccagccctcagggggcggtcacaagtcagc

SEQ ID NO: 34581 - DNA, 15 bp, Homo sapiens
  chr12:103352268-103352283
  hyper
cccaagcaagtcaag

SEQ ID NO: 34582 - DNA, 368 bp, Homo sapiens
  chr12:103352313-103352681
  hyper
cgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacga

SEQ ID NO: 34583 - DNA, 302 bp, Homo sapiens
  chr12:103358661-103358963
  hyper
gttctttacccactgcgaaagcgaatggcttggatctagcgcaggtcgaagttatattccttcttcctttgtatgcaagattaggttgttacaaaagagggtgtgtaggttaatggcaggaagcaagttgcagcgcggagcgcgggccctgagcgcgtgtcaggcttaatgatttattcaagctgcagcgcatccgggcgttgattggctgcaggcatgcgtccgctgtcagctgcgcgcgccgggaactctccaggctacctgaagctggggggaggaagaggaggcgtggggacccgagg

SEQ ID NO: 34584 - DNA, 220 bp, Homo sapiens
  chr12:103359352-103359572
  hyper
gagatgggggaaagccgccaacccacactccttggagggagtcactttctgcaaagtgcgttggagaggactgggccctgggtccgggctgtcgaagcaggaagtggatgtaggggacaaaagctccgcacctgccaaatgcgagaccttagagagagcctccccctcgccgctccctgctcccccgcgggcccgggaagcttgcactaccgggctcagc

SEQ ID NO: 34585 - DNA, 145 bp, Homo sapiens
  chr12:103359573-103359718
  hyper
cagccagccccaccgcctccggactcgaccccaccatagccccgccgtccgaatcgtctctgaaccaaactacttctgcctgcctttctttggatctgtctttctctgtcatctgagtcactttctctctcgcctctcttttctt

SEQ ID NO: 34586 - DNA, 288 bp, Homo sapiens
  chr12:103889228-103889516
  hyper
ttagcatgcgggcggcggcgagccggccgggtggggagggcggcggtggcatcgctgcgcggggcgcattgtgggccgcgctcgcctccgcgggggaccatctgctcgctgtcaatgcatcacctgctcgtctgggccgtcgccggggcaacggggggcgggggattaaggagcgtgtgcgtctcggtccgggccgaggcggcgaggtgggggttggggcgggggaggagagctccttggccccccacccccctgccccgagacgggtcgacccgctcgggggccggc

SEQ ID NO: 34587 - DNA, 197 bp, Homo sapiens; identical to SEQ ID NO: 1063
  chr12:103889517-103889714
  hyper

SEQ ID NO: 34588 - DNA, 237 bp, Homo sapiens
  chr12:103889788-103890025
  hyper
cgcagtcgccgggcaaccacaatggggctgccttgccgtgagaccctcccccgcgactgccaccaaagtcacagaaaactttcacacctctcatctgacactgtggcctgtgcacgactccaagcactggggaagccttcgacatcagaatatgaatggcacctgttcttccgggggcggcaagggggatcccgatgtttatcaaaatgggttgattttccacggagggggtacttc

SEQ ID NO: 34589 - DNA, 112 bp, Homo sapiens
  chr12:104322966-104323078
  hyper
gcatcctcctgcactcgttaaactaagggttttccttttctgtgctagacccgcttttacgaccacgctctccacctgattcacagaaagggttctacgaccgtcaggtcac

SEQ ID NO: 34590 - DNA, 190 bp, Homo sapiens
  chr12:104609336-104609526
  hyper
ggattttgggtggtgcgctcttttctcctttccatttctgcattttccaatttacctttagcgaccgttctttcctgttaaaaaaaaaaaattcacgaccttgaagaagatacacgggctatgacttcgctgttgtcaccgagcgccccgcccaccgcgttctccgacccgcggccggcagggggctcgc

SEQ ID NO: 34591 - DNA, 270 bp, Homo sapiens; identical to SEQ ID NO: 1066
  chr12:104609527-104609797
  hyper

SEQ ID NO: 34592 - DNA, 293 bp, Homo sapiens
  chr12:104850244-104850537
  hyper
aaagaaaaacgaaaccgcccagttctgagcgtcggaaaatgggcactcgctccctgggggtttggggcaacttccccgctacgtcgcccagggattttaaataattgccagccaccagaaaccccctaacccttaattcttccctccgagacccagcccgctgcttgccacttccctctccaaacgctggcgggggtgggtggcagcaccgaggcgattttcttcgtctttttttcctccgggttttgtcatggaaacgctgacacaacctccagacggcggccgagcccggc

SEQ ID NO: 34593 - DNA, 672 bp, Homo sapiens
  chr12:104850577-104851249
  hyper
cgcacaccgcactccccgggcaacagctggacgcgaccatatcccgggtaggggcggggggagcgcgacgctccgccccggcgctagggtccctccctcctcccggctctccgcaggcgccctcccctcgccgggggccgcgagttgcatttggtaaaacccagccccggaatatatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggcc

SEQ ID NO: 34594 - DNA, 231 bp, Homo sapiens
  chr12:104851920-104852151
  hyper
gttgcccctccaccacgcgccggccgtttgcccccggggtccgggtccgcagtgaccttgcggctggtgccccggggcctgctccagcccccagccctgagctggaaactccgagctcctgggtcacgccttgaccactgcagttttggaggaaactttggccaggtcctgggctgaccgtccgtttgcatcccccacttctgggatccgagcaacgggaatcccccgggc

SEQ ID NO: 34595 - DNA, 287 bp, Homo sapiens; identical to SEQ ID NO: 11387
  chr12:104852152-104852439
  hyper

SEQ ID NO: 34596 - DNA, 6 bp, Homo sapiens
  chr12:104852440-104852446
  hyper
ggccac

SEQ ID NO: 34597 - DNA, 61 bp, Homo sapiens; identical to SEQ ID NO: 11389
  chr12:104852447-104852508
  hyper

SEQ ID NO: 34598 - DNA, 107 bp, Homo sapiens
  chr12:104852725-104852832
  hyper
cagattccttgacagcgcagggacagacggcccctttgccccactcggtctggagcagttgttaaggcagccacactgccaaggatatggtccgactctaccacatg

SEQ ID NO: 34599 - DNA, 43 bp, Homo sapiens
  chr12:105478265-105478308
  hyper
gcggcgcagcctgggcgcggcctgggcgcggcctgcagtctgg

SEQ ID NO: 34600 - DNA, 30 bp, Homo sapiens
  chr12:106532217-106532247
  hyper
cccgcttgactttgccgtaggtgcctttgc

SEQ ID NO: 34601 - DNA, 640 bp, Homo sapiens
  chr12:106974353-106974993
  hyper
cccacctccactctgcgtgcaaaaattataataataatagcaacaataatagtctcatccgccctggagaccacccgtgcccccgtggcatccctcaaggactctccgggcggtggcagccgcccaccctggggacgcgctccttgctgccaccggaacgcccctggccaggctccatctacgcgctgtcagaccctcccgccgtctgaagaaggcttttactcttcagcctattccagtggcagagaagctaaggctacaaaggcgaacgcgaacagtcagatctgacttcgaattccgctgtcattgctgccaggcgcaccacgaggacgcgcggtgaccgccaccatggcattcggctgccaaaggtttccatcgacctctttcccatcaccagcatcgcagcgggaaagaatgtgcctggcgcccttctgggcactgggcatggggtggtgaacaaagtcctccagaaataaaccgggtaatgagcccggcagcggccggggcaggaagggaccttcgcagagagtggtcaggcacagcccctccgaggaggcgacgctcagctgagaccagggtgacgcaaaggtgtcggccggttaggcacctgtgaggaaggaggagccggcagagtgccaag

SEQ ID NO: 34602 - DNA, 439 bp, Homo sapiens
  chr12:106975246-106975685
  hyper
gggctccccagtctccgtacattgtcccactcagctctgattgtggggagggggcggaccgagggggcggggggcgtctttccgaaggatcgcggaaagccgcgcgctgccaggggcccggggttagagacccccactcccgcacggcgttagggactccgcgcttccccgcccccgccgcggcccgccggctctgcctctgtccatggtcaaagcacccggggtaatccgcctttctcttccgcccgccgggccccattcatattctaatcacagcgcggccgacccgcgaacggccactttatcggggcccgcaggagacgcagcttgctccccctcacttccacttccagcaccccccggccctcgcccccctctttctgcactttcaactccgccgaggagggggtccctgggaaaaccgcgtccccacttggat

SEQ ID NO: 34603 - DNA, 119 bp, Homo sapiens
  chr12:106976403-106976522
  hyper
cccggcctgccagcacggcgcggggcccgatggtggggaagggccgggagggggagggggccacatctaagccaattttgatttcgcctataatgagtgccgggcgaaggctggagaag

SEQ ID NO: 34604 - DNA, 55 bp, Homo sapiens
  chr12:106976725-106976780
  hyper
tgacattgctcccatcggggctcctataaaatgatgctttttcccatgaaacatc

SEQ ID NO: 34605 - DNA, 11 bp, Homo sapiens
  chr12:106976842-106976853
  hyper
cgctttttctc

SEQ ID NO: 34606 - DNA, 479 bp, Homo sapiens
  chr12:106977373-106977852
  hyper
gcgcgcgcgaaggagcgcgctttcgcttgccctggacacaaagttacgtaaagatgcgctggctcgcggcgagctcgaggtgccacttgcagaaactttgccagccgaccgccccctcccggacccaggtcctcctagggtatgggggcctcggaatagcggtgcgctcggggtctggcggccagggccgggaagccgagcggaacgccccgaggcgggggagggtgacggcttcgcactgcgcctgggaggtggggaccgaggctccggctggtagagacgcgcagctggagggagtggcggcggcgaacccggtggtccgggggaatccgcagaaacgggaggtgggagtcctgggctgtggggtcgggcttttagcttttctgccaggaaggggcacccaacgccgggctccactagggagctgtgaccttgctggagggagggcaggacgcagactggcccgctaaactcggcgt

SEQ ID NO: 34607 - DNA, 30 bp, Homo sapiens
  chr12:106978736-106978766
  hyper
tgaggtctctactggcggtaaagcgggagc

SEQ ID NO: 34608 - DNA, 30 bp, Homo sapiens; identical to SEQ ID NO: 11398
  chr12:106979261-106979291
  hyper

SEQ ID NO: 34609 - DNA, 86 bp, Homo sapiens
  chr12:106979504-106979590
  hyper
gttattatatcattccgaaaggactggaacaaccgactcacagcaagtgctggggcgaagtaggaaacgtccaggataagagaggc

SEQ ID NO: 34610 - DNA, 238 bp, Homo sapiens
  chr12:106979636-106979874
  hyper
cgaagtgcctcgggcccgggagaacagttttgcaggggccagggctctagtggcctgctttggggccacttcagcatgacctgcggaaacgcgcccctttgttccgcacactgagccagtaatatattcctcgggtttccccaaaatactcaacaagtgtggagctaagacaatggcccggtcgggggaagctgggcagccggcgcgcgcctcctgggccctaggcgctctcgctgcc

SEQ ID NO: 34611 - DNA, 120 bp, Homo sapiens
  chr12:106979875-106979995
  hyper
agcccgacaaagcaaagcccctctcggaggcaaagccccagcttgccgcgcgccgcggtgctccggcaggaggcaaaggcgacaggcgcgcgcaggggcagtcgacgcaccttctggccg

SEQ ID NO: 34612 - DNA, 257 bp, Homo sapiens
  chr12:106980223-106980480
  hyper
agaattttaggccaccgagaacttgtgcaaagtgggccgggccgggtcggtcgcctacgcaacagaaggatcatttcttttaaaacgggatggcgcgttagagagggccactgccaagctggagctggaaacttctgcctccatccactttccgctcccatctccagaacccagagctgaggcggccaaagtacttcctggagccggatttgagttccccgggccgcatcggtgggagggcacgctagtttacaggc

SEQ ID NO: 34613 - DNA, 28 bp, Homo sapiens
  chr12:106980719-106980747
  hyper
caaaccagacagtctcgccctccccggg

SEQ ID NO: 34614 - DNA, 628 bp, Homo sapiens; identical to SEQ ID NO: 1067
  chr12:106980911-106981539
  hyper

SEQ ID NO: 34615 - DNA, 42 bp, Homo sapiens
  chr12:107297268-107297310
  hyper
tgactgggaagcttccgcagggaattccgccccggacccctg

SEQ ID NO: 34616 - DNA, 146 bp, Homo sapiens
  chr12:107486450-107486596
  hyper
cctaaaattcgtaagcggtataagcaagacagtcccacgtctaaattcacagatttggcggatcgcatggaattcattaacatcagactcattaaacacccaaatccatttcccacgggcttgtgactcaccgccacctgttgatg

SEQ ID NO: 34617 - DNA, 209 bp, Homo sapiens
  chr12:107487646-107487855
  hyper
gcggccaccattggccgaggctcgctgagacccggatgagcacggggatgcggggagcttgcgggcgcgcgcgctgctccgttaggcgcgcgtgcgctctcgctgcgttccagagggtaagggggcggggccggcgggcaggagcgcgctcggcgattcctcccgtgggatttggggagggcctggaaattgtccggtttccttcagga

SEQ ID NO: 34618 - DNA, 38 bp, Homo sapiens
  chr12:107711950-107711988
  hyper
agggggcagcatccacgtctctacgcttgcaagggttc

SEQ ID NO: 34619 - DNA, 30 bp, Homo sapiens
  chr12:107713205-107713235
  hyper
gagcgccatggagatcgtgctgtcctgggg

SEQ ID NO: 34620 - DNA, 530 bp, Homo sapiens
  chr12:107714660-107715190
  hyper
gttagtttagggcgtcgtttccagcaggttctatcatcgtctcttcatgccccactgttttgaaggcctgacttgggtaggtttgaacccgcagttctgtccttgaagggggtggggccggggcgcttgttttcgagagctcgcgctggcggtgctgcccgtctgcgaaagccggagctagacacttcaaagcttcaattttccacaggaaatggtagaaacgtaactggagactctaaaggcgaaataaaactttgttacatattcggcggtttggccagaggttgcgcggttggagctgaaatgcagtctttctgggcagatttcattcatgttgctgcctgtctgtttcccgggggctggaggagcactgcggtgggcggtgccaagggtgtgcatgtgcgtgtgagagtctgtgtgcgcgcgcgtctgtgcgtgtgtaagtgtgcttgtgagtgtgcgcaggaacaagcgggcgcgcagggcgcccggctccagccgaagcctttggaaaccgaccctgccgccct

SEQ ID NO: 34621 - DNA, 492 bp, Homo sapiens; identical to SEQ ID NO: 1068
  chr12:108168922-108169414
  hyper

SEQ ID NO: 34622 - DNA, 55 bp, Homo sapiens
  chr12:108169549-108169604
  hyper
cgcacagcgcgcagccgggcgctcaacctaaggtcctcttcgaaggtggtttgca

SEQ ID NO: 34623 - DNA, 103 bp, Homo sapiens
  chr12:108237422-108237525
  hyper
aaacagcttcttcatcgcggcagcttcggagaagcctcagctaccctgcagctccccttcgccttttcgcggaatccggagtccagtcacaattagctaagcc

SEQ ID NO: 34624 - DNA, 307 bp, Homo sapiens
  chr12:108238207-108238514
  hyper
tcaggatactgaggccgcccagagcacgccccgccaacccacctaggcgcctgagctgcagcctctgcgccgtctctgccgcggtccggcaggccgcctggattggccgccgccgctgctgccaccacggtgtccacccaacgactctaatgtgggaagtctggcggtggagggtgtcgcgggctctccggcagacccgtagctggtggtggagctgagggccctggggcatggcgggcagggacttgaggcccgcaggaggagggggccgtgccgatgctggctgtgccggggctgcctgagaacc

SEQ ID NO: 34625 - DNA, 433 bp, Homo sapiens
  chr12:108297323-108297756
  hyper
aagttggagatacaccgattctcctgtttctggggaaggattctcagaaggtggctcatatgagtaaaaatcatttttcctgggtagctgattcctagaaactcgcagggcggcacagcacggcggctcgtggcagcagaagaggaagatgccgcggtggaaggcgtcttcgcggccgggcagcgacgcgtacacctgccgccggaagaagagcgacggtcgcacagctctcaggccgggggccggagccccggcagcccggccgcgcccatccacgcccagccacgcccagccacgttggccgcccgcccagcctgctgggaaactgctcgctgcgcattcgcccgccggcgccgacttggcgatggccagctacacaggtccggcgggggcggcagccatgtggggcgcgggctggcgtggggagcagccc

SEQ ID NO: 34626 - DNA, 79 bp, Homo sapiens
  chr12:108523360-108523439
  hyper
cccgcctccctggctcgccggctggcgtcgccaccgcctcctcgtccccggccaccgctgtcgccgctgctgcaattca

SEQ ID NO: 34627 - DNA, 30 bp, Homo sapiens
  chr12:109746889-109746919
  hyper
aggagggagcaaagccgaccctgcaaggcg

SEQ ID NO: 34628 - DNA, 100 bp, Homo sapiens
  chr12:110271088-110271188
  hyper
agatgtccccaggggcgcgaggggacctcggctgagccgcccctcccgggcccgggccccacttacctccgggacggctgggcgccggcggccgggagat

SEQ ID NO: 34629 - DNA, 148 bp, Homo sapiens
  chr12:111127212-111127360
  hyper
acaaaaatcctgccccgggccagcctaagggaagggtgggcgggggaaccacttccttcctccgccggctggagcggggcgaatccaccccgccaacccctttcggggagcttctgctccatcccaccgtctccgggccacccctgcc

SEQ ID NO: 34630 - DNA, 372 bp, Homo sapiens; identical to SEQ ID NO: 11409
  chr12:111284662-111285034
  hyper

SEQ ID NO: 34631 - DNA, 144 bp, Homo sapiens
  chr12:111471165-111471309
  hyper
tggtgacatttcccacgactcagtggcgcccccgggcggctcccaccctccctccggccggcgcgtctacgcagccccaagtgctggctgcgaccctcggatcccaagcatatctggcgatggagcggcggcagcccgaggcac

SEQ ID NO: 34632 - DNA, 650 bp, Homo sapiens
  chr12:111471310-111471960
  hyper
tgttgtgtgtgctccgattgcaaaagaaaaaaaaatgcatttcaaactattaacttttttttaagcgtgcaatgccgggagctgggggtagacaggtgcaagcgggggtaggcgccccgcgcgcccgcctcccgcagcgccccctcccaaacttccctttgcattgatcagcacgttacgtcagtattgataagtttgcaaaaagccaaagtcaagtgcaatcgcgcggcacaccgaccccggacttgggggggagatgcagcgagcgctccgcgggcccgggagccggcggcaggcagggcagcggcggcgccggcgcctctcggagaggctgcctccccccaacccctcccctcccaccccatccccggctgcctcccccgggcgggcgccgagctccccgcccggcgcgctccgcccgcgccctccgggggtcgggggggcgcacggctcccgggcccgttggcggcggcggcggcggcggcgcggcggcggcgaggggcagcgggtggcaggaggccggagggcgcccgaggggccccgggccgcggcgctcagggcccgggcggccggcggcggccccggggctggggggagtccagcccggatattgagtgcagccattgagaaaagccaaactcttgtgtgtg

SEQ ID NO: 34633 - DNA, 138 bp, Homo sapiens; identical to SEQ ID NO: 3943
  chr12:111472058-111472196
  hyper

SEQ ID NO: 34634 - DNA, 155 bp, Homo sapiens
  chr12:111472356-111472511
  hyper
cgggcagggggctgctggcgggaacccccggcggtcccccctgagccgcactttgcgcgcctcccaacttcgcggcgcccggggaggccgcggagcgcgccgcttgccagtccgcacccggctggggctccggcgagggagggagggagctggcg

SEQ ID NO: 34635 - DNA, 101 bp, Homo sapiens
  chr12:111472571-111472672
  hyper
ggcgaggaggcggctccgcgccccgccgctcgccggcacctcagccttcgccgcccgcctggctgcgcagcccggacgcgccgccacccgggggccgccgc

SEQ ID NO: 34636 - DNA, 166 bp, Homo sapiens; identical to SEQ ID NO: 3946
  chr12:111472851-111473017
  hyper

SEQ ID NO: 34637 - DNA, 67 bp, Homo sapiens
  chr12:111844623-111844690
  hyper
accgggccaggcccccgcatgctgctgaattgggcggttcaccagggctaggcgtcccagagacagg

SEQ ID NO: 34638 - DNA, 325 bp, Homo sapiens; identical to SEQ ID NO: 1070
  chr12:113012954-113013279
  hyper

SEQ ID NO: 34639 - DNA, 30 bp, Homo sapiens
  chr12:113229420-113229450
  hyper
cccaacctcccctcccggcctcccaccttt

SEQ ID NO: 34640 - DNA, 77 bp, Homo sapiens
  chr12:113494339-113494416
  hyper
ccactccctgcctcacgctctgcttggggtcagaaggccccttggggtctcgggagggcctggccgaggatttgggg

SEQ ID NO: 34641 - DNA, 607 bp, Homo sapiens
  chr12:113494430-113495037
  hyper
cgtgtcagcgccggtggcgctcagggccgagatctgtctcctccccttcctcctcctccgccccctcccctctccctcccggagcacggccgaggcctcctcccacccgcgagatcccggcggccgccagccggctcctgcgtccgtccgtcggccgggcagtctgtccacgcgcggaaagctcggcgcggcggccgaggggcctgggagggaacgggcgcggaggcgggaccgcggctccctcccactccggggggagcccaggaggcggcggtgctggagcgcgagccggagccggagccggagacgaagagaggcggtgagaacgcgggtgcttagggaccccacccccggctcccgctgggggcccgcgagcggctcggggacgtctgggctggggaagcggggctgttacccccagggcgggaggcagagacgatccagctcctggcttcgccccctccgcgacgcgacccccgaggggccctgggccgcgcctgcagcgccgcgcatccccgtgcttcccggcgcaccccagcgcacccggcatccccccggcagggcgagggccccgggggaagggaaggctccgggagccaaggagggc

SEQ ID NO: 34642 - DNA, 50 bp, Homo sapiens
  chr12:113495038-113495088
  hyper
ccccccaggcggagagtctcggaaaaccgcgcccccggcccctgccttcc

SEQ ID NO: 34643 - DNA, 593 bp, Homo sapiens
  chr12:113541506-113542099
  hyper
ttagaaataacacgtcgcatacgccaagcagcgtcctatgctctttgtgtaaatcaagtcatttaattatcacaactccacgagataggcactgttatcaacctcatttcacagttgaggagactgaggcatagagaggttgagtaacttgcccaaggttgcacagccagcccaggcggaagtgggacacccgctgattgacgggtggggagggcggagcctgcagtccgccctgccccctcacctgagcgctcagcctggaggcagcaggtccagcgcgcgctgcggaaggcaccggggtggcaggcggccagcttgttcgggttgggggcgctggccttgcgcaaggccgagagccactggttgagctcattcacattctgcagcgggtgggaggcgatcagggggcgggtgggaacagagggacgccccccgctccccatcgcggtggggtctcaccttgcactggaggtaggtggtgtgcagcgcccccgtgccgtcctgcgtcaccacctgcatcacgtggggcagttggaaggcgccctcgtctacgcgctccacggcgcggatgtgagacacggggatggagtgac

SEQ ID NO: 34644 - DNA, 271 bp, Homo sapiens; identical to SEQ ID NO: 11420
  chr12:113592127-113592398
  hyper

SEQ ID NO: 34645 - DNA, 140 bp, Homo sapiens
  chr12:113900538-113900678
  hyper
acggggaaagcacagcgagaaataagattacaaaatgccactcggattgcagagagagggaaaaacaccgtctccgccccttggcctcaccctctctcagtccaaagaggtggcggtggctgggtgggtgggtgggggcc

SEQ ID NO: 34646 - DNA, 407 bp, Homo sapiens
  chr12:113900752-113901159
  hyper
cggttgctgggagagtactggcggtgggctgaggctcctggagagcccgcggggtggagatgggggtcggccccccctcggcgcccagccgaggagcagctgccagttgagtgcggacccgagagagaacccccgagggacacccacgtctcccaccgcgtctgcgtcgggcgttttggtttcaggaggctgcttcggggcggggcccccgggggccgagcgcggggggcggcccggcggccttaccacacggcggcttcgttgagctcggggttgggatgcgacaggggtccgctgtagccgctggtgccgctcattgggaagggcgggctgggcccgccgctgaatacctcgccgggcatggggtgcagcgtgcccggcaggcctggctcggggctcggtgtgtc

SEQ ID NO: 34647 - DNA, 611 bp, Homo sapiens
  chr12:113901407-113902018
  hyper
cgaagtaggcgggggacccgggacccggggaggggacccgggcgggcgagagaggggagcgcgcgacaccgacccaaggttagagagacctgcggaggccggcgccccttgagacggtggacgtcgcaggctcacggggagggttggggagagagacaatgagagatctcgaaagggcaagagactcagactgccagagaccacacacagagacgggagagactccgagaccgtgggggacacacgcggcaaaaactcggagacttcagtcacaggttccctgacacctagagatggagagagacagaggcggccagagacgcagagacagacaatgattcctaagtgtcttagggtcggtgagagacacagagatgcgggacagcgagagacagacggagagatcggcagaggggcagagagaaaggcggaaaagagacccagagacgcggagtccgcggctgagacccgaaagcccgagacatcggagggtcgcggaggagtcgaggagacgcagagagaggaaagacggccgcggttagagacacgcgtggaaacccccgggggcggcagcgagggagtcaggagtgagcccgaagatggagagaagt

SEQ ID NO: 34648 - DNA, 312 bp, Homo sapiens
  chr12:113902041-113902353
  hyper
cggtggatcagagatgagtcccaggaacctccagagaagcggaggctgacaggcccggggagaggaaccgggcagggacaaaccagcggacagagcagagcgcgaaatggttgagaccgggaagcgacctggccgggggaaactggatccgggccgcggcaggagcgactggtgggttgggccgggcggggcggccttggcgccctaaactcggtccctgcgccctaccaacccagtccaagtccttcgcctcgccaagtacggccgccgcgtcgatcccggtgagaccatttgtaccggcctagcctagcc

SEQ ID NO: 34649 - DNA, 79 bp, Homo sapiens
  chr12:113902608-113902687
  hyper
gaggtgtagggactccggattgcaaacccattctgcctcaacaaatctgtatcaactctctgaccgccccacatagccc

SEQ ID NO: 34650 - DNA, 522 bp, Homo sapiens; identical to SEQ ID NO: 11424
  chr12:113903021-113903543
  hyper

SEQ ID NO: 34651 - DNA, 273 bp, Homo sapiens
  chr12:113904756-113905029
  hyper
gcgatcgtgtctagacgtgtgtccctggagtctctgaacgcaagtgtgagtgcaccttgtgccctgcgtgggtgaatgtgtcactgtatctcgtgtgtgcttctgtgtgcatcactgtatgggtgagaccatgtatctgattttgtgtccaggacatgtgggtgagtgtacatgtgtctgtgatcgtgtgtccagcgagtgggcgatgttctggagcggcggaaagcgtgctggccgggacccttcgccctcagctcccggaataggacaggt

SEQ ID NO: 34652 - DNA, 33 bp, Homo sapiens
  chr12:113905380-113905413
  hyper
ggtggagagaggcttcggcgaaccagccaaggg

SEQ ID NO: 34653 - DNA, 761 bp, Homo sapiens
  chr12:113905673-113906434
  hyper
aagcaaggcggggggcggaattcagagaggtaaagtgacccgcccccaaatcgcaataccaggaggacagcagggctagatggaatctttcggttcacagtccccgacctcgggcaagtgccccactcgggcgcacggtctgctcccagaccagaaccaggcgcgctcgtagccaaggaagcttggcgggagactcctccgaggctcccggctcccaggccagcggggctaaggagctgtgcccgccccgggccgcacctggatgacgcgcatgttgaggccggtctcctgcgccagctgctcgcggatgtggcgcgtgggcttgggcgtggcggcgaaggcagccttgagcgtctccagctgcttggccttgatggtggtgcgggggccgcgccgcttggtgcccgagttctgctcctcgttctcgttgttggccgtctccttgtccgacgaggtcgagttgtccgtctctttggggtcgtcctgcagtgcgtcctggaggtccggggacaaactgcggtccgtacaggatgacactgcgggcggacggatcgggaaggggacagcggcgtcagcgacggccagacgcctcttcagtccagtggcgggttcccgccggcccaagctacggcctgcccaggctacggccagccccgctggattccctcccaaacctgcgacagcccctcccccagggacccggtgcccgcccactctctccaggcggggctgggcctttggaggggcgctcttaagccctc

SEQ ID NO: 34654 - DNA, 32 bp, Homo sapiens
  chr12:113907104-113907136
  hyper
gggcgagatgccttgcgcgcagccggcgcatt

SEQ ID NO: 34655 - DNA, 163 bp, Homo sapiens
  chr12:113909055-113909218
  hyper
tatccccttccccagcgccccagtggagcgcgcgcagggtgggcgcgcaggcagcagagcggcgcggcctcttacctgaaaaagtcatttttgcagtagagcttgccctcgcgcgagaagcacttctccgagaggttggttttgcactcgcagcactgaacac

SEQ ID NO: 34656 - DNA, 35 bp, Homo sapiens
  chr12:113909468-113909503
  hyper
tggcgctgggctgcccggagtggggtggtgggggg

SEQ ID NO: 34657 - DNA, 123 bp, Homo sapiens
  chr12:113909534-113909657
  hyper
cgcacgccccggcgcctgttccgggcttccccaggtatctcgggtggctgctggcctcggcgctgcggagcggctttccccggtggcggaggcgccggcactttcccccactttcaagcggtc

SEQ ID NO: 34658 - DNA, 449 bp, Homo sapiens
  chr12:113909717-113910166
  hyper
cgtggcgctgcacgtagggggcccagcggccaatgggcgcaccgtggccatggcaacctcttaaatttatagcatatctaaattggctacagcgttgctgtccggacagagcaaaaaaaacaaggcatcagtattgttgagtattagcttgtacctggttcggaggctaagtaagtatttaccttccagtttggggctgacggggcgggggcagcgcgaaacgaaaattgcgtctctcttcctctctctttctcctcacaaatatttgggggtcacgggttccaaggcctagtccgggaggtacccctgcccccttcgccatccctggaacttgcagaagttgccccacgccccacacttcgctccccttctccagcccagccagcccagattggattcccccacccccgcgccccctctgcgccctgaagctgcgtcagcgcggttct

SEQ ID NO: 34659 - DNA, 157 bp, Homo sapiens; identical to SEQ ID NO: 11429
  chr12:113910529-113910686
  hyper

SEQ ID NO: 34660 - DNA, 814 bp, Homo sapiens
  chr12:113912868-113913682
  hyper
agctcagccccagttcgagaactccctggacctgggctcagccaagctgcccagaacccgcccggccttctctagcccaccaccttccccggtgcacagcatcggaaaatgccagcagaccagctattagactcatcccgacctaacagcgctaacagatggcgaccaggcagcgaaatcccctcctatatgtaactaataaaccgcttgtgtcttaacagggtaatgcatggagacgcaatgtcacttatacaagatgttgatggaatttactatataaaaatcttcctcctagagtaaagagtatcaacattacaactcgacagacggcggcgggataagtaaaacagacaaaagacaaacaagataataatctgtttccaatcacttaagccctgtagagttagtaatatgcggtttgcatattcccccttgagttcggtaattaattactggcgaggaggcgcacactagcctggggtgggagttttggggagcgctgagctggggcgtggggcatacctctcttgagttctccagcccgggacaccgggcagcggccggaatgagggcgcttccagaggtttggagctgacccacccgcgggttgaagaggtcgtttcagttgcacctccctattcctcaccggaaagcctccggcctgggagattctgcagccaagcaggaaagggggtcttctctggcagccagtgtctctcctggctcctcttaaagcatcctctccttcgaacggccgggagtggcagctttattgggaaacgcgcgctctgggggcccaggtggctggggggac

SEQ ID NO: 34661 - DNA, 204 bp, Homo sapiens; identical to SEQ ID NO: 11432
  chr12:113914020-113914224
  hyper

SEQ ID NO: 34662 - DNA, 228 bp, Homo sapiens
  chr12:113914300-113914528
  hyper
cgggccagagaggacgccggcggggtgcaatgggtgctcaggcctagacatccgggcagggatgcgagagggatggcgggggtgggagtggggtgggtggggggtggtggtgaattttctggggaacccttgggggtggccgtctgagagcggcccggagcccaggcggggagagtgtcctggcctgggtggaaccctgggaggcgggggcgtcgtggctggtgtgcc

SEQ ID NO: 34663 - DNA, 44 bp, Homo sapiens
  chr12:113916222-113916266
  hyper
tttgttagcctaatacgggttactttagaattggcccgactttg

SEQ ID NO: 34664 - DNA, 404 bp, Homo sapiens
  chr12:113916326-113916730
  hyper
gtgtgcctgcgcgtgtatttctcgcttgctaatgattgtgtgttgatagagtgatgcagtggcctcattagcctttgtttagaaggtgttaaaagggaaatctgcatcgggaaagcggcggtttacgcagcagcccggctgaacaccgcgagccaaggggctggggggcggggacggtgcccaccccccaggcccccactcttcccccaggcgcccaccgccgcggaccccgggagggaggaggggtccggggaaagcgaccccagctccttcctcccaaggcgagtatgtttaccctgctgggcacccttccgctccgcggggaccactgcgggatcgcgctctctaaaactcctctcaactgccccgcagtgcgcggcggccttttccgccaggttttttgg

SEQ ID NO: 34665 - DNA, 285 bp, Homo sapiens
  chr12:113917232-113917517
  hyper
agtgagcttcgtgcacggcatttttcaccctctggaagaagccagatttcgggcaaggtagaacgtgagaagaatcccttttatactggctcctacgaaaggaaccagaaaaaaaaataatacacattttgagcagcctctgtgggtgcagcttgttgaactcggagccagacgctttttctggcgaaacggagaaaaaacgccgcggaaacggtgcgcagggttggggagtataggttctgattgcaacataattccgcaagcttttttattttttatttttcc

SEQ ID NO: 34666 - DNA, 121 bp, Homo sapiens
  chr12:113917580-113917701
  hyper
cgggtcttggggcgaggcttagctggtctgggggtccttgcgtgtccacagccccggatacgcacccgcgaaacgttcgacatcgccgcttttttgttttgttttgctttgtttttttagt

SEQ ID NO: 34667 - DNA, 160 bp, Homo sapiens
  chr12:113917730-113917890
  hyper
cgcggccggctggggcctcgggcagtgacagtgaaacgaattccaaacccattctgaactcgccatggcgctctcctgccctccaacacccaccccaaacaccgtgtaggcagaagcgaggttccccgtgaagccgggttaaaatcggcagctgagatgc

SEQ ID NO: 34668 - DNA, 136 bp, Homo sapiens
  chr12:113918155-113918291
  hyper
cttctagctccccttcgctctgtgactcttgccttcccctgaatttatttcccttttgggggactcaccttagaacctgcgccctgtacacaggtgtatatacatatatcaaagaacaaaacgattgattgaaaac

SEQ ID NO: 34669 - DNA, 192 bp, Homo sapiens
  chr12:113952930-113953122
  hyper
gaagtaactctaaaacgcgtgatggaggccaaggggccgccgcccgggctgcagctgaaacggcgctttcacaaacaagacgtaaattggatgcaaacatctaattaaccttctccctcagttccctccgcagagggggaggtgggcctcctagggctcccagcgcctgtcttccctcgggggatggatttg

SEQ ID NO: 34670 - DNA, 42 bp, Homo sapiens
  chr12:113953467-113953509
  hyper
ggacaccgagcatcccgggccatcggacgcagcaggtgcaag

SEQ ID NO: 34671 - DNA, 368 bp, Homo sapiens
  chr12:113957639-113958007
  hyper
ccatttgttaaggggcgaaagtcctcaggtgcatcccgaggctggacaatttgtctctgtgaaaaggacgctattatcagagaggctggatgcaggcggagggcgggcccgaggggcggcttgggagggggaggctcggaggagcgaaggggctcaggcaggggtgggggggcggaggccgagacaatggggggaaaaataataaatacatcggagcgtgccagccgcggggatcctggctggagaggcgcgaggggcaggggggctgcttggggctggaggagctcatgtgctcgggcctcggaagccaattcctttttcatgacccttgtccaggaccagaagggtgtcgccggggagctctgccg

SEQ ID NO: 34672 - DNA, 207 bp, Homo sapiens
  chr12:114029630-114029837
  hyper
acctgcagctcaacccgcctaggagaggcgctcgccgagctcgattctccgggtgccataaattaggacgccagtcgccggcgaacgctgggggcttccagtataccttccagcgcagcccgcaggctatttttatctccctcagcacctcggcacctcggaggagcttctgctaattcactaccccgacaccgtctcatctcccct

SEQ ID NO: 34673 - DNA, 96 bp, Homo sapiens
  chr12:114075780-114075876
  hyper
gctcgagttcaaggacgcagagaggacgggagggggttaaagcccattcaaacgcgcagccccccgcccccggctcgccccccactccccgccggc

SEQ ID NO: 34674 - DNA, 184 bp, Homo sapiens
  chr12:114075909-114076093
  hyper
cgcgtttcacacagcgcacaatggccgccctcaaaggcgcgccgcccgcattgttcgggccggcgcccgcgcgtcctacctccgcgcgcgaattaacccccgtcaccccgccattgtcaccgcgcacttcggggccggccacaaaggcgccagaaaaccctgccgtgttcggaagggtgggggg

SEQ ID NO: 34675 - DNA, 359 bp, Homo sapiens
  chr12:114833767-114834126
  hyper
tccccaccgaacttgcgaatcgccgcgtttaacagcctgaaaatctggcctgctttttcccgggaactgcggaggttgtctctgtgactttgattatttgcattgatgaccctggggcaagattcttggaccaaccctggagtccggccccgatcgagtggaggtagttgggggaggcgagccgcggccgggggcgggggagggacgaggaactcgcgggccccgcggctgcccgaccccgggccgcgcgtctctaatctccggccgccgtggcccggccgcctccccggccgatagcgacgccgaccggggcggcgtggcgacagagagacgcagcggggccccgctggccgccacag

SEQ ID NO: 34676 - DNA, 30 bp, Homo sapiens
  chr12:114834466-114834496
  hyper
cgtcccacttcccagcgtcaaggaccacgc

SEQ ID NO: 34677 - DNA, 477 bp, Homo sapiens
  chr12:114838373-114838850
  hyper
ggaggcctctccctccgagccccggagccaaagcctcgcagtgtttatcagcctgagcgagcgcgcccggaggcggaggcgcagaagacttcgcaggccttttatagttaaatcctcacggctcaggctcggggggaaagagggactcggacgtgtctttccttcctgggggaataggaagaggactgcagttcgttgatataaacagaacgcgcctcctagttcactcaggccttgggccgagcggggagcagactttgtttaattttaaataataataaatgtcactgttgtcagtttattgagggaggcttcggctggagaacgggggcggggggcgtctggaaaggcggctccaccctcccccttcacacactcggtggcttgggcctaccgttcgcctgctccacacgcctgctcggggcatcctctggctttttgctttgcgggacgcggaagacccgtccagcacgggta

SEQ ID NO: 34678 - DNA, 149 bp, Homo sapiens
  chr12:114841034-114841183
  hyper
acaaatggtgcggcgcgcgggtctagtcggcggcgcggaggaggcaggaggaggcaggaggaggcgggaggaggcgaaggctacggaagatcagaagaggggtcaagccatcgctcatgccggcctgaatcggccgctgacctggccct

SEQ ID NO: 34679 - DNA, 30 bp, Homo sapiens
  chr12:114841854-114841884
  hyper
agctaccagcacctccgttcccagccgaag

SEQ ID NO: 34680 - DNA, 72 bp, Homo sapiens; identical to SEQ ID NO: 11445
  chr12:114843007-114843079
  hyper

SEQ ID NO: 34681 - DNA, 520 bp, Homo sapiens
  chr12:114843285-114843805
  hyper
cggggagctccgagccgcgcaaaatctctgcaagctgtgctctgcagaatgcaaagccgggctggaatccgccattcccgccgccccagccgactcggccgacgagctccctcctgagcctcccgggccatctgccgggacggttacctcgttcggtgaagccggtgcattcaccacatcctctgctgctcctagcagggaagccggcggtgaggcgggggagcaggcatggtggctccggggtttatgcggggtttactgcttacccagaatagcggctactgctgcctactagggcgcacctaccgctggagcctccgcggcgactgcccacctccaacacacacctcctctgctgtgcgcttgctctccctaaatacttcccagttggcaagcgccaaagaacacaaaatagcctccaagagcaccggcaaccatataatctcagtgccccgctcctcctttacacccccagggagggaaagttggaagcccagtgaatggtcgaagtcctttctga

SEQ ID NO: 34682 - DNA, 190 bp, Homo sapiens
  chr12:114844184-114844374
  hyper
acaaatcatttcaaacgcggtcggcttctaatcgggaagtaatctcagtgacgctggcggtgcagagaaccgagtctggacgcacacacacaaacacaccgcgggcctccgcagccttgcagacattctctccaacgctgacctcgagaaggagagctgcctgaccccgcctggccggcgctcgccttcc

SEQ ID NO: 34683 - DNA, 175 bp, Homo sapiens
  chr12:114845868-114846043
  hyper
gactatctcaccagccgctgcacctataggacttggagacgtcacgagtcacgcaaccggcccgcgcgctgtcacgtttggctggggggcagcggcgggaggtaaatttctctccgtcttcgcctatcagtgccgggtctgcgcagccacaggttccggacgtcttggccccggg

SEQ ID NO: 34684 - DNA, 491 bp, Homo sapiens
  chr12:114846456-114846947
  hyper
tccaagaatgcaattcgtcccagagtggcccggcaggggcggggtgcgagtgggtggtggagtaggggtgggagtggagagaggtggtttctgtagagaataattattgtaccagggcccgccgaggcacgaggcactctattttgttttgtaatcacgacgactattatttttagtctgatcaatgggcacaatttctaagcagcgcagtggtggatgctcgcaaacttttgcgcaccgctggaaacccactaggttgagttgcaaaacgtaccgcgtagacgcccctggtggcgccgagagaagagctaggcctgcccagcacagagccggagagcgtcgggccttccggaagggtaagttctccgccaaggggtcccgagggagctggacgtctgaatctggacttgcccccagcttcggggttcgattctgggttttgcgcgtccccaacccccagggctttccgaagcatggcctggctccaggcc

SEQ ID NO: 34685 - DNA, 122 bp, Homo sapiens; identical to SEQ ID NO: 3956
  chr12:114847042-114847164
  hyper

SEQ ID NO: 34686 - DNA, 272 bp, Homo sapiens; identical to SEQ ID NO: 3957
  chr12:114847165-114847437
  hyper

SEQ ID NO: 34687 - DNA, 78 bp, Homo sapiens; identical to SEQ ID NO: 3958
  chr12:114847577-114847655
  hyper

SEQ ID NO: 34688 - DNA, 62 bp, Homo sapiens
  chr12:114852127-114852189
  hyper
ccctcccaggcactgcgttctgcggccgggacagcacccgccaggcgcggcccttctcctat

SEQ ID NO: 34689 - DNA, 162 bp, Homo sapiens
  chr12:114877171-114877333
  hyper
aaaaggccgccacagcggcggggcccagggagaaaaagcagcgttcccaattcccatgcttccagctccaggttgtcggtcttttgtcagcctccgaagccagggtgctcaacctggccccctttctttcctgctggtgaggccacccgctttgggacagaa

SEQ ID NO: 34690 - DNA, 227 bp, Homo sapiens
  chr12:114878367-114878594
  hyper
ataattccatgcccacgagccgacagatttgcaattctcaagtacttctatgtgcatgtaattctacgggcaaattgttccgagtgcaagggatttggtgtgtgtgtcagtgattgcaccgctgaaaacaattctgtagatgtgtcgatgcctttagaagaaagggctccaaagaatcgtgtctcgatggttggtcagcgcgcgcatctgcggcactggctaaatcc

SEQ ID NO: 34691 - DNA, 204 bp, Homo sapiens; identical to SEQ ID NO: 11455
  chr12:114878808-114879012
  hyper

SEQ ID NO: 34692 - DNA, 450 bp, Homo sapiens
  chr12:114881634-114882084
  hyper
ctgggaggggagggtcgctggggtcgctgggcgcgcgcgcgcggagcaaatttgcccgcgcgcacccagaaacgatgacataagtggcgctgatgagcgctgcgcggctgaaacgcgactacataaagggtccgccggcagcgtgggccggagggattgcttcacactccggaattgggcccagacacatttagaaatgttttgctggacgtgtgccccgcaagggcgacagcggcagccggcagcctgggtgaagctgcgccgctggtcacaggctggcgcgcggcggcggccacagaggcgtcctaggtggagaatgcttctgcctttgcctgttctcccctaacccccacgtttgtatgcctcctggggacaggggtctgtctgcagcctgcagcgccccagctgtgaccagagaagcattaaggagcggcgcgggcaagaatttgg

SEQ ID NO: 34693 - DNA, 30 bp, Homo sapiens
  chr12:114882616-114882646
  hyper
cccgtgccccaatttcgccagacttaacga

SEQ ID NO: 34694 - DNA, 83 bp, Homo sapiens
  chr12:114883452-114883535
  hyper
ttgtttgaggatccccgcgccacataaatcctgcttcgagattaatctccctgctcgctcgcgctgggcgcagtgattttttt

SEQ ID NO: 34695 - DNA, 30 bp, Homo sapiens
  chr12:114883832-114883862
  hyper
tgtgccattgtgggtcggctgttgggttgt

SEQ ID NO: 34696 - DNA, 39 bp, Homo sapiens
  chr12:114885145-114885184
  hyper
ttggccagagcctggcgggttccgtgcttggctagccag

SEQ ID NO: 34697 - DNA, 15 bp, Homo sapiens
  chr12:114885371-114885386
  hyper
cgctggaagaaacga

SEQ ID NO: 34698 - DNA, 61 bp, Homo sapiens
  chr12:114885605-114885666
  hyper
ccgggtctccttctgcgggaacatacgccccagtcagctgaggtgccggctgactttcccc

SEQ ID NO: 34699 - DNA, 421 bp, Homo sapiens
  chr12:114917674-114918095
  hyper
tgactttggccacctcgcagtcttttagggtcgccggaccggcttcctggaatacctgaggtcgcagattcaggtagtaaacagatgtggggtccaccctccgccaaatgggcggggcaagttcaacatcccgcctccccgaccttaagtgcgcagggcgcctggtgctcgcttgccgaaaacgttaaacatttttctttgatcccgctctttttttggggggaaaaatgtctggggaagagggaagtagtgggggagtgaggtgcctgcccaagcgaaattttgatgcccgcctgcctctggctccagctccgccctcacggaagggggagaacttcgaattccagaaccggaatccttgcctaatttttttttttttttttttttgaaattgatcgattttatccgggagcttcaaatc

SEQ ID NO: 34700 - DNA, 130 bp, Homo sapiens
  chr12:114918587-114918717
  hyper
ggagaaggcaagatccggcaggcgacgctgattagctgggggtctccgatgcgaccccggactcggagcaggaaatcctgggtgctcctgaagctccgcctgccccgggttccagcgagagcacctcgtc

SEQ ID NO: 34701 - DNA, 38 bp, Homo sapiens; identical to SEQ ID NO: 11459
  chr12:115106464-115106502
  hyper

SEQ ID NO: 34702 - DNA, 130 bp, Homo sapiens
  chr12:115121885-115122015
  hyper
agagagagagagagacggagtcggagagggagggagcgagagaaagcgagagctcctcgccaccctccgccgcctctagaattcaccgggcgtctgctcggcggctctagaaggtcgggctgcgctgtgg

SEQ ID NO: 34703 - DNA, 40 bp, Homo sapiens
  chr12:115130675-115130715
  hyper
caggctcagagagaacgcagccgagcgggggaatcttcgt

SEQ ID NO: 34704 - DNA, 73 bp, Homo sapiens
  chr12:115889703-115889776
  hyper
gcccggggcgaggggcgagcggcgcgcggccgtgcggctcattctaccgccctgcgtgcgaaggggaggccgc

SEQ ID NO: 34705 - DNA, 105 bp, Homo sapiens
  chr12:116946095-116946200
  hyper
tctcagcggctccagcgttttcaaggagcggggtcaaggtcaaagggcccctcccaggctgcccgggcggggctgtagtgggatgctggtccccaggctgcgcct

SEQ ID NO: 34706 - DNA, 118 bp, Homo sapiens
  chr12:116946250-116946368
  hyper
cgccgccggagagggtcccagcgcgcccaggcctcccgcaggcgggacgcggcgtcggggggctgctgcgctgctcggccccagcgggcccgccgcgccgccgcggctctggctgcct

SEQ ID NO: 34707 - DNA, 291 bp, Homo sapiens
  chr12:117319805-117320096
  hyper
ctaaagtgcccccagcgcccggtgggaggctggatgggcccacctgagctcgcgtggggcgcggacggaggcattctcgctgcccggcacccgcacccaaaagaccctcgcaaggggctttctaaagggaaacttcttgtctgctttctttgtgaacattattttcctgatggcgttacagttttctgcgatgaccccgatttaatgcgcagtggagaccctaaggggtcggcgagaggaggggcgcgggggactttaattcccccttttccaatccgacagccactcctg

SEQ ID NO: 34708 - DNA, 321 bp, Homo sapiens
  chr12:117798084-117798405
  hyper
tggcgtcctctggggcgcagtcccgagagagccccttccgggacctcggacgcaaggcccctgagtggccctggaagttggatcccccggggaccctgctccgaaccctggccacctggaagcaacctcatcgagcgctccttccactgcccagccccgaaccgtggcggaacgcgcccctcggcctccctagagcctcctttgcgggagaagcacaactttcccaggttttggagacggcgctcttacaccccaatctcgcccagacggaagaagtgagaggtgcgggcggccccgccatgaccgcgggaggagagcgca

SEQ ID NO: 34709 - DNA, 193 bp, Homo sapiens
  chr12:117799086-117799279
  hyper
ggttgcacccactcgcctcctggtaggagccgcgcgcgtccctccccttcccctccgctttgtgcctccaagatccctccccaccccctctcccctagcccccactcctcccttctcttcttccctccccttgcgtcccctccctcagcctcagcgaacccaagttcgggacggaggctgcgggcttccccgg

SEQ ID NO: 34710 - DNA, 208 bp, Homo sapiens
  chr12:117799330-117799538
  hyper
cgctgctcgctgcccggccgcccctcggaggagccgcggcgctaagtagctcctcacccagcggctggaaacgcggcataaatatgtagggactgagccgtgagctcagcgagggtcgtgagggggaatttatttcttaatgtccctcctttatcctatcatcactgaaacgaattagcagtgacgtccaacccgactggtttatggg

SEQ ID NO: 34711 - DNA, 88 bp, Homo sapiens
  chr12:119212112-119212200
  hyper
cggggcgtttgaacacgaatttggaggtccttgtttgtccttgaacgcggcagggagtggaggaaggcgccgggaggaggcacaaaat

SEQ ID NO: 34712 - DNA, 88 bp, Homo sapiens
  chr12:119212318-119212406
  hyper
cgctgctgaaatgcaatggacaaaagggagaggaatggccgcatcttccggctgcccgttgctatggtttccgcggagctggtgaagg

SEQ ID NO: 34713 - DNA, 62 bp, Homo sapiens
  chr12:119417764-119417826
  hyper
ctgcagagcaagtagcgctctcaggcactcaaataagcggacgcaggcgtgtcgaacacaca

SEQ ID NO: 34714 - DNA, 808 bp, Homo sapiens
  chr12:119418516-119419324
  hyper
aaaagtggctgcaggcggattccccaggagtggatgggggtggggtggggtgagatgggaactctttcctctggacggggttggcggcggggacgctgggcaggccggctgtgagacacaaaagagatacccttgacagctccgcatgcacagatgtaacgctgcgccccttggcgggcgggggccctgctcggcagatggcgagaagccgaattggtgagggattgtctatcaaatggcactttctgggtggtggagacctcgctaacccccggcgcaaagaggaacgcagggcaccctctgtaccggcctaggccgtgtctcccaaaagtgagggtctgggggaggccggctggggtggatagattaagttttttacgagcccccccaaccccccccccccccccacgcagaagatcagctacaagacttgcgaaggggctggaaagaaaggtggcctggcccaaagggggcacccaggaaagggctgaggaaggccagcgatgatgggagaggagaggggcctgggaagcaggatctcctgcctggcgcagattggggtgccaggatggcttctcagagggatcagcgctgcaactcggtcgccgcggggccctggtgacaggcgcacgccccgccctttctcctcccaagacctgcgggcttttgttatgcagatggcggcaggaggctgagcctgaggaggagggggttggtggggaggaggagagacggagaggggggaggaaagtgcagctcgcgcgaccagcctcctcttccaacgtcacattgtgcgagagacaaaacc

SEQ ID NO: 34715 - DNA, 432 bp, Homo sapiens
  chr12:119419368-119419800
  hyper
cgtcgcctcttctctcctggtgctgcccagaaagccagccctcccttcccttcttggggcgcagaggctcagccagctcagagcgcagcctggagccgacccagaagggcgaagaaagcccagcggacgagcctcctttctctgctgcctgcccgggctggggcgtcccatcccccgccctgaactccgatctctcccaccccacccctctctgggtttcacccggacagagccgggagctgggtgtcgcccccgtttggaatccacgtttcagcactttggacagcgccccggacgccccggcccctttgggttggcgatggcgagcgttcagcaaggcgagaagcagctttttgagaagttctggcgaggaaccttcaaagcggtggccaccccccgtcccgagagcatcattgtcgccagtatcacggc

SEQ ID NO: 34716 - DNA, 30 bp, Homo sapiens
  chr12:119446620-119446650
  hyper
tgacactaattgatacggagtttccccctc

SEQ ID NO: 34717 - DNA, 91 bp, Homo sapiens
  chr12:119458719-119458810
  hyper
aaggagatgccttctcgcccgtagagggcgctgtagaggcagcgggaaagtgattcctagagacggtggggggaggcgctgtgttctgctg

SEQ ID NO: 34718 - DNA, 119 bp, Homo sapiens
  chr12:119499184-119499303
  hyper
tttcctagagcctgacggcggttcagcaccagggacagcgaccactgattaaataacaggctgcagtgaatccaaccatgaaagcactacctggctgttgcagccgtccttgcctattg

SEQ ID NO: 34719 - DNA, 30 bp, Homo sapiens
  chr12:120031836-120031866
  hyper
atggtgagtgaatcacggccagaggcagcc

SEQ ID NO: 34720 - DNA, 29 bp, Homo sapiens
  chr12:120032345-120032374
  hyper
cttctctctttgctgcgcccaagggcacc

SEQ ID NO: 34721 - DNA, 56 bp, Homo sapiens
  chr12:120032375-120032431
  hyper
cttccgccactctccggggggtccccaggcgattcctgatgccccctccttgatcc

SEQ ID NO: 34722 - DNA, 153 bp, Homo sapiens
  chr12:120032454-120032607
  hyper
cgctctgtccaggcaacagtttcctctcgcttcttcctacacccaacttcctctccttgcctccctccggcgccccctttttaacgcgcccgaggctggctcacacccactacctctttaggcctttcttaggctccccgtgtgcccccctca

SEQ ID NO: 34723 - DNA, 483 bp, Homo sapiens
  chr12:120032837-120033320
  hyper
ctctctaggagtggccgctggggcctctagtccgcccttccggagctcagctccctagccctcttcaaccctggtaggaacacccgagcgaaccccaccaggagggcgacgagcgcctgctaggccctcgccttattgactgcagcagctggcccgggggtggcggcggggtgaggttcgtaccggcactgtcccgggacaacccttgcagttgcgctccctcccccaccggctcacctcgcctgcagctgggccacggaactccccggccacagacgcagagccctgattcagcgctgtgaaaatcgctagccacccgtcccccatcaagtccgcccacacttgcccacgggtggtggcaccatattcgattcgtgggcacctgcaaggctccatttgcacccgtaacttgccctttcccaaacccggtttgtggacagcgtctgcaccgatatgaaagcgtgcagccgctgaagttcagac

SEQ ID NO: 34724 - DNA, 32 bp, Homo sapiens
  chr12:120807600-120807632
  hyper
acccactcagtgcctcgcgtcccgagtgggga

SEQ ID NO: 34725 - DNA, 193 bp, Homo sapiens
  chr12:120807844-120808037
  hyper
ctctccctccctggccggtttttgtgagatccattcagactcctgtcctgattcgggaaacccggttccagacactcaccacccccaccacaccgaggctggaggaaaaggcagtgcctcttagagcctcctgtttccagtttaggagcccaacgcctcagctgtgcaccgtcccctccgaatgacccccttc

SEQ ID NO: 34726 - DNA, 30 bp, Homo sapiens
  chr12:120826930-120826960
  hyper
gcggccctgggaacccgggaaggaggcgag

SEQ ID NO: 34727 - DNA, 191 bp, Homo sapiens
  chr12:121566850-121567041
  hyper
gaggttggcccttgacgccctgtgtgattatggccccgcccacagccatagctgattggaccagggataaagaattaggccaatcagattcattccccttgagttctggaactgggcaggggatctgggcttgcatttgaactgtggaacctaacttggagagcattgctgaaccacgtgccctgggagaa

SEQ ID NO: 34728 - DNA, 36 bp, Homo sapiens
  chr12:122667836-122667872
  hyper
gctgggtgcgggcgccggggccggaactctgggggc

SEQ ID NO: 34729 - DNA, 527 bp, Homo sapiens
  chr12:122688648-122689175
  hyper
cggcccgggggtccccgcagagtgggtctctgctgccgtcagcccttcggagactgtcgcgttgaaagaatgaaccagagttcgccccctgcccgcgccagggcgttttgggtcaccgagtcctgtggggatccgaggcggctgccgcccaaggccgagcgcagcctcaggacccgcgccccaccagacggggtcgtgcgctccgcggcgggtggagagccgggctctggggtctccgcggctcggagggcggcggggcgaggccgtgcggccagcgcctggggacgcccgcggcgggacaggggccacccgggccgcggcgcagcctgggctgaaacctcctgggacggaaccaagccacctgctgtgcgcccttctcggtgaatggcaccgccgcccgcccgggcctctcgtccacagcccgcggtgctcgcacacctgagactcatctcgcttcgaccccgccgccgccgccgcccggcatcctgagcacggagacagtctccagctgccgttcatgcttcctc

SEQ ID NO: 34730 - DNA, 156 bp, Homo sapiens
  chr12:123920515-123920671
  hyper
aagaaaaaagagaaaagagaagagaaaagaaaaggaaggcgtctccctgccagtaggtgccctcctacgccccgcaggcgccgtgggcccggaaccctcgctcccacactcacctccccgctggccggagggctctgtctccgcagcccctccacc

SEQ ID NO: 34731 - DNA, 42 bp, Homo sapiens
  chr12:124779516-124779558
  hyper
ggagcgggagggcctcggcggaggcgccgggccggggctgtt

SEQ ID NO: 34732 - DNA, 416 bp, Homo sapiens
  chr12:125534006-125534422
  hyper
accctcctttggcagcgcagaagtcaagctagaggtcgtgaccccctggagtctcggtggtttcgggttggggagcagagcgggtggggcaggaccgactcgccggtgccagtcaggatatcaaggtgacagcgcccggcactggccttggtcgaagggtgactccgccccattgctaagctccgattgggcacgcccttttctggttcttcttcaggattggctgggaggtgcggcctatgaaccggaacgcgtcgcgattggttggcgctcaggccgatcttccagacgcggaggcctgggccgatgtggcccaactctctgccagccaatcagcgctcgggctgagtgtggcgcgtgagtgtgtccgggatccctccgccgcccgggcgttggggtcgcgggaagggagggga

SEQ ID NO: 34733 - DNA, 159 bp, Homo sapiens
  chr12:125670102-125670261
  hyper
ctggatggaagaattcgaccacctagtacccggccctgcgcaacacctccgctccgtcactgcctgaccctgcgctgggaactcattcccgggaccgccagggaatctgcccttcccaggagaactcctggctgcctccgcgtgctcctagggcctgcg

SEQ ID NO: 34734 - DNA, 111 bp, Homo sapiens
  chr12:125670334-125670445
  hyper
cgccttcgctgtgtttcaggtcaccgcacccagcctgcgcacccctagcccccatcccggtgccgtgcagaggctctgcacacagcctcggcctcccggaggccctcccct

SEQ ID NO: 34735 - DNA, 369 bp, Homo sapiens
  chr12:125671544-125671913
  hyper
gaacccaggagcccccggcgcgttcccctttgcctagcgcctggggagagcccgcctgccttctcccccaaacccttagcttccttgcggatcctttcgggacgcacgggggccacagaccggggcactcagcctctcgaggcgggtggggacgcgactgcaggaatcgagccccctccccgccctgccttgggccaaatcccccccaggtcccagttcctccaggggttttgctgggcgggggcgtcgacgcagcccttctccagtgtcttgctgcccgcggtcgcacagtggtgcgttcccgggacacctgcgggccccggagatgtctcggccggcgctgtctggcttgtccgcagcccctcccca

SEQ ID NO: 34736 - DNA, 268 bp, Homo sapiens
  chr12:125672764-125673032
  hyper
tggcattgggcttaacgtggatgaatcttgcctgcttggctaaggagcagctatgatagctgttttgctttcggcattcctctgcggtccacgagaggggctgctgctggggccgaggctgttttctcttagctgaagccctgggacctgtttgcaaaagtgcagtccctcggacttgaaaattgcagttttgtctctattttgtttctccacgggggtcagcatttgcctggatgtgcttataagtgaatatcggaagtctctcaga

SEQ ID NO: 34737 - DNA, 244 bp, Homo sapiens
  chr12:126168427-126168671
  hyper
gcacaggtggccccgcgcctctcacacaggttcagctcccgccggtccctgtgcagagcgccccctgccggtccctcttggaggctgggccagcgttgcgagtcttgccagggacgcgcgctctagcgccggaggctgggaacgcaccgcggtgccaccgcgtcctgcaggggcggggcgcgcacctggggatgcacctgtcctagaccccctgcgcctattcctcgcccgccccatccttccc

SEQ ID NO: 34738 - DNA, 267 bp, Homo sapiens
  chr12:126675639-126675906
  hyper
aactctccagagctgcgccgcagacggcgaaaaccagaggtggttacagtcaagtttagggactgcaggagcgaattcccgaaggcttgcaggagccgcccggctctgcctccagcctttctctctgggcctagcgggactctcccaggcaggcccctccctgcccgcgggcgcactttccccgcctgcatctgaggcgtggcgcagctgggagcaaagcacaggtgggctgggcgcggtttggggttcgggcgtggcagagtggcg

SEQ ID NO: 34739 - DNA, 62 bp, Homo sapiens
  chr12:127211316-127211378
  hyper
cgggcagtggcgggagctggagccgcggtggagacgactcgaggggacgcagcccgcctggc

SEQ ID NO: 34740 - DNA, 30 bp, Homo sapiens; identical to SEQ ID NO: 11481
  chr12:127212512-127212542
  hyper

SEQ ID NO: 34741 - DNA, 291 bp, Homo sapiens
  chr12:127765158-127765449
  hyper
ccctgctgagttctacgtgcttgcgcgcttcttcctcgggagagcttccactgatttaattggatatggggatggagagaggaaacagaaacagggaaagaagtgaaaaagggaaggacggggcgcgcgcggcaggggggcaggcggcctggtgcaggtgcatccccaggtgcgcgccacgcccctgcgggacccggcggcaccgcggtgcgttcccagccgccggcgctagagggcgtgtctgcggaaagactcgctgcgctggcccaggctccacgaggggccgacagg

SEQ ID NO: 34742 - DNA, 127 bp, Homo sapiens; identical to SEQ ID NO: 11483
  chr12:127865735-127865862
  hyper

SEQ ID NO: 34743 - DNA, 310 bp, Homo sapiens
  chr12:128751133-128751443
  hyper
cgcaccccgccttcacgctccgctgcgcgctgcttttccgcgctcagtgatccagttaggagctctccccgcagcagctgcgcgggactttgcattccagatgtccccagccctccaggctaaagcagcggccacctgaagttgaggaatggggcgtgacgaccaccaggtcccgcagtgaccacgggagggtggggagaaggagtccagctccgccttgagcgtcgggtccctgggcaggaccctccgggccacgggccgctgtccgttgggcacccgggcaggagtctgcgaacgctgagtttctctg

SEQ ID NO: 34744 - DNA, 184 bp, Homo sapiens
  chr12:128751694-128751878
  hyper
aggctgcggaggctgcgggagaaaagttgtcccggccggagcgcgagcagcggcggagccggagccgccagagccagagccggagctgcggcggcgtggacccggcaggggcgggcctcggacagcagagacgcagcgggcccggccgaccgggctgcgggagtggccccgggcatggggcggc

SEQ ID NO: 34745 - DNA, 153 bp, Homo sapiens; identical to SEQ ID NO: 3963
  chr12:128752114-128752267
  hyper

SEQ ID NO: 34746 - DNA, 741 bp, Homo sapiens
  chr12:128752499-128753240
  hyper
ccaggagggaaggcccggttctttgcatcccctttccgcaaccgctagggtctctgtgcgggccctagaggaacgctcactcatcgcgcagctcaccagggaccccagcttggcagaaaccaggggctctctgcgggttctctcaaatgagtcctttgcggtgggggagcgcggatggggaggtgggtgcgtccctcgcgacgggaactacctcaccagcggtcctgtccggggctccttcacctcagtgtcctcttctctacaatgggagtgacggccctgctttgggttggaggaatttaaaggagttaacgtatggcgcccgcagggctcacgaaaggtagccgtgtggtttttccgaccttttttattatgtgcgtgtgcggccgagtggccgcgcggatgcggcggcgggaagggcggggagaggcggtctccagccccaggagccgcggggcaggcggggagcaaggcctaggctctgccagggcagcagctgcccgagtcccggggcgcgcccagggcgtagaaaaaggagagcgtcgctttcctgctccccgcgccctggcgaaggtctcgggttcatttggttaaacggaggtgcgcacatgggtgccctgagccttcgcgcggcgccgcgggtccagtatcggccccaggctctgagcagagaacactcaaagccacccttctcccgcctaatgctctgaggctgagctagaaatgcgttcagagagacaa

SEQ ID NO: 34747 - DNA, 84 bp, Homo sapiens
  chr12:129337826-129337910
  hyper
agggactgtggtcaccgctggtcctggtccaggtggaaacagaccgcggctaccctggtgatggaccccacggggcacacccgc

SEQ ID NO: 34748 - DNA, 239 bp, Homo sapiens; identical to SEQ ID NO: 1076
  chr12:129338587-129338826
  hyper

SEQ ID NO: 34749 - DNA, 79 bp, Homo sapiens
  chr12:129338851-129338930
  hyper
cgctcggcctgtattagccggataaacatattccttgaggcgaagcctgggaagtgccaggattagagcctgcagctta

SEQ ID NO: 34750 - DNA, 30 bp, Homo sapiens
  chr12:130387483-130387513
  hyper
tctcaagggtccccacgccctctcccttta

SEQ ID NO: 34751 - DNA, 129 bp, Homo sapiens
  chr12:130387796-130387925
  hyper
cgtcctcacctttggaaaacagggcggccaggctgatgagtaccggcgaccagtggtgccacagcgtccccatctcagacgggcacatcctggagacccggagcgcagatcctccgctccccggcgccg

SEQ ID NO: 34752 - DNA, 156 bp, Homo sapiens; identical to SEQ ID NO: 3967
  chr12:130388279-130388435
  hyper

SEQ ID NO: 34753 - DNA, 140 bp, Homo sapiens; identical to SEQ ID NO: 3968
  chr12:130389012-130389152
  hyper

SEQ ID NO: 34754 - DNA, 30 bp, Homo sapiens
  chr12:130498725-130498755
  hyper
ctgtgctcaagacctcgtccatccctccat

SEQ ID NO: 34755 - DNA, 42 bp, Homo sapiens; identical to SEQ ID NO: 11494
  chr12:130526846-130526888
  hyper

SEQ ID NO: 34756 - DNA, 164 bp, Homo sapiens
  chr12:130526931-130527095
  hyper
cggcagcttgcagggcccgctgtctccactagggggcggcgtacgcgcgtctctcgaagccgggacccgcgcggggaggctgcactggctggaaacagcgcctgggcgctcccgcggctcccacctcagagatgtccccaggtgccccacgccccccgcgcgag

SEQ ID NO: 34757 - DNA, 107 bp, Homo sapiens
  chr12:130589202-130589309
  hyper
gagaggaaaatgactcggaaaccctgttgtgagaagcacgttgctatcccggatgaagggccatttcagccctaagctcaaagccggagctccgaccagcactctca

SEQ ID NO: 34758 - DNA, 564 bp, Homo sapiens
  chr12:130645186-130645750
  hyper
ccccaagtttcttaccgatgtaaaaattgtagggcttgttttaattaaaagccaatactctccgaggaagtggccccctcctgcacggcgtgcagaaagctggtcagtgaggggggttcctggcgggccccatctccttcccgggcgcttcctagggagaccttgccccgtgcgcagcgtccccaccgcgggggcccgtgcagccgccccccacgccgggtggagcgccgccaacgcgggaagccccagcactgcctccaaagatgtccgcacactccaccctgctccctggaactatcctcaaacgggcagggggcaagcgaggccggtggacgcgggactcgctcctctgacctctccccggccccccgggaggtagcgggagattgcacacgcgatcctgcgagtttccgaactttggaagatcgtgacccggagagaccctgggaggagagggccggccacctcctaggggtgctgtttttttaagggtcaacccaggacgctacgggaagcacctggcgcatccttgggaacagtggggcttggcggtgggcgcccacc

SEQ ID NO: 34759 - DNA, 235 bp, Homo sapiens
  chr12:130646084-130646319
  hyper
ataaataaactcagccgccaagaaggcatctccagccctgctggcgcgaggccccggctctgcggcttcggagggggcgggggtcaccgcggtacaaaccaagcccgcacttcccgcggggtgggaggcggtgttcaaagtcccgggacgcttcccgcccctcccccttcccgccttcttagaggagacctcggatgagcggccctaaaatccggattctcgagcccctccccct

SEQ ID NO: 34760 - DNA, 89 bp, Homo sapiens
  chr12:130646565-130646654
  hyper
tctcccgccagtccccgaacttcccgtaacctcggcgtcctcggggtgccggggaccatcccggggaccgccgggaaagggggcgccgg

SEQ ID NO: 34761 - DNA, 128 bp, Homo sapiens
  chr12:130646945-130647073
  hyper
gcggcccgggggcggggcctgtcagcgctcggcttttctgcccccctttgcctttttgcgagtcttctcatcccgggacgcaaacctcgaaacagctgccggctggtcccggccgaggccggcgcagg

SEQ ID NO: 34762 - DNA, 172 bp, Homo sapiens
  chr12:130647737-130647909
  hyper
gcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaa

SEQ ID NO: 34763 - DNA, 120 bp, Homo sapiens; identical to SEQ ID NO: 1078
  chr12:130647950-130648070
  hyper

SEQ ID NO: 34764 - DNA, 48 bp, Homo sapiens
  chr12:131199494-131199542
  hyper
gttccccttagaaaccgggtgagtgagcctgcacgccagctcccctcc

SEQ ID NO: 34765 - DNA, 49 bp, Homo sapiens
  chr12:131199887-131199936
  hyper
agtcctccctccctccggccagccgccaccccgacctcagccagcgtgc

SEQ ID NO: 34766 - DNA, 47 bp, Homo sapiens
  chr12:131199937-131199984
  hyper
ctccccggggacaggagggaggctgcttccaccgaggcctctgctga

SEQ ID NO: 34767 - DNA, 169 bp, Homo sapiens
  chr12:131200355-131200524
  hyper
ctgagaagcctggggcgcactccccaggcgagcggggccgtgtccatcgggtgccaaactttgcctggaggggcctttcttaaaagcctggggtgggggccatgacagagccacagcacccctgcagctgacacccggcacccaggaagaagcccgtcagcccttccct

SEQ ID NO: 34768 - DNA, 78 bp, Homo sapiens
  chr12:131400841-131400919
  hyper
gccgcctctcagaatcgctgtgcaattggcgattgcgacattcatggaataaattccccttcgcgacacatggggacg

SEQ ID NO: 34769 - DNA, 150 bp, Homo sapiens
  chr12:132312680-132312830
  hyper
tcagggtcagctccccgcaggcgccccgacccccgcctccgcgcccatcccgcgcgtccccgccgccccaagagcgtcctaagacacccggggaaacgccttccctgtgatgccgcggacccagtcccgtcgcggacacggcggggcggg

SEQ ID NO: 34770 - DNA, 730 bp, Homo sapiens
  chr12:132312856-132313586
  hyper
cgggccctttaaggcggccggcctcgttagcatacatttgcatggccccgccccgccgcttgaggctgccgcgcggggctcagtccggcgggggcgccgcggagagcggagggcgccgggctgcggaacgcgaagcggagggcgcgggaccctgcacgccgcccgcgggcccatgtgagcgccatgcggcgccgcgcagcccggggacccggcccgccgcccccagggcccggactctcgcggctgccgctgccgctgctgctgctgctggcgctggggacccgcgggggctgcgccgcgcccgcacccgcgccgcgcgccgaggacctcagcctgggagtggtgagcgcgcgggcgggacgggcgcggagctcctgggccggagccgggggtctccgcgggccgggtggcggggaccgggaagaccccagcagtgcacgtcggcgtcgcgcgggagccctggcgccctggacccatttcctgggtggggagactgaggcagggacgcgggctgagcgaccgggcgagcgcacgcgagtcctggggaggcgccggctgccgtcccggctccgtgcgctgggagcgcgccgcagccgcaggagcccgtggagttgtgagggggtcgcccacccggagcccgggtcgccggcttgcagcagccccggagcagccgggctgggcgagagcaggcatcgcggccgccccgagctctgcgcgctgcgtgcgttcc

SEQ ID NO: 34771 - DNA, 30 bp, Homo sapiens
  chr12:132314800-132314830
  hyper
ctcggctggtacctgcgcctcggtctctcc

SEQ ID NO: 34772 - DNA, 30 bp, Homo sapiens
  chr12:132315470-132315500
  hyper
tctgtgttttgagtacgacatacagcgagc

SEQ ID NO: 34773 - DNA, 30 bp, Homo sapiens
  chr12:133174537-133174567
  hyper
cgcctcctctccgcgcgcccctcctctccg

SEQ ID NO: 34774 - DNA, 122 bp, Homo sapiens
  chr12:133194939-133195061
  hyper
gtctgctggcaaaggcgggagtgcaggttgcgctcgaagccccggcagccgcggcaggaaccggcctggacggggtggggggcgccgcggaggccggcgggacttcccatgtctttctcctc

SEQ ID NO: 34775 - DNA, 167 bp, Homo sapiens
  chr12:133195062-133195229
  hyper
agctcggaaaaagttcccacccggggaatcccgaccctccaacttcgagaccgccggttccgcgctcggcccccacctggaccaagagctggggctgggctgccgcgcccccggctctgtccccgcgaggccccgctcccagccccacctgggacacccgggactcc

SEQ ID NO: 34776 - DNA, 140 bp, Homo sapiens
  chr12:133195488-133195628
  hyper
gacgcccaaggtgatcgtggtgaggaaccggcgcctgggggtcctgtaccgcgccgtgcagctgctcatcctgctctacttcgtgtggtgcgcggggcgcggggtgcggggcgcggggtgcggggcgcaggggaggggct

SEQ ID NO: 34777 - DNA, 356 bp, Homo sapiens
  chr12:133463573-133463929
  hyper
cttatacagttgtaacgaaggctaaatgatgtgcgtgaatcatgcgcaagaatcggtgggcagaacaccgaataaataccagttcttacatgacatttcactccacggaaaaatctggagcgcacactgcaccgccgcccgtgtggcctgcccgcaacccggtggctctgcccggccccggcccccggccccggcctcagccccgcacctcgtctccgcccgatggtccactcccgcttcctcaggaggacgtgcggctcgccctcctccgcgcccagacgcaggagccgtccccagggctgcggcggcggcgactgcttgccttcctcgggccgctccatcgggattcacatctg

SEQ ID NO: 34778 - DNA, 127 bp, Homo sapiens
  chr12:133464414-133464541
  hyper
gggacggggaacttccggattggaagccccaaggattctgagagccccgctaatctggggatgactcctaggagtagaagacggtccatcttagttgtcacgaggtagtgcacgtggggaccctttc

SEQ ID NO: 34779 - DNA, 30 bp, Homo sapiens
  chr12:133464773-133464803
  hyper
ctgaaagtgaaaggtcggcgaaagaggagt

SEQ ID NO: 34780 - DNA, 15 bp, Homo sapiens
  chr12:133481368-133481383
  hyper
gaagcttttcctcac

SEQ ID NO: 34781 - DNA, 31 bp, Homo sapiens; identical to SEQ ID NO: 1080
  chr12:133481489-133481520
  hyper

SEQ ID NO: 34782 - DNA, 134 bp, Homo sapiens; identical to SEQ ID NO: 1081
  chr12:133481521-133481655
  hyper

SEQ ID NO: 34783 - DNA, 257 bp, Homo sapiens
  chr12:133484596-133484853
  hyper
cagacgtttttctctaggtaaagccgcgggatgaaccagcccctgtggaaatttagaagtaacgacgtccgtcaatttctgtatgaaaaatatacagatcgtgtgacacgtcttctgggaatgaaagtctgctaaactcgccgtcacgagtagatgaacacatttaaagtttgtagttaagaggaaaacaacgccaacgacacaaatgccccaagcgctggatgaagcagcgacctaggatggggctggcctggaac

SEQ ID NO: 34784 - DNA, 187 bp, Homo sapiens; identical to SEQ ID NO: 1082
  chr12:133485161-133485348
  hyper

SEQ ID NO: 34785 - DNA, 251 bp, Homo sapiens; identical to SEQ ID NO: 1083
  chr12:133485439-133485690
  hyper

SEQ ID NO: 34786 - DNA, 15 bp, Homo sapiens
  chr12:133485815-133485830
  hyper
cgtcatctggggtct

SEQ ID NO: 34787 - DNA, 30 bp, Homo sapiens
  chr13:20692885-20692915
  hyper
cagctgagctggtctcggtctcccagctcc

SEQ ID NO: 34788 - DNA, 101 bp, Homo sapiens
  chr13:20734542-20734643
  hyper
gcgatgctgaatgcccgtggacggctgggtgcgcgccgttagctggcgcggtgacatctgcttagagttttcaagcatttcagcatcgctaggagccctac

SEQ ID NO: 34789 - DNA, 94 bp, Homo sapiens
  chr13:20735438-20735532
  hyper
cttccctgccgcctacgcactccggggcatgcccgcgcgggacgtgagaggagagccgagggctgttggggcgggcccgacccgcttgcggggc

SEQ ID NO: 34790 - DNA, 534 bp, Homo sapiens
  chr13:20735533-20736067
  hyper
cccaccgcacgcagatgcgccagcccgcgccccgctcgcgcctgtcctgggcttcgcaggcccggcgaggtagctgctctccgggcgctcccacggtcggaggcgcgtgggcgtcgggcacctaggtctcgcccgcctgcagccgcctggggacgcgggttccggacggctggcgcggggcggggcggggaccaccgagcaggaagtccccgcggaagcgccgccgggcacagcgtgggtgctgtcgaggagtggcgcccgggcggggcgggaggttataaatagcggccgccatcctgcttctcttcagacacacttaatttagccggcaggcacacggatgcttatttttaaaaaaagaacttgttttattgcgctcgaggtgaccgggaaggtgtccccgcgggtcactcgctccatctggtcctggagacgagatgccagggcgaggcctaacctgcctgctggcgcccaacgaagattttaacgttttctgttcccttcggggtggttttaccacgcttgagagggacg

SEQ ID NO: 34791 - DNA, 62 bp, Homo sapiens
  chr13:20766251-20766313
  hyper
cacaccacctcttcgcgaacaagggtcctaaaaattttccttctaggcggggagcacagccc

SEQ ID NO: 34792 - DNA, 534 bp, Homo sapiens
  chr13:20805970-20806504
  hyper
agtcaaaggggaccacgctggggtaaaagtcaaaccagtccatcctcgttcctctgcgtacagagagagggtccagcgcgggcggcgcccactgccatcgggccggggccggggcgcgtggacaggagggtgcggatagaggcagatcgggggcccggtcgccccacgtgcggccagacacccatcccggccgcgctctgccggctctgatccggtgccagacaggagcgacaggggcgaggtggggaccagccgccgacctcacctgttttgttttcttggaggaaattcctccgctggggggccgaggtggcaccgcccgctcgccccccgcaagacccagccggtccgcgcccgcttacctgctctgcggccggcggccctggcgcgggctctgcgcggggcggcgcccttcgctccggctgggcaggcaggtcgggctcgggcgccgccggctgtcgggctctcgtcgggtttcgggtgaaggccccggctcccacctgctgcgccttttaaccgcgccccaccccgcct

SEQ ID NO: 34793 - DNA, 45 bp, Homo sapiens
  chr13:21520313-21520358
  hyper
agggtgtgaagagatcgggagtcctctgcgaggctctggagcacc

SEQ ID NO: 34794 - DNA, 30 bp, Homo sapiens
  chr13:21634461-21634491
  hyper
ggctggggagctaagcgcaggtgagcttac

SEQ ID NO: 34795 - DNA, 154 bp, Homo sapiens
  chr13:21634799-21634953
  hyper
aggcggcgcagccaccgggggctgaggggcggcgcggcctcgactgcggcaccgccgtgggtccgtcggctcgcgggacgacggggcggccggcgggggccaacagggcgggctctgaaggactgattggcccgtgggacgatggcgcggccgg

SEQ ID NO: 34796 - DNA, 419 bp, Homo sapiens; identical to SEQ ID NO: 11520
  chr13:21649623-21650042
  hyper

SEQ ID NO: 34797 - DNA, 591 bp, Homo sapiens
  chr13:22243273-22243864
  hyper
caactggtcgaggaacgcccctgctgtacccatcactgctggctgcctcggagattaatgcgagcgactcgggtggtttatgagaagtgacacttaatacccagcttcttgtatctgccgccgagcagttaacgttaaagcccgctctgtaccaccgcggatgtgactgctgtaaataccacggggcagggctctcatgcttcagaaacacgtaagcaagacgcaccgagccagccccggacacccaatgaccctggactgcggcaaagggggggtgggaaaggaagaggggaggaccactcgctcttctctccttcctcctcgcccgggccggagcacgccttcctccccggagggcaggggaaggtcgctccaggtcgctggcacctccagcgcccccgaaatctgcaaattcatcgctccctttcgtcttcaggcgaagccctcccgtccggagtagggccagccccagttatgcatctccagcctttagctgactactaaggcggatccgacttctcccccataaccaggttttgattcgcttccccaccgcaggggttcagtctctgctttcgactttgcttctca

SEQ ID NO: 34798 - DNA, 69 bp, Homo sapiens
  chr13:22247111-22247180
  hyper
gatttcatttttcagcggagggtatttgtgactcagcactgagggctgcagactcgagggctggtggct

SEQ ID NO: 34799 - DNA, 279 bp, Homo sapiens
  chr13:23489692-23489971
  hyper
gcggagcgatgcccgcgccggcgcaggggcggataaaaagccgtagcgccacgggagtgggcgggagggagagggggtacccgagggccacaagagtatgacggggctgtaagagctggtgtggcgggtgctgcccccctgctctgtctgcaccgcaagctcacctcctggctccgcgttcggttcggcacttggaactggatctggcgactgtgccggcgcgccgcctctgccgcggtcctagcgccgctcggcttcacgctccgcaagtcccaggcg

SEQ ID NO: 34800 - DNA, 851 bp, Homo sapiens
  chr13:23733447-23734298
  hyper
cactatttcccagctcgcctccaagagctaactaaagtgcagcataaactgcatgcagcattgttttcaccacagcaaacccttcggggtgcctcctagcggcggatggagaactagcattgcgcgagagtgagtaaactgtgataaacccaaggggtttgcgggggacaggctgggtggcaagacttttaaaggctcgcaaatggaaccactccctccagagggactatctaaatctcctcaggtgctgaccctttctgacagtaaaggacgagggccagaagtgtaaagattgtggtcccgcgctccaagcccaagatgcgttcagcaggagtagttgggttggaaagaaggcacccagcgtctgcagcgaaggactcgcgtgggagcgagaaatgtccctgcccagtgccccgcgcgctggatcgcgggggcgagtctgagggtggagaggccgccgggtggaggcgcgcaggggtgcgtgggtgggtgcggaaggagtgcagggtatggaggggaatcttggggcggcgcgaaggaggagcgcttggaaaggcgcggtgtttggtcacagaggggctcggagtgggagtgcaggggtgcggggagggagtgcagggacgcggggagggagtggaggggtggggacgtgctggaggggcgcgcctcgatagaactggagaaactggaaaagtggaggggcggggcagtggctggaggaacctctgaagcgacgcggggaatatgtgaaggagtgctatgttggaacttggaggggaggggggatgctggagaggcacacggtgatggacatggaaggacccgggaggtgtggagtggtgggcccggcc

SEQ ID NO: 34801 - DNA, 30 bp, Homo sapiens
  chr13:24007814-24007844
  hyper
ccagcgtgactgtcccgcagccgcactggg

SEQ ID NO: 34802 - DNA, 209 bp, Homo sapiens
  chr13:24040780-24040989
  hyper
gcctagaagtggccccgaagccgtgcctttcccgatagccaagcagaagtaggacttgaagcaccgaggctgggatgcccatgctggtgacgccttggggctcgcagttatacttggtgaccggtctacacggcgattcggtgctttccggagtagcagattcatctatctttagacccaccttcgtccttcggcggtttagcacggcc

SEQ ID NO: 34803 - DNA, 30 bp, Homo sapiens
  chr13:24153182-24153212
  hyper
tggggaacaccccggcggaaaggaaccctc

SEQ ID NO: 34804 - DNA, 178 bp, Homo sapiens
  chr13:24153573-24153751
  hyper
caaccccgcgccctgcgccttaaccaggactgctccgcgcgcccctgagcctcgggctccggcccggacctgcagcctcccaggtggctgggaaggtaggtgcgtcgctgtccccggcgcgcggcgtcccgcgaggtcttcagccctcgccctggtggatccccgctgggtgggagcc

SEQ ID NO: 34805 - DNA, 70 bp, Homo sapiens
  chr13:24154053-24154123
  hyper
ggtcccctgagccagcgcgcggctgcaggggtctcggggccgcatcccggaccagcgccagcggcgggag

SEQ ID NO: 34806 - DNA, 427 bp, Homo sapiens
  chr13:24477590-24478017
  hyper
tgccgaggtcccaggcgggcggcaggatccaattagtccgtgtaaaatgagaggcatctggcttctcccgggcaccccgcagcctgccccgcctcttagtggctaaaggcagggagcccctgagtcccagcgcggctgggggctctcagcagttctggccgagctccctcccgcccgcgtcgcctggcctcgaaccgctgcaccgcgggcggccccgacgggttcccgacctcccgctggggacacctgtcccgccgcccggcccttccccgcctcccgcgcctccgccccaggggagctccgggacaggcccacctaggcagcctgccggcgcagacccagcgagggaaggccagtctcgggcctccaaccggacacgcgctccccattccgggctctcccacgtctgcacactccagcccagcca

SEQ ID NO: 34807 - DNA, 243 bp, Homo sapiens
  chr13:25254954-25255197
  hyper
caggctgacgggaagcgaggaaaaggcgaagaggagaaacgccccgtcccggggcaaggggaggccgcctttcctctgagcgccccccggcctgggcaccgcttctctgactccccgccacggctccgtgcggccgccggggctggctggggaaagaagccagtccagaggagcgagaaggggccaaggggtcctaggccagctccatggcacctgcgggctccgactcggaggatggggtga

SEQ ID NO: 34808 - DNA, 75 bp, Homo sapiens; identical to SEQ ID NO: 1085
  chr13:25319830-25319905
  hyper

SEQ ID NO: 34809 - DNA, 1 bp, Homo sapiens
  chr13:25320108-25320109
  hyper
c

SEQ ID NO: 34810 - DNA, 153 bp, Homo sapiens
  chr13:25320387-25320540
  hyper
cgcagctcctgatgccaagttcacttggaccccggctgagattagagaggcctggcgaggtgtgggggtgcgcagggagaatgggctgtggtcgccatggtgcgtgttggtcttgtggagatggatgctcctccgggtcaatctctgccttct

SEQ ID NO: 34811 - DNA, 416 bp, Homo sapiens
  chr13:25320613-25321029
  hyper
cgcgttctccttgaggggccggcgggcgttggcgaaggtggtggggactgtcgtgaggatcatcatgggcagggaagggcgcgcggcagtggcctcgagccctgggtcttctccttcctgaatttgcaaagccaggcgaaggccctcgtgctctcccagagagctgcgctccacccgcgggcctgcctgcgcgtggggagagcggggaggcggggacaggagacctgagcccctgggcgcccctaccacgtgtcccccgtcccaacactggacctcttcagattccttgccgagaggggcctcgtcccaaggctggatgcgccgcgcagcggtgaaagccgccctcgcagcccgcaggcgaccagtgggtgctgttggctttcgccccggggagggaacgggcttgggggcactgg

SEQ ID NO: 34812 - DNA, 1082 bp, Homo sapiens
  chr13:25321112-25322194
  hyper
cgagctgaggagaccggagtttttccccaggagggagccgcgcaggccggcgacctcttcccaaggctctactgctggaccgcgcccgcggcgccgctcccgccccccttcagcgcactctgcgcctctcgctgggtatggccagctcgcagtgcgcgtttatgctgcggtaaacgcattgaaggaacgcacagcttatctaatagggttttgaaataattttcggtatgccagctggggtgtggtttgcccaattctgatcctgtttccagagaacacagctgcttagacaatctgttatcttcgcgtcctgtcttccttttgacgccagaacatcctagggatcaggggcctctcccatgccctggaaccatcctctcacggtgctgctcttcactggtgccaataacagagctcccgcaggcaggcctggatcagtggggactggggccctgaagtgagatggagcaagacagagcggcccttgggagaggggcatggggcggccctgtgctttagactcggcaccctatggcttgaggaggtgacactgtgtcgacgtgcgtttgaagggaggacggctgaaggtacatgcagtctcccggacgtcacaaactccgcggacgcgggtcacacccgcgcgcacgcgcagcaggggtcttagccacacaggcgcacggcggggcacggcggggcacgggccctgctgcaaacgggcgcgctcccttctgggcaagcaggtgcgaggcgcgcgccatggaacagcccttagctgagtttcggtttgcgcgcaaacggccggcctggccgcccaacgcagcatttccagccagggcgcacaaacctcgggagagaaggtggaagccgcaggggctctaaaggcagccccaggttggctaaagcggttcctggtacggacaccaaggcccccgtgctcgggccctacccagcctggttcaggtgagaggaggcaagcctcggcccggtaccggcgtcggaaccacagtcgggcctggccctgctgccggggcggggctgctggacttccctcccgctccgggctggacctgacatctgtctct

SEQ ID NO: 34813 - DNA, 72 bp, Homo sapiens
  chr13:25592968-25593040
  hyper
gctgctcctgacccgcgcccagagagcaggacctggcgcttggcactgtgcagccacggggatgaggctgag

SEQ ID NO: 34814 - DNA, 15 bp, Homo sapiens
  chr13:25593061-25593076
  hyper
cgccactggggccac

SEQ ID NO: 34815 - DNA, 55 bp, Homo sapiens
  chr13:25620899-25620954
  hyper
attgagaaagagacccgggtccagtgaagcatcagacacgctggcgcatggggac

SEQ ID NO: 34816 - DNA, 95 bp, Homo sapiens
  chr13:25620955-25621050
  hyper
aggagccctggagactcagggcccgtctggtgcggcccgggctttgctccgcgctcgccccctgcagctgccggggccgccgcaacttttcaaac

SEQ ID NO: 34817 - DNA, 69 bp, Homo sapiens
  chr13:25621342-25621411
  hyper
ggaaactgtcctgggcgcgcaccgcccccgtgccctgcgccctcctcatttgctcggccagcgcgggac

SEQ ID NO: 34818 - DNA, 98 bp, Homo sapiens
  chr13:25744637-25744735
  hyper
ttttcagtgaagtcacgtcagaaaacatcaaacaaatacgatctgccgacgggtctgagggtggatcgacagaggcagggtctggggcggcgggcgcc

SEQ ID NO: 34819 - DNA, 295 bp, Homo sapiens; identical to SEQ ID NO: 1089
  chr13:25745300-25745595
  hyper

SEQ ID NO: 34820 - DNA, 221 bp, Homo sapiens; identical to SEQ ID NO: 1090
  chr13:25745726-25745947
  hyper

SEQ ID NO: 34821 - DNA, 84 bp, Homo sapiens
  chr13:25945934-25946018
  hyper
tcctggaagagcccccgaaagtacaggcccaatctcccaccccaccaagccctccccatcgccttccccgacacctaaaagccc

SEQ ID NO: 34822 - DNA, 76 bp, Homo sapiens; identical to SEQ ID NO: 11538
  chr13:25946300-25946376
  hyper

SEQ ID NO: 34823 - DNA, 75 bp, Homo sapiens
  chr13:25946599-25946674
  hyper
gcgtcgctgcacctgcggggccaaaaggctccaggccggggcgaggtgagcggcgggcgtcagagacccccggct

SEQ ID NO: 34824 - DNA, 51 bp, Homo sapiens
  chr13:25946801-25946852
  hyper
cggcgcagagaagatgcagccttccctgccggcggccggcaccgctgtgct

SEQ ID NO: 34825 - DNA, 403 bp, Homo sapiens; identical to SEQ ID NO: 3985
  chr13:26042768-26043171
  hyper

SEQ ID NO: 34826 - DNA, 159 bp, Homo sapiens; identical to SEQ ID NO: 3986
  chr13:26043340-26043499
  hyper

SEQ ID NO: 34827 - DNA, 183 bp, Homo sapiens
  chr13:26624710-26624893
  hyper
ctcccaggtccctgacgtccaggcaacgccaaccgtcctccctttcgcgctgggcgcaggccgccctacctgccgagccgtcggggccgtctttgtccgcccggccaggctcgccagcgccctgctggcggtcattgtcgcagccgccctggtccaggcgcgcctcggcgctggagcagcagt

SEQ ID NO: 34828 - DNA, 391 bp, Homo sapiens
  chr13:26625266-26625657
  hyper
cgacgccgggccctaggtccaggagctcctaagccatccccgtcctcagccggtggcccggtccccttagggactgccttatgagttgcactcgctgatggaaatctcgggatgcagtcagaaggcccccggggctgtcgtccggaagcctctggaggtttcactggcaaccggaccctccctgagcatccccgaagggatgctcactcgagccgaatgaccgctgggcgcgccgccgcggacctggagccagggctctgcgcagggtttaagcctcagggtcccgcgcgcgaatcagggcccgtctcccctcctttattccctcctcgggcgggtagaaggggcgaaggcgggcagtgcacgcaaggctctgggcagcaagtgacgcagc

SEQ ID NO: 34829 - DNA, 39 bp, Homo sapiens
  chr13:26626239-26626278
  hyper
gacctcagggacgcccgcgggcgccgggcagcccctcac

SEQ ID NO: 34830 - DNA, 86 bp, Homo sapiens
  chr13:27050496-27050582
  hyper
acctagggagggcagcgggcaggctgggctgagccctcttccgtcacacaggaagctgcagggctttcctgcggcattcatgcttt

SEQ ID NO: 34831 - DNA, 276 bp, Homo sapiens
  chr13:27131553-27131829
  hyper
atccccacctctcctcgctggaaaggacgctgcctaagcctcatcccgagctgggggcggaggaccaagggtgagagccaccgcctccgcaatcccccgcccctcggcaccgtcgctcagcgcgctcgccggctccctattggccgaggcactcgccaatcctggtgaagcggccccgtgagttggccctggttggtggagccggcactgagcccccctcctgctccggccgagcccccccgccgggagggggcgtggccgcggccgtggacgggc

SEQ ID NO: 34832 - DNA, 451 bp, Homo sapiens
  chr13:27131859-27132310
  hyper
cggtgtggtgcgaggcgggtgcgccgggcggccgcggcgcggcgggaccatggagctcagagcgcagccccggcgccggcggcgggaccgcggaccggtgagtgagggctgcggtcgccccggctctccgctgtaggctgctgtggccctctcggctccgggccgggcggctgtcgggggaggggcggccccacggcgaactgaagttgctgcatcgccgcgcgctccggccgggcggcggggcccactgcgggctgcggcgccgcctcgcgcctatccctgcagcccggccgcattctcccggccggctcccgcgctggcaggggcttctcgccgtcacggcgcggccaggcggcccttctctcccgcgcctccgggcctccggccctttgccgtccggtgcgcgctccctggactcgggacagccacccgccctccccgccgtaagtgg

SEQ ID NO: 34833 - DNA, 158 bp, Homo sapiens
  chr13:27132629-27132787
  hyper
cggggtatcatccccgggggtctttacccgcgcgcctgggctttagcgagggcagaagcttcctctcagtttgtggtgctgacgtgcaatggcgattgcttcttgatttggcccctctgcaagggagagttccctggtggagacgagagttcttaatt

SEQ ID NO: 34834 - DNA, 419 bp, Homo sapiens; identical to SEQ ID NO: 3987
  chr13:27334304-27334723
  hyper

SEQ ID NO: 34835 - DNA, 256 bp, Homo sapiens
  chr13:27334724-27334980
  hyper
cccaggccgagggggctcctccggtgcttccgaagcgcgtgggctactcgtgtcgcatgtcggcgcagttgcccgctgtggcaaggggggggcggccgggctccggagcgggccgggagggcgcggggcgcgcactccgcggcaggtgagcggcgcggctgcaggtgagcagcagcctcggctcgcgcgcccagctttccccgccgcgcccgcccggcccacacgctccccgcgcgcgcgccgcccccgccccgcg

SEQ ID NO: 34836 - DNA, 30 bp, Homo sapiens; identical to SEQ ID NO: 11551
  chr13:28363673-28363703
  hyper

SEQ ID NO: 34837 - DNA, 142 bp, Homo sapiens
  chr13:28363953-28364095
  hyper
cccccggaaaccaggcggcgggcagaggccgcggggtggggaggccgggttggctgggtggggaggccgggttggcggggcggcccggacctcccggctgcccgcgctagcacctgcccaaggctcgggtctctcagaggca

SEQ ID NO: 34838 - DNA, 28 bp, Homo sapiens
  chr13:28364723-28364751
  hyper
cgctggccactcgcgggctcccagctcc

SEQ ID NO: 34839 - DNA, 436 bp, Homo sapiens
  chr13:28365659-28366095
  hyper
gcagcggtttcccagcgcactgctggaagtgtgctccagtagacagggtgtgggcaagatgcgcgggcagacagtccgcactcgccacatgtgctggggtgcgagatctagatctgcgccatctcggctttcattccccattccctgtctctgttcgtaacgctcagagactgtttttcctcttttacatccacggccctgtcatttgaaggaaagggctggttggccagcatctaccgaacaaagactgggcgtcgtaggcagcaccaaaattaagactatttgagaaacttagagaaaaccgagggacagcgatgggtctagggctggataaggaataatgagcccttctcctccctccccacagacgcctccttcacgcgggaacccggtcctccttcttccgacgcagagagagaagcgattccacaggtgg

SEQ ID NO: 34840 - DNA, 194 bp, Homo sapiens
  chr13:28366408-28366602
  hyper
cgagggcgcctgttacggcgtgggtggggttgacaagaatagagtacattatgcagttcatttagttaacaagtgaaataatgaggaagcgtgcagagtgaatgccaagagaaaaggcacaaaaaccctattgagaggccccggccgctcctggcgtagtccatcacatggcaatagtcctatttaagccgcgc

SEQ ID NO: 34841 - DNA, 375 bp, Homo sapiens
  chr13:28366664-28367039
  hyper
cggcagcagaggctactgtttcagcctaggtctcagccgcgcgttcagcctcctgggcagaggcagctgcgggataccgcggccagggaaagcgcgtggagagccgaaaggtgcggtgggcgcagagggcgggctggctgcggggcgaccgcgcgccggggccatgccgcgctccttcctggtggactcgctagtgctgcgcgaggcgggcgagaagaaggcgcccgagggcagcccgccgccgctcttcccctacgctgtgcccccgccgcacgcgctgcacggtctctcgcctggcgcctgccacgcgcgcaaggctgggctgctgtgcgtgtgcccgctctgcgtcaccgcctcgcagctgcatgggccccc

SEQ ID NO: 34842 - DNA, 6 bp, Homo sapiens
  chr13:28367253-28367259
  hyper
cgcgca

SEQ ID NO: 34843 - DNA, 345 bp, Homo sapiens
  chr13:28367601-28367946
  hyper
gtaagaggtcaaagtcgtaggattctggcgaccgcctaccaagggattgggtccacagcacagaggtctgatcgcttccttctctgctctgccacctccagacagcagctctaaccagctgcccagcagcaagaggatgcgcacggctttcaccagcacgcagctgctagagctggagcgcgagttcgcttctaatatgtacctgtcccgcctacgtcgcatcgagatcgcgacctacctgaatctgtccgagaagcaggtgaagatctggtttcagaaccgccgagtgaagcacaagaaggagggcaagggcagcaaccatcgtggcggcggcggcgggggtgc

SEQ ID NO: 34844 - DNA, 150 bp, Homo sapiens
  chr13:28368153-28368303
  hyper
cgctgattcccaggcacccgcagccaaaccactgcctggcatggatttggcactgctttgcagaggtcccgggcctgggcagggctgagagcttggcagagactggaccatggcgtccccgccccagggctcgctcgtgtccaaagccaa

SEQ ID NO: 34845 - DNA, 353 bp, Homo sapiens
  chr13:28368718-28369071
  hyper
acagatgataaatttcgcccgtagtatccatattggggaaacagatttgctctgtttccaacacgctcttccttcctctaaacataggaccccgctctgcgccgctggcgaccccactcttccccctccagactctggcccgccccagcctagctgtgtaattgtacggcctctgcaatgccagaagatatttatttatttatttatgtacaaaattttaaataaacttttttttttcttagaaatgcccgtggctctgagcccagaggccttcgctctggagtagacaggcgccaacccggattgggcctcccttctgggaagggttggggatccagttgcagggtccgagc

SEQ ID NO: 34846 - DNA, 906 bp, Homo sapiens
  chr13:28369161-28370067
  hyper
cgattgtcccgctccggcgtggcgcacaagcgtcgcggagctcagagagctaagccggaagggaaggagagcgctctccttggactgcaccatgggtcccaacccctgcagcgcctccttctcacctgggatccagccccacctccatccctcaccatttcgctgtcctggccaacagccgggagggcagaaaccactccctccataagcacaagaaatccgtccttcactgcgcttggattgataacgattcgttagggacaaatttccattctgcgggatggtgcagacttctctcagagggccctcctctctttgttttaaggcaaattcccttagccgagtccctggtcgcggaacattccgggcaaggaatccgagaatccgaagtgatcctgccccagggagtccccgagagggactctgcatagctggagccagtggctctgggacctcatgttctcaccaattctcgttaaaatcctatatccccctacgacttagaatccacaccccagctccctttgaggacatatgcgggtttttttactctctaagatggatgaggagaaggaagtgcgtgaggttctgcagaaacggagagcgcacagctgcgggaggagtatttctgcagtcagtatttctgcagtcagacctgggaagctaatatccgcgttctcgccgctcccattctgtgtccaggaaacctgatagaccttcttttcctgccagacccctacacacacacacagacacacacacacatacacaccctggggagcgctgaactccccgtgtctaggcaaagcaaatgcgtcttttccagcaggaaagacggtccacctgaggttgcttaacatttttgaagctcatttcctcccccccacaaaacggctttattgagct

SEQ ID NO: 34847 - DNA, 15 bp, Homo sapiens
  chr13:28370409-28370424
  hyper
tagtcccagtctaac

SEQ ID NO: 34848 - DNA, 698 bp, Homo sapiens
  chr13:28370763-28371461
  hyper
caccatcccaggaggcgacattgtgccaatctacggccaatctgaacgaagccaaggtgctttagtgcataccagtgaatagaatcacaactgttttactatcagtgatgaggctgatgcttgctgagttttgctcgtttgcatgttgctctagggccccagggtgagtgcagttgtgcactcttagctccagcaggaccggcccagcctccgtttggctgggatttgggggcgggcggcagcacgattttctggcaacgagttcgttgtgggtctgaaggaccggcttagaactagcacctctcctggattacaggagggggtggtcttgtgcacctgggaaaggccttcgccagcactcagtgtcaggcatcttgatcagaaatgcactttcgagcctgccagggaaccaagtttggaggggatggaaacggcggtgggagacatagaaaggatgaacacacacacccggctctccccgcactcgcctcttctccagctccccctcctctcccgcctaggagtccctcctgttcccagcttctccccagagtccgcagatccacagctgtgagccaggtccgcgtggggccagttttcccaggagtgcacgtttcctcctctcggcttcccagggattcatttccggaagaccaagctttcagctttctagtctgccttagcgagcagcgggagga

SEQ ID NO: 34849 - DNA, 146 bp, Homo sapiens
  chr13:28394662-28394808
  hyper
agttgtgttggaacccgtggagagaaggaactgtccgtttccaaactctgcttcggcccctctcccctcccacccacggccccaggcagagagggccggaaaggcagcccattcctgcccgcgcattcgggcgcacaagcgcattg

SEQ ID NO: 34850 - DNA, 402 bp, Homo sapiens; identical to SEQ ID NO: 3996
  chr13:28395255-28395657
  hyper

SEQ ID NO: 34851 - DNA, 75 bp, Homo sapiens
  chr13:28395998-28396073
  hyper
cccaaagttcttgttcggtttcgcctggcactggaaatgccgtcaaaccagagcgcgaaacggtctggtggagta

SEQ ID NO: 34852 - DNA, 140 bp, Homo sapiens; identical to SEQ ID NO: 11563
  chr13:28396578-28396718
  hyper

SEQ ID NO: 34853 - DNA, 292 bp, Homo sapiens
  chr13:28397177-28397469
  hyper
ctcatgcccagagagcgggggaactgtcagaaacatttacgctagaatatcttgaaattgcaaatccttttatgggggaggacgctgccgatgtgggttaaatggacaatgacgctggttaagttggagggtcctttggagacggacacgtggcttctcaatgaaagctgctccgggctcgcgtggccgccttcgccctgcacacacttctcctcccaaatacttgaaaatagacagagaaaaacaagcaactcacaaactcagcccttggccctggcggggaaacagaatt

SEQ ID NO: 34854 - DNA, 632 bp, Homo sapiens
  chr13:28491793-28492425
  hyper
gtcccttctataggtcgcaggcagcagaaaatgctaattgtgaaagtgagaacgcgcctccatggaatacccccggcgatcccctcctcctcccccacagccgcgggtacccgggtttttgccggcgaccgcaaccggcggatttgctttctgctgagagcctcttttctttctgcagggccgagcaaaaatattaaatggaagcaaatgaagcatcgaaatggagaccaatttacagaaatgtgcaattagttgagaagtgcaaagtaaacactccgggggtggcaggcgaggcagggagcaggggagggagagtggggcgcagactgagtccagagtgggtgtaggggtgcccagggaggaggggaagggggaggaaaaggagggggaggggaaaagtggccgatctttgtcctgagcggagcttgccgtccgctcataaccgcgtcgccaagtcaaccctcggcgactcggcagattatctccaagggtcaacacgccgcggccaggcaaccccctccagcctgccctcctgatcgatgtggtcactcgcggccagggtgatagggtagagttctccgcggccgcagacaatggactcattgacgcgggcgcacagagattaggtgccc

SEQ ID NO: 34855 - DNA, 127 bp, Homo sapiens; identical to SEQ ID NO: 3999
  chr13:28492426-28492553
  hyper

SEQ ID NO: 34856 - DNA, 61 bp, Homo sapiens
  chr13:28494773-28494834
  hyper
cgccttggattatcccgggtcggactaaactacatcagggagctaccgagcccatccctca

SEQ ID NO: 34857 - DNA, 30 bp, Homo sapiens
  chr13:28503435-28503465
  hyper
gtatctgggagagcacgcttgtgccgaggg

SEQ ID NO: 34858 - DNA, 145 bp, Homo sapiens
  chr13:28527239-28527384
  hyper
acctttgccaccctccgcgctgatggaaactggaggaggatgtggtttagacacaatgtggcccaagcgtccttgtttcctgaatataccccaaagtacaagtcccatctccagttttgaaagaattccccgaggaaaggggctt

SEQ ID NO: 34859 - DNA, 987 bp, Homo sapiens
  chr13:28527845-28528832
  hyper
tgtgaagagaaggagcgggggttttaagagccacagcgccaccgagagagtggaaaggagtagattagctcgcgcctgctatgcgaggcgactccccccgagacccacccgcagcccagcgcccttggccaggaggcccggaaagccaccgaggcggccgaaaggggccgcggggcacccctcagcccctcctgcggcggctccggctgcccctgctcagcctcccgctccccgcccggagtcccagctctcagatcggccgcagagctgggaacagaggccgcggggtccaggccgttccgcccgctcagccggagcagcagcgccgcctgccgggggcctcgcgcaggcgagacaggccagacgccggaggccgcgggcggctgcagctttgacgggccgaacacaccagcgctcccgttccgccttttgaaaatcaaatcccttgggcctggtgccaccatcgctcagcccaggtcttcgacgacgggtcgaaggccagtgctccaggccttcttcaccgagtggcttcggcgcttgcggcccaggttccccgcacctccgcgccgtagttgcgcgcaccttttgaaaagcttggcgtcttcaggtataaggacaaaaacaaccgcggacatcacaccattccaaagaagaaaaagaaagtgcccggaatctcagggcgcgacttccggggcgacgggcggcggcggagaggcgctccccgggcttcctacccggcaggaggccgcggcgccgggacctcgcctgccctcaccgcgcgccacctctcgggagacgccgcgaatctctccagggaatcccgggcagcggcgcagacccagcaaggaccggcagcaggccgagaccggccgtcttgggcgagagcagcgggacacgagcccccgggcgcccgctgggagcgcggggaggctctgggctcagggaagctgcgctccgagtggccttggaggacggtcaaggagcccg

SEQ ID NO: 34860 - DNA, 38 bp, Homo sapiens
  chr13:28534516-28534554
  hyper
aaactggaacctttccgggttcacgagcccaagcccca

SEQ ID NO: 34861 - DNA, 251 bp, Homo sapiens
  chr13:28535305-28535556
  hyper
cgcccgcgggccgggccaccggagcccctttcccaatcctggagctgtatacgccacccggaagggccgcggaattggagaggtgctgcagagggtctatacctcttgctgtttcccggctctgctcatcttccccaactgcccttaaggcgcctccgtgggcgcgctgattaggctctcggatgttggtgggaagatcgaaacgaagggctaagcccccctcgcccgggtcctgccggaaagttcagctc

SEQ ID NO: 34862 - DNA, 105 bp, Homo sapiens
  chr13:28540706-28540811
  hyper
cgcctggaagtgtctcggagcgacccttgctcgggtgctgccccttcagtgtcccggacgtgccgggcaacgcgatgaccagaccctgagcgctcttcgacccat

SEQ ID NO: 34863 - DNA, 18 bp, Homo sapiens
  chr13:28541082-28541100
  hyper
catcacaagggcacccgg

SEQ ID NO: 34864 - DNA, 71 bp, Homo sapiens
  chr13:28541179-28541250
  hyper
cggcttccctcccgcccccttcccggccctcaccccgcggccgctctcccgggacacgcaaaggtcttcct

SEQ ID NO: 34865 - DNA, 74 bp, Homo sapiens
  chr13:28542653-28542727
  hyper
tccgccgctggccgccgggagacagctgctcggcggcagcggtggcggcgggcccaggagggccggggttgagc

SEQ ID NO: 34866 - DNA, 708 bp, Homo sapiens
  chr13:28542728-28543436
  hyper
tttgcagcagcccagaagcgcaggaaggcgcggcggccgggtggtgcgggtggtgatgcgggtggtggtgcggatggtagtctgcggggctgctgtagcccatggctgcggccggggagccaccgttgaggccgtgagccacggcgttggcggcggccgcggcgcctccgggcgcgtagccattccagtcctcccggagtggggcgccatacgctgccggccaggatggccccggggactgcgcgctgtccaagttcgctgccgctgcagctgcggccgccacgtggtaaccgccgtagtccgggtactgcggggggctgacgaagttctgcggcgccaggttgaggccgccagagtggcgcacggagctagggtacatgctcacgtccttgtccaggaggtagctcacgtacatggtggcgagggtccgggagcagacctcaccatgctgcctggggaccgacgctggaggctgccggggggcacgaagggaaaggggcgaggggactcgaggagcggcgggtggctgcgccccagcccgcggtgctccgctggctcctcgcggctcttctgcctccgaggcggtccctccctctggcctgcctcctccctccctccctttcttccttctttcctcccacctccttcccactaggctgcagaggcggggaagacccgccacaggctggcgtgcggagccccaggccg

SEQ ID NO: 34867 - DNA, 387 bp, Homo sapiens
  chr13:28544198-28544585
  hyper
ggcgagctaggggatcgttggtaaagcagtttcttaggctgctggttacacagaatgtcagtttgtgaaaattcattgagctacacttgtatgtttattatacttaaatataaggaaaagagaatttctgctaatgcttacctaggtatttatgtgtcttacatcatacctgtatctttaaaactctctgtcctttacaaagggaaacgttctccgaagaaatttatttctcatttccaggagatgataaggcaactcagggccattattaacgactgctaatgaaaagctctgagttgagaaaggatctctcttggtttgggaagcgctgcggccaaggggcctagggctggaagtggccgtcttggggaccgaagccgcgcagcc

SEQ ID NO: 34868 - DNA, 238 bp, Homo sapiens
  chr13:28544665-28544903
  hyper
cgcgtggagtgggcctgcggccgccgttcacctcctaatacaagcctttgacagcgctgccagattcgggaatgaggatcactgcggcgaggcccggcgggctgggcagcctgactcggcggctttgagcgctctcagaacccgcgggcgctcgcggcactcctggagacctgcacttgtctgttctcattgtcaagcgtttcgctcggatatttgtcaccatcgccttcatcctgtc

SEQ ID NO: 34869 - DNA, 30 bp, Homo sapiens
  chr13:28545247-28545277
  hyper
cctgagaaatacaaccggaagcaaattgca

SEQ ID NO: 34870 - DNA, 395 bp, Homo sapiens; identical to SEQ ID NO: 4002
  chr13:28549497-28549892
  hyper

SEQ ID NO: 34871 - DNA, 20 bp, Homo sapiens
  chr13:28550239-28550259
  hyper
cgccgcgcagccagctctct

SEQ ID NO: 34872 - DNA, 30 bp, Homo sapiens
  chr13:28550493-28550523
  hyper
cataaagagcacagacgctgcatttggggc

SEQ ID NO: 34873 - DNA, 420 bp, Homo sapiens
  chr13:28551129-28551549
  hyper
gccacctctggccttcgcctattaccttgtctttgttggggagaccatgggtgtttcatttctcctctgccaatagaagcctaagtagtatttgttggggctctttacaccttccctgtgttggggggggcgggggggtgtcgacgggtggtagaatgtggtgggctcctccgcaggatgctaatgtactttcccccagtggacagtctggctgctggtacaggaagctgcccagcctaataggggtctgaaactccagggctgacaagcaaagatttctatgggcacttccctccatttaatcgacactgcaatctcgcttcattctggggtccaaatacccagcgctgctcaatgttactattttaataactgatgggtttcccggggcagtcgagccacccccccaaagccgacctc

SEQ ID NO: 34874 - DNA, 727 bp, Homo sapiens
  chr13:28551658-28552385
  hyper
cgcagggctcttcccggcccaccgcctccttcctgcggcttccccggctccccaggccggaccgaggccagcgtttgactttcctggctcccagtctgctcccctagtgcccaagagcgagaacaccgcttccgctcacatgtaaaggtcgggcgcagcaaatgaagtgggaaaagagaaaaacagacaaaccgctgtggcataaaagattccttttccgtccgttttgctttgcagttcgggcttagcaggagagggttggggagaactggataaacgctttggaatccacaaaggccggtggtgtcgggggccgcaaagggagtgaagaattgaagcagtgagctggataaatccggggcaaagcactaaacaatatggatattttggcaacgcgtgcgcgtgtgggtgggcggacaaaaggactcattactcgtatgattgcctcaattctccacttcctttgtgcacgtgtgtggacgctgttccaggcccgagtccgcctcccgcccaggacgcacagctccgggccgtggcccccgcgcgtccggttgtgcgtcccgggtccctggcccgcgcggcagctacagcttggcggggtctgcgcggaggaggtcggccaggcgcaggctgccgatcttcttcacctcgcccagagcagtgcgcagctcctgcgcggacgggcagagcagccggcgcgccagctcgcgcggcaccgccgtccggt

SEQ ID NO: 34875 - DNA, 514 bp, Homo sapiens
  chr13:28552659-28553173
  hyper
cgcgtaggccgcgcccggcccccctgccccgccccgccccgcccggccccaaagaaggctgcgggagggtgaagtagagtacccaggcggtgatgtcctggcggaacaggggcgcccttggcgcgcccctctaacaagtcctggaccttgcgcttctcggtccccactacattcggtcgggaccaggatccaggggcggggcgggaagtgacacgtttgtcttttgagaccttgggtcaagaagagcggaggagagagagggcggccgctgaggctcggaatttacgactaggtcgggagggagcagagacgcgataaggatcctgagcttttcctatctttcaaagtcctttgctctcagggggggctttgatgtctaaaggggccggacgcaagggcctgaagacttcctgcaaaagctctggaatgggtttcgttctgctccaaaggagaacggacaggggcggggtgcatccatagggataacatccatggggctcggcaaataaatgcc

SEQ ID NO: 34876 - DNA, 171 bp, Homo sapiens; identical to SEQ ID NO: 1098
  chr13:28674056-28674227
  hyper

SEQ ID NO: 34877 - DNA, 463 bp, Homo sapiens
  chr13:28674720-28675183
  hyper
gctgcaggtggctctcttaaggatgcgcgtcaccgaccgcaaattccctcggactggtgcaaagtggaaggggggaggaaccctctccccagaggcagggaccgaggcgggagcggagaggttgggcagagccgagcagccggtgcctggcgcagcgctgcagccgagcccacgtgcccgccgcggtccgcagcctgtgctcggcggcccccggggctccccgactgcggcggggaagattgggcgcggtcccgccggagaagttgcactggctccgcggctctgccgccttgctgcccctgtgagtccccgaactctgtcgtttggatccggggcgtggggactgcagggagccacaaaccaccctcctagtgcgctgggatctttgaggccctgagaaaggcgctgaatccgctcggcacgctggcaactcccgccagcgcacaggcgagcattccattaa

SEQ ID NO: 34878 - DNA, 1213 bp, Homo sapiens; identical to SEQ ID NO: 1100
  chr13:29067773-29068986
  hyper

SEQ ID NO: 34879 - DNA, 283 bp, Homo sapiens
  chr13:29068993-29069276
  hyper
cggcctgctcgcccggtgcccgcgctccccgcggccaacgacccggccgccagagtccgtcctctcgttcgccgccgccggccccgcgccctgagcgcccgtctcgcggctccagccaggagacaaccacttccccgggtaatcctcgccgccaggcgcccgctggccgctgcacccgagccccggagcccgctccgagccgccgccgctgccggggaggagccgagaggagtgtccgcctggcgcgctccgagcctcccgcggacctcgatgaagagcagcc

SEQ ID NO: 34880 - DNA, 32 bp, Homo sapiens; identical to SEQ ID NO: 11588
  chr13:29069551-29069583
  hyper

SEQ ID NO: 34881 - DNA, 30 bp, Homo sapiens
  chr13:29069801-29069831
  hyper
cccttcagactgtcccgagaagtctaggaa

SEQ ID NO: 34882 - DNA, 334 bp, Homo sapiens
  chr13:29105249-29105583
  hyper
cccttcccaacagatcgagagctcggaggcttggcacggtcggtcccgatggccccagcgggagggtcacggttgagacagcagccccatctcattgtttaaggccggggcttcctcttttggcggagcgggagcgggagcgggagctgagcgggaaggggacggacgccgcgggagccttcgggatgtctattgctgccgctccctcccctcgccgggagcttgggtttcccggggtgtgtgcggattctcaataaaaagggaaaagcacgatccaagttaattttccagcgccgacaggaaatgctgtttcctgcatcgtacaacgctggtg

SEQ ID NO: 34883 - DNA, 114 bp, Homo sapiens; identical to SEQ ID NO: 1102
  chr13:29106308-29106422
  hyper

SEQ ID NO: 34884 - DNA, 392 bp, Homo sapiens; identical to SEQ ID NO: 1103
  chr13:29106423-29106815
  hyper

SEQ ID NO: 34885 - DNA, 119 bp, Homo sapiens
  chr13:29106898-29107017
  hyper
cgccctgaggtcagggccggggcctgaggacacggcgctgggctccgggggacgcgggttcacgccggcgcccgagcgccacctccccgccctccgccggctcacgtagtcccggggtt

SEQ ID NO: 34886 - DNA, 208 bp, Homo sapiens
  chr13:29393656-29393864
  hyper
caatgcctcctgctgcgcctaattcgaagcggctccctcttctgttctgagcggaaaacagcggaacccattcctggaggcctgccctggaacggccaactcattcttactcctttctcctggggtccgatgctagggcaccacggtgaccagccgcgcagcgggcagcggcccgcgccgcgcccaccgcctgcggaggctgggtctg

SEQ ID NO: 34887 - DNA, 14 bp, Homo sapiens
  chr13:29394329-29394343
  hyper
gggagcgcctgggc

SEQ ID NO: 34888 - DNA, 268 bp, Homo sapiens
  chr13:29394643-29394911
  hyper
aggaggaggaagcagcgtggcggaacccggcccgagatgagcgtctccgtgagggcagtggtggcctcttggacattacatctttcttggctctttttgacccaggtgagcgaatcctctgctgcgcggtccggtggggtcggctggctctgctgccgccctctggacccgccggagacaggtgagcggagttggggagcgcgcagccgggctcggggcagcgccgggctggttcggcttctcgtctccagagcgctgatgcttcctg

SEQ ID NO: 34889 - DNA, 160 bp, Homo sapiens
  chr13:33001068-33001228
  hyper
aaaggcaaaagaaggcgggagggcaagccaggcaggaaggccagcgtcaaggagagaagcggcttggtttacaggagataaaaacagttcgaagttgctggaacatcaagcgcaaggcagggagcggtgggagttcaggctggagcggtggggcctagca

SEQ ID NO: 34890 - DNA, 176 bp, Homo sapiens
  chr13:33590482-33590658
  hyper
cgggggtgggcgcgccggcggtgggcgggcgggcgcggcggggcgcgggcataaaggggcgcggcgcggggccccggagcctggctcccgcgcagcatgcccgccagcgccccgccgcgccgcccgcggccgccgccgccgtcgctgtcgctgctgctggtgctgctgggcctggg

SEQ ID NO: 34891 - DNA, 375 bp, Homo sapiens
  chr13:33591066-33591441
  hyper
cgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggtgagtgcgaggggccaggcggagggccacgcaggggagacaga

SEQ ID NO: 34892 - DNA, 41 bp, Homo sapiens
  chr13:33924637-33924678
  hyper
cggacgcggcactcccgccggggtcccgggacccaatgcgg

SEQ ID NO: 34893 - DNA, 41 bp, Homo sapiens
  chr13:35517132-35517173
  hyper
ggatgattaacccttcggtgccgatccgcaacatccggatg

SEQ ID NO: 34894 - DNA, 646 bp, Homo sapiens
  chr13:36704800-36705446
  hyper
cacacatcactggcccgggcacacggaaaagcacacacacaataagaggccgggcccggccactccttccttggttcccgctccgcagccagttctgacaatgacaagcacctctcccagctcctccgccctggctctccatctccactaacaacgcgaaaagcctgggagggcccgctcgcctgactccaggtttaaagccccatggcaccaaacaaaagaggcaggtgccagcagccccggggccgcccgcacgcaacgcccccgggtcgggccaggctggccagggcagggcggccgcctttcgaggaactgcgggcggggcggcggggccaagctgagcgcccgccctgccctcggcgccccgcggctgcgggcggagcgggctctgcggagtcccccggccgccctccccgcagctcccgtccccagggaaggcaaaccacgcaccggtccgcggagagacgccgccgggggtctttgtggccgcgctgggggccgcctcctggtgctgtcctcgccgggctgggcgcggccggggctgcggggctgcagggctggggggcggcggcggggccgggctgggcggcagcagctgctggagcgcggcgcctcggttgcggccactagtgcagggatgtgcctc

SEQ ID NO: 34895 - DNA, 119 bp, Homo sapiens
  chr13:36705447-36705566
  hyper
gcccgtcctcattgaaatgcggcgcttcgcacagcctcactccagcctctctctccagaggagggcggcggcggcggcggcggcgggcgcgctcccttttcttgtctcactcgctcaca

SEQ ID NO: 34896 - DNA, 15 bp, Homo sapiens
  chr13:36705621-36705636
  hyper
cgcccttcttggcag

SEQ ID NO: 34897 - DNA, 91 bp, Homo sapiens
  chr13:36729246-36729337
  hyper
cggcggcgccttcccccggcgtccccaaatagaaacagcactagtgccctctctccgaccccaccagggccgctgccgggctcctccttac

SEQ ID NO: 34898 - DNA, 345 bp, Homo sapiens
  chr13:36919879-36920224
  hyper
ccatcccaatataaccgcagttgttcgtgggccttcttgcagagaaaggctgcccaaccttgacggggccatgggcgctgcgggagggcaaaagaccacagagatctgcgaagccaaagtaaacaacggggttggggcggcgagaatgatcaatagcgatgctccgaaaggactccgcgataggaatcgagcgggaaggattccctccatcctaacagtccatgggttaagaggccgaagcttccctaaataccacactcccgcgagagaagggactgagaacaacttctcaaactattctctctcgaaatcgctcccttcctcgaaaattccatctctgagact

SEQ ID NO: 34899 - DNA, 66 bp, Homo sapiens
  chr13:36920266-36920332
  hyper
cgcccgctcagcctcccagccgagtccgcggggcctggggcgcccaccccgcccacccaagggacc

SEQ ID NO: 34900 - DNA, 54 bp, Homo sapiens
  chr13:36920333-36920387
  hyper
cgcaggggtgaactcccccgcgccccacctgcgccttccagacctcgggcgccc

SEQ ID NO: 34901 - DNA, 657 bp, Homo sapiens
  chr13:36920464-36921121
  hyper
cgctcgccgggggccggtcccgaggttcccaaggcctcgcgcgcgcgcttgccgtggcaaccaagacgttccacgacgcgcgctctcgaacgcttcgcgtcacgcggccgcgcggccccgcccgtcggcctcgctcccgccacagagcccgcagcacgccgccgccgcagcctaggtcacgtgagtacccacgcgcgcgtcttgccagcggattcatcaccggcctgctcagactaggttctgcccactctgaccttctaaatggtacgtgggaggacgtccgtccccttcggacccaagagtcaccgtaacactctagaaggggagaaaaggagcgagggcggcaggcgacagagaacctcgcgagtcagcggccccgcgcagacccccccaggcacggtcccctgcggccacgtcggctgctcggcgcctgcgcaatctctttctctccagcgaaaccgaggcctccggagagcctagtagagagtgtgggcagtgagcgcttgtagccgctagagggagcgctgggcacagtgcacgagagacaataaaggctgattatcccctcaatgtctctgcagcctgagctttgtgacttctgtatccagagcacagttaatttccaaaagcccgcctgcaccacgtgttttaagtctt

SEQ ID NO: 34902 - DNA, 34 bp, Homo sapiens
  chr13:37004837-37004871
  hyper
gcaggtgggggagggcgcccgggaagatatccaa

SEQ ID NO: 34903 - DNA, 108 bp, Homo sapiens; identical to SEQ ID NO: 4013
  chr13:37005473-37005581
  hyper

SEQ ID NO: 34904 - DNA, 164 bp, Homo sapiens; identical to SEQ ID NO: 4014
  chr13:37005899-37006063
  hyper

SEQ ID NO: 34905 - DNA, 225 bp, Homo sapiens
  chr13:37006433-37006658
  hyper
cgcatcgctaagcccggccgcctcccaggctggaatccctcgacacttggtccttcccgccccgcccttccgtgccctgcccttccctgcccttccccgccctgccccgcccggcccggcccggccctgcccaaccctgccccgccctgccccgcccagccggccacctcttaaccgcgatcctccagtgcacttgccagttgttccggacacatagaaagataa

SEQ ID NO: 34906 - DNA, 138 bp, Homo sapiens
  chr13:37006733-37006871
  hyper
cgcagcaccctgctcgtcacttgggatggagaccggctttcccgcaatcatgtaccctggatcttttattgggggctggggagaagagtatctcagctgggaaggaccggggctcccagatttcgtcttccaggtaac

SEQ ID NO: 34907 - DNA, 471 bp, Homo sapiens
  chr13:37248523-37248994
  hyper
gtcccgagaagcaatcgcagcccggctctccgagtcttggggtgactccacgggctgcaggaggagccgcgaggggccctgagtgcaatgtccttggccccgtgttgacctgcctcggtcccagacactgggaaccgggaaggtctaccctcgctctgcaaggtggattcctccatgcaagtgtagacagttctacactttgcagagtgtgtctaggtgccttctgtttgcttttgcctttgtggtgtgtggagggtcattcttgggtttgttttgctcctgtctgattttctagggtcatttgcgtcccttctcgggaacggggactcgccatgcgcacactgacagctggctttgcacctgctaaggcgctggagagtcttttcgcccgtcttagggtggccctaaatccggggaagttttatgtggcgctgaacacttgcgtttcccaggggcgttttccctagctcc

SEQ ID NO: 34908 - DNA, 15 bp, Homo sapiens
  chr13:37249039-37249054
  hyper
cgggtctgatgagac

SEQ ID NO: 34909 - DNA, 30 bp, Homo sapiens
  chr13:38443600-38443630
  hyper
ccccgcagggatgtccgcctcccagaagag

SEQ ID NO: 34910 - DNA, 87 bp, Homo sapiens
  chr13:39260356-39260443
  hyper
ttggtctaattactgcgaagagaacaggaacgtctctaatgacagctaccctaacagagtcggatttgggagcgcctggggccacat

SEQ ID NO: 34911 - DNA, 300 bp, Homo sapiens
  chr13:39261007-39261307
  hyper
caggacaacctgttgcgcctctatctcctcccctccccgcagtttccccgccttggcctctaagagctgattggcagaaattactacccaaccctcagctccgcacctcctcccccgaccaacgattggccacctgggaggactggagtaaggggtgcgagcggagggatttccctcaaagcccagggtccggggacctggaaagtagaagtggagggattcaattctccgcgcgattgaggcgctagcggcggagctggacggcctgggaaggcttcggctcctcggctgcggctccag

SEQ ID NO: 34912 - DNA, 94 bp, Homo sapiens
  chr13:39261689-39261783
  hyper
aggccatagtgctggcgaaccgcggactccgggtgcctttcggccgtgaagtctggctggatcccctgcatgacctggtgttgcaggtgcagcc

SEQ ID NO: 34913 - DNA, 102 bp, Homo sapiens
  chr13:39261928-39262030
  hyper
cgcgtccggctgcagctgcgctatgacgcgcccggaggggcagtagtgctaccactggtactggaggtggaggtggtcttcacccagctggaggttgtgact

SEQ ID NO: 34914 - DNA, 112 bp, Homo sapiens; identical to SEQ ID NO: 11605
  chr13:39262129-39262241
  hyper

SEQ ID NO: 34915 - DNA, 95 bp, Homo sapiens
  chr13:42031220-42031315
  hyper
ccccttgggacaatgcgtaggggacctccgcgtccccgacacccgactgggacacggccgcgggctccttcgtccctcaccgccagccagggagg

SEQ ID NO: 34916 - DNA, 69 bp, Homo sapiens
  chr13:42032580-42032649
  hyper
cagcagcggcttcagcgactcggagagtaagtgcggcccccgctaggatggcgccgggatctcccagct

SEQ ID NO: 34917 - DNA, 517 bp, Homo sapiens; identical to SEQ ID NO: 4016
  chr13:43566059-43566576
  hyper

SEQ ID NO: 34918 - DNA, 137 bp, Homo sapiens
  chr13:44359843-44359980
  hyper
ctttccccatgtgctcgccgcgggatgacaaccacaacactccagaaccaccccccttccgaaagagggcggggttacgccttcagccaatcaggacccgcgagccccgggtgtccaacctatggggtggctgtggc

SEQ ID NO: 34919 - DNA, 236 bp, Homo sapiens
  chr13:44360043-44360279
  hyper
cgggtccggagaggcggggaggcggccggcgtccagcggccgaggcgcgggctctgcaccctggcagcggccgagtccggctgccccagtgcctcctttacctcgcgttgggccaggcagggcgcgctcccgccgacgaagacctgtccaaggtgtccgagctccccgcgagaggggacagtcacgaataacaacagtacccagcgcagactaggcggggaggaaagtttccggcc

SEQ ID NO: 34920 - DNA, 327 bp, Homo sapiens
  chr13:44360467-44360794
  hyper
cgcggagcccggagctgacactggctggcgggcggaggggagagcggggaacagctgtctggggcgctgggcacccccgggcgcgtaaaagtgagggagcttgagacggggcacggcggggaagggcgtgggggctgcaccgaagcccccacgcgtccacgcacccctcctcaccagcctcacctctagctccactcccctcccccctcgcccactcccctctcagtctagatccaggtgccgtggcgggggtgagaccagaggaccccggctcggagcccggacgccccagggaggctgcgggccccggagctgcttacctggggc

SEQ ID NO: 34921 - DNA, 99 bp, Homo sapiens
  chr13:44360995-44361094
  hyper
cggctggaagcctgtgtgagtagcggcgcccgggagagcggggatctgctgaggggcgctggagactccgcggctggaggcgcgcgggcgtgcgcacgc

SEQ ID NO: 34922 - DNA, 780 bp, Homo sapiens
  chr13:44947737-44948517
  hyper
cgacgcgctcacaaacgccgtggtcgcccgaaccttcggccccgcagcattcggctacaggaccgcgacactgcagggccccggctctgcgcgctgcgctccggccgctcggcgcgggaggacgtgcggtcgcgcctgcctcggtggccgcgcggggtaggtggctgcggggaccggaaggatggcgaggaagtcggaaagggtttcctgagatgagagattacttccgtccgggctgcggcctctctctggagtcggctagccggggctcggggagcggggtgcgcagggctcggggccacgccttgccacctgcagcgcccgggtgggccgcgggggcctcggcgggacgcgctcggccctgtcgcaggagctaacgcagggggaatccttgcaggtgggagcatttcagagcgcacaagccatggtggccaaacagcggatccggatggctaacgagaagcacagcaaaaacatcacccagagggggaacgtagccaaaaccctggtaaggcggggtcggcgccggccaggcagagccctgcagcccggcggggtggggcggaaggtgggggcggggccgggcgggtagcggcgcagggtccggcctcccggctcccggcccgccccttctgcggggtcctgcagagtgggggctgagagctgggttcagggcggcgcggtctgcttggcgtcctcgtgggcggagagggccctggttggtcgtggcccctctgggagtggctacctgggctaccagggaggcgcagaggagccctc

SEQ ID NO: 34923 - DNA, 207 bp, Homo sapiens
  chr13:45885757-45885964
  hyper
ctgccgagcagcatccgcgcggagcgagctgcggtcctcgggaccccgcagcaggagccacgagcccgccccggcgtccgagccctgcaggcgaggccaggcttggcgcggagggacctcagcgtccggggagcgctcgctgtctttgagttcctgctgccagagccgggcctcctctgctctccgcagcctcgcagggagggcgca

SEQ ID NO: 34924 - DNA, 146 bp, Homo sapiens
  chr13:46189788-46189934
  hyper
ggagcgcattgctaacgtgcgcagcccttacccaagccaggctcccgcgcgtgcatccaccgcgatctcaggccccggcgtttgtggcagctctcggttaccatgggaaccgcactccgcagcctccctgggccccatctaatctg

SEQ ID NO: 34925 - DNA, 33 bp, Homo sapiens
  chr13:46425360-46425393
  hyper
ctctcaggttgacagcgtcggggaaagacatca

SEQ ID NO: 34926 - DNA, 548 bp, Homo sapiens
  chr13:46961084-46961632
  hyper
tctccaaggggtccccgacactgctctgagcgaccctaagatacctgggtgtctctgctgggcacaaacctctctggcgccacttccaccatccaacctctcccgcggccctcccttccctttctccaaccaccctctccaccccgcgccgctcccatctcgcccccggccccgccagcctcacccagccaaacccgagcggtggaacgctgcgctgggtaaacgccgcgcgtcgggtcctccctcgcgcggctccgggcagcgttccgtggccaccgcgctcccggtaacagcagaaaggggagggaggagagctaccgaggaggggacagcgacgccccgacgccgccacgccccccgcctcccacacgggggccaccgtagctctctagaagctcctcagggaagcaaagcgccgttcccgccgcaggcaccgagacgtcgcccagatggaagaaactctggagatgcgcgctcctacaccggtgccgcggcgcccgggcccagcaccacgcacctatgcgcgcctctgccggtcctcctagaaa

SEQ ID NO: 34927 - DNA, 780 bp, Homo sapiens; identical to SEQ ID NO: 1106
  chr13:49794146-49794926
  hyper

SEQ ID NO: 34928 - DNA, 236 bp, Homo sapiens
  chr13:50070422-50070658
  hyper
ccagaggacagggcgcggcccaggccagttccacaggtggctctgactgcccatggtttcgcgcgagtggtgggcacgcttcggtttacctcccccgcgggtgacagcccagtgcttccaccacaaccgatgtcaactctcctagcgcccctccgctcaccggtaaaccaggacagtggaggggcgccctgatgcggtgaggcagggggcggccctgagggaagagctgggtctca

SEQ ID NO: 34929 - DNA, 15 bp, Homo sapiens
  chr13:50070684-50070699
  hyper
cgtctccccttctcc

SEQ ID NO: 34930 - DNA, 108 bp, Homo sapiens
  chr13:50704569-50704677
  hyper
ccggggcgctgaggtcggcaagtcgtcttcggaactggcggcggcgcttctccagtcgacgtggaaaaaaaaatcgtctcaaatagcacccctcggtctgcagccctt

SEQ ID NO: 34931 - DNA, 30 bp, Homo sapiens
  chr13:50705047-50705077
  hyper
caattggctgaatctcgaaataactttttt

SEQ ID NO: 34932 - DNA, 30 bp, Homo sapiens
  chr13:51086861-51086891
  hyper
tcaaagagaaaccaccgcttcctccccgag

SEQ ID NO: 34933 - DNA, 68 bp, Homo sapiens
  chr13:51797123-51797191
  hyper
aagtctttccgaagtcggctaggaggatggcatttctcgttatatggcttcatcgtgggactttaatc

SEQ ID NO: 34934 - DNA, 63 bp, Homo sapiens
  chr13:52979747-52979810
  hyper
gaagtctacccctcgcgtcgtcagcttaaagccctccttaatgaggaccgtctttaatttaat

SEQ ID NO: 34935 - DNA, 169 bp, Homo sapiens
  chr13:52980066-52980235
  hyper
tgaggtggcagagtccggaggcatttcccgaccccagaggagcctccaagagtctcgcggcacgggcgcgaacaccaggatgcggagggcgcttcttacctttcgagactgacgggcagcaaccccaggccgtccgggcgcgtggcgaggcggacgggaaggctcaggg

SEQ ID NO: 34936 - DNA, 105 bp, Homo sapiens
  chr13:53174056-53174161
  hyper
ctagtccccagagcccgggctttagggcgcccggatgcaaaccagttttgccgccaaggaacccggacaggcgcgcctcctccccggcctcgcaaggaacaggtt

SEQ ID NO: 34937 - DNA, 14 bp, Homo sapiens
  chr13:53174673-53174687
  hyper
gggtgctttcctac

SEQ ID NO: 34938 - DNA, 454 bp, Homo sapiens
  chr13:53312860-53313314
  hyper
tgccttccccacggtcgcgccactgcttagtgggagatgagccgagaacggcctttctcggaccgtccactacattctcccctactctacgcttcaatcttctcccgtgaaaccttcacttgcttttctacaacgttgacctaaggcggaaagccgcgtgccagagtgggatgggagaggggagctcacgctgggcccgaggggcccgccggcagccgcgcgcccctcgccggcccgcgctcgggctccccctaggggcaccatgggcgacacgggggtccccgcgcgccgccctctggacttacgtgactgtcgctccccttccagaagtagaaggccccgatggccccaaagagcagcagcacagctcccgaaatgaggaccacggctcccaccttgagcagccgcgcggggctggagggcttcaccgtcagcgtagcgtacgcctgcgggc

SEQ ID NO: 34939 - DNA, 17 bp, Homo sapiens
  chr13:53313512-53313529
  hyper
cgcagcacagggccttc

SEQ ID NO: 34940 - DNA, 83 bp, Homo sapiens; identical to SEQ ID NO: 1109
  chr13:53313530-53313613
  hyper

SEQ ID NO: 34941 - DNA, 273 bp, Homo sapiens
  chr13:53313677-53313950
  hyper
cggtggcacgcacccctgagtccgaactgtggaacctgatactcacacaacccaggccctgcgtgtggaatccctggcggtactcaccggggggctgcagaattccacgtcatcaggtcccaccagggcaatgggaactttgtcggagttctctgtcatgtttgcggcgggaggagtgaggcacttggagactccctgggcaccctgggatctgtcccgctgccccgacgtgcagggcatttcaacgccgcgcgcacacacggtgcacggtcc

SEQ ID NO: 34942 - DNA, 287 bp, Homo sapiens
  chr13:53419734-53420021
  hyper
ctcctttccaaaacccggggaggcaccgtagggctgcagcagggaataggggaatgggagtggggggagggttggataagaaacaaacaaaaaacaagtgcgacaggttgtctacctgaatgcacccaccctacccctccagtctcccttcccccagcctgtccgcggagctcggaggggggcgcccagccgaaggaaggcctcacctcggcgtgcgcgccgcggagccgctgctgcccctcgaagtgacaggcgctttccccagtggcgctgccgccctctgagcc

SEQ ID NO: 34943 - DNA, 22 bp, Homo sapiens
  chr13:53421826-53421848
  hyper
cgccctgcgggaaggccgggct

SEQ ID NO: 34944 - DNA, 138 bp, Homo sapiens
  chr13:53422642-53422780
  hyper
aggctctcggaatcacgctctttgcgagccctgtgcgggagaagtctgcgggtagcagctccgagcctccagcgggctctgaggacgcgcggacccgccctcactctgcgcctctccgtctcttacagaagctgcgcc

SEQ ID NO: 34945 - DNA, 27 bp, Homo sapiens
  chr13:53422781-53422808
  hyper
cctcgcgccgcctttgcctttatagcc

SEQ ID NO: 34946 - DNA, 76 bp, Homo sapiens
  chr13:53422809-53422885
  hyper
ccgatatgctaatcacccgagccgggtagccaatggccgcctccccctcgcgtcgcccctccgcctgcctctgaca

SEQ ID NO: 34947 - DNA, 30 bp, Homo sapiens; identical to SEQ ID NO: 11621
  chr13:53423168-53423198
  hyper

SEQ ID NO: 34948 - DNA, 341 bp, Homo sapiens
  chr13:53423765-53424106
  hyper
ctaaacggtgatgggcgctgaattccacacaatacccggctcgtattaaagtgcatttagagaactttttcctcctgatgccttgttccgcctatttagaggattttctttctgttctaatagggccactctgggaagcaacactcgtccggttccagaagaacaaaatcacagcgtgacgttgaaacctggcaggaacgtggggggaacttaaccatctgcttaggaaagtgtggagcttcggcactgccaaaatctgggctgggcggatcctggggctggccgggcgctgcgctgccccacagatagccccctcccatccctgacggccagggagatgg

SEQ ID NO: 34949 - DNA, 105 bp, Homo sapiens
  chr13:53424765-53424870
  hyper
gggggtacacgcagtcgaaggaactttctattttccttccgagccccgcaacactcccaccccaacctggggctggctggtgacctttagcgcccctaggctaac

SEQ ID NO: 34950 - DNA, 196 bp, Homo sapiens
  chr13:53425241-53425437
  hyper
tactcaaagtgcttccgcgtcagcatgctcattctcaaggctgaaataaaccaaggcgtgcttgaaagtgggaaaaggaaaggggagtaggggcaggcaaaagccaggaggcgggaggaggggtgtagggtggctggtagcaggtctaaagtgttttttccgcggccaggccctcgtcgatcggaagtagccacga

SEQ ID NO: 34951 - DNA, 146 bp, Homo sapiens
  chr13:53425699-53425845
  hyper
aaagggaggggagctcgcccgcccgggtgctgatcaggcctcacaaaagccgctcgaatcgccttgttatcataccaaaaggtctgggcaggcccaaaggagcccctttctctcggttttagcaacttcgccggcaactgtctcgc

SEQ ID NO: 34952 - DNA, 831 bp, Homo sapiens
  chr13:58203590-58204421
  hyper
gcatgttcgtaccagcgcgggcagaaacgggctcacgagcgccctcgaattcacacacactcaccgaaatacacatctcagcccgtggaagcgcattcacacacacccacgtacactcctccgcacctcattcagatgggtccacgcggagtcagggctgcgcttcccttggcatgggcgtgtgtgcggcgagggcgtgtgtgcgtgcgtgtgtgagagtgtgtgtagagaaaccctttaggcagaccgcagctacgttattctgcaagcatactgcgattcccgattccgtgtatgtaggaccacaaaaaaattaaatcgctgttaaacttttttttgtaaattctcttttccgaaggaaggcgctggaagagctactcccggtggttaaaggcccgggagacctggtggcgaatcctggggcgcgtccgctttggcggagcgctgggctccgctagccggactggttccccatctaactgatctaatcaatgactccgaagagccggggctcctggccccgcccccgccatcctcttctccgcctcccattggacgcgggccgagaaggcagggccttgctcctcgctcggattggctgacagggaatcagtatcaatgtttaagcggcggcgtgaggtgaatagagtcagtcagcaagagacgctggggagagagcagggatcgcgagcccggcggatgcggcagcggcggaaggcggctggggagacgctactccaactgttgaattgaattttcacctttcctttcatccgctgctttgcttgcggagatggatttatttgctttgaaatccgcatatctttctca

SEQ ID NO: 34953 - DNA, 63 bp, Homo sapiens
  chr13:58204937-58205000
  hyper
gggaggaccatgaggcgagagtgaatacgattcgttccgctgcttctgactcatccggcagat

SEQ ID NO: 34954 - DNA, 392 bp, Homo sapiens
  chr13:58205840-58206232
  hyper
gaggaaactacaaatcgggacactagttctttacgctgcatttcctcccctccctttggctgctcggaaaggagagagaggaaaaaaaaaatacgcttggctggtagatgcagtccgccgccgccgctgcctcagccagcaatgcaagattagatctctaaatgcagcaaaacactgcctgaaaacagaccggcccgcgcagcaagcagacatttcacggtgcgctggggaagcttcaaaatatatctgtgactctgtcttcgttgctcttcatccccatcaatttcatcacgggaggcgagcagcaagtaagaatttcactttcggatctgcctagagacacacctccctgctccctcccccactcgatgtgaagagtattccggagtctc

SEQ ID NO: 34955 - DNA, 210 bp, Homo sapiens; identical to SEQ ID NO: 11626
  chr13:58206452-58206662
  hyper

SEQ ID NO: 34956 - DNA, 114 bp, Homo sapiens
  chr13:58206898-58207012
  hyper
cctgctggacgtggacgcagacagcgggctcctctacaccaagcagcgcatcgaccgcgagtccctgtgccgccacaatgccaagtgccagctgtccctcgaggtgttcgccaa

SEQ ID NO: 34957 - DNA, 247 bp, Homo sapiens; identical to SEQ ID NO: 11627
  chr13:58207567-58207814
  hyper

SEQ ID NO: 34958 - DNA, 234 bp, Homo sapiens
  chr13:58207891-58208125
  hyper
cgggcccgggggttccgtccccttcaagcttgaggagaactacgacaacttctacacggtggtgactgaccgcccgctggaccgcgagacacaagacgagtacaacgtgaccatcgtggcgcgggacgggggctctcctcccctcaactccaccaagtcgttcgcgatcaagattctagacgagaacgacaacccgcctcggttcaccaaagggctctacgtgcttcaggtgca

SEQ ID NO: 34959 - DNA, 609 bp, Homo sapiens
  chr13:58208334-58208943
  hyper
tgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctatctggtgagcactgtgcgcgccctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgggacatgtcgctgccgctcatcgtgactctgagcactatctccatcatcctcctagcggccatgatcaccatcgccgtcaagtgcaagcgcgagaacaaggagatccgcacttacaactgccgcatcgccgagtacagccacccgcagctgggtgggg

SEQ ID NO: 34960 - DNA, 69 bp, Homo sapiens
  chr13:67804269-67804338
  hyper
acttcttgtaggaaacgtcagagttgcggtgatgatgattctctgacagctatccgggtgacagttgcc

SEQ ID NO: 34961 - DNA, 100 bp, Homo sapiens
  chr13:67804644-67804744
  hyper
cggcagcagcgaaaacccggaaatctgatcctggccccaggagagccgggttccatgaggtgcactgagcatgctctgcagggtccggcgtgggagggac

SEQ ID NO: 34962 - DNA, 23 bp, Homo sapiens
  chr13:67804745-67804768
  hyper
cgctggcgctccccaggcccggg

SEQ ID NO: 34963 - DNA, 384 bp, Homo sapiens
  chr13:67804863-67805247
  hyper
cgcggatccggggaaccagggccaccgctgcgggcggatgggggtcaccgaggcggctcgtctccaggcgcacacttcgcacatctctttgctaagtgaaggggccaaaatgcacagatgggggagtctacccaggaacagaggcgcgagacgtatagccacccctgggttgggagcacgagccagcagatccccggagcgcgttaaacggacaacatgcccggtgctgcaaatagaggcttttgctggcagggacattggaaagaagggcggagagggagtacagcgaaaggtggggaccgcagaatttggaatctctgcggagaccggaaagaaaattaatcggagcacttcctacatgcagagccacggaaactgccttgg

SEQ ID NO: 34964 - DNA, 199 bp, Homo sapiens
  chr13:70681579-70681778
  hyper
agaggacggggaggacgatgaagaggaagaggaggaaggcttcttccagaaagtgctcacaccgcttctctcttggcttttgagcaggcgactctggctgggtccccagtgctcaaagctgccactgccgtcctgttgcaggcagcctccccccgccgggccgccggtggaaggagacgggtggctgaagagtttccag

SEQ ID NO: 34965 - DNA, 205 bp, Homo sapiens; identical to SEQ ID NO: 4025
  chr13:70681866-70682071
  hyper

SEQ ID NO: 34966 - DNA, 30 bp, Homo sapiens
  chr13:72438533-72438563
  hyper
ggaaaaaagagctagcgctttttcaaccca

SEQ ID NO: 34967 - DNA, 124 bp, Homo sapiens
  chr13:72438769-72438893
  hyper
gaacttttgcctctgcgcttccttgcagagaaccgtggggacaaagcggcgctgtgaaagggggtggaatgatcatctctaccccgaaactgacaagttgccccactcccgccccctcttggta

SEQ ID NO: 34968 - DNA, 65 bp, Homo sapiens
  chr13:72440007-72440072
  hyper
tggtgggaaggggcgcgggcggcgggggctatcccccccgactcaccttgcgttggtgcagtcat

SEQ ID NO: 34969 - DNA, 30 bp, Homo sapiens
  chr13:72440711-72440741
  hyper
ccgccgccgccgaagcgatgggctccgggc

SEQ ID NO: 34970 - DNA, 91 bp, Homo sapiens
  chr13:74707261-74707352
  hyper
agttacacatcattacgaccagagacaataatgaatgtagcaccaggagcactattcatgccagcagtgtcatctccgccttaaccccttc

SEQ ID NO: 34971 - DNA, 43 bp, Homo sapiens
  chr13:74707625-74707668
  hyper
cttctttcttctccacgaatccgaccgacgctacttgctttgc

SEQ ID NO: 34972 - DNA, 165 bp, Homo sapiens
  chr13:75149921-75150086
  hyper
cggcccggagaggctcgcggatgcctggccgcgcgcctccgcgggacgtcagcgcccgcggcacgatctgctgctgtcactatcagtatccggcaggagcccgcccgccccggcccggccccaggccgtggaggaggggggagggtgcggcgcaggaagctgaag

SEQ ID NO: 34973 - DNA, 981 bp, Homo sapiens
  chr13:78492991-78493972
  hyper
taatatgcagtggggcggggcgttctggaaggggtgtgccagggagggaatgatgggggtcccaggcaaagctccgaactctttcacgtaacgggaggaatacagacacgtcttagttaagcgtgcgtgggaaccgcggaattaaggcacctagaggccaagggcttgtgtcaagctctgcattttgccccgcaggggaacctctataccccgcgattgaactcgaaagactcctcccggcggatgaaagccgctactccctggctggctgagctacagctcccgcagcgcgcccaggagtgcgccggagattcggaaacccgcagagacttctcaagtcagcaggaacttggaaaccgctgttccctccaaacggcttcaaacactcgcgctccttcctttacccaacctaattttaatttgccctctctataggcttaatttttatttttttaaaatcccaaactagtaagccaaaccgaagccccagaataaggttcaatcaatgattttaattcaacaccaagcccgaatgtttacctctcggatctgacaaaccagatgcagagcgacgaatggagaccaccttcccgggaggcggaacccagctgggttccagcctgctctgggagaggagcacgcctcccttgagctgcaggcgggtccggctctgacgaaacgctgcgagaatgccagacagtgtagcctccaccgtttgctcggggtctctgctgccatcagacaagtacttttattcattcatcccttcccatcaatcaccgccagactcctcccgcgccttccgaccccgctgcaacctttccccttgggcgatgcctggacagcatcagtagtagttgcccgagggaggggggcagtcctcgtccggggacaggtcccaaaaggctgtttatttgttagagttctacgctcttcaaatgaacccaaatcaagggcaagttatcacgcaccatgtgacac

SEQ ID NO: 34974 - DNA, 47 bp, Homo sapiens
  chr13:79160995-79161042
  hyper
atgcagaagagtactcgggaccattgccgggacgagaagcccatcag

SEQ ID NO: 34975 - DNA, 265 bp, Homo sapiens
  chr13:79169849-79170114
  hyper
cgccccgggtataaatccctgccggataaattcaaatctgtagcagggttttggtaatatgcatcttagcaacaaaacaaaaaccaacctcgtatgccttccagttctttttaaaacgtgtacggcagttgtgaaagttttgtggtgcttgagactgttgacttatgcaactggggagagggtttttttaaccgctttgagatattggtccatcccttttctctcagaacgtcctcaagggcacgtaagagttggaggtgacctc

SEQ ID NO: 34976 - DNA, 37 bp, Homo sapiens; identical to SEQ ID NO: 1112
  chr13:79170347-79170384
  hyper

SEQ ID NO: 34977 - DNA, 729 bp, Homo sapiens
  chr13:79170467-79171196
  hyper
cgccacccggagaaccgcggctggtgcccttgaaggccctgggatgcctgggttgggtgggtgagtgaacgagaaccctgagtgagtgaggggagggcgggtcccctcctggcttcaaattcaacccaatcagctctgccgatggtttgaaactgcacacgccgacccacccgccccgaagtctgaaagttatgccctggagacctgcgagctgcggagtgcagctggagagggagctgccccacgaggaggcctccagaataactcccggagtcggaacagcgctgggctgctgaagtttgcagcctccggatccgcgccccgccctgcagatccaccggatttcggggagggaatcggggggctgcccgtcctcccgtaaagctgacttgacaacaattacgaaagtttttaattagctccttgttataattcattttatttccagaactctccgaccataaattattcaaagagtaagccaacccgagcggggcggccgcgcgccttccccacgcgcgccgggctggctctggccgctcagctcacccgatgccccgtgagccagccccgcgccagaagccgcggtggcaggaaggtttgatcaaacattaaataacgtaatgtttgcgacaaggcttatctcacaagtggaaaagaggacctcgcgagaattagaattcggctgctattttaaaaaatcaattaagcttgcggtcttttttgaaa

SEQ ID NO: 34978 - DNA, 349 bp, Homo sapiens
  chr13:79175595-79175944
  hyper
ttgcaaaaccacacccgcaccacgttctttttgaggtccagtttctcggcgatggcggcgatcttctcggacgagggccggggctgcacggcgaagtaggcctcgagggagcgcttctcgggcgcggcgatggaagtccgcttgcgcttcttctcgccgccgttgaagagctcaggcttgttcattttctcgcgctgggcgccctcggcctcctcgagccacgcctgcaggatgggcttgagcgcgatcatgttgttgtgcgagagcgtgagcgactcgaacctgcagatggtgctctggctgagtgagcccacgcccgggatcttgaggttggccagcgccgagccca

SEQ ID NO: 34979 - DNA, 49 bp, Homo sapiens; identical to SEQ ID NO: 1115
  chr13:79176077-79176126
  hyper

SEQ ID NO: 34980 - DNA, 145 bp, Homo sapiens; identical to SEQ ID NO: 1116
  chr13:79176276-79176421
  hyper

SEQ ID NO: 34981 - DNA, 577 bp, Homo sapiens
  chr13:79176608-79177185
  hyper
ggcgatgtccacggccgccagcgcctcggcccgcgccagcagcgtctcgtccaggctggcgaagaggttgctctgcagctgcaggcgacacaaaccaaaccaaaaaaaccacaaaaccaaaagagcaaaacaaaacaacagaagaaacacacacacaggccggaaagcacagcatgcgaagggcaaacacaaagcaaccaaaataacaacgggtttgggggcagtggagagcgggaaagacggagagggggcacattgacgaccagggagggggcagacgagaagggatgggagcgtggagagggggacagaagtagggagaaagggggacacaagaacacattccggaaacgggcgtgggagacgaaaaagagggaaaagaagaaatggaaatgtaactcgcagctggggacccgtgtcacacacccgagcacgcacagagactgcctttctgaggcgtgaaattaacagagaaagtagagggaagtcgagagtcctggccccagcgctccctactccgatcgcaggcgcctgacgcggaggcagaggcagacaggaacacgacattaagggccgc

SEQ ID NO: 34982 - DNA, 318 bp, Homo sapiens; identical to SEQ ID NO: 1119
  chr13:79177305-79177623
  hyper

SEQ ID NO: 34983 - DNA, 193 bp, Homo sapiens
  chr13:79177885-79178078
  hyper
cgtgggagccgctcttatagtgaccaccagcaaggacagcgcaggtgatgcacctgtagctacccgggcatgcgcactgcccgcctcacctttcccaccgtggtctggaaagatcagaaggtccagctattgtctaagggtgggcaccttttagaataaaaaagacgagatgcgcgcacgcccctctatgtgt

SEQ ID NO: 34984 - DNA, 221 bp, Homo sapiens
  chr13:79182709-79182930
  hyper
ccgcctgggccctgccgcattcaaagctggaagaaggcgctgatcagagaaggggcttccaggtcctgggttagaacaacaacaaacaaacgaaactccacaacagacacgcctgcccatgaccccacgcaaggacataggaagttctgtcgccttcctgctccgcggatagccgcctgccgtctgctgccaccagaacgcacggacgctcggggtggagg

SEQ ID NO: 34985 - DNA, 244 bp, Homo sapiens
  chr13:79183180-79183424
  hyper
aatcaaagccccttgcgagggactgggaaatagttgccttgtcatgtaacacattgccctgatttattataaaattttaacgaaatcatgcatattttaacagcctttaatcactgcatgaaaatttaattcatgaactgtagcgcgtttaaataaatgaagtgttaattcattaggattaattaatttgttaaaggattgtgtgcaaggttaaggtggaaagaaaactctttgttggtttcgc

SEQ ID NO: 34986 - DNA, 196 bp, Homo sapiens
  chr13:84455560-84455756
  hyper
tcttctctttgcaaacgtcccctgtaacgtttccagcggcaaaacaaagagacgtctccagcaacagaatccaaagcagcatttttaaagcgagcaattcatccccgatctcatcacaaagtaacagcgaccatcctgctcgccacagacacaattcaagttcatttagtgctccaatgtccgaagccaggaaagg

SEQ ID NO: 34987 - DNA, 274 bp, Homo sapiens
  chr13:84456111-84456385
  hyper
ctgtgcatggctgtgcgtcggactgaccttgcctctctgatacaaagcagggttttccgcggcttctgttgttgaggctgctggtggagttcttgctgtggttgcgggttgcccagaagtccccccgaggtgctgtccagttcccccggtgctgaaatcacgcccgaccgaaggactcacgctgcccagccaatggcgctggaaaatttccgcaatcgctgcgttttgtggttgtccatccttttcctttcctccccttcggtcctcttaaggc

SEQ ID NO: 34988 - DNA, 451 bp, Homo sapiens
  chr13:88323380-88323831
  hyper
caggaggaaggcaggcgatcagcacagggctggaatcatctgttcctgaccaccagcaagcctggcactgccggggttatttccactcctccctttcccaatccgagaattgcacagtcccacgctcgaattacacacatggtccaagacttctctctcttcctacgaatgtgacatccaagggggccccggttgcgccgccctagcccagggacgccttcgccctcggctgccatctatcggccaccgagcgcccgcttcgccccgggcccatcatgtctgctgcagcttggctcgcaccagaggcgcgacaataaacaagtgcactggactgggccctgcacccgctccggagcagctgtctcagagacccggtgttgcttaccgcgttgccacctcctcggcgcccgggaggaagacgcaactttctcggagttttttttagagccac

SEQ ID NO: 34989 - DNA, 87 bp, Homo sapiens
  chr13:88323867-88323954
  hyper
cggttgctgcccgccccccccttcccccagaaaccccaaaggatgtcggtgatagagagttccaactaatgacgattgtgcgccgca

SEQ ID NO: 34990 - DNA, 278 bp, Homo sapiens
  chr13:88324241-88324519
  hyper
atgcatgcacacccccgcgacccgctccctctggctcgtcccccggcgtgcgccactgaccaggggggaatgtggtgaagacggcgaggaggagagccgaggggggaggggagggccggccggcgcgaacccaggccggagggtgcgaggagccagaggaggctggagggggcggcggccacagctgggtcggagaaagttgccccctatgcagatggcaactgtgagtacccctgtgggggggagggtgcagcgaaggctgccagggaccccgcgat

SEQ ID NO: 34991 - DNA, 79 bp, Homo sapiens
  chr13:88325198-88325277
  hyper
ctccccttcttcctccgttttcccttccttctctttggggcggggtgggggagggggagcctcgcgtcctggaactccg

SEQ ID NO: 34992 - DNA, 429 bp, Homo sapiens
  chr13:88325619-88326048
  hyper
tgagaggaagctcttcgacccttgctaactagaactgaattaaagttgtaaacgctggagtttaatactggctggactgaatttgcaatgggctttcagatggggtgggaggtgaatgggggcggggaagcacagggagggagggggaggggacccaacctcgctgaatggatgtgcggatttgatccagcggagaactgaaatttcaaggtaaacgttttgctttcactggggtggggatgtttttgccgcttttaagccgggagacgtttaccgttgcgttgggaggtcggggatacttgcgaggtttatgcactgtggttccaattcatctcgacacgtctgggtggccacacgtgaatgattcgcaggcacactgatacatgtgcgtttgaatgcaggggcgtttaataacgcgggctggagtcg

SEQ ID NO: 34993 - DNA, 208 bp, Homo sapiens
  chr13:88326500-88326708
  hyper
cttaatcagcccaggcgtcctttccctgagattaaaaaaaagagagaggggagcgttaacaattaaatgtaataagcaactccaaagatggggatgctgtcgaggtggtagttccgtgcaaaccttgctattaccgttgcaaatagacgcggagcccaaggtaagggaggctttcgtgctgatccttggtgtactgattcccggtaag

SEQ ID NO: 34994 - DNA, 188 bp, Homo sapiens
  chr13:88326936-88327124
  hyper
cgtggtagtgaagtccaccatcaaagcaaatgcgctctccttttttctccttactcaaagctccgggagacaattggtgatttaagagcttcttggggctcctttgatgcattatattacagcctttttgcctctgaaaagtatcctttaggttcccaccgtggcatttctagcgatggtttaaaata

SEQ ID NO: 34995 - DNA, 30 bp, Homo sapiens
  chr13:92050679-92050709
  hyper
tgggagagcgaggtccgggtttccttctat

SEQ ID NO: 34996 - DNA, 404 bp, Homo sapiens
  chr13:92050996-92051400
  hyper
cttgcgggctccctgcggctccactagttttcttcgccccgcccagccgcccactcttctcggctagggaagaagaccagagggtgctcagctggaaaactctggtgtctcagcttagggcctcctccgggaagagctaactgctcccaggtgaagccggtgcccgcgggcggtccgtacaccccgcagccggctcgcaccgctcgagagcctcggccgctgtgtcttccacgtctgcagctcagccagggcgcgcagggcgagtggggtccactggcgggtaaaggggaccaggacggcgaggatggacgcacagacctggcccgtgggctttcgctgcctcctccttctggccctggttgggtccgcccgcagcgagggcgtgcagacctgcgaagaagttc

SEQ ID NO: 34997 - DNA, 113 bp, Homo sapiens; identical to SEQ ID NO: 11658
  chr13:92051401-92051514
  hyper

SEQ ID NO: 34998 - DNA, 20 bp, Homo sapiens
  chr13:93879283-93879303
  hyper
tcccgggggagccggcgcgc

SEQ ID NO: 34999 - DNA, 157 bp, Homo sapiens; identical to SEQ ID NO: 11660
  chr13:93879304-93879461
  hyper

SEQ ID NO: 35000 - DNA, 175 bp, Homo sapiens
  chr13:93880042-93880217
  hyper
gcgggggaaggtgtgcgtctccgccgcctcattgtgtgcacacgcgggagcaccctggctcccgcctcccgctgctctcgcgcccttctaccccttagttgatggctcaggcccggctggccagggagcccgggtcactccggggcggctgcaaggcgcagacggagagccgagc

SEQ ID NO: 35001 - DNA, 205 bp, Homo sapiens
  chr13:93880533-93880738
  hyper
cgttagggttcctcagtgcttccccagttgctgttggccactcagggcccggggacaccctgccacccggtctggagccggcctcgtctgccagcgaacagccaactttagcgggtggctcagctggggattcgggtccgggttcgggggccccgtgtcccccgcatgcccggccactggcattgctccaccaagagcttgagag

SEQ ID NO: 35002 - DNA, 49 bp, Homo sapiens
  chr13:93880793-93880842
  hyper
cgcggcagtctgggtgcttgttttccggctcttagctccaaccgaatcc

SEQ ID NO: 35003 - DNA, 183 bp, Homo sapiens
  chr13:93880843-93881026
  hyper
agcttctctggggctctgtgaatgaaacgtgtcggggagagataatcctttggctgctaaagaacagaactgagagaggccgagggaggccaggagatgctgcgagggcgcgggctgctcaaaccgggcagctgaagtccttagtgacctcagatcgtcaagtcaaaacgctgaatttccacc

SEQ ID NO: 35004 - DNA, 65 bp, Homo sapiens
  chr13:95354293-95354358
  hyper
gtgtgcatatgagagcggagagacagcgacctggaggccatgggtgggggcgggtggtgaagctg

SEQ ID NO: 35005 - DNA, 46 bp, Homo sapiens
  chr13:95355963-95356009
  hyper
ctgtctcaggctctccgtgcgtcctttcactcgtcttcacccggcc

SEQ ID NO: 35006 - DNA, 749 bp, Homo sapiens
  chr13:95357026-95357775
  hyper
tttcctccagtcaagcgtgagtgatggggcggccgcgcaagggcaacggagtccagcggacaaagcttgcagagaggggcagtggcccggaggcaagggtggcggtggggggggtggggggatgggtcacaaaagtagagcaactgagcttgctgcctagcggtgccacttccctgctctgcgctaaggctatcgtcgaaggcccagagacaccttgaccctggaaacccaatccagcacgtcctgcctccccacaaatatccctcaccccaaatcgctgtgcgttttgtctcctcaaagcgactcccaatggatttggatttattcagatagaactcttcggaagtttttcagatttttcaatttcaagaatttgcatgttttaagtgaagctgaaaccgcgaaggctcaggttacactttaaaatatgcaaggcttccgtgcggccccgacatttggtaaggctcaattgcttaagaaaaaagaaaaaaaaaagaacattgctttgagaatttggggtgccccccccccacttttgtcacaattcagagcttcattccctccggccgtccaggacgtcgagagagcggctggccagagctcagccccggcgcattcgcagggacgtgtcagctgggcaggctataatttgcattattccattaagttaggagcagcgctgataacgactggaaagttcgacggctgggtgggcccgcgacccgcaggcctggcgagcaaccatcgaa

SEQ ID NO: 35007 - DNA, 179 bp, Homo sapiens
  chr13:95359682-95359861
  hyper
cgcggaccctcgaggcggacgagttgcgggaacttcgcttgcctggaggacacggcggcccaggcggccgggagcgccggcgccgagccgcgctctgattggctggcgcgaccgtccctatctgctccggggagagtggaatcttctctccatcttctgcgccccgagcctggggtgag

SEQ ID NO: 35008 - DNA, 182 bp, Homo sapiens
  chr13:95360231-95360413
  hyper
aaacagggagagagacggagatagataaagagatggagatagagatcgcgagccagcagcagctctctgcccaatcacagcgctgcatttgtgggccactttcagacgcttacaccacccacccccgggcctttctctacgccctcttgccccggagccgctccccccgctccaacccctta

SEQ ID NO: 35009 - DNA, 443 bp, Homo sapiens
  chr13:95363009-95363452
  hyper
gcatgcaacacggaccgggagggggttgggggttggggggctgaggggcgaggaagaagaatgagaaacaaaaacaaaaccgaccatgaaacttccaacaaaactggaaaggccaacatgtcaaaaagttactcctccacctccgtgggtcaaaacgcaacaggttccgaagtgcaaagcaaacgccaactgctgccgcacacaaccgcctgctttcgagttggctgccgaagtgcgggtctgaaatgatcctgcgaattcacaggcctgctcgcccgcgcccttgcgcgcttggccactcctgccccgcctggcctctctgcctctacctggcacctatacattctatgtacatacaaaccgggcccccggtcgcgggagggcgcacggggaggccgcagcgctcgtacctatacatatgtacacgtgtgcacaccggtcct

SEQ ID NO: 35010 - DNA, 467 bp, Homo sapiens
  chr13:95363493-95363960
  hyper
cgcggggtaggggtccagctggggcttgcccatgcccggcagcaggatgtaggcgagcggcggctgcagcccggggctgggccacgcgctgcagttgcacgggatcatgtagcccgggttgcccgggctggggtgcgagtgcgtgtgccccccggcggcggcggccgccgctgcagccgccgccgccgcgccgtggaaggcgcccgcgcccgcggtcgggtagcccagcgacgacgcgtacgggaggccggacgaggacgacgagatctctgccattttggagcccaggtcgagcagcgagtaggggctgcccgcggcggcggcggcggcggcagcggcggcggcagcggccgactgcgggaagaagacgcgtgcggcggcagcggcggcggccgcggccgccttctcgggattggcgagcagcgactcaggcaccaggccgccgcccgcccccgcgtgcagcccgg

SEQ ID NO: 35011 - DNA, 132 bp, Homo sapiens; identical to SEQ ID NO: 11670
  chr13:95364064-95364196
  hyper

SEQ ID NO: 35012 - DNA, 16 bp, Homo sapiens
  chr13:95364659-95364675
  hyper
ctcctcctcctcggtc

SEQ ID NO: 35013 - DNA, 699 bp, Homo sapiens
  chr13:95364676-95365375
  hyper
ttctctcttaaatgcaaagcgtccccaaaagttgcgtcgcggagactcctcgaagttgagccgaggagcccgccgccgcgtgctgccaagtgccaaagggggctctcagcggctggagtgtttgggttctcctcggtgactttctcatttgacagaagcagatgggggtggggaaggcggggaggtggccctggaggaggaagaggagggggaggcggaggagtgtccaggcgtgccacgagaacgcagagcgcagcaatggatataaatacaaatacagcagcaccagcctgtcttcttggctccgggcagggtgcgccgatgggaaacccccaatcggctgggtgattttttttttttggaggggggagctgtcccccgcagcacctgcctctcgagtcttcctctcccgctgctggactgacgggtggggcgaggaaggagggtggatgaggcttgagcaagcgttggtcgcccggcctcagaggaagttctcccggctcgccgaggagccgcgtccggccgtcccctgggccatgccggctctgttcgctccgagccccttcaggcgcgcctgccgacttagggctcccggagctcgccggccgcggagggcagcgcagcctccacgcggcgccgcaggcctggcaccggccgcgtccccgcctcgctcttctcggcagccgcctggcacttgca

SEQ ID NO: 35014 - DNA, 101 bp, Homo sapiens
  chr13:95365624-95365725
  hyper
ggccgccctctgcaccggctcaggtgagtgtggctacctgcatgtgtgcgcgcccggagccggcactgggtgtgcatgtccagccgcggctgtgtgtgtat

SEQ ID NO: 35015 - DNA, 503 bp, Homo sapiens; identical to SEQ ID NO: 11673
  chr13:95619803-95620306
  hyper

SEQ ID NO: 35016 - DNA, 475 bp, Homo sapiens; identical to SEQ ID NO: 11674
  chr13:95620307-95620782
  hyper

SEQ ID NO: 35017 - DNA, 221 bp, Homo sapiens
  chr13:95620853-95621074
  hyper
cgctgcggccgctgtgtgcccgaggggcggctctgtaacccggctccaggcatttcttaggtttcccatccccgccctccaagctcccgggagcgcctgctccgctgcccgcagacaggcgtcgttcaaacctcagctctgctcggtctgcattcatggaccccagatcttcaccctaggatttccatctcagcatttcacgttcccggggaaaaagggag

SEQ ID NO: 35018 - DNA, 205 bp, Homo sapiens
  chr13:95655055-95655260
  hyper
tcaggactttagacccggtggctaccacgtggccatggctagctgtgtccacacggcccctccgaagcgccttggccccagctgcactctcctcgcccccttcctcccagtgggaacgagccagccagcgagccctctccccacgggtggcgcccgcacccctccttgcccccgggccccggcctgtgatcgctttccagggggc

SEQ ID NO: 35019 - DNA, 30 bp, Homo sapiens
  chr13:96056313-96056343
  hyper
ctcagtaagaaagtgcgaactgaggtgcct

SEQ ID NO: 35020 - DNA, 441 bp, Homo sapiens
  chr13:96204922-96205363
  hyper
cgggaggcggagccccggggttgggagtgcgggggtcgcggcgcagagtgggagccggagagcgagcgcggctgcagccggcggcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggtctgcatccccgcggcccccgccctcagccctccttccttgatggccagcccgctaggcgccctctcgcccccaatacccccagcgggacccctagactggactcctctgaggcccgacccgtctctcccaacag

SEQ ID NO: 35021 - DNA, 173 bp, Homo sapiens; identical to SEQ ID NO: 4037
  chr13:96296383-96296556
  hyper

SEQ ID NO: 35022 - DNA, 110 bp, Homo sapiens; identical to SEQ ID NO: 4038
  chr13:96296840-96296950
  hyper

SEQ ID NO: 35023 - DNA, 247 bp, Homo sapiens
  chr13:96296991-96297238
  hyper
cgcagcgctaaaatgcgctcagccaatccggcagctggcgcagacacgtggttcgggggcgcgctccgttgctggccctggatgctaaccctaggaaggcttttcaaagagaaaccagattcgctcctacccggttgttggtctggccctcagcaagctaatttcccagaggagcttcaggtgaattatcttccaaaaagagatgcgttttaatcgcagaagtctgcagatgcgaaggaccttgaaa

SEQ ID NO: 35024 - DNA, 30 bp, Homo sapiens
  chr13:96742799-96742829
  hyper
gtcgcctgagagagccgcgccggggcggga

SEQ ID NO: 35025 - DNA, 57 bp, Homo sapiens
  chr13:96743056-96743113
  hyper
gcccgtccgccctgccgccgccgccgccgccgcttcgcctgccggcctgagagcggg

SEQ ID NO: 35026 - DNA, 198 bp, Homo sapiens
  chr13:96743376-96743574
  hyper
gccggaggaggaggacgaggagcccggagacccccgggagggggaggaagaggaggaggaagacgagccggaccccgaggccccggaaaacggctccctgccccgattcgtgccgcgcttcaacttcagcctgaaggacctgacccgcttcgtggatttcaacatcaaagggcgcgacgtgatcgtgttcctccacat

SEQ ID NO: 35027 - DNA, 107 bp, Homo sapiens; identical to SEQ ID NO: 11682
  chr13:96743788-96743895
  hyper

SEQ ID NO: 35028 - DNA, 151 bp, Homo sapiens; identical to SEQ ID NO: 11683
  chr13:96743896-96744047
  hyper

SEQ ID NO: 35029 - DNA, 324 bp, Homo sapiens
  chr13:99404616-99404940
  hyper
cctcggcggagtcggcgcctctgggcacctctggcttccgcgccccggccgcacggtgaccacccgggaggggatcccgggcgccccgcaacctcccggcccccgtgggccttcgggtcgccccgcttcccgccgccgcgtacccttcgcgcctcccggccctcggtgccggcccccgccccgcgtagctccgagtctttagcccggccggccccccacccgccgagcgtacccatggcggcggctcccagggctcctgcgacctgccggcgggacgtgctcctggcaggtgctactcctccgacctgacgtccaggcccggcc

SEQ ID NO: 35030 - DNA, 344 bp, Homo sapiens; identical to SEQ ID NO: 4040
  chr13:100608461-100608805
  hyper

SEQ ID NO: 35031 - DNA, 116 bp, Homo sapiens
  chr13:100608838-100608954
  hyper
cgagttctgggacggctgggaccaaagggctggcctccggcctgcgccctgtttgttttcctttcgccccctgaatactagattgagacgtaaagattacccgggccgaataatgc

SEQ ID NO: 35032 - DNA, 30 bp, Homo sapiens
  chr13:100609476-100609506
  hyper
tcctcactccacccccgccacttcgtgcag

SEQ ID NO: 35033 - DNA, 327 bp, Homo sapiens
  chr13:100611882-100612209
  hyper
tttaaatgtcacctccgcctttctaatgggcacagggctggaggcgacccttcaaagcgcctcggtgatgaacgacccttattaaatatggcccgagctgctgggaaagtcccgcgcccggccgcgcgccctagagcgcccctcgccggtgggccctggaggagccgggcctccgctgccaccgagcggagtccgggcccgcagagccccagcccggactggcgagggggtgcagagggaagaagagggaagcctggacgagggggggcgttgtaatacaacttcttatctgccgaccccaacacgcccgtgcgcccccagccccag

SEQ ID NO: 35034 - DNA, 32 bp, Homo sapiens
  chr13:100620640-100620672
  hyper
aaaaacccaaatgaccgcgggtcccctcgccg

SEQ ID NO: 35035 - DNA, 30 bp, Homo sapiens
  chr13:100620880-100620910
  hyper
ttgggagttccctttcggggccgggctggg

SEQ ID NO: 35036 - DNA, 263 bp, Homo sapiens
  chr13:100621752-100622015
  hyper
gtgaagagtgtgtcacggtgggcgagtgcgagtggtctccggggttccgaaagcgcattcctgtcttcccggaggggtcccttcccctcccggaaggcctgcctcgggcggcccaaatccggcagcaaatcccacgcccggtcctcggagcgcggagactgcgcggggcctacgacccggtgggaagagaggcgcttgccggggcggcccggcctctctttccatcgccctcccagacttcccagggccgggcgggtggggac

SEQ ID NO: 35037 - DNA, 166 bp, Homo sapiens
  chr13:100622330-100622496
  hyper
cgcaggagctggtggcggcggcggcggcgcggccggggacagacacccacctgtatgagtacgcttgtggatcttgaggttctcggagcgcgcgaagaccttgccgcagccggggaaagggcagggaaagggcttctcgccggtgtgcacgcggatgtggttgatg

SEQ ID NO: 35038 - DNA, 201 bp, Homo sapiens
  chr13:100622959-100623160
  hyper
gggcggccgccgctgcggccgcaaccgccccgtagtgcgcgtccccagagcgcggcgcgaagggcggttcggcgcggccgtacagctcagccgccgcggctgccgctgccgccgccagccccaggcgcatctggccgttgagcgggtgcgggtggccgcctggggcccccggcgtgtcgtgcagcgcggggaagagcgccg

SEQ ID NO: 35039 - DNA, 231 bp, Homo sapiens
  chr13:100623899-100624130
  hyper
tttattccctctgcccgccttcaaaaacatgtatgtattgggcgctctttaacttcttttgtcctggcctcttaactctgcttattcctgttcccactctatcctccagcgattggcagagtgaacaccacatttgagctgcacagtgggaccgagattttggaaatggcacgggtgggattggagggagccgcgtgattggcagtagcctcggctgctcgattggctccc

SEQ ID NO: 35040 - DNA, 102 bp, Homo sapiens
  chr13:100624131-100624233
  hyper
ttcaggccctcgacccagcggggattcgcccccgtgcttgcggccgcctgcgctttcgcttcgcgccccctcctccgctggagccacacgtccccgcctccc

SEQ ID NO: 35041 - DNA, 279 bp, Homo sapiens
  chr13:100624323-100624602
  hyper
cgccggcacgcgggcagagggcgcggggtggtgaggggctgaggacccccgaggggcagtcccagtttcaaaaaccttggcctcacttctctgtgtgccttctggcacccaagtactttctgcctctacctccacctctcttgtggggtggaagagccctgggctgctgtttgggagagaagggtgaatagcccgtcctacctgtagtggtgatgctagaaacttcttgtttggacacccaacctgcctagcgctcacctagggcgcatagacagtaga

SEQ ID NO: 35042 - DNA, 30 bp, Homo sapiens
  chr13:100626366-100626396
  hyper
tcttgttaaacacagcgtgatatgtatctg

SEQ ID NO: 35043 - DNA, 331 bp, Homo sapiens
  chr13:100630666-100630997
  hyper
acttctgagaagggacggcgacgtgactttgaacttggctcagctcttctgtgccctgcagagagaggagaactagagccgggaaagaatagccaggagcgcccaacccgtagggtctccggcgggaattaaggcgtccgccccaccgcccggccgcgcgcggcccctggaatccggcgcgagcgagcgcccagccgcgcgatccccaaacgcgggagcagcaaaggcgaaatcaaagcgaaagagagaatgggtcaaagaggagagggagggaggactggggagggggtaagacagtgggaaaggaggaaaacttcgaagtctgatggcc

SEQ ID NO: 35044 - DNA, 54 bp, Homo sapiens
  chr13:100631883-100631937
  hyper
gcgcggcgccgggagcggcctcgccgctgggccaccgcccgggtggtactccct

SEQ ID NO: 35045 - DNA, 245 bp, Homo sapiens
  chr13:100635085-100635330
  hyper
aatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcc

SEQ ID NO: 35046 - DNA, 53 bp, Homo sapiens
  chr13:100635398-100635451
  hyper
cgcgggctgggacagggaccaggcgcggaggggagacacgcacaggctgagac

SEQ ID NO: 35047 - DNA, 30 bp, Homo sapiens; identical to SEQ ID NO: 11693
  chr13:100636167-100636197
  hyper

SEQ ID NO: 35048 - DNA, 100 bp, Homo sapiens
  chr13:100636984-100637084
  hyper
gaagaaagtaaaatacgaaataaatgagcaggactgtcgggcgggaaggcggttaatttgatcttagttctgccgcagaggggatcggactggtttgagg

SEQ ID NO: 35049 - DNA, 642 bp, Homo sapiens
  chr13:100637364-100638006
  hyper
taccaccgcggcggccgggaggagggcgaggcaggccgaggcgccggtgcagcactggcccggaccacctcagccggcctgggagggtccccaggggccagggcggcggggggaacatttctgggggtgctctcccccaggggcccggccccacagcagctgcactcacacccagtcccctctggtcccccctcccggcttttgtcttgcaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcga

SEQ ID NO: 35050 - DNA, 30 bp, Homo sapiens
  chr13:100640440-100640470
  hyper
agctgtgaggaaaatcgtttagagttttcc

SEQ ID NO: 35051 - DNA, 187 bp, Homo sapiens; identical to SEQ ID NO: 11697
  chr13:100640972-100641159
  hyper

SEQ ID NO: 35052 - DNA, 51 bp, Homo sapiens; identical to SEQ ID NO: 1121
  chr13:100642150-100642201
  hyper

SEQ ID NO: 35053 - DNA, 328 bp, Homo sapiens
  chr13:100643842-100644170
  hyper
gttcccttttcaccccggctcttatgttgccagtctcccccctaccaccaggcaaagcccccctaaacttagggtctggaacaaggccgagccagcgagggcctgccaggagctgcgctggagcctctcgctgcatccagagctggttcttgttcttttctctctcttggcccactgggcccacagtggttaggtggccgagtgtggtttcccgaaactctttggagtcgcctgggtctgcgtgcccctggccccgtcctcacccccgggctcgtcccccagcctccgccggcccgcctgtgaatggtggatttaatgagcgtttgtg

SEQ ID NO: 35054 - DNA, 32 bp, Homo sapiens; identical to SEQ ID NO: 11700
  chr13:100647898-100647930
  hyper

SEQ ID NO: 35055 - DNA, 115 bp, Homo sapiens
  chr13:100648149-100648264
  hyper
accacttggctggaacgcttgctttcgatttgtttgtttcgcgcatttccctaaagagccgggctctttgcgctgttttaattctgctttaaaaatgcatcgcttctgccctgaa

SEQ ID NO: 35056 - DNA, 224 bp, Homo sapiens
  chr13:100649352-100649576
  hyper
tgtgcgaggacaattattttcatcagctgcttgctagcccgcgcccgactgctcctctttgcagaaccgacgggctttcaactctggaagtgaagcaggacgaattcctccatggagactccctccttgggaacgtcgaactctctctgccttggggagtggggctcgataaagggtacctaggtcgcaccctggcaggggagcactagagggccgcgaggtcc

SEQ ID NO: 35057 - DNA, 86 bp, Homo sapiens; identical to SEQ ID NO: 1123
  chr13:100649799-100649885
  hyper

SEQ ID NO: 35058 - DNA, 52 bp, Homo sapiens
  chr13:100649944-100649996
  hyper
cggccgagggagcctagagccggtgggagacgggcagcggcctctcctgatc

SEQ ID NO: 35059 - DNA, 169 bp, Homo sapiens
  chr13:102068189-102068358
  hyper
ggtttacccaggcagcggccctggtgccgagggggcaggtgcagcgctgtagtgatgcccagtggcctcgtcctcagccacctgccccccaacacctgctagatgcccaggcggggcaggcccgaggtgtcgccggccctgggcttcccaagccagcccaggggcatcc

SEQ ID NO: 35060 - DNA, 29 bp, Homo sapiens
  chr13:102068417-102068446
  hyper
cgccccggccaggccggcaaggaccccac

SEQ ID NO: 35061 - DNA, 58 bp, Homo sapiens
  chr13:102069013-102069071
  hyper
gcagttggtggggagcgccagggtcggtactggcagttccttcttgccggctgccacc

SEQ ID NO: 35062 - DNA, 163 bp, Homo sapiens
  chr13:102568410-102568573
  hyper
gctcagatcagactgcgagcggtggctcgaccccgggtgtggcaggaaggggtgccccgcgttccagagccagtgccagtccctatcctcccgggaagccgagactcagggggaacaggtttcccagagcccagcctgcagggacgcggagggcaggagccgc

SEQ ID NO: 35063 - DNA, 109 bp, Homo sapiens
  chr13:102568659-102568768
  hyper
cgacggcacccagagtgctcagaagggaggccggggccggggtgggccgggaaaaccgagggagggaaggagcctggagaagctccgtttaggcggggagggggcgacc

SEQ ID NO: 35064 - DNA, 642 bp, Homo sapiens
  chr13:102569312-102569954
  hyper
gctcgtcgcaggaaccccggcgggggtcgccaccgccactcgcgctgccttctcgccctgcccggctcccgggcgggaggtagagccggccggcggctccccgggcgccggctggagggcgggtcccggcagggtctctgcgcgtccgtcggtccgggtcgcgctgggcaggactcagcgccgggctccagctgcccgcgggccggtgccgccgccggcgccgcccgctctcggcttctgccggtgattgtcaagtgctttggaaatcagcatctggagagaccaatcttctcccctgagatctctaatcaaacgctccgttcccaccccactacaccccctccacctatgtggtccccctcctgatgtacctcttcagaaagaaacaaaacgtataggtaataatgatttaaaaataataagaaagaaagctaagatggattgcagggatggggtgctaagaggccgagccaaagcaggtggaattgaaggaacatcggggcgctttttcttagatgcaactcgctggttcccgagccttccgcggcttggttggggcttctcggtcttaacgtggttaccggtgcactgaaactctcagcagcggttggagggcgaggtggtttccgccctccctgctaa

SEQ ID NO: 35065 - DNA, 30 bp, Homo sapiens
  chr13:102572245-102572275
  hyper
ggactccggagtctccgggcatctattctg

SEQ ID NO: 35066 - DNA, 388 bp, Homo sapiens; identical to SEQ ID NO: 11707
  chr13:103046665-103047053
  hyper

SEQ ID NO: 35067 - DNA, 247 bp, Homo sapiens; identical to SEQ ID NO: 11708
  chr13:103047054-103047301
  hyper

SEQ ID NO: 35068 - DNA, 30 bp, Homo sapiens; identical to SEQ ID NO: 11709
  chr13:103052128-103052158
  hyper

SEQ ID NO: 35069 - DNA, 23 bp, Homo sapiens
  chr13:103052445-103052468
  hyper
aggcggcagacccctcggagcgc

SEQ ID NO: 35070 - DNA, 359 bp, Homo sapiens
  chr13:103052469-103052828
  hyper
ccaccccagctacgttgcattggcaaggttcggaggctggagggcagcagccacttgctgccccagtcgctggggctctgggtgccagtgcggcccccggcagagcccagggcgtcagggaggccgtggagagccatgatctactgcaccgcagtgccagcgtcaggagcttccagagcccgggctgccactgcgggacggccgatctgcccgctccctccttcagacacaaccccagacaaaaacagccggccccgggtccctctccaccctgaacggagctaggggacgccacacactcccggctgccagcgtgagcggttccgggaaaggctgcgcccagcctcctcgccagcgcc

SEQ ID NO: 35071 - DNA, 403 bp, Homo sapiens
  chr13:103052829-103053232
  hyper
ccgccaccaccatgcagccctccagcctgcctcccctgggttgctcgcccacagctccgcggccgcccccaatcgcctcggactgagacgcggggacgggaacccctgggatccgactccccaaatcagatgcatttgcatttcttatgtaatgtactgcaagttcccttgttggagccctttggaatcggggcgcatgatcaccagtaggcttaaaagcaggaactcacggcctggctcatccccacccctggccctgtgggaccccgacgcagggctttgacaccgctttctaaagggggggacttcaattacaaatattagaggggctgggcttgtcctctcagtctggggttccctcccggcgcaagccttgctcaagtattcccggtggcaggatgtg

SEQ ID NO: 35072 - DNA, 59 bp, Homo sapiens
  chr13:103054561-103054620
  hyper
agtgctcagtgggatcggtttgaacctgcagttctcaatcaccacgaagaaaagatgca

SEQ ID NO: 35073 - DNA, 78 bp, Homo sapiens
  chr13:107186854-107186932
  hyper
tgtggccatgtccttcgtcctcgaaaacaggagagggtcaggtatcgccatcggacaccttcccggacttgacacccg

SEQ ID NO: 35074 - DNA, 97 bp, Homo sapiens
  chr13:108518548-108518645
  hyper
gggcagggtgggggacgaggaggcggagaggagtctgtgtgcctgggcggcgggcgaggactcccccatgctcgccaggagcgcgggccaggagggc

SEQ ID NO: 35075 - DNA, 217 bp, Homo sapiens
  chr13:108518705-108518922
  hyper
tgctgctgccgctgctgctgctggtgctccttgtcccgggcccgggtcagcttggcctcggcgcagaaccacaagtgatcagagagcaggactgtgaaaaacaagagagatgccagagacagtcgccatttctgagccctctcggaatcgatgaacggtttctcgttctctcggggtgctgccaaccagatttttaagccgtcgtcatactgccgac

SEQ ID NO: 35076 - DNA, 156 bp, Homo sapiens
  chr13:108519254-108519410
  hyper
agagagagagagagacggaggaggctggtgctggtggccggcggcgaggctgggtgcagggggcgatggtggaggtgacagggtggctggcgcggctccggtcacccaggcattgtcagcgcgcgggtccccatggccccgcggagcccagcccgc

SEQ ID NO: 35077 - DNA, 124 bp, Homo sapiens
  chr13:108519622-108519746
  hyper
ccccaccccccaccccgcgctctaagtgctgccgccgccgccgccgccgccgccgctgccgcagggccgcccgcgggcgccgccgccggggctccgactgctgacgccgcctcccgcggagctc

SEQ ID NO: 35078 - DNA, 2 bp, Homo sapiens
  chr13:108519901-108519903
  hyper
cg

SEQ ID NO: 35079 - DNA, 70 bp, Homo sapiens
  chr13:108520465-108520535
  hyper
ctattctaaagtaaacgattagaagtggcctcatagagtcttaggaagaaacagtaagccctgtgccacc

SEQ ID NO: 35080 - DNA, 21 bp, Homo sapiens
  chr13:108520805-108520826
  hyper
aatctggggtcacctcgattc

SEQ ID NO: 35081 - DNA, 150 bp, Homo sapiens
  chr13:109147713-109147863
  hyper
ttcaggagtgagctgcgttcttagaattgtagcagagagagaggagggagagagcagaggatcggagggcaggagtggagagaggcgcggtctcctggaacgcgcgggggaacgtggaaaggagggcgcgggagacccggagggctgccc

SEQ ID NO: 35082 - DNA, 125 bp, Homo sapiens
  chr13:109148154-109148279
  hyper
cgggcacaggggcaactgccgacccctctcacccgccgcgcggggctggtttccgagccgagtcccggccatcgccgcgtcgcctggcgcccggctccggcggacccttctccggcaggtagggg

SEQ ID NO: 35083 - DNA, 278 bp, Homo sapiens
  chr13:109148376-109148654
  hyper
cgccgggctggggacgccgggagggtgccccgggtcggacttgcggcgctgggtccccacccagagttcccgcacggtgagggttggacgcgtctggggggcgtggagaggaggcttgtcggtcccttcctgggaaaggaatcgcggggacttcccaaccgctaggacgcgtaagccgaggctgggagtagaagccttctgaactctggacctaccccagaaggagggggcgaaactggccatttcgagggacgcggaagccccgttgctaggggaga

SEQ ID NO: 35084 - DNA, 140 bp, Homo sapiens
  chr13:109148885-109149025
  hyper
gtctcacccggggggcgtcgagcctcagcgcatcgccccgtcttccctggctgcagaaaaccactaggccggtggaagtgctccgtttaattggtccctagtacgcccccgaaaggaaatggagacgatttccgtcaagt

SEQ ID NO: 35085 - DNA, 268 bp, Homo sapiens
  chr13:110958709-110958977
  hyper
acttctgccttggagcgcgccttaggcagcagtcgtgggaaagctcagatacagctgtttccaggcaaagggcccagagcttttcagcctcagccaccagggtctccagacaaggagaaatacgcccaaagctgctcccaggggctaggagctcggagctcccagtgtgggtctctgagcagcgcggggtgggcgctcccggccctccagcccccaactccctcgcgcacccgggacgggtgaaggcgcccagctgccgagcataccc

SEQ ID NO: 35086 - DNA, 76 bp, Homo sapiens
  chr13:110958978-110959054
  hyper
cgacgcgggttcaaatcccgccggctcccaggcaccctcaccccgccacagcgcgggctgtttctcctcccttccc

SEQ ID NO: 35087 - DNA, 132 bp, Homo sapiens; identical to SEQ ID NO: 4051
  chr13:110959517-110959649
  hyper

SEQ ID NO: 35088 - DNA, 391 bp, Homo sapiens
  chr13:110959752-110960143
  hyper
cgagcccccggggccggcgcccagagagcccagcaaggccggccgccctgccggtgtgccgccggcgggtgcttctggaagggccaatgcgttcgggcagcagcccctgaagccgagcccgaggtgagagcgacccccgagcggcgcccagaccctggcccgagagcaccgacttggagcgccttgtgcaggctagggctgcacgctctcctgcttgggagtagaaagggggagggtgggagagcgaagaccgagctcctcggccaaggagcacccacaggggcctaacgggaggctctccttctttccgggtcgtgggggggacggccctccggtcacccctgcatgcgggccgcgcaccgcgctgtccccgcgtctcgcggaccgagac

SEQ ID NO: 35089 - DNA, 259 bp, Homo sapiens
  chr13:110960344-110960603
  hyper
cggtgtaactctcggggactgacaagccgggcccgcacgttcacgtctctcttcctccctttcccatgcaggtggctgctgctggggacagtgaccgtggggttcctcgcccagagcgtcttggcggtaagtcctggctcccgcgcttggacttgcgcgcccgagagtggttgggacgtttgagtggccttggagaaggcagctcgtccgtgcgctcccgagtgtgtgtgtgcgtgtggatgttcgccaggctgcccac

SEQ ID NO: 35090 - DNA, 221 bp, Homo sapiens
  chr13:110960909-110961130
  hyper
ctctgggtaaaggggcggggcgaggaggcgaacgagacaaccttagtattgtttgaattgaagcattgcgagggaacaatggcagaaaaaccgcgttttctcccaagtcctgttccggccctggaagagctgctccgggcgccacactgggatcctgttcgccgagcctgcccctccacgccggccgtgcacagccctgccgataccgtgggtgcagctgg

SEQ ID NO: 35091 - DNA, 112 bp, Homo sapiens
  chr13:111766833-111766945
  hyper
gctccatttcttcctcgcatgtcaatgtgtgcgtgtcatcagttgttcgaggaagctcgcgcatgacgcgacacttgccgtctgggctctccaggttcggcctgctgctttc

SEQ ID NO: 35092 - DNA, 80 bp, Homo sapiens
  chr13:111767213-111767293
  hyper
tgcaaggtagcaaagcgaaacaaacgtctcgttttcagcctgtccccgccaccttgaaataaaaccggcaaaaataaaaa

SEQ ID NO: 35093 - DNA, 252 bp, Homo sapiens
  chr13:111767866-111768118
  hyper
cgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtaagtcccggcccgcgcccccgcccgcgccccccggtccggcccgctgcggcccgggatgcgcgcggagcacctgaggc

SEQ ID NO: 35094 - DNA, 30 bp, Homo sapiens
  chr13:111768438-111768468
  hyper
gtggacagttcttgccggtggcgttgcgtg

SEQ ID NO: 35095 - DNA, 311 bp, Homo sapiens
  chr13:112707694-112708005
  hyper
acatttcaaggatgacggaagctctgagtgagtgaacagatattcttcgtgcagaataatcccccgtggcactggtttgccggcagagcagaatgtttgagacctcaccccgcagccacgcgcgggcgtaaatcgttctcagcacgagaaacacaaaggccgcaggatcccgcgagccgcagggggttggggtcatttttttgatgccgccgcccttaagagttccagtccttcaggcgaaaggggcagatcaggccttcggggaggacccttgcctgggagagggagggcagtgccccaggggccgcctc

SEQ ID NO: 35096 - DNA, 206 bp, Homo sapiens; identical to SEQ ID NO: 4054
  chr13:112708307-112708513
  hyper

SEQ ID NO: 35097 - DNA, 30 bp, Homo sapiens
  chr13:112709027-112709057
  hyper
tgtctccgcgtttcccgccacgaaattcct

SEQ ID NO: 35098 - DNA, 30 bp, Homo sapiens
  chr13:112709489-112709519
  hyper
aaaaaaattaccctgcgtttgtccggggga

SEQ ID NO: 35099 - DNA, 236 bp, Homo sapiens
  chr13:112709815-112710051
  hyper
cagagacccagaccccgagaaacaagtgtggctccagcccaggagcctcacagaacacatttcctcctccgccttcggctctgcgtgggctagccccgcgctagggagggcaggcaactaggtcctccgaggtgaggctggggctccgcctgcagagggagtgacagcgcgccgcgagggtccgcgacccaggcaggggtggccgcaccaccccggagcgccgcacagccccgcag

SEQ ID NO: 35100 - DNA, 117 bp, Homo sapiens; identical to SEQ ID NO: 11728
  chr13:112710359-112710476
  hyper

SEQ ID NO: 35101 - DNA, 78 bp, Homo sapiens; identical to SEQ ID NO: 11729
  chr13:112710745-112710823
  hyper

SEQ ID NO: 35102 - DNA, 470 bp, Homo sapiens
  chr13:112710824-112711294
  hyper
caaaccaactgctcgattctattcactgtcgagtaggaacaaaaaagtggctatttattagaatacttgtttggtattgttccgcgccacacaaaaggcgtttcattatgtggagggatctcctttttccagagagaaacaataacttgaaattgtctttaaagtcttttctatcaataataaatttcattttcttgtctctctcgcctgcagtgtgtgtgcgcgcgcgcgaggcgaggagagaggcgcgtgtgcgagtgagtgtgctagcgggggtgcgcgtgtgagtgtgcgcgtgtgtgtgcgtgcgcgtggcaccggcgcccgcggctacggggctggcgctgccggagccgggccggaccggggtccgagatctgcgtcgcgctgggcacgctggccacccggtccggaatgagtcggggctccgggaggtgcccgtgggcagagcgttaggggcgcggccgtgc

SEQ ID NO: 35103 - DNA, 1654 bp, Homo sapiens
  chr13:112711375-112713029
  hyper
cgcccggggctgcggagctggccggtaaaggctctcgggagaggggcgcggtgtctccacggtgactttccgtgaaggaggatggggtgtctccgcagctttggggccccaggaaagaacaggtgggtagatgtggtggccacggctagcggactcgccgcggggcacatttgtcattttcttatctgtgcgttcactcctcccccatcctcggcttttgggattggccgccgcccaacggacccagactgtttctctctgggtcgccatttttggggaggggggagggaggtcgagtctgtggatttgggggagaggttcttgtccgccacagctccgcgccccctccccgcccctcgcggctcccccaccctcgcgttcggcagcgccaggctgcgctctccccggtgcacacccggccgcgccgagaactaaatccgcgggctgaaattacgttttaaaaattaacatgttgaagcgtgtgccatttagtgagaggtgttttgggcaaagaatcaatttaactgtgactgaccgacgggcttgactgtattaattctgctaccgaaaaaaaaaaaaaaaaaaaagcaatgagccgcaagccttggactcgcagagctgccggtgcccgtccgagagccccaccagcgcggctcacgcctcagtctcgccgccccaaggtgggatccgacgcccaaaggagggcgccccaaggtgggatccgagcgggccgccctaggaggagtgaaccccgcccgggcgcacagctccgtgcgcctgtcctccctcctccagcgaaatcacacccgctttgcctcctcttgcagcaccgcgcgtgcctaggttctcggtctgcgcagctgggagtctcccccaccagcgccgcggagccgcccgcttccgctccctctttccgcgggtttgagcctcccgtggagaggaaaggtcacgaagtttcaaaggtgaaatggattttcggcggtggctggtgcgggagtcaatgggcagggcggggcaagcctggcagtcatcgacccgagcagggacccggctggccgcctccccttgcaggaaacaggtgtttgaacgcgatagcggccgccagtcaactaaggcattaaaagctcgctttataacatcgatttcctggagtgcggtggggcctgcgttctggaagctcgtttgtgaaaggcggggttgggggaattgccctgatggtaccccagttggcgcagaagatccccaaaagtccctgtcaccgcagcggcggacagcggggctgcccaggcggctgggagggcagcttttccctcccgctggggtggaaagaggagtcctgctccgttccccacccaggacaatggtcttgttaccccggcctcctcccctgcacctagggcctggcatgcagagagcgcccgcagcagagggggaagtctccaacaactggcaggtgtcccccgaggagctccgcttgatttggaagggtggttaaaccgggatccaggaggaaagcaattccgttgccacccacatcccctgggccctaccaggcttcttcccctgctagcacatctcccggatgcgacgcaggccaggtggcagggctgaagcaggcaggcacacaggagatggcatgcgtacctgtaaggat

SEQ ID NO: 35104 - DNA, 365 bp, Homo sapiens
  chr13:112715354-112715719
  hyper
gggaacgctcccagccggcagccgctctgggcgtgcacccgccacgcgaagccagaggttggacgacgcagccggccaggcgcggctcccgggggaccccgaaaccgcctgtggctcaggccctacttggcaagaagagactggggagtgagaggaggggtcactcttgctctctcgcacaatagacttcccgcaggcgagtgcgaacggccttttgcttcctccttcttttccaggacccttagcgacaggagaggaagagaagcggcccggcggtttaattgccaatttcctgatgcagccacagggcccagcagcggctcagcctaggccaccgggtccaggcctctaggcaataggcccgg

SEQ ID NO: 35105 - DNA, 550 bp, Homo sapiens
  chr13:112715803-112716353
  hyper
cgccgggcgctcggcgcatccgccgtgcccacagcgctgaggaccaactagggctgccctcggccaggggcactgtgcccgtttgagtggcactcggacctggcgaggggtggaagcccaggtagagctcgcgtctttaagagccacccgacagaactgcgcgctacatctgcgccagctgggctgggtgggaacagcgcagaaatactcccgtgccggggcgtacagggcaggtaggcccagcagagagtcttctcggaaagtttcccacaaaagaagggccgggcaggccgagcggcaggaaaagccggtgctcagcggcgaggcccgagaggtctggcatccggcggcctcccagctttgctcgggtctcccgccgcctctctccagagccgcccgtagctccgtggggcggagggcgcaatgccccgctctggttccagcctttttcctccccttgtctcctctttcattcataaacctggtggctacagacgcagcttgaatattgacgtctctcccccaactgctctgccgttaacccaattac

SEQ ID NO: 35106 - DNA, 99 bp, Homo sapiens
  chr13:112716622-112716721
  hyper
cggaggcacacagcacgcgcgcgtgcgcgcgcgcgcacacacacatacacacacacagttgtttgttcttcgattgtgaatgtgcggctctccacacga

SEQ ID NO: 35107 - DNA, 44 bp, Homo sapiens
  chr13:112717110-112717154
  hyper
cccctggccatcacccgagcgccctggagcgccatcacccgaac

SEQ ID NO: 35108 - DNA, 495 bp, Homo sapiens
  chr13:112717474-112717969
  hyper
ctccctcctcgccctcgctccgcgcctcctgttggcagagatggcctcgaaggcctcttccaatttgaatggctctttcttcttctctctcccgcgctttcttttccgccttctcctcctctccttctgactactcttgtctctttcaaaagctccgcctggaaactagcggcttcctcttcatctgcctcctttaactgtggcctcggccctctggggcgacaccagagcgcggaagcctgagcccctcggagatccggggaggcacctacacatggcctcaatcctccaaccggccccagaagccgtaggagctgaacccaggagggcaaccggttgtggtgcggccacatgtccctggagagtgtcagcaagacgggtcgacttcaccaggaccacgaaagacagggcagagtttctgtcttctttcactgtcccgtagaactcctagcttgtccatcgtgctccttgcttgggactcgggactgacactgg

SEQ ID NO: 35109 - DNA, 975 bp, Homo sapiens
  chr13:112720052-112721027
  hyper
tgaaaatctctttcacgttcccaaatcaaagccactttgaggtttaagaatgataaccacaggtgaatgccttactctttccacgagccaggcctttcctttgcatgacgcagaccggcggctgagacccgtcctgaggccccgcctttcattcggtttatgtggccccgcgcagttcacgcagttttctccgttcttaggcaaccagctcgtgggaaattcactccagaaaagcgtgcgccatatcattattttgcgattcaacaaactttttcaactgttgttcaggaactagattccagatagatcttgttgtgttcggccttcctagaaattccttttccagaggaagaagatccgggttgggaagagtgcgtgactatggccccgggctcattgaaagactcctccccacaaaagtttagggctgatactaaacgaagctatggagccatgcccacacaaatactccccctttacccgaattgtggggcctggactgtgaaggccttcgctgcaagagcgggcactggcgaacttcagtgcacgccgcggccgagaacggatgcagggcgggggatggctgagccgcctgatccttgcagagaacctgcaggggccctcggagggtatcccctgcgtccaagggagcgcccctccttttcagcactcgggggaactgagggcgacgtgccagccccgcactcaactttccccttccctgcaggcacagagttggccggcgggggcagaggaggagctgggtctccactgcgcccgtttaaacctggccaggggctgcgtttcctccccccaccccacgacgatcctttcttagtcttcgcttttcaacccaatcgttaatcattcggaacgcgcgggcggggagcggcgaggagggcgagctcggggttcgccgccgccgccgccgccgcgcgcgcgcgctcaggaagcggtgtggctgtcaccccctcc

SEQ ID NO: 35110 - DNA, 93 bp, Homo sapiens; identical to SEQ ID NO: 4060
  chr13:112722128-112722221
  hyper

SEQ ID NO: 35111 - DNA, 129 bp, Homo sapiens
  chr13:112722274-112722403
  hyper
cgacgaggccaagcggctgcgcgcgctgcacatgaaggagcacccggattacaagtaccggccgcgccgcaagaccaagacgctgctcaagaaggacaagtactcgctggccggcgggctcctggcggc

SEQ ID NO: 35112 - DNA, 111 bp, Homo sapiens
  chr13:112722871-112722982
  hyper
ggcggcggcggcggccgcgtcgtcgggcgccctgggcgcgctgggctctctggtgaagtcggagcccagcggcagcccgcccgccccagcgcactcgcgggcgccgtgccc

SEQ ID NO: 35113 - DNA, 236 bp, Homo sapiens
  chr13:112723488-112723724
  hyper
cccacttttgtataccggccggcgcgctcactttcctccgcgttgcttccggacggcgccgaccgccggagcccaagtgacgcggagctcgtcgcatttgttataaatgtagtaaggcaggtccaagcacttacaagttttttgtagttgttaccgctcttttgggttggtttgttaatttatacaaagagattaccaccaccaccccctccttcagacggcggagttatattctg

SEQ ID NO: 35114 - DNA, 363 bp, Homo sapiens
  chr13:112724172-112724535
  hyper
aagtatcttctgctccggctgtttcactgcggacggctggggctgctgcgcgttaccttgctgcaagcggggcgccttccacctggctgggggtctgcgccacagtttggtccagaggagggaggaggaagggaagaccccagtggtgggaccctggaccaggccatggatgaaggacaaagaccagggcaggtcacgggtttcccaattccccagcaattaagatttcgagcagaatttatctaaatgtgtttcaaggaaacacaatcgctgaaccaaaacgtactgcagccgagccccctccgtccatcctctgcccctccccctggcttctttctcttgggaaaacgggcaaaataattg

SEQ ID NO: 35115 - DNA, 30 bp, Homo sapiens
  chr13:112725438-112725468
  hyper
aggttctttgactgacgtccactctcagtc

SEQ ID NO: 35116 - DNA, 45 bp, Homo sapiens
  chr13:112725825-112725870
  hyper
ctatccccccttccccgcccccagcagtgtcgctccaattcaaat

SEQ ID NO: 35117 - DNA, 294 bp, Homo sapiens
  chr13:112726435-112726729
  hyper
cgtttcattcccccggcaaagactgggcgccgcagatttctgtctccggaaaattccagttaattcaagaaacccatccccggacgtgtgcccgcccccccccgaaggctcgcttcaggccagcccggactccagcgccccctcgaccccgtcgggctccggccgactcccgccccctccccacccacgctcggcctgggcccgggggcagcggctccagaggcgtcggcggcagaatttaacccccggtctgagtccttggaaacttcaagtgaaaagcagacttggccttgg

SEQ ID NO: 35118 - DNA, 378 bp, Homo sapiens
  chr13:112726796-112727174
  hyper
cggggtgcgggcccccagtatccggcggggtggggcggcgtcaggacggagcgagggccggcgggggggctcgcgtggaggcccaggccgggaggtggggacgcagggacccctcacccagtcctctgctcccgcccgagccaggcctcgggatcacctccccttgcctgagggcgagctctcctcctccctcttcctccccgcctcccccgttcttccctccctctctccctcctccctccccggcccttcctctccagctgcgcgcccgccgggaccacgctcctcccgcccccgggagccgagcggcgtctgcggctggtccggacgtgtcccctccgggcgggggtggccgggcctcctcggggcctcgggcct

SEQ ID NO: 35119 - DNA, 42 bp, Homo sapiens
  chr13:112727837-112727879
  hyper
cgaagggagggggaggggaggccgggtaccggccgggtccgg

SEQ ID NO: 35120 - DNA, 4 bp, Homo sapiens
  chr13:112727961-112727965
  hyper
cgca

SEQ ID NO: 35121 - DNA, 370 bp, Homo sapiens
  chr13:112758003-112758373
  hyper
ctcagcacctgcaggcggggggaccgcgcgcttggctcgaagaccccgccctgggcaggggacagaaaatatgaaatcagatggggagttatgaataactgtcctcccctcccctctgccgtgtttcctgaatccgtacgctatgcaggaggggggcgggggcgggggcgcggggaggaggagggggccgtttgccattaatctgggaacaagcggctaacctcggtgactggtattttcgcttttcttttctcacttttctcagtgtggggaaagcagtcaagcccgcgcggagcgattgtgaggggctctgctggaatttggcagcgcggaggcttggagagaagccccatgctggctcccattcagc

SEQ ID NO: 35122 - DNA, 196 bp, Homo sapiens; identical to SEQ ID NO: 1129
  chr13:112758495-112758691
  hyper

SEQ ID NO: 35123 - DNA, 670 bp, Homo sapiens
  chr13:112759111-112759781
  hyper
cgagtttggggtcgaggggcagttccctcccggagtcattaacttcgtctcctcgtgctcagggaccagcaacttggtgctgcgggcgccagaaagaaaagggtagcgcctcgcggagcgcgcgggggaagagggactgcggcagcgggacgcgagggcgggaggggcgcagcagcggggagccggagcgcagcggaggggagcgctggggggcggggagcgctcgggcagccaccctgtccccgtctggagccccgcgctgcgtctaggagggcgcaacacgcagtccccgcgggggccagagctcggagccccctagtgcatgccccctctcctcgcgccctgccgaggcctcggccctgcctgccgtgccctgggcctggttgtgcccgggggtccccgcgggcagggcgcggggcaggcagggcgcgcgcgccgacgctcttttgtctgataactaatttgagttaatgcgatctttatgtaaagctaacagcggataattgtctattttctcgccaacagtctccatcacaatcacttatctggaaacctgcggttggattaatcgttatattcccgagatgagcgtcgctgcaatccgcagcgaacgcgggtagggacctggagacgcctcccgggcgctggcggggccggtgtgggccagctc

SEQ ID NO: 35124 - DNA, 416 bp, Homo sapiens
  chr13:112760006-112760422
  hyper
cggggcctgggggggcccaggcgccggaggagccgtcggtgccggaatgcagcgtgtttcacttgggagaaacgttgccctcggtcccttgcctccctcctgttgtctcggtttttctggcttcgtccttcgtcccacccacccgttcccacctcaggtccctcccccaggatcccctccttaaggatccaggtctctgaaaattattggcaacagttacacgccccacgattgaaatccacaagagaagagtcccagttctgcaggccgctccagggctaggggtagagatggtggcaggtggtgcgtcaactctctagggaagaggaacttgcattacaaagacttgtctttctgagctgaagtcaaaacgggggcgtcaagcgcgctccgtttggcggcggtggaggggccgc

SEQ ID NO: 35125 - DNA, 492 bp, Homo sapiens
  chr13:112760850-112761342
  hyper
ggccaaggctctccccgcgttttcttctcgtgacctggggaatgtcccgccccatcgctcacctggctcttgtcatctcgctcatcttgaagtgacccgtggacaatgctgctccctgccgcagctccgccggtcactcaggcagaacggggtatgcaaatggcctggagaggccgaggccgaacactgcgcccattgtcccgggcgctcaaagcgccgagcagctgcgcagactttctgggctcggaccctcggccgccacgctaatgtcatcattgcaaaacatcagattttgagaactatgcagtctgaattcattagcagccttctcggcgaaggttcttttccccgtgacaagtttcaaagtccagaccccctccaacgttggtaggggtaggaagaggaggaggggcccagggaggggggtctttcgcaagtggggcctcgggggatccctgctctccttctggtgcattccgcaactttaaaagc

SEQ ID NO: 35126 - DNA, 69 bp, Homo sapiens
  chr13:113547082-113547151
  hyper
tgcagggtttctgcacgctggggagggcaggttccccagtggagccactccctgcgggtctgagtgggg

SEQ ID NO: 35127 - DNA, 132 bp, Homo sapiens
  chr13:114462866-114462998
  hyper
cgctgcagcctcggagccaggcaaaggctgggaaaacaggaaacctgttgcgtgttcaccagttcgcaagccgggctcgggggctctgccgggaagtggccaggactggaaggatgccgggtgtcttcctga

SEQ ID NO: 35128 - DNA, 32 bp, Homo sapiens
  chr14:21093506-21093538
  hyper
tgcaaactcctataacgtgtgtggtagtgtgg

SEQ ID NO: 35129 - DNA, 152 bp, Homo sapiens
  chr14:21093598-21093750
  hyper
ccaccactgccagtggtacgttttagcacaacaaggatcctgaagtactaacactttctaactagtaaaataattaaatcttcctttcccaggattctcccggattacacagcatcagttcctctgaattctgcattcgtaattaaaatcct

SEQ ID NO: 35130 - DNA, 30 bp, Homo sapiens
  chr14:21098864-21098894
  hyper
cagagcagaagccaccggcttggggtgaat

SEQ ID NO: 35131 - DNA, 378 bp, Homo sapiens
  chr14:21100629-21101007
  hyper
gcaacttttccccgacggcacctcctgggcgcccttgaaagacgccttaaatctaaacctataatacataggtaatcaactaaagctgaaagggaatggccaaagcacccacgtggagtgctgggtgctgtaggcgagaggtctgaggtagtggcttttagagctcaacatcttggtaatgttggttcgaccttttcccctgccagtcccgcggtgacctttatctttcggtgagtgaaatcggtcgttcgtgtttttcgtgggtcttccaaccacaggccgcctgagatggttctagtccctttgagtatacagacccttcctgtgcattgaccgacacagctcggcccggatcccgaaatgaacgtttctaccttc

SEQ ID NO: 35132 - DNA, 3 bp, Homo sapiens
  chr14:21101008-21101011
  hyper
gaa

SEQ ID NO: 35133 - DNA, 19 bp, Homo sapiens
  chr14:21101037-21101056
  hyper
cgcacgttgactttcctgg

SEQ ID NO: 35134 - DNA, 30 bp, Homo sapiens; identical to SEQ ID NO: 11759
  chr14:21121400-21121430
  hyper

SEQ ID NO: 35135 - DNA, 15 bp, Homo sapiens
  chr14:21121902-21121917
  hyper
ctcatcccccacccc

SEQ ID NO: 35136 - DNA, 292 bp, Homo sapiens
  chr14:21769054-21769346
  hyper
atgtcccaaataacccgtagaaataataactgtcatgaaaggagaagccacgtgctctatttgtccacaggctgaggaccaccttgctgcggttgaccgctgctggccgggacctgcgggtcgcggaggaggcggcgccgctctcggagaccgcaaggcgcgggcagaaggcgggatggcggcagcgcctctccatgcaccagcgcccccagatgcaccgactgcaagggcatttccactgcgtcggccctgccagcccccgccgcgcccagcctcgcgtccaagtgggaca

SEQ ID NO: 35137 - DNA, 139 bp, Homo sapiens
  chr14:21994200-21994339
  hyper
gctctgccggctccccgcagggcaccccgagacgagagctcctctcggattcgtgcgccatggttgtgggggaagtggagggccaggtggggtgggagacaatggatattgggattgagggaggcgatggccgctgggt

SEQ ID NO: 35138 - DNA, 88 bp, Homo sapiens
  chr14:23291857-23291945
  hyper
ccctgcataagctggcggccagacaggagtctgggcgagcgccccaacccctgaccacaactgcctccggccccgagatgcttggctg

SEQ ID NO: 35139 - DNA, 30 bp, Homo sapiens
  chr14:23652871-23652901
  hyper
cgtgcttctctttagcgaggggttttattc

SEQ ID NO: 35140 - DNA, 177 bp, Homo sapiens
  chr14:23821399-23821576
  hyper
cgtgaagatggggtccgaggccatgcccagagccacgaagagcaccggcaggcagcagaggccgagctgcagctgctggccgccgcccagcgcccccacctgggcgagcagcgcctcaaagctgagggggcctgggggcacggccagcgacaggctgctgcccagtccgtcgccgcc

SEQ ID NO: 35141 - DNA, 592 bp, Homo sapiens
  chr14:23821601-23822193
  hyper
cgctcccgctcaccctgcagctgctccgtgggcaccgcatctccgagggtcccgacctgctgttggggggcagggggtggcaggagaagggtgaagcggaggaaaccgcagagcaagggcagggggcaggtgggagggagggctaggaaggcagtcaggggcgagggatgcgcaggaggaaaatgccagacgctccgcgggggcgggggtgctgggagaggatggcgtcgccacctggggctcgggcacttactccgttggaggtgggggtgatctctacagtgttgtcgattttgccgccgcccccgccattgggctcgggggtcccggtggccacccggggagccagcttgccgaccgcaggggccctgccggcccgcgccgaaaggatgcgctgtcctctggctcagttgcgcgccggctgcccggacacagacagctcgaagagatcccgctctgcagctctgcagccgcgggcgcctccttggtctctgcgatctctgcgctgctttcccctccccttcctctagactctcctccccttcccacgtcagcagaaccttcggtccagactcttcgtcagagagaggaa

SEQ ID NO: 35142 - DNA, 444 bp, Homo sapiens
  chr14:24803473-24803917
  hyper
gaacccggacagaaacgagaagcatccaggactcagctttctccctgagcagacccagaagggtagagtgacttgcccagggtcactgcagttcctagccaggctcaatggtcctttctttctctgctcccagcaacgaaaacacatcgaaaagaagaccccacaaaccccaaccccgaaaatgctccccaggtagagaccctcccgcagcagaggctcggctcaccctgccgctggcccaggccactgcgagcagcgccgcgagcgcacagagcacgatccccagcagcagcagcagcagcgggtactgctggctcaggctgtagtaggtctcgtagaagaggtcttcgctggggggcggccgggggctgaagaggcgggccatgatctccccagccccgagccccggggctggctagggccgggcgccgggttacctccttc

SEQ ID NO: 35143 - DNA, 205 bp, Homo sapiens; identical to SEQ ID NO: 1132
  chr14:24803918-24804123
  hyper

SEQ ID NO: 35144 - DNA, 70 bp, Homo sapiens
  chr14:24804424-24804494
  hyper
cgcctccccgcttcagccccttcagggaagggcaatgtggaccctgggagagatgcgaaggggtgggctg

SEQ ID NO: 35145 - DNA, 36 bp, Homo sapiens
  chr14:24808711-24808747
  hyper
cccggaacactgtgccgaacccgcctttgccgacga

SEQ ID NO: 35146 - DNA, 30 bp, Homo sapiens
  chr14:24837774-24837804
  hyper
ggactcgttggcctgcggaagtgaggctgg

SEQ ID NO: 35147 - DNA, 234 bp, Homo sapiens
  chr14:25518435-25518669
  hyper
ggtgttggtgaggctcgatgccggcgtgcacggcaagcgcgaattcggaacctggcgcccttgaccaagcctgagatcggaaagggggcatcgcccagggccagcgccctgggggcagggtgccgtgcccgccagaaaagctcgcctcagttttggcagtaatgattttcctagaagatgccagagttcgcgaagatcggagtgattcgcggatttctgcgctcaagctagagg

SEQ ID NO: 35148 - DNA, 432 bp, Homo sapiens
  chr14:25519184-25519616
  hyper
cggacaaggcttagccggcccgggtgctggctcgccgccgctcgcggctcccgcgccggctcctgctgccgcgcgcgaaaagggaggggttggggggaaactcccggcaactccaactccgggcgctggagctccagctgcagccgcgcgcccgcccgccgccgagtgcgagcgcctgcgaagcaaacctgcccgcgcggccgcctctgagcatgctcagtgccgccgtgggcgagcccgagcgccctggcccggggcaaagagcagcggctaggggctgggggctgggggccgggacccgcgacccgccccaggcctcggagcgcggaggtggcagaggaagggaaaggccaatgtaggggcgggggccctgagccaaagacccgggagaaaccgatctgggtgcaagagccggtgcgactttcacggctt

SEQ ID NO: 35149 - DNA, 258 bp, Homo sapiens
  chr14:26674319-26674577
  hyper
agcccgactctggggcgtttgggaggtgggcctgaggtttgcctaggactcgagttcctttcaaaggaaggcgagagggagatggggagaaggagactcggagacttctctattaaagccgcgctgaactctagccttctggcaagccgcggcaagccgccaatttgaagtgtgtgagctttaatctgctcctagcctgatgggctcccgtgtccacagggagctgggaggcatccattacgccggaccaaggagatg

SEQ ID NO: 35150 - DNA, 110 bp, Homo sapiens
  chr14:27066218-27066328
  hyper
ggtcaacctctggaccgattaaatggaaagataggtctattccgaaaaactggtcgccattttgatgaatgataaacacagaaatggaaatgtgtcggggacacctaggc

SEQ ID NO: 35151 - DNA, 63 bp, Homo sapiens
  chr14:27066618-27066681
  hyper
ctggatgggagctgccgccatcatgtttgcagttcctgccgctgctaccgggagaaggttctc

SEQ ID NO: 35152 - DNA, 60 bp, Homo sapiens; identical to SEQ ID NO: 11772
  chr14:27067097-27067157
  hyper

SEQ ID NO: 35153 - DNA, 65 bp, Homo sapiens
  chr14:27067614-27067679
  hyper
aaggtcgctggtccccggcaacacggctcaggcaaacgtaagcggcttgtcgcagaaaccaaggg

SEQ ID NO: 35154 - DNA, 37 bp, Homo sapiens
  chr14:27068238-27068275
  hyper
gaactaaatattgaacgaaatacgagtgtcggaataa

SEQ ID NO: 35155 - DNA, 46 bp, Homo sapiens
  chr14:29224761-29224807
  hyper
ggggaaggctaacatcgccgttaatataatgcgggagaggaatgat

SEQ ID NO: 35156 - DNA, 237 bp, Homo sapiens
  chr14:29225531-29225768
  hyper
tttggaggagtggggcggggagacattcctggagggccagagcggggatcgcagcagaatctgcagcactggtgttaaggagaatttgagcgctcgaatgctgttgttaaatttcttcccagagccccatgctccctcgtttagcatctcccttccccaataattacttgagaggatgagctcgagattgaagagtgaggttggcttttctgtgtgaggagccgataggatccacca

SEQ ID NO: 35157 - DNA, 121 bp, Homo sapiens
  chr14:29226033-29226154
  hyper
gagatctcagatcttcgcgtttggggtggggagtgggggcgctggggaaaagtcgggaatagccccgcggtacctggggatcccagttgttttttctaagaaagcccggggttaaaaaatg

SEQ ID NO: 35158 - DNA, 207 bp, Homo sapiens
  chr14:29226360-29226567
  hyper
aagaaaatattgtgacgatgttgtagggcgaaaggggacgtgaggaggaaagggagggggagttagtttggagagcaatttgcaaaggaatattaactttgattcccgaggtcaccgcgggaaaaggggttctgggctgcagagctcttcctctaggtggcggactttggcaccaaacaaccgctagatgagcgctgacttcaaaca

SEQ ID NO: 35159 - DNA, 48 bp, Homo sapiens
  chr14:29227895-29227943
  hyper
cttctgcagccctggcgtggatatgcacgtgagcgaagtaaaagtcgc

SEQ ID NO: 35160 - DNA, 981 bp, Homo sapiens
  chr14:29228268-29229249
  hyper
ccctgttttgtgtttcgagcgggagagcagacactcagctcaaatagaggcctttctctcgtctttcggggtgtttattctatggccaaaaggtaagatggccaaggcagcgatctgagcgtgatgtctggccccgcggggggcccaggaggcccaagttgggacagctccggagctaccccggtgcccctcagctgggggagggcgcgcggcagccgcctgccagccccacaggctgctctccaaaggagctgggctttttcagcgtttctgtttccttgtagcctcatctatcttatctaacaagttcacgctccgggagaaaagaagagggtgagaaaaaaaaaaaagaaagaaaaaagaaaacctcttcaccgcggtgattcatagttcataggctccggagccaaacttgccgacccagcttttttctcgaacattactttctctcctacgtgccttaggacaaacccagaaggaagacactaaaattgccgaacaagaatctaggattgttttaaaaataaaagtgaccccccacagacacctttgatgttgttgattctgacacagaggagtcgagttgttttgtttacacatgctaacggtaacttgctcctgatgccgctctacgcgcagcttagtctgtcttctcctctcctccccgcaggcgactccttccaaagagcgagagagaaatacgggtattactgttatcccccactgggttcaataccccttacatgtaattgaatattcgaattaacgtcacctgcatgcaccccagtcttttaactctgaaatgtgctttatagcaatacagacttgaaacctttaactgttttctatatccccgcgtttaccgtggcagatgacctcttagcccaaaattgatttggtgtgtatccggtcttatgtgccaaaaaaagagatacctaggctgaaaaggcaactttaaggggggacatctagagagatgac

SEQ ID NO: 35161 - DNA, 468 bp, Homo sapiens
  chr14:29229250-29229718
  hyper
cctagaatcaaggcctctggctcgattgcgttcggcaagcgtctgcaacaaaggagcgtcgggcaagctcgcgggtatgcgcagggagcagcggcgcgcagacctgggagccccagctccgcgaagctcctcgaagggaaccctcgcagttacagcctcaagaggcaaggcaggggagggagaaaagctggacctcttgagaaacgctcctccaacagattttccatggcctcgtgttggagaaggggcgcgggggaggagcgagggttggggtaggaagacctactggaaccgactccggagagtgagggccaggtgggtgtaagatgagcacaaagtaaaaacttgcccattggtttgtccacgcaggtttcttgaaagaagcagatagatctgattagtagatactactttccccacgcaaagggagactttggggtgaagggttctctgcgtgcttcctggctt

SEQ ID NO: 35162 - DNA, 315 bp, Homo sapiens
  chr14:29230871-29231186
  hyper
cttttcttttggctgcgtacgtacttggcttcagagagcctggaacacctggcagcgtcacagagacttgcctggagagtcccaggggtctctgtcaaggccttctcctcatccttgtcctcttcctcctcctgctcctcttcttcgccttggactttctcccttttaaagtggctccctagcttacacaagctaaacatttccactctcatagacgaggctctcccatagatttttttactcgaggttctcaagcaaaattgccggtgccacaatgttatgatggaaggatgctgaaatgacaggcctagtaga

SEQ ID NO: 35163 - DNA, 213 bp, Homo sapiens
  chr14:29231283-29231496
  hyper
cgcccccggggacgttgagggtgcgcgtgcgcgcgctgagagcagccactgacaacctgcagctccctaatgagtgacgaggcagggctgctgcagaaaagtaacacttccctggtgtgaagacctcttactgagaagtttagttcactactgttctcgcaaacctaatcgtataacctgtaaccaaaacccacagaacgaggatacaacacg

SEQ ID NO: 35164 - DNA, 30 bp, Homo sapiens
  chr14:29231696-29231726
  hyper
ttagctagagcttggcgctgggtgccactc

SEQ ID NO: 35165 - DNA, 35 bp, Homo sapiens
  chr14:29234555-29234590
  hyper
tccttttaaagcccccgattcgcaatttccccatt

SEQ ID NO: 35166 - DNA, 456 bp, Homo sapiens
  chr14:29234853-29235309
  hyper
tgtcaacaagcaaaacgaaaatatttccagggtgatcgctcgcagctacccgcttccaattcggattagaagctgaggctggagcggcgaggagaaaacgacatcgagtcaccccgcgcgtgagcgacgctctggagcaggagagaaggaaaaggaagagacacacgtatatagcatgtgttacctgatttatttcgagattgtttggtactgttttctctctgggcacctctcatttcggaaggccatcagaggcgcccactactgagcggccccggccgccgcagcagcacccggagccccagtcccggtttccccgcggtgccggagcccggagctcgccgccgcccaggcctcaggaatcgagtaagtaacccctgtttggccccgcgctcctctgcccacttcctcctcctcatctcatcgctcccaaagctctcccacaccctcctcccc

SEQ ID NO: 35167 - DNA, 15 bp, Homo sapiens
  chr14:29235341-29235356
  hyper
cggtgggccttatct

SEQ ID NO: 35168 - DNA, 203 bp, Homo sapiens
  chr14:29236018-29236221
  hyper
ctgtctccccagcctcgccgcggccgctccgggacgcgcccgcccgccgcccggctctccccccctttgggctgctgctgctgctgctgtgactgctgctgcgagaggaggaggaggaggaggaagcagcgggggggggagcggggggtggggggggagaccaagaagtacagttgggagcgagggagcttcacccccggggc

SEQ ID NO: 35169 - DNA, 54 bp, Homo sapiens
  chr14:29236281-29236335
  hyper
tcctgaggggtggttgctgcttttgctacatgacttgccagcgcccgagcctgc

SEQ ID NO: 35170 - DNA, 371 bp, Homo sapiens
  chr14:29236413-29236784
  hyper
ggtcgccgccgcccgccgcgccgctgtcccgctcccgcgccgccgccgccgtttccccccgacgactgggtgatgctggacatgggagataggaaagaggtgaaaatgatccccaagtcctcgttcagcatcaacagcctggtgcccgaggcggtccagaacgacaaccaccacgcgagccacggccaccacaacagccaccacccccagcaccaccaccaccaccaccaccatcaccaccacccgccgccgcccgccccgcaaccgccgccgccgccgcagcagcagcagccgccgccgccgccgcccccggcaccgcagcccccccagacgcggggcgccccggccgccgacgacgacaagggccccca

SEQ ID NO: 35171 - DNA, 37 bp, Homo sapiens
  chr14:29237030-29237067
  hyper
gccgttcagctacaacgcgctcatcatgatggccatc

SEQ ID NO: 35172 - DNA, 77 bp, Homo sapiens
  chr14:29237139-29237216
  hyper
cgcgagaacaagcagggctggcagaactccatccgccacaatctgtccctcaacaagtgcttcgtgaaggtgccgcg

SEQ ID NO: 35173 - DNA, 317 bp, Homo sapiens
  chr14:29237573-29237890
  hyper
cgtggaccggctggtcaacggggagatcccgtacgccacgcaccacctcacggccgccgcgctagccgcctcggtgccctgcggcctgtcggtgccctgctctgggacctactccctcaacccctgctccgtcaacctgctcgcgggccagaccagttactttttcccccacgtcccgcacccgtcaatgacttcgcagagcagcacgtccatgagcgccagggccgcgtcctcctccacgtcgccgcaggccccctcgaccctgccctgtgagtctttaagaccctctttgccaagttttacgacgggactgtctg

SEQ ID NO: 35174 - DNA, 30 bp, Homo sapiens
  chr14:29242568-29242598
  hyper
ctgcctgaggttgtccgaaggatgccgagg

SEQ ID NO: 35175 - DNA, 63 bp, Homo sapiens; identical to SEQ ID NO: 11788
  chr14:29243208-29243271
  hyper

SEQ ID NO: 35176 - DNA, 157 bp, Homo sapiens
  chr14:29243513-29243670
  hyper
ttaattagcttttcccggcgcctcagggactccggggtgaagatggagaggtggcataatggcgggacttgaagtcgttgtggcagggacctggcagcgttgttttctcgggttttgaaccggtgtggagaagtaacttcagctgctgagttggggc

SEQ ID NO: 35177 - DNA, 524 bp, Homo sapiens
  chr14:29243730-29244254
  hyper
cgatccccgcagagggtgaagccgggcgctgcgcagggagcagcaacatgagggcgctcttgcccaggacaagcagagctgtacgtttgggtagctcatattggctgatgccaagaaaagtgacttcagaaccttggctggcgcgcttccctaccttttccctttcttcttaatcttctgtgtgccaccacctccccccaaccttttttcccctcccaaagttgtttccttttgtttacccggtgcggtttcagatctcagcacttctcagctagtagataaaattatttgctctgtaatggacatctcttctcctctccacttgttaccccactcgcccttcgctttctaccccattttgcttctctctgcccaagcctgtggtccaaggtgcagggatctcacaggaaaacaggtagcctcggggtgggaattcccagagcactgaaggcgccggttgttggccagagggaggccgggactccggtgggcagagtaccccgcgagtgcggagattttcaggc

SEQ ID NO: 35178 - DNA, 622 bp, Homo sapiens
  chr14:29247097-29247719
  hyper
atcttctcaccctggcgagttttcctgaaactacttatccttagcgtcagcgctgtaagaggtggagccgctcagtcccgcgggtggctgcagacagaaggtgggcgagtcctgggacttaaaaagttttgcagaaggttgaaaagaggagcagagggagagttttgagtttatttattttattttcctttttttttttttgtcttgtgccaagcccttgaagttaacgtagcgacgacgtggtccttgtaggaccaagcattcttggcattctgtcgagattgagattccagagcatcggatgaacgggacttatagctaaggcgtactcacccacccctcccttcgtctttttacgcacgcagcaactcgtcctcacgtgcataggggtagtggacagtgttgacttgaattgctgtccctcgttccaagcctttcctgtgaatgaacccgaaaacactcgacaggtcgtgaataatcgttttaatgagtgtgcaaagcgtgcgacggggtgcaccgagctgtcgggttaaacaaacaacttgtaccctgaccaaatccgattgttaaagtgcaaagtgatgtcagtaccatttccattgcctttcggaaatccacagat

SEQ ID NO: 35179 - DNA, 15 bp, Homo sapiens
  chr14:29254425-29254440
  hyper
ggcgcccgcagaagc

SEQ ID NO: 35180 - DNA, 522 bp, Homo sapiens
  chr14:29254611-29255133
  hyper
cgcgtccgccgggaccccgtccctctttccccttcagtcttcagggagggggaggcgctccgcattagcggggcagttcagcaaccccgaccccacccgcgtggctccaggcccaggggtccgttcacttccccgtccggtttgggggacgccaattcgcctaagaaaaccctggcagaagagcgcggacccttcactacaaacctcacgtcagggttacagccacatttaggaacctcttcggaaaagctgagaaatcactgttttgcaaaaagccttctgtactgtgatggggctttgtggtgagaggaacctctgagaagcctcgtgcggcttgagtttagagtcacgccctgcccagcgacattctcccgcgcacgggagaacctgcacttccggtctccaaccctcgcgggccgtgactcttcccctcccccgcgccgggccctgcatttccggcccccttgctctcctgcacttccgcccagtcacatggatgatggatagcgttgggagctgttt

SEQ ID NO: 35181 - DNA, 30 bp, Homo sapiens
  chr14:30396081-30396111
  hyper
cgctggtccagggtccgtaggggagagagg

SEQ ID NO: 35182 - DNA, 51 bp, Homo sapiens
  chr14:30396380-30396431
  hyper
gcggagagggccagccgggcagcgccccctgcgccgcggggaggcgccggg

SEQ ID NO: 35183 - DNA, 245 bp, Homo sapiens
  chr14:30396925-30397170
  hyper
ggaaaatggccgaggcgggaggactctgaggcccggaacgcggcagccggctcggggccgccggcactggggaggcgccgccgccgccaagaatctgccgcctggcgcgctcggaaggacggggcgacgggtcggcgcggcccgagcgccgggcgggggccggggcgggaagggggcgtgaggggcggggaaggggagctgggggcgggcactggggagccaccacccggcgggcgcgggagtcg

SEQ ID NO: 35184 - DNA, 39 bp, Homo sapiens
  chr14:30739946-30739985
  hyper
gttcacatcagcagtcgtcagcggcgatgtcaggcgccg

SEQ ID NO: 35185 - DNA, 623 bp, Homo sapiens
  chr14:31343352-31343975
  hyper
gttcggttctcaggccgcgtggacctgacagctctcagaagctccaggcctcgctgggtggggcgggtagcggccgccgctgcctcagcagccctggtcccggcagagcagggctggcgaggccgctgctgccgccgtcggggccgccggccctccacactcgttgagacgccggcacggggaccttcgtgcccctctagggactggcgccgcgtccaggtggccgagcctgcgctgctggaggaggcgcctccgcgccggcctcaccccggggccggcagggggcgaaggcggagctggaagtcgccgccgggccccgggggaccggctcccgcgcttcctcccgcgccccccgcacagtgctcatgcgcacggcccagcctttatagcggccgcgggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagaccta

SEQ ID NO: 35186 - DNA, 362 bp, Homo sapiens
  chr14:31344187-31344549
  hyper
cgcccctcacgaccccggccccttgctccgctgggtggaggctggagccagccctcacgcttctctcttcgcaggtgtgtgtctgctgctgctgccggggcccgcgggcagcgagggagccggtgagtgggggagctggggtgcgtccaggcggtcgcaggggctgagcaccagcgggtacaagcgggactcagatccagccccttgggcttcagccctaccgcctgaggaggaaggcgcgaaggttgagccgccgcgtggcgcgcccgcgttaacccctgcagccgatctgctcctgctcacctgtttctcccatggtagggggcccctggggtccagtggggggacgttctccaagagca

SEQ ID NO: 35187 - DNA, 40 bp, Homo sapiens
  chr14:32671453-32671493
  hyper
cccagtagacacctacgatgctgtccgggcctcccaccag

SEQ ID NO: 35188 - DNA, 232 bp, Homo sapiens
  chr14:33401993-33402225
  hyper
ttacgattctttttacgtgcaacacgtgggggacgaagcagtttcatatctcctggtattatctgccgtccaaagcattttctttgaaaggaaaatggaaacgcagctgcgccgtgggcccggccagcgagagctggggctccctccctctgtttcccagcggctgccgggtgcaggaggcgcctccggaaactgacttgggttaggggagttcagaggttgccccagcagg

SEQ ID NO: 35189 - DNA, 145 bp, Homo sapiens
  chr14:33402367-33402512
  hyper
cggcctgtgtcactcttggccttggcaacttctggccaatccgccctgcccctctgggtcccggcgggccggctgcgccctaggctcaaagggttaagcaggtgcctctccgggcgaggcgctattggccgagggctggggcggc

SEQ ID NO: 35190 - DNA, 404 bp, Homo sapiens
  chr14:33402513-33402917
  hyper
cggccgcggtcaccacgcttcgccgatcccaacttgggttcctgcggaaggcaaggcggccactcgtcccctggctgcggctgcggggcccaggccttggcgcgcagggagtgggaaggagaaaaggacgagaaggggcaagcaccagccgcaccagcaaagggggcgagggtggcgcgcgcaagatgaggggagctgaagccctgcatcccgaaggaggctgcgcccaccgcccgcaactccactccaggctcgccagccggaagaaagaggaggaagtgggacaacgggggtcctgggcaggggtaggggaaacgatcaactcccactgcccccacccactagtcgagttggaatgcaagtcgtcacttaaaaaggctcacccaaaccgcaggcatacctcc

SEQ ID NO: 35191 - DNA, 631 bp, Homo sapiens
  chr14:33403270-33403901
  hyper
taagtatcaagttctcgaggagcccaacttgcgcttggcagccctcgcgctgcctgatgtgcataagacgggcagagaggggttccggccaggaagggaggctctacgtccccattcctgcacacgcgggctggcttccaggttgctggaagccgcgggaggcgcgagcttgcctggatggtggttatttctctagagaaaggaggagagagagagcgcgcctgagtcttgcactttgggtcggaagtgcgcggcgtgtgtgtgtgtgtgtgtgtgtgtgtgtgtagaggggggcgggaaagaaacgcaccctccgctgccggtcattcccttgcaccggccaagtcctcgccaagcctcccggtgcatccttcctccgccaccccctccccttcttccctcagctgggctcgcgcggcgcagccggagcagccagtgagagcaacatcctggaaagaggggggagcaccgccgccccccaaaagggaaaaaaggccccaccctgacacgttttgctgtttgcaagtccctcgcacgccccccgcacctcctcctcgcgcttgcggccccccccacccccagcccgctgcgcgcacatcaaagctcctctccgccgcgcacagtggccgcg

SEQ ID NO: 35192 - DNA, 269 bp, Homo sapiens
  chr14:33404149-33404418
  hyper
cggcgccgcggccaacggcaccccgcagaacgtccagggcatcacctcctaccagcagcggtgagtagtcccgcctgggctgggatagtgcccccgccccggggtgctggggtgggactcactttgcctcctgttttgtgtcttacaacacacatgcacattgccagggctcactttgcctgcccctcgttctacagatgaggaagaaaaacacacttcactttggtggattgaaaagcactccagtgcgctggcgaagtgaaatcatc

SEQ ID NO: 35193 - DNA, 30 bp, Homo sapiens
  chr14:33407749-33407779
  hyper
ctgcgtacgagagagcgctctggagcaaag

SEQ ID NO: 35194 - DNA, 60 bp, Homo sapiens
  chr14:33408303-33408363
  hyper
cccacctcagcagcacggccgccgccgccgccgccgccgccgccacggccacggccacgg

SEQ ID NO: 35195 - DNA, 55 bp, Homo sapiens
  chr14:33408623-33408678
  hyper
cgccgcctccgccgccgagggcccctctccgcagcccgcccgcctcctgggccgc

SEQ ID NO: 35196 - DNA, 177 bp, Homo sapiens
  chr14:34419561-34419738
  hyper
ccgcgggagcagctgcggcagggcgccgagcgcgtcctaccttagacctctccttgacgtagtatttgcccagccggctcccgcagtagaggaccagcctgtcgatgagggacaggaggaagctgatggcctcgcagccctcctcgttgcccccgatccacgtgatctggtcgcccc

SEQ ID NO: 35197 - DNA, 182 bp, Homo sapiens
  chr14:34529691-34529873
  hyper
ctcgccttccctgggcggagtccccatcggtgcctgcccgcccggaagtaggggcgcgagggtgacgggcaagaccgagcccggcccgtgattcttcctcagccggagctcgaccttctccttgtcccttgcgtttcctttctttgaaccacacactcgctcgctcacgtttgtcccgacta

SEQ ID NO: 35198 - DNA, 151 bp, Homo sapiens
  chr14:36003806-36003957
  hyper
ggcgcagagctgcgtcgggcgttcctggagcgctgcctcagctcgcccgtctccgccgagtctttccccgggggcgccgccgccgtggccgctttctcctgctccgtggcgccagcagccgcaccgaccccgggggagcagtttctgctgc

SEQ ID NO: 35199 - DNA, 655 bp, Homo sapiens; identical to SEQ ID NO: 4075
  chr14:36004080-36004735
  hyper

SEQ ID NO: 35200 - DNA, 101 bp, Homo sapiens; identical to SEQ ID NO: 4076
  chr14:36004821-36004922
  hyper

SEQ ID NO: 35201 - DNA, 206 bp, Homo sapiens
  chr14:36972706-36972912
  hyper
ctgactttattcttacggaattaaacacaataatttttttaaaatatcttctttgaggcaagtgaccacgagagcacctgttatttaaaagtttattgggtagtttaaaaagcggtgtctccctcttcccccttcaaaaataaatggcattgaagtcctccgtttctcttgtttagatcctgcggttggctcgctcatgaatatta

SEQ ID NO: 35202 - DNA, 12 bp, Homo sapiens
  chr14:36973210-36973222
  hyper
ccctgcgcagcc

SEQ ID NO: 35203 - DNA, 412 bp, Homo sapiens
  chr14:36973454-36973866
  hyper
ggaacgcaggctgaggtcaggctgaccacgccgcctcctcagtcgccgtatcgcggggctggcggccagcgccttagaagagcctgctccgccgcaggaagaaagacgcccgacaggcgcccactgcccgaacccacgcgggggccagtcagccagcgggccgtgttgggaaagctccgcgcggcggcgggacataggatccccatcggggacctgggcgacggcctgagcttgggcgcccctccagctgggcgtcatctccacacagttcttcccttgcgccgcgaattcagcccctgtgaagacgctttgggcattggcgagcaacaggggaaaaaacgagtcacttaaatgggagaaggaaggggatggtcatgaggacttggaggaaaccacacggaaaagaaatcct

SEQ ID NO: 35204 - DNA, 267 bp, Homo sapiens
  chr14:36974533-36974800
  hyper
tagaaatctttgcctcggaaattatcggagaatattaacggagagggaggggagcgcgcgggtcgccgaggaaggacgcgggtacggccccttgctttggggtggcagagccgggctcaggagccagccaagctgacttcgcgaggtggcgcctgggcctttcgggggaaagccccgacggcggagccgcggctgggcggggactcaaatgctggcggcctctgggctggggccgagcagggggtgccgaccgcgggaagtctgggc

SEQ ID NO: 35205 - DNA, 127 bp, Homo sapiens
  chr14:36974801-36974928
  hyper
gccgccctcccacccagacgagccgatgctgggccgcggtccctctcagctacctcgcttgcccgcctcggggcccctggagaggggtctgtgcctcccaggcagggaagcgtcttgatgtgcaccc

SEQ ID NO: 35206 - DNA, 262 bp, Homo sapiens
  chr14:36974967-36975229
  hyper
cgatgtcatgctgggtattaaaagggttgtgctgcagctaaaatatctcacagtgtgtgtgaacctcataaaagggaggacccggattccaagcccctcgaagtccccaagcagcctggagggtgggggactcccctctccttctctccacactgagcccccgggcaagcccaggcctcctcctgcgccggggtccccgggctccgaaactgcgagagccctgcggagcccggccagaggggcagagggtgggggctggggg

SEQ ID NO: 35207 - DNA, 177 bp, Homo sapiens
  chr14:36975280-36975457
  hyper
cggggagccgggatccgccttccatcctgggaaacgactcgggttagggaagcgggatgggctccgctcggagttcccaggcagctggggcgccctccaagtgacgcctttgtccaggctgcgctcgcggagaataaagggggcgctgtccaacctcaggttcggggaaaaccaagg

SEQ ID NO: 35208 - DNA, 427 bp, Homo sapiens; identical to SEQ ID NO: 4079
  chr14:36977503-36977930
  hyper

SEQ ID NO: 35209 - DNA, 26 bp, Homo sapiens
  chr14:36977974-36978000
  hyper
cgcagactccccgccagtcccggcca

SEQ ID NO: 35210 - DNA, 30 bp, Homo sapiens
  chr14:36978658-36978688
  hyper
acaccaccacccagccgtctcccaggccct

SEQ ID NO: 35211 - DNA, 67 bp, Homo sapiens
  chr14:36979742-36979809
  hyper
gggtctcctgggttgcggcagagcgtgcagtcagctcagaggaactagctctcggtcctcttagtgt

SEQ ID NO: 35212 - DNA, 244 bp, Homo sapiens
  chr14:36981839-36982083
  hyper
gaacatggtgtccagcgtctcctaaccaggatctagccgagcagagaaaacattcagcctcctccctcccaatacccgtgtctgtcactttctttccattcaaaaagaaagtcctagttgaactaaacaagccagtaacccatgcctaagaatcatatcatctcagattctcatctcccaatgggctttctagttctccacaaataaaatcgtctactctgcttcctcgcgctaataattgggg

SEQ ID NO: 35213 - DNA, 294 bp, Homo sapiens
  chr14:36982402-36982696
  hyper
tgtgcactcgcgcctcgagatagcccctcactgacgcctggacgcggtgagcgcgctgaaggctgtgcggcctctaaagtctcagaattcctccctgcggcctcaaaattggagagttggattccagaccaagacactgtcactagagctccctagccctggcccaggaagatttaaaatcccttaaaatcccttagacttgctcccgagcaagtctttccctatgaaaggccaaactctaagcttcgtgaagaagcctcctacaaggacactggtctggagcgcccgggcctc

SEQ ID NO: 35214 - DNA, 288 bp, Homo sapiens
  chr14:36983130-36983418
  hyper
gctctccaaggctctcgagaaagtcctagtgtttacatggcgaagtgggggtggggagaggaggaaggggggtgcagtgtgcaaaatctcccccactcctctcagccgttggggcctagggatgggtagggtactttggcggaggcaaagcttcgcggtgatctcggggtgaaccgtacttgctcccaaacctcggaagcttccaagcacctcagcgccaggggcatcctcagaatgctgatttctccgagaggggaggccagaaattgggcacgagttgatgcagga

SEQ ID NO: 35215 - DNA, 585 bp, Homo sapiens
  chr14:36983678-36984263
  hyper
gagttcacctttccccgggacaagtaaacagacttcaaactatgccgactgtagacggcgaggagaagaatgtatttgatggaaactccatccaatgcaaagatgataaggccgagggtgccacagcctactaaaattgtgactcccaaaggcttcctcccagctagaatggggtgcggggcagccgccagaaccacagccgggcaccgccagccaggtccccgcccgggcttgggctaggctggggcaggttaagcgaagctccaattccgtgggatccggacctagagccaaacagcagctgcagtatccatgtcccctgcccggccggcctgagctgggtgccttagccacctacactcccggtcccggaaccacagctgaccattccaacgcaagtggtcaaatttgtttgttttccaaaacgtgagacctgttaaaatctcccttccccgccttccaacaagcactctcactagacccaaccatcctcttgggaatcttcgagtccctctggctgttggaaactgtgtctcagcagtgaggcccaggtttctgagggagaaagcccggcctagcccacag

SEQ ID NO: 35216 - DNA, 30 bp, Homo sapiens; identical to SEQ ID NO: 11812
  chr14:36985841-36985871
  hyper

SEQ ID NO: 35217 - DNA, 244 bp, Homo sapiens
  chr14:36986228-36986472
  hyper
ccttgagattggatgcgcttggttgtttttcattttctttttttaaaaaaaaaaacccacaaattttagggggggaaaaaaagaaagacgtccagcagtttggcctttgtggtttttttgttccttggtctaaacgcggccaggttgttaagaaaagtcgaagcgcgtggagcagcggtggatggtggtctgtgtggcgggcaggagggaagcggtgaggcagagcgctgggctagggccggcc

SEQ ID NO: 35218 - DNA, 384 bp, Homo sapiens
  chr14:36987301-36987685
  hyper
gcccggcccgccccaaccgacggcgccctcctgacccaggcagcctagcgctggggcccaagaggcccatccgcggggaactgccagcgcctgccccaggccgtaccgtcgagggggctgtactggagcgctcacagccccaaccctggctgccctccctcagtctcagttccctctttcgaaccaaaagacgcagtgggggaaaggccgcttctgctcctttcgtgcccagcccgggtcagagcattaggattagctggccacaggcggcgaactgggctcaggccgggagctggggtcctacggtagaccccagtttggagaggttaggagagggggtgttgacttccaaaagctggagcccccagacgctttgcctcttgg

SEQ ID NO: 35219 - DNA, 214 bp, Homo sapiens
  chr14:36987939-36988153
  hyper
accgcgcctaggagacgccgagtacccgcatctgaccgcaggaccccagcgctaccaagtgcctgttcttggacccccagccgagcagggggaagcatccccagctcccgcacccaagtccctggcgccgctgccgggccgccctccctgatgcccagcgcgcagcctgccggcgccgcgccttctggacggctctcgccgcacctcctgagct

SEQ ID NO: 35220 - DNA, 38 bp, Homo sapiens
  chr14:36988606-36988644
  hyper
gggagagggggaaggcgaagcctcgctgcttttttttt

SEQ ID NO: 35221 - DNA, 36 bp, Homo sapiens
  chr14:36989186-36989222
  hyper
tcggtcggggttccccgggcacggacaggtctttag

SEQ ID NO: 35222 - DNA, 829 bp, Homo sapiens
  chr14:36989705-36990534
  hyper
tgggaaggggtctcacgggagggtccgtcactgaagttgccccacctcgaacaaacctggtgtccctgaccctcgcccatctcccagacacgcggggatctggggctggagctgactttccgaggacatcacagccccagcacccgagcccagagccacgctgttttcccctctgatgcttcagggagcgcgcgagcagggagcggcgtgagtgcccgtctgtctgttgccgggcggaactgagcctgaaccccggcggctggagcgctggccaggagggggcgaatgccgaggtgcgggcagctcagcgggcgggaggctgggccgaggctcgcctccgcccgcagctcagccatgcaaaagtgctcttgcttcccgggaataaccaaatatctttgtttaaagtggtggcgtaaatggccagtcgctttgtggccacgctggatattagtagatgaggatcattctgcttcaattgggcgcctctcatccgacgagcaagaaactgcttaggaggaagagggtttcctgtctgcgcgttcccaggcttcaagtgtgggccccgcgccttgagggtccttgggcgcctggcgagggggagctgtgggctgcgctccccagcggaatcgggggtgtcccccgcgttgctccggccaggccggggcctgcagccgagtcgactaccgagtggagcactgaacggcgcggattttgagaccgactccggtttttgtccttggattttaaacgtttttatcattgtttttgttttgctttctccttagctgttttagtctcctctgcgcgccaggggctgggagggcggagc

SEQ ID NO: 35223 - DNA, 498 bp, Homo sapiens
  chr14:36990535-36991033
  hyper
ctccccggccggccccggcaggtgcctccaagacacccgcgctggtcaaggagcttcttgaatttagtttttgttttcacattttctttcccctccttgtagagaaggagctcctgatcatgacgaacaggcagttttgagctacttaattcatccgggctccctttttttattaatagcaattacagtagagaaagttttatttatttttaaagatttcagccctctccttgaagagagctcttactccctcaatacaaagccaacttctataataacattcgcttttctcaccgcctaccttctttaccagggtaaagaaagctcaggacaccctccgccctcccacctgcgcccgcgtttttgtgcggtccccacggcagagctggggaggccaccctacgtttgcgcagggagacgcgctcgccgctggtgttgcgaaagaccagagcgaagcccggctccttgcccttccttcccaggggcttctctgggggg

SEQ ID NO: 35224 - DNA, 105 bp, Homo sapiens
  chr14:36991094-36991199
  hyper
cgacgccgggcttaagcgaaccacagaggagaactggcaacgctgaatacagaccttgtctgcaggcgcgacctggccgggcctgagtcccgaatggggtctaat

SEQ ID NO: 35225 - DNA, 199 bp, Homo sapiens
  chr14:36991579-36991778
  hyper
tcagcaggccacaggcgcacgtggctggcagctccccggcctccggctctgacagtccgggggcaaccaggcctgcagttctcgaggaaacccccagccccccacgtctcgttctggaccaggaaccccctccccaacaaccgcgcagcaagtggcgactctgggagctgaactggagtggagctcgaagtggctgggg

SEQ ID NO: 35226 - DNA, 176 bp, Homo sapiens
  chr14:36991988-36992164
  hyper
cgaaaataagcccggagactaacgcaccttgtagggaagagaaggacatctgtatctccaagcttatccaagcaaaggcctccagagtccctcccatggcccgaaacacctccctctgaccgaagagcgtcctttctttccgccgcctcctggactcatcctaaatagggcagacc

SEQ ID NO: 35227 - DNA, 280 bp, Homo sapiens
  chr14:36992221-36992501
  hyper
cgaagtctgcgcgtattcctttatcccgcaactagcttgctcccgggtggagtgggcacagtggggagcggtcagggcagggcagggcccaacgctggcccctcgcggagctttccctggcgcgacctcacacggtcgctgcctctattccgaccacgctctgcttcgctggctgcggctccgccaggaatccgagggggcgcaggcccaggctcggccctagatgcgcggaatcgccatcagcctttgcttacaccagcgtggccgcagggaaactcct

SEQ ID NO: 35228 - DNA, 50 bp, Homo sapiens; identical to SEQ ID NO: 11824
  chr14:36993438-36993488
  hyper

SEQ ID NO: 35229 - DNA, 263 bp, Homo sapiens
  chr14:36993693-36993956
  hyper
cgcgggagcccggggcgtgcagacaggcggctttcacagacgcagcgggaggaaggatccctctactgctccctttcccgatttgaccgtctagggcctttgagaggactttccttttgggaaagcttttctcaattcgtggcctgtgggcaggctggggggtggggcgccaagtcatccgagcgcggcttctgcttctccctttccctcacaggcatgctctacggagggtatgggaggcgagggcgcgtctatgagggcca

SEQ ID NO: 35230 - DNA, 706 bp, Homo sapiens
  chr14:36994303-36995009
  hyper
cgaccctgtgaggcccgcgctgccgtgctacgccgcgaatccgccagacgcccccgtcggaaggggcagggacaccctcgggggcgctctagggttcgtgctgcgctaaggtaagtttcgcagctgctcctgataattaaaggacagattcccgaagcatccttgtggcggcgcggctgttttcgccccaggacctgtgcagcctcattcagctttaggtagtcgaaacctatagctctttctgccctctgttccccaacaaatctcagtcccaacagtgggagcccgtgggccttgggtgttcgagtttcccgcgggcttgccagcagcgctggggttccctcctccgctcctttcctcctctccaacctcccaccacagcccgtctcccccacatccccaacacttgtcccaggcagtttccggtggccgcagtatcgaccccaggccattggggtgggtgtgagggaagggtggagggggaatctccgaggcccaatgttttctgggacttgagggaggctgaattctccctcgctgcctaggacttggggtctgaaggttgcagaccgaggcgatccgcagcgccctcttccggcggccgtctggagaactgcagctttagagcggtctcggggaagctttgctactagtttccggctagggaaaactggtggtggtcggagactggtagtacatcatccac

SEQ ID NO: 35231 - DNA, 63 bp, Homo sapiens
  chr14:36995010-36995073
  hyper
cattcgctcattctaactgtccgcccgaccatacgtcaggctgtctatcggtccacccaaagc

SEQ ID NO: 35232 - DNA, 84 bp, Homo sapiens
  chr14:37051112-37051196
  hyper
ggcatggagagggggcggggggtggggtgggggcggcaggtggcggcgcgttttaaatttcaattattccgacctctagaaatc

SEQ ID NO: 35233 - DNA, 30 bp, Homo sapiens
  chr14:37051599-37051629
  hyper
aggaggggaaggaggcgggggcagggcagg

SEQ ID NO: 35234 - DNA, 30 bp, Homo sapiens
  chr14:37051933-37051963
  hyper
agcatttggcattagcgattctgtctgatt

SEQ ID NO: 35235 - DNA, 190 bp, Homo sapiens; identical to SEQ ID NO: 4091
  chr14:37116105-37116295
  hyper

SEQ ID NO: 35236 - DNA, 387 bp, Homo sapiens; identical to SEQ ID NO: 11829
  chr14:37116983-37117370
  hyper

SEQ ID NO: 35237 - DNA, 511 bp, Homo sapiens
  chr14:37123566-37124077
  hyper
ggcgtaggatccctgcgcaggaggttgcaggaatgcccccgctagccgcaaggttcctgctggcctgtagagctttcgtgatccccgccaagatgcgaacagtaaggtcctcgtatggatcgcagtttttgtccgaaacctgaaaacactaacttgggatttcgcagttctggccctcgggcccgcctcggaggcgcacccccaatccccacggaacgaattccgcggctaaaatgcattttcccaaggcagtaaaagtgacccctgcacctaacaacctttgggctttctcttctcctgactaccacctctcgcagggtgcgctgaaatctctttatcgttatcgttttttataaatgaaatgatttatttattcgctgtttgcagggaatgaaaggagttgatcctgactccaagatgcattccaaagaaagaaaacgcaactgtagcccggactccgcggaggaaggccaactgactccactacgtgcacttccgagccacttgggcc

SEQ ID NO: 35238 - DNA, 91 bp, Homo sapiens; identical to SEQ ID NO: 1143
  chr14:37124481-37124572
  hyper

SEQ ID NO: 35239 - DNA, 664 bp, Homo sapiens
  chr14:37124988-37125652
  hyper
ggccgcaagagaatccgcccggtagggcatagaagatgggttttcggtgaatcgtgaaaagacatgatcgggtttcccttggagcatggtggagaatgatgcggagccttggggtcaatggagagttgagggtgcagagggatctgaaagggggaaccaaaaatatcgggctttgaaattctgtggattttcaaaggcggttcccaaccttgtcaaaaactacagtgggtgcgcgatctaatctggctcctataggtggcgctgtgacaaggtgcggtggccgggagaggcggctgggggactcgaagactgcgggaaattttctgcgactccgacgctaacccgctgctcccagcctccgcttcctgttttcgagggattagctaggactgtgcaacaccagtctccgctctcggagtcggcacgggggctggtgggtggcgggatgaactcggggaaggcgacaggctggaaacgcagctcctcgactttgcagcgcaccaaccccctatcgccccgtccgctgctcaggtgcgaggattcgccagacgccacaggactgggggcgactcgcaagggcatcatgccacctagaggaaacgcgcagtgagtgagccctgggtcactgaaaatgggagaacgttcgagtcggtcaagatgactc

SEQ ID NO: 35240 - DNA, 165 bp, Homo sapiens
  chr14:37125763-37125928
  hyper
cgtccggctctgatcagagtacagcgggctgggcctggcagcctgcaggcaacctggaccttgcaataaagctgcattcaacataactcagaccacagtgggagcccccgaagggcttcatgtgagtcccgaaaccagagtttagaggcgcggcctggttctcgt

SEQ ID NO: 35241 - DNA, 558 bp, Homo sapiens
  chr14:37126156-37126714
  hyper
gcaaccctggcaagacgaaatccccctccctctggctagatcagcccagcctcccctcagggaccttcctgcccctccctacccctccctacccctaggccgctccccccttcctctgttgggatccgatccttgttcgctcttgcaatcccgcagcccggagttttgccccgtgcattaaaacatgttctctttcatttgcagatttaataaacaaacgtaaccatatcacatggagctccacactgtccttctgaaagcaattccgctgttgaaaactgaaaaatgggtgtaatttgctttcagaaagtaatgttagggtcacggcaatttctcgggccgttatttatttttactttaaagtctttaggaaagatttgcttatatgctcggaaaacttccaaatgcgcgaataccagcaatcccgctcgccttcaacgcgtggggtaagggggggtggggaacaattactgagtgacgctaatatggggaaactgaaaagaaatgtcgattgtttttattgtaatagaaggagtgagcaaacagaaaaaccaaccc

SEQ ID NO: 35242 - DNA, 816 bp, Homo sapiens
  chr14:37126964-37127780
  hyper
cgtgaggctccttgatgagaaggtggagaggctgccgggctattctccgagcatcttccggccgagctctgctcctctccgtgcgcttgcggcttctccttgggctagcgcgtccgcagtccctccaagtccaggccgcaggtcagtgtgcgggcgcctcctgtcctcctctcccaccagaggacccctgagggctgtctccatccccaatccccgcgactgctccttttagccgccatcccctcccgcagcgcagatcctgcaggggccagcggtccagggcggaccctccctcgccctgggcgcggggcgagcttctggctgtcacttgccgctgcagtttcagggaaactcagctggccgcttaccctgcaagacggggacatagcagagggccgagttctggagaagctgggcttgtttttctctctgcaccgcgcgcaatgccccaactgaccctgaagggtcttgcctttactgcatttgcccccagacggctagaagtcaatgcactatgaaaatcccagtcccggacctcggactctggctgtcttacaatccctgcaactcctccgagtggacaagaggcgggcaccgtcgcctgggcctcgcttggggggggggggtcctgtccccagcagggggcaagttggaggaatcagctccttaatattttctgctagctctgcttgtcataactgcaactcggaatagaacaacctctctcccgtgcatacgcacccccaactctcgccctatcctcccatccacagtcatcactgacctgtagacccggaggagcaggcttccgggggt

SEQ ID NO: 35243 - DNA, 506 bp, Homo sapiens
  chr14:37130077-37130583
  hyper
cagaagtaggcagaacgacagggcctctggagcttaatggaagacgagggaattacatccatgtgcagcgtcggtgtccactgtcttgggactaagtctctttcatatttaaacaaaactctttcgagagggctcgctggtttggagaaccctcacaaacgctgccaccgagggccaggggcccaggacagtggctgaatgtggcagagccttgggctccgtagtgagtgccccacgcactggcaattggtcgacttggggctgtgcgctagcgttagccgcctgtggttcagttccccgcacacggcgtggcccgtgcctcgagcctgtgtggctagtggttggccggtccacctggactggggggtcgccgcaggaagctggcggtaggaggaacctccctggccttaacagtggcccccacctgtggctcgggctccccgcaacctcctggtttctttggccggcctatcttctcacacctgcgctctcgccacctggcatgg

SEQ ID NO: 35244 - DNA, 30 bp, Homo sapiens
  chr14:37131143-37131173
  hyper
ttccttttgccctctcgcctcctcctcctg

SEQ ID NO: 35245 - DNA, 264 bp, Homo sapiens; identical to SEQ ID NO: 1144
  chr14:37132290-37132554
  hyper

SEQ ID NO: 35246 - DNA, 697 bp, Homo sapiens
  chr14:37132602-37133299
  hyper
cggccgccaaggtgcccacgccacccggggtgcctgccatccccggttcggtggccatgccgcgcacctggccctcctcgcactccgtcaccgacatcctgggcatccgctccatcaccgaccaaggtaggggctcagaggctgggcgtgtggatgtgcagcgtctgcccccgcactctcgcggaggtcccagtatctgcagcctcagggacactgtctttcccaccacctgaggctttttcctttggaaacgtaaggagtcttcctagggggtgttctgatctcattaacttgaaactcatgcccctggtttccttgccacacacagtcttctgcctcatctcaaactaccagacccataacatccccccatccccaacacatggttcgcattttccaccctcccccgcctctcgcgccgaggcagcctcagcccggcttgctcacttggagagtgcggccggggctggacttggggcgcagcccgggaggcccgagcctgcttggggctgccggctgcagactccgctgtgggcagagcagcttgcttggggatcactacggccgggagaagtctggccgggaggagtccagcacgccttggaaattgaagtattctccgattctggtaatcaggccaaatttgctcaggcaggaagttcaaatgtcacctaattggtttcgttcttatgcttca

SEQ ID NO: 35247 - DNA, 86 bp, Homo sapiens
  chr14:37133668-37133754
  hyper
ttgcctagtcctaagcgtcctttctgccttgtcagaaggattccccgagccctcctgcccagtccggcttccgcaggagacctgag

SEQ ID NO: 35248 - DNA, 12 bp, Homo sapiens
  chr14:37135739-37135751
  hyper
cgccgccccgca

SEQ ID NO: 35249 - DNA, 324 bp, Homo sapiens
  chr14:37136294-37136618
  hyper
gttcggactttctctccggtggctctcggacaaacacgcttggccaatcctgcggagaggggcacccagataaacgtaacaaagctaccattttctcgactaaaggtcacattgtaatctcccaaggaagttagtgagaaaacctcaaattatacggactggctgtggaccgtttaatttttctttccctccgtccctccctcatgtctccaaaggaaaatttaaaacactcgtgtttttattttccccccgagaaaagctaaacaaccaccacaacaaaagccccagatttaagtctaaattcatcaccgtcctggagtcaag

SEQ ID NO: 35250 - DNA, 170 bp, Homo sapiens
  chr14:37666822-37666992
  hyper
gaggccacaagacaccgtttttagttccgcgttctccctcttctaatcctattaggttttgtccagacaacgttttgctctttcagaagagaaagagcgttctgcgctcgtcgtcttggattcgacaaccataagcatcccgttagggcaaccaccgcagcagactaagt

SEQ ID NO: 35251 - DNA, 112 bp, Homo sapiens
  chr14:38052852-38052964
  hyper
ttccttgccaggttgcgggtacagccagctccgcgccggggttgggcggcgcggccgggatgctgagagccctgcgtgctcagccaggggcgcagggcggcccttctgccca

SEQ ID NO: 35252 - DNA, 95 bp, Homo sapiens
  chr14:38057238-38057333
  hyper
gtggaaacacccagacgaaaaggggatggggtgggggtcgcaggaaggcggcgccctcaggcagggtctccgcactccctcggaaccacagatgt

SEQ ID NO: 35253 - DNA, 273 bp, Homo sapiens
  chr14:38060644-38060917
  hyper
gctcctggtggtcaccgaggcgctgcctagaggcaggctggcgggcaacgtagagccgtaaggcgagtattgcagtgcctgttcgtatgccttgaagtccagcttatgctgctgctccgaggaggacatgaggttgttgatggagaacgggtggttgaaggagtagtgggggtcccctttcaggtgcagctgggactcgtggggtgccaagccgtgtgccgggtgagaggcgggcacagaggccagcgccccgggcccggagcttatgggggg

SEQ ID NO: 35254 - DNA, 45 bp, Homo sapiens
  chr14:38062015-38062060
  hyper
gcactttgcagaacacgggacgcccccacccggggcaaatggcta

SEQ ID NO: 35255 - DNA, 128 bp, Homo sapiens
  chr14:38072551-38072679
  hyper
gagagtcagccctgacgacctcacccagggaaatgaggaacccgtgtgaacctaagaaggaaaccgctatggtggttgtggtggtgggtggctcagctccagaagtggtgaagcgactttcccgaaag

SEQ ID NO: 35256 - DNA, 42 bp, Homo sapiens
  chr14:38677446-38677488
  hyper
ccagctgcgcgtcctcgtttctgcagtcgatattcctgtggg

SEQ ID NO: 35257 - DNA, 30 bp, Homo sapiens
  chr14:38678172-38678202
  hyper
gaaaaaaatggggggcgggggggacaagcc

SEQ ID NO: 35258 - DNA, 52 bp, Homo sapiens
  chr14:38678631-38678683
  hyper
ctcctagccccagcccgggcagctgcggcgaaggcggcggcagcaggggccc

SEQ ID NO: 35259 - DNA, 142 bp, Homo sapiens
  chr14:38679118-38679260
  hyper
ggtagtaaacctgggcgtgtgggtgctatcgctgctcgtcatcctgcccatcgtggtcttctctcgcaccgcggccaacagcgacggcacggtggcttgcaacatgctcatgccagagcccgctcaacgctggctggtgggc

SEQ ID NO: 35260 - DNA, 136 bp, Homo sapiens
  chr14:38679744-38679880
  hyper
gcacgtcccggatcacgacgctctgagcccgggccacgcaggggctctgagcccgggccacgcaggggccctgagccaaaagagggggagaatgagaagggaaggccgggtgcgaaagggacggtatccagggcgc

SEQ ID NO: 35261 - DNA, 232 bp, Homo sapiens
  chr14:38724294-38724526
  hyper
ggttgcagtggccggcgggcgcctggtgggcaccccggtccccccaagggtcggctgtccttccccactggtcacacaagagcggccgtccttccccagctcgaagcccgtagcacattcgcaggcaaagcctcccaagtcgtctaggcagttagggagctctgcgcatttgccagcacggaggtacctcccggggcagggacacaacacatcgcccgagagtttgtcccag

SEQ ID NO: 35262 - DNA, 382 bp, Homo sapiens; identical to SEQ ID NO: 1146
  chr14:38724978-38725360
  hyper

SEQ ID NO: 35263 - DNA, 30 bp, Homo sapiens
  chr14:42074229-42074259
  hyper
gtgaagtcccagaagcgatcaagtttaaag

SEQ ID NO: 35264 - DNA, 113 bp, Homo sapiens
  chr14:42074474-42074587
  hyper
tctgtggtcttcctgcgcagtccctcagcggctcggagtttggccttccagctctccaactcagatcctgagcctcctaagctcccgcggagaccctgaagtcccggatctgg

SEQ ID NO: 35265 - DNA, 15 bp, Homo sapiens
  chr14:42074668-42074683
  hyper
cgtggcttgagtgga

SEQ ID NO: 35266 - DNA, 183 bp, Homo sapiens; identical to SEQ ID NO: 11850
  chr14:42075097-42075280
  hyper

SEQ ID NO: 35267 - DNA, 330 bp, Homo sapiens
  chr14:42075480-42075810
  hyper
accaactgcagtattcgtaatgtctgatgctgagctgagttgattcccaaatataaatgttcttttcagaatccgctcccatctgattagtaagcaaatcaccacccacaactaaggggacagcggaagccagcctcagatgactgaaacccccaagtcagtagctctcctcaaaatttccggcgggttattatagataatgacttttcccaccgccctaagcagccgaagcttgactcagtgatgattctctctatcccgtaactgcgaggaagtgggcgatcagcaaattgcccttttgcaggaggctggggacgcccctggaagttc

SEQ ID NO: 35268 - DNA, 70 bp, Homo sapiens
  chr14:42075811-42075881
  hyper
ctttcattctccaggttttctgccttttcccttcccccttcctgcaacgcccccgcgcctcctcagcctg

SEQ ID NO: 35269 - DNA, 565 bp, Homo sapiens
  chr14:42076803-42077368
  hyper
gcaaatgtgttaactcggcgatgccccttcatgcccgggttcttgcagagctctgaggacgcccagacccattttcctggctggatttggagcggctgctgggctgtggacccaggtgtgtggatcgctttacccagaagcttggaaagcgccaatattaacctgcttccaggtacatcacaaggtcaagagagtgtcttgcagccctcttgtttccgtgtatctacaccttcttctcttggccagaaggatatttacgttttggttcacagcatttgaagccaaaagttcagcccttcgaactggtttgctatacaaaacaaaacaaaacaaataaggtaatgaggattgcttattaaactgcttaacaaaatccccgactcttcctcagccctttctcggctccctcctccccaccaaaatgtcaccagctcttgaattacgtggattcgggttggaggagaacttgaaggaaacgtgattaaagggctatgcgagaacgctctctttgctgcccgcggtccggtgggcttcgaagccaatcgtgagaaggaccggttccctc

SEQ ID NO: 35270 - DNA, 200 bp, Homo sapiens
  chr14:42077488-42077688
  hyper
cgccctgcctctgcccgctccccgggcgcggagccgcgggtttcatggggcgattgcagcgattcccccacccagagcgacctgcgggcagcggcggcagtggcaggagccgcctttccgattccctacgatgcgggtgctgagctatggcaaagggcagcgaagtgacgagcgagacccgcgtacgactgtgaaagcca

SEQ ID NO: 35271 - DNA, 690 bp, Homo sapiens
  chr14:42078799-42079489
  hyper
cgaagacattagaattaacaagataaagcacttccaaagtagtctcatcaatgttttattccatagtgaagacggtctgaataatttaactaaggagtgttcgtttgtctcccgcctttgggagctgcttgctggctacattcagcggaggatttggcccagccaagctcagggtgccctgcttcaggaggcagtgactggggctgctggggggcggggggttctctttgctaacgccgtttaggaagtgtaggggcgctgcctgattttcccccactcgctgcatttctatagatatccatatgatggcatttgcagacttctagctggccgatagctgctctgcttgtccctgcgcactgacgtccccaactcctcttcgagtctgggctcggctgctgctgcagccctcgcaggctggtggtgctacaaggccatgtatgcagcgggctttgggggctgggctctgccactgcagctggcaggacggctttgacactttctccgggcagggcggaagagctcagcggaccccctggcagacagcaagcgcatcgtggccgaggcggccgcctggatgcgagaggagggagatgcccagagccacagaggagcgtggagggcggtggtgtcctgtctttgcctgcaaaacctttctctctctctccctccccgcgacaatgaatattg

SEQ ID NO: 35272 - DNA, 486 bp, Homo sapiens
  chr14:48143051-48143537
  hyper
gccctggaacccagacgcgcggacttagcagtccgttcattcatgcacttgctcatccattcacacaaacatgtcccttaattgtgtctggcaccgagaatcttgcctgctattttcccctcccgaagtcagtgctcatggcaaccgctggtgcagaacgcaactcaactgtcaccccacttcctgagccggaaaatcaaggcatgtaggcattcacagaaaaaggaaaaggtggagaggaggaggcggcgggggcggagaggggtggggagactcacggggtcacactggaagcttccctggggggtggggggaaaccgtgacaccgacaccgtggcatgcaaggagccaaaccattattaaatcaaagactgctggagctcggattccccgcggggataaatcaagtgcaaagccgctcgttcgcacgagtgcgttgctgccggctaaacccaactccgagccagagcccaggcgccggggaag

SEQ ID NO: 35273 - DNA, 102 bp, Homo sapiens; identical to SEQ ID NO: 11855
  chr14:48143617-48143719
  hyper

SEQ ID NO: 35274 - DNA, 161 bp, Homo sapiens
  chr14:48143797-48143958
  hyper
cgtgaacatgaacatatccagcccagggggtacgcaacgggaccttcaggaggccggcggccagccaggcgcgctccactcgcgcccgggccaagccgaggtgcccgggaaccgctcgccgaaggaggaagcgccgtccgtctgtccttccccggcggcgg

SEQ ID NO: 35275 - DNA, 13 bp, Homo sapiens
  chr14:48144358-48144371
  hyper
cgaaggtccccgg

SEQ ID NO: 35276 - DNA, 141 bp, Homo sapiens
  chr14:48144623-48144764
  hyper
gggtccaacagggagcggagtgtgcgtctggagctcgcttgggcacaccagcccagccgccaccgccaccgctctccaaaatagcctttagcgcccggccagcgtagaggtgctctggccggccgcaccaattcccggagc

SEQ ID NO: 35277 - DNA, 126 bp, Homo sapiens; identical to SEQ ID NO: 4104
  chr14:48145236-48145362
  hyper

SEQ ID NO: 35278 - DNA, 197 bp, Homo sapiens; identical to SEQ ID NO: 4105
  chr14:48145469-48145666
  hyper

SEQ ID NO: 35279 - DNA, 171 bp, Homo sapiens
  chr14:50155136-50155307
  hyper
aactgagggccagagcgtcttccctggtgtcgggctgcgttgagccagccacagcgctctcaccgctgccctagacattgcaggactgcggccgagcttcccggacacaggatcccccttctttcgaggccatgagagctgttgggttccctacttcgcacaagctctgga

SEQ ID NO: 35280 - DNA, 154 bp, Homo sapiens
  chr14:51026705-51026859
  hyper
ctatcactgtcttcacggtctgggggtggactgaggtagggagggtgtgacgctggtatctgtgtgaactcgggcttgtgatgctgagcttggttcatctgctttctcctcccttttcctccccactccttcccaccagcgccacagcaacatc

SEQ ID NO: 35281 - DNA, 19 bp, Homo sapiens
  chr14:51338713-51338732
  hyper
gcgaacagcctgacccggg

SEQ ID NO: 35282 - DNA, 49 bp, Homo sapiens
  chr14:51410296-51410345
  hyper
aggagaatgggtgggcggcgctctacgcttggagcgggaccctgcccct

SEQ ID NO: 35283 - DNA, 94 bp, Homo sapiens
  chr14:51410569-51410663
  hyper
tgtgaagtggacaggcgagaggggcctgggcttttgcccacctggcggtttccaggggcggacggcacagtggtttgggcgggacactggcggg

SEQ ID NO: 35284 - DNA, 410 bp, Homo sapiens
  chr14:51560304-51560714
  hyper
ggctcatcagtattccgcctgcggcgtctccccgaccctccgccgtgcctcaccaggtccgcctatccagcagcgacagactcccgccgtccgcgcgaccccaccgcccccatcccagtccctccccgagggttcgcagcccgccctgccctcgagcgtgcctagcggccctgggcactggcgcggctctacccagctatgcagtgctttcccacacactggccgcggccactggctgcagacccgccgcggaaagggggcgccctgagtcccgctcgcaggcagcgcgccccgagagacccgctctaaggcatccccgcaacaactctgtgggggcattcaactcccccgtgcgccggttaagattcccccatgcctcctgcaatgcaccagaccagggaggtaaacat

SEQ ID NO: 35285 - DNA, 523 bp, Homo sapiens; identical to SEQ ID NO: 1148
  chr14:51560770-51561293
  hyper

SEQ ID NO: 35286 - DNA, 344 bp, Homo sapiens
  chr14:51561294-51561638
  hyper
gggcaccggggccagggccggtgacaagtgggtggccggtggcggcatagccgggggaaacacgcggacgccgttgggggacttctggcacggggtagtgggggcgctggcgaaccccccgtaggagccatagccgctgtccgcctcgctgtataggctcatcttgtccaggtccagatagtcatagtcggagaccccggagcccgcggcccgatggctctggggggattcagactctggggtctgcaccaggatgttgcgggcgcacgcctgacacaaattgtgagagcagggcaggatgatgggctcccgatagaaggagccgcacacggggcatttcaact

SEQ ID NO: 35287 - DNA, 35 bp, Homo sapiens
  chr14:51561875-51561910
  hyper
ctgccctcctagtcccgccccggcccatgagcagc

SEQ ID NO: 35288 - DNA, 425 bp, Homo sapiens
  chr14:51562235-51562660
  hyper
cccagctctgagctccgcgcccacctaccgcgggcgagtgctgcgcagcacggaggacgccccttctcttccgctgctggcagccttcgcaggcgtctcacccgggcctaggcttctgcacggcagtggggcttttctccttctccgtgaatccgctgacgccgtgccctggagctcccccatcccgggagtctgacggcgctggcgcaagccctggcgacactcttggcttctttcatcctgcgtccctcgtttcctaaagagcatgtataaagtcgatttcctagtgtcgacatgagattcaactgggtaaccgatggaaatggtcagcattagtcagaatctatgaccccttcgtttcatgctttaaattatagctcggcccagaggcctcagtgccgtggtgtgaacgtgcttccttccac

SEQ ID NO: 35289 - DNA, 396 bp, Homo sapiens
  chr14:52534631-52535027
  hyper
aggtggccaggaaggcgtgggtgggggtaaagcgcgcagagcgcgggaagccagcgcgcacatagcgggcggccaggcccagcactgcgggggaggtgtcctctcggtacaggactcggcctctgccgtggctcgtgtcgatgtccgccagaaaaggggcgatggccgggaagtcggtggggaaatcatagtccacatactgcgtttccctggggaagtcctgagtggagatgatgccgttggtgcccacctgggagaggagagggacaaaaaggtgacagtcgctcaagcccaaggacgctaccctttcgcgcagggagggaagggaactgacttaggcaaaaagcctctctctccttccccactggccagggagtctggattcagggaaacaag

SEQ ID NO: 35290 - DNA, 209 bp, Homo sapiens; identical to SEQ ID NO: 1151
  chr14:52535055-52535264
  hyper

SEQ ID NO: 35291 - DNA, 91 bp, Homo sapiens; identical to SEQ ID NO: 1152
  chr14:52535334-52535425
  hyper

SEQ ID NO: 35292 - DNA, 332 bp, Homo sapiens; identical to SEQ ID NO: 1153
  chr14:52535426-52535758
  hyper

SEQ ID NO: 35293 - DNA, 214 bp, Homo sapiens; identical to SEQ ID NO: 1154
  chr14:52535759-52535973
  hyper

SEQ ID NO: 35294 - DNA, 92 bp, Homo sapiens; identical to SEQ ID NO: 1155
  chr14:52535974-52536066
  hyper

SEQ ID NO: 35295 - DNA, 38 bp, Homo sapiens; identical to SEQ ID NO: 1156
  chr14:52536067-52536105
  hyper

SEQ ID NO: 35296 - DNA, 62 bp, Homo sapiens
  chr14:52536342-52536404
  hyper
cgcttcgctccacccagagacgccctgaggagaagcgagcctttgtacgaaggcagagggct

SEQ ID NO: 35297 - DNA, 16 bp, Homo sapiens
  chr14:52734509-52734525
  hyper
ccagccctctgctccc

SEQ ID NO: 35298 - DNA, 476 bp, Homo sapiens
  chr14:52734526-52735002
  hyper
cacgccatgaagtcgccgttctaccgctgccagaacaccacctctgtggaaaaaggcaactcggcggtgatgggcggggtgctcttcagcaccggcctcctgggcaacctgctggccctggggctgctggcgcgctcggggctggggtggtgctcgcggcgtccactgcgcccgctgccctcggtcttctacatgctggtgtgtggcctgacggtcaccgacttgctgggcaagtgcctcctaagcccggtggtgctggctgcctacgctcagaaccggagtctgcgggtgcttgcgcccgcattggacaactcgttgtgccaagccttcgccttcttcatgtccttctttgggctctcctcgacactgcaactcctggccatggcactggagtgctggctctccctagggcaccctttcttctaccgacggcacatcaccctgcgcctgggcgcactggtggccccggtggtgag

SEQ ID NO: 35299 - DNA, 380 bp, Homo sapiens
  chr14:52735044-52735424
  hyper
cgggaagttcgtgcagtactgccccggcacctggtgctttatccagatggtccacgaggagggctcgctgtcggtgctggggtactctgtgctctactccagcctcatggcgctgctggtcctcgccaccgtgctgtgcaacctcggcgccatgcgcaacctctatgcgatgcaccggcggctgcagcggcacccgcgctcctgcaccagggactgtgccgagccgcgcgcggacgggagggaagcgtcccctcagcccctggaggagctggatcacctcctgctgctggcgctgatgaccgtgctcttcactatgtgttctctgcccgtaattgtgagtccccgggccccgaggcagcagggcactgagactgtccggc

SEQ ID NO: 35300 - DNA, 20 bp, Homo sapiens
  chr14:52735451-52735471
  hyper
cggatcgggatggacgcggc

SEQ ID NO: 35301 - DNA, 549 bp, Homo sapiens
  chr14:52781428-52781977
  hyper
gggtgcagcgccggccgcaggagctccctctccttgttccacgtgctggtgaccgagctggtgttcaccgacctgctcgggacctgcctcatcagcccagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcgcgctccgggggcctggccgtgctgcctgtcatctatgcagtctccctgctcttctgctcgctgccgctgctggactatgggcagtacgtccagtactgccccgggacctggtgcttcatccggcacgggcggaccgcttacctgcagctgtacgccaccctgctgctgcttctcattgtctcggtgctcgcctgcaacttcagtgtcattctcaacctcatccgcatgcaccgccgaagccggagaagccgctgcggaccttcc

SEQ ID NO: 35302 - DNA, 233 bp, Homo sapiens
  chr14:53417159-53417392
  hyper
ctccaatgtgcacctcgccggtcactctcagggtgacatcgcggttcaggtccgtcacatggacactcagttcccacgtcccgtccgcgtagcagccatctggcatccttatcccgtccagagccatggctccttcctgcgagcgcggaggaaatggctctcgtaagcgtcactcccccaaagaaaggcgaatcccaccgaattcgcagcgccggccacgggctgggaggtgg

SEQ ID NO: 35303 - DNA, 494 bp, Homo sapiens; identical to SEQ ID NO: 11873
  chr14:54422431-54422925
  hyper

SEQ ID NO: 35304 - DNA, 34 bp, Homo sapiens; identical to SEQ ID NO: 11874
  chr14:54422926-54422960
  hyper

SEQ ID NO: 35305 - DNA, 57 bp, Homo sapiens
  chr14:54423406-54423463
  hyper
agctagatactcagccggagcagcagcggcgtctcaggctcgcgtccctcagctcgg

SEQ ID NO: 35306 - DNA, 387 bp, Homo sapiens
  chr14:54430156-54430543
  hyper
atgtccgctaactaacgtaaagaaacgtccgcgtgctccgctgataccccagggccaccggaggagagcagtggggtgtgagaactaggctgtgtccagtggctggtggtggggggagcggctactgcgccttccccttgggcactcctctcgggtccctgaggcgacgccctagtaagcctccacgcacgtcagcgaagggtgggtggagggtcaccctgaccgcgccccacagctggctcccgcgctctgcccaccgccacgccaccttcaccgcgcgatctcggcactcccgcctttctcttgccctcgttatttttagttcggctgctgcacctccctgcctgcaacagctcgccccactctcagactcgttttgcaggattt

SEQ ID NO: 35307 - DNA, 35 bp, Homo sapiens
  chr14:54687254-54687289
  hyper
tggggagaggggttccgtttcgggtcacggtcctg

SEQ ID NO: 35308 - DNA, 232 bp, Homo sapiens
  chr14:57260863-57261095
  hyper
cattttaggccaattcgttaaaccagccgtctaaacgggccctggcactgggtatccgaccgctccacgcgccagctggtgaggcctggagttggaaccggaagccgtctccagccggcctcctaggccctaggtgcccgggtgggcacacttccgcgagggcccggggacagcgccggccaagtcttgcgggcaactgcacactcggttccgggaggcaggtactccaggt

SEQ ID NO: 35309 - DNA, 234 bp, Homo sapiens; identical to SEQ ID NO: 1159
  chr14:57261174-57261408
  hyper

SEQ ID NO: 35310 - DNA, 415 bp, Homo sapiens
  chr14:57261465-57261880
  hyper
cggaggcctgggttggggggtcgtgagccggatgttccccgcagctggccagaaagctgcctctgagcctcttgagcaactccctgcctcctccggtagtctctctggactctccaagtgacttgctgggggcaccgggcgcggggagggcaggcccccggggtgacgcaggtgtgtactttacagccagagaaggcctagctttcagggacattggcttagtttgttgggtgagacgtgggggtggagaatgggagcactgtctctttgccaaattttccagagaaaccccgggactagctctgtccctggtgccccggctactgccagcgggtccttagcgctgtcgattgcgcgcaccggagcccgaagtcttccccaccgctggcaggagagccccgcgagctctcccgga

SEQ ID NO: 35311 - DNA, 214 bp, Homo sapiens
  chr14:57261965-57262179
  hyper
cgcgaaggaggcctcaaccttaggacaacccgggcgtcccgggcgaaggtctcgatctgccggagccactgcctttcaggcatcgctccattaaagccagggaggagagggtcattggccagcgacccgccctccttacgtccggaggtcaccccacgcctacaggcaggtttttctgtctcctttgcagaacactatgcgtttgttacaacga

SEQ ID NO: 35312 - DNA, 815 bp, Homo sapiens
  chr14:57263831-57264646
  hyper
tatcagagcaccctgcgctgacaggctcgggcggtttagaagagaaaatcagaggtgctcagggcacctggtcacaaacctgggcatgcagatgcctgatgggggcttggaccctttcgtggcacgaaaaggagagagactgctgttcatcttaaaagtctcgaaggaggcaaaaacccaggcggaagtcatggctgactctgatcctgcatcttctcattctggttgttttccaccgcgtctgctcccatttgcgtgggatgcgctggtctcctgcccgactcttttgtgttcctcttttgcatgattaaaaacacgtttctatatgcactaaaccatcacctagcactggcacgcctggttttgggttacagctttgtccgtataataacagcgaagttctccctgggtgtgagatgcgggttcgaacatgtggtgtgcgcgccagggctggccgcttccggttaagtggacgcggggacttgactgcgtcccctgccttgcaggtaactggaatgggttgcctggcaagttggccctgcccgggacgccgaagggaccgcttccccattccagagcctgcctctggccttcagggccgctgacaggtccgaaaagaaagagaaggcactcagttttaaaaaaaagagatctagaggactggggaaaaggggatgagccaaggcaaactgggaattgctcgggcttcccccgaaagcctcagctcagtgccgggggagaccccaacggagggccagactcccccaaatccagtggccgaagacctggatttcctgggaggatccccgggggcc

SEQ ID NO: 35313 - DNA, 43 bp, Homo sapiens; identical to SEQ ID NO: 1162
  chr14:57264764-57264807
  hyper

SEQ ID NO: 35314 - DNA, 135 bp, Homo sapiens
  chr14:57265147-57265282
  hyper
gccctgggaccggcgcccccgaggcctgagaactacgcccggggggcgcgggctgaggctcaagagaggtcctaggtgcgggccagggatggagccagcccagagagaaaggggaaaacccggcaaggcaagagc

SEQ ID NO: 35315 - DNA, 160 bp, Homo sapiens
  chr14:57265517-57265677
  hyper
gccccagcctcccagcgtcttgcgcctgtggcggcggcagtacgggcctggggggtcacccacaggaaaggtgagattagcagcaccatgtgggagaggggttgaggaaacccaccattatctaaaacttggaggtttccaaagccggaacttaattgag

SEQ ID NO: 35316 - DNA, 15 bp, Homo sapiens
  chr14:57270957-57270972
  hyper
aagatgtctgggtac

SEQ ID NO: 35317 - DNA, 96 bp, Homo sapiens
  chr14:57271153-57271249
  hyper
cgcagcagtcccccgttcctcacagcccttcagccgggagcctaccaatgctctccccaccgtctccccagccttgctccccggggacccaggaca

SEQ ID NO: 35318 - DNA, 30 bp, Homo sapiens
  chr14:57271654-57271684
  hyper
aacaactgcgaagcccgagagtgctaagga

SEQ ID NO: 35319 - DNA, 95 bp, Homo sapiens
  chr14:57272009-57272104
  hyper
agggtgttgcatccccggagggtgggcatggggaagaggggtgcgggagtgcagcagggctcacttacccgggtagcccacggaggggtgcagca

SEQ ID NO: 35320 - DNA, 77 bp, Homo sapiens
  chr14:57272324-57272401
  hyper
gctggtttactgcttcggaggcagcagctcttccacgttccagcactaacttaaaaagagcacggactaggcgaggc

SEQ ID NO: 35321 - DNA, 30 bp, Homo sapiens; identical to SEQ ID NO: 11888
  chr14:57273051-57273081
  hyper

SEQ ID NO: 35322 - DNA, 322 bp, Homo sapiens; identical to SEQ ID NO: 1166
  chr14:57274417-57274739
  hyper

SEQ ID NO: 35323 - DNA, 310 bp, Homo sapiens; identical to SEQ ID NO: 1167
  chr14:57274740-57275050
  hyper

SEQ ID NO: 35324 - DNA, 476 bp, Homo sapiens
  chr14:57275210-57275686
  hyper
cgcgagggagggaggaagaaacgtgccaaaagggttggccttgactattaattatcgttgggagaaagccccggtgttagcgctgaggtctgggtgtctaccttactctggggggaggagttccctctcctactcccctctgttgctaataacttttggtgcctgtaaaaagtcccgagctgagcaggagaaatcctgaccccgaagctctaggatggaggggagaatttctaggagcgacttccccgtcccctccccaagcaatccaccaccgcagggtcggcgccgctcggccttcgctccccgcgcaccagttctatctgtgaaggaagcaaaagccaactcggtggaatcctgacaggggacttgggtttccaaaaatatgtcccgaaatcgggcatcgatttcaagagtcacttgaacgcaacaacgcgaagacttcttgggagtttgcagagcgacccgtcgcccgcgcc

SEQ ID NO: 35325 - DNA, 807 bp, Homo sapiens
  chr14:57276073-57276880
  hyper
gggggttgggaggctgcgtaattacaacccagggtggtttggattttggggggtggtggatatttaaaaacaaaaaggagatctggaagcttttgggagaaacagacaaccgagctgtgctaggctgagggagaggaggccaaagagagcgagcagtgagcgccggggcggacgagaagccagcgctcccagcctcctcggttatccgctccggtttccgctcacgttcaacaggggccgacaggggctcgagcggcggcccccggcccaggccgacccgcaagcgaaccgagcttccggcgcgcgggcccaaggaggcgcctggctttttattattgttgtttcaatccatccatctagttacatctgcatctttttgtctcggactctaaaaaggtccctgggatccatccaaacgaccccaaccaaatctgggggccaaaacgcaaagatcgcgggagaagcccagaacggcgttgacataaaaacaaaaccacaaacaaaaccttccaaaacaccccagattacattcgcagcgtttcgacgacgttttgcagaagcgacgacccccaggagcacgctctctgcctctctcccactaccgctctcatctctagatcacatttttctttttgcaacgatcgttattacacctcaaaatttgtaagagaaaaaatacatccgcctacagaactccacgttcgcagaggggcatcggtcggtctattggaggtactggggtgatggccgacagacacggggacacgtagatatggatatagacaagacagacggacacttacctta

SEQ ID NO: 35326 - DNA, 829 bp, Homo sapiens
  chr14:57277934-57278763
  hyper
ccgagtgagagaccccggcttctggtaggttcctggggttttttggaattgagaagcccacgacagactgcagggaacacgaaccccggaatctaatctcagggcccatttaggagaagtagctgggaccacatcgggcctcgaggatgcgagtgtgaggtcgacaagatatcgtggaagagagcgaacgagggaggcccccgttggaaacagtttctgtgttagaacaaacgccaccaaacgaccgacactgcgaggcctggagctacctgggctggcgccgcccgagccccgggctgcgagcccagaggctgggaagtgatgggacctgggggcccgagccggagagtgcgacccccagcccaacttttttgcctggcatagaaagcagggaccggacaggtttcaaacggatccgagtccctagaaaagcaaaaacagactgggcggagtgtggggtggggggtggctagtggaactggtgagtgtgtgtgaataagctgggtgggggtgggagcagaagacagctcttgcttcacaacacccagtgcaggaaaagaaaaataaaatctcttcctaaataccccaccccccgccacccacccaccaccaactaccatcaccaccacggccagtgggcccaaagaaacagctcgctgcctttaatttggggacctatgttaatgaagttggtaattaattcgtcgctttgttgtcggttcttatactgtatgtgtactcaaatgtggccgtccttgggatttacagcaattaacgaattacgggagtgcgcacgaggcagcaagctctcggcagccgggctccggct

SEQ ID NO: 35327 - DNA, 728 bp, Homo sapiens; identical to SEQ ID NO: 1171
  chr14:57278837-57279565
  hyper

SEQ ID NO: 35328 - DNA, 126 bp, Homo sapiens
  chr14:57281138-57281264
  hyper
tcactccctgcattgcggttgcctcaaaaaagagggtaagggagaaagaaacaacttcaaagataggattgggctgtctcgataaaagagtagggaggcaaactccaaatgcgaaaaagaggaaaa

SEQ ID NO: 35329 - DNA, 110 bp, Homo sapiens; identical to SEQ ID NO: 1172
  chr14:57283299-57283409
  hyper

SEQ ID NO: 35330 - DNA, 592 bp, Homo sapiens; identical to SEQ ID NO: 1173
  chr14:57283445-57284037
  hyper

SEQ ID NO: 35331 - DNA, 541 bp, Homo sapiens; identical to SEQ ID NO: 1174
  chr14:57284070-57284611
  hyper

SEQ ID NO: 35332 - DNA, 188 bp, Homo sapiens
  chr14:58332215-58332403
  hyper
ctgggcgcacccagccgggccccttgccctctcacggttcagcaccgaggacagcggacatacttttctccccggggggtccccgccgccaggaaggcggtgttgacagcgtccgcagggctgcaggtgtccgtaccgcgcgcccgcccgtccgcatccccgcggcacccctgcgcgcccacctccct

SEQ ID NO: 35333 - DNA, 68 bp, Homo sapiens; identical to SEQ ID NO: 11902
  chr14:58332640-58332708
  hyper

SEQ ID NO: 35334 - DNA, 100 bp, Homo sapiens
  chr14:58618341-58618441
  hyper
gcattggggacactgcgatcgacggtttgaaaggagtaaaccgttgttttcgggaacttctctctcactgctgtgggattgcgagcggagggagaaagag

SEQ ID NO: 35335 - DNA, 158 bp, Homo sapiens
  chr14:59931281-59931439
  hyper
gatcttctcccgcggcggccgcacgatagcgcagtaacggtccaacgagatgagcgccacgctgagcgtggacacgatgccgaagcacgagctgaagaagcggctggcggcgcagaagccgcgccagggccccgcggcggcggcaggcgccgaacccc

SEQ ID NO: 35336 - DNA, 334 bp, Homo sapiens
  chr14:60043273-60043607
  hyper
tgagtgcctcctaagcgccacctctgaggagacgtcccttccagcgcccgaggggcgtcttacccacaacaaacagctgctccagcgcctcgaccgcgaccgaggagcccagggtggagggtaaggtgcataactccagggaggggccagtggagacggcagccgcctgcaccagcttctcgccagcgcccagccctggggtccaggggctcagggccattttgccgctctacttgagcgcctcctaagccagagccaaggattgccggttgccacgggcaacgaggacaccgaggtcgtggggcgccccctcgtggcccgcacctctagtagg

SEQ ID NO: 35337 - DNA, 54 bp, Homo sapiens; identical to SEQ ID NO: 11904
  chr14:60097193-60097247
  hyper

SEQ ID NO: 35338 - DNA, 204 bp, Homo sapiens; identical to SEQ ID NO: 11905
  chr14:60097406-60097610
  hyper

SEQ ID NO: 35339 - DNA, 77 bp, Homo sapiens
  chr14:60336952-60337029
  hyper
gcgaatattcccagtcgcccgtggcgacgcgggggtggggtcggcgctcaaggcagaaagcgcgaggcaggtgccca

SEQ ID NO: 35340 - DNA, 16 bp, Homo sapiens
  chr14:60386034-60386050
  hyper
atccagagaacgacac

SEQ ID NO: 35341 - DNA, 668 bp, Homo sapiens
  chr14:60386051-60386719
  hyper
agacctgcggttgctttggtttgccttttactaagttcatttctcagcctctctgcccactctgaaaagtctcccctttccccccttttaattctactctattttgtaaattactgttgtctcctgaaaattttggaatgcttaaaaggcactcaaaagcctgtccgagatcgactagaagaccctcggaaggtccctctcttctctggacctcactgggcgttcgtttgcccgcgccgtccttccattcggcttgccgggcgcgcagcggcttgcggctgtggtcagccaccttcccgggaggcggtggtcgctggccgcgggaaggatgccgcgctgggggtcggggttcgtcccggctgtcacgccaccttgtgacatcacagggccatgccctcggggctcaaggccagagaggctccgcgcttccaggacccgagagctaaagataatgaatgggagagagcgagactggaggaggtaacgaataagtccccaccaccttgcccataacgcgttgctttcagtcacgttccgcgaactggcgaaggtaagtgaaaagataagcgcaggtacagaaaaacctgccagcgagaagctcccgccgtttcccaggagccccaggtggggtcttccggttggacccctgcttccgctgattggttgga

SEQ ID NO: 35342 - DNA, 358 bp, Homo sapiens
  chr14:60794473-60794831
  hyper
ttaaaaaaatatcctcgtggcttaatgaccaaggcgggtttattctcaaggaagggggagcggcgtggtggtgttactaaacataacagatggcagctgtctgcggctatatagggcgcgctgacaaatccctctggatggccacgcggcgctgggctgcggggcctgggtgcacttcgcgcctggctcggagggcgccgcctgcgggaggacctccgggagccgagctgcctccccgcaaacccggcccgggcccacgcgggctcagggcgccaggcggggtgcgccgaggtgcagctccccggccctaggcttcgctggggtgggggtcgaggcctctccgcgggtggctccctcc

SEQ ID NO: 35343 - DNA, 225 bp, Homo sapiens; identical to SEQ ID NO: 1175
  chr14:60952195-60952420
  hyper

SEQ ID NO: 35344 - DNA, 117 bp, Homo sapiens; identical to SEQ ID NO: 1176
  chr14:60952516-60952633
  hyper

SEQ ID NO: 35345 - DNA, 230 bp, Homo sapiens
  chr14:60952729-60952959
  hyper
cgccacagcggatcctaactacaaacggtccccggagccctgggctggactcgctcagccccgcccccacgcccctggtaccagccctgagagaccccgcggagcacgccgcgggagccgcagatcgcgctgaagagcagcgagatcgcgctctggacgagacctgcgcggctgcaaccgctccttcttcgcgggtggaagcgcggaataagccccgtaaaaccacagaa

SEQ ID NO: 35346 - DNA, 769 bp, Homo sapiens
  chr14:60973239-60974008
  hyper
atacttcttcctgttcgtcccttccccttgtgaagctggtgaacaaataagtgattccaaggtgccctggcgcagtctatttcctttgggttaataaaattaaatcaagtcccttgcgatggcgaagatggatctcctgatagtagtccccaacctccaggcacttctcagtcccttcctgccaagccaccagacagtgctcctactctgccacacgcagcccgcacccttctggcggctcccgcgaggccaactcagactctcagttccagttgcccgcgagcctcagacacgcagaagctaaagcgccctcatctaattatttgcagaactattatccaagaaatgggccatgggataaatattcccatttcctggatggggcccctagactgtccacttgctcacaaagattaagggtaagaaaccagctctccccgaatgtgccgcttccaaactgtccagtaaaagggcgagagggagacgtgtggtctcctggggcatggacaacctctcccacctcagcagctaggcgctgggatcggggtcggctctcggctcggctcgcgggctgtaaggtctccgcggaccccaccgcctcttctgcgcgctaagggtgagcgccaagcaatttcgcgagcaatagccggcaaagtaaccaccccgagagggaaaataaacctctgcaaactggagcaagggggtgctttcctcccctggccagaagctccgggatcgcagccctcccgggtccggcttcatccctgcc

SEQ ID NO: 35347 - DNA, 15 bp, Homo sapiens
  chr14:60974077-60974092
  hyper
cgatgtttctttcta

SEQ ID NO: 35348 - DNA, 47 bp, Homo sapiens
  chr14:60974368-60974415
  hyper
tgccctgcactcaggcgtggcgtgatctgacccgacacctccaacca

SEQ ID NO: 35349 - DNA, 441 bp, Homo sapiens; identical to SEQ ID NO: 1179
  chr14:60975448-60975889
  hyper

SEQ ID NO: 35350 - DNA, 536 bp, Homo sapiens
  chr14:60976074-60976610
  hyper
cgctccgggctcagtgccctcgccgccgccggcactgcctcgatgttccagctgcccatcttgaatttcagcccccagcaagtggccggggtatgtgagaccctggaagagagcggcgatgtggagcgcctgggtcgcttcctctggtcgctgcccgtggcccctgcggcctgcgaggccctcaacaagaatgagtcggtgctacgcgcacgagccatcgtggcctttcacggtggcaactaccgcgagctctatcatatcctggaaaaccacaagttcaccaaggagtcgcacgccaagctgcaggcgctgtggcttgaagcacactaccaggaggctgagaagctgcgtggaagacccctgggacctgtggacaagtaccgagtaaggaagaagttcccgctgccgcgcaccatttgggacggcgaacagaagacacactgcttcaaggagcgcacgcggcacctgctacgcgagtggtacctgcaggatccataccctaaccccagcaaaaaacgtgagctcgcccaggcaac

SEQ ID NO: 35351 - DNA, 376 bp, Homo sapiens
  chr14:60977337-60977713
  hyper
tttttgcctttaggtcgggccgacccgatccaacgcgatcgcgggagcacttgctcaggcgtaagccccaggcagacgcaccgttagaaatggtatcccatgtccctgggaccgatctgtccttgtcacccacacttcgtttatttcctgacagtcctgtaaatctcccaaaagtgcacaacaaacagggaggacactgcaagcccagtatataaaagacctgggagctgcggcgctgagaaagggcgcgaatcatggtggggcacaacagtagggacccgcggaggggcggccgcggactcctgcccgacctctgtcgccttgccgagtaatcctcgccttaactgctggggtcttcggaagaacctctagccgc

SEQ ID NO: 35352 - DNA, 410 bp, Homo sapiens
  chr14:60977879-60978289
  hyper
cgtcgccaccagcccggccgccagtctatccagcaaggcggccacttcagccatctccatcacgtccagcgacagcgagtgcgacatctgagttgcccatccaggatgctcagaagcagattccagtgtaaaaacgagaaaaacaaaatgaaagaggggaagaagatgagagacctgcaaatccagcgccacagaagccaggtgaccagggacccgcgggctcgggttgccgtttcccgccccaccccgcggccggcctggcttcactggcgccctttggccgcgaccacgggaaccagcggtgaggcctgacccagcaccacgttcttcttgctttgctttttcctaaggattttgctgcaaagtctccttcggaacccgaactgcaagctgagcgcctgcccagattc

SEQ ID NO: 35353 - DNA, 611 bp, Homo sapiens
  chr14:60981202-60981813
  hyper
tttcaccaaaaaaaacgacggcccctgctccccaaatgccgcagttcctctcgcctccactttaatgacccactccacttccacccgtcactccctcctttcccttcgccagtttgtttataaaaaatctgggagggaggggagaagacgatgggggtggggagggcttgctctttgtttacattaaacaaatgacaggcaaagagctcaagcaaagtcttccttgacctcgttccctctccctaattttaacaaaaaggaaaaaaatattgtatccaaagagaatgtgaatggggcgggaggagaggagaagcagcttttcgctctattcaacggggacgcgagagcgcggacgatttccgctccttttgtgaggcggagcccgggggcggccgtgaatggggggtctgtggagcggccggcggggctgtcaggcggctctgcgtaatcagggctaatgacggcggccgggcgctcggcgggacaatgcgcggggccgcggggttttgtcggcctgaatggctaataggtttgcctgtgagctgcgagggggcggtgtcggggaggaggcggcggcgaggggagaaggggtcattgtccgcgcgctggcc

SEQ ID NO: 35354 - DNA, 396 bp, Homo sapiens
  chr14:60981972-60982368
  hyper
cggtccgctcccaaagagaagcccagactgggcccacagtacccgggaaggtgagtccttactcgggggcccagatctccccacggaggccacagatctgggtccccgaggaaggagagccccccttttcgcgcacccaccttttccatccagcgccccgcgaactcgcggacgtgtaggcctcgagccactcctactgttgggctgcgtgactcagcggctcgaggagagaaacctctcaaaaccgggggaccgagacggggttcaatttaaacctaggtgggagaatgagcccacaagcgcgcgcccctgcagctgcggaggcgcgcgcccgcccaccctcgggcgcctgaagtcgcagcggttgcagagcctcgagcccgtggatgcggcgcg

SEQ ID NO: 35355 - DNA, 426 bp, Homo sapiens
  chr14:60982573-60982999
  hyper
cgccggggttagccttcgaggcggggagagggagcggggtccttcaaggaccgcatgttcgcgatagcacatttgagccctggcaggccacctgggccgccttctttcggaaaccttgcggggtttccaagcaaggtttacaatgggaaactttatttcccattgtaagctcttacaaatctcctctggctagatccttccttgcagctctctttgctaggatttatattcccaaacttcttcagacgtgccctaccgcgagggaacgaactggttttcttcccgttttcacctccttgtctggagacaaaggggtgtgagggcgatcccagagctgaacaagcagtttcacgcctccctgcccgctcatgctgtttccgcttgccctgtggtttgctctgcctggaacgccgccccctacctcaa

SEQ ID NO: 35356 - DNA, 15 bp, Homo sapiens
  chr14:61104140-61104155
  hyper
cctaccccccagtgc

SEQ ID NO: 35357 - DNA, 316 bp, Homo sapiens; identical to SEQ ID NO: 1182
  chr14:61104241-61104557
  hyper

SEQ ID NO: 35358 - DNA, 241 bp, Homo sapiens; identical to SEQ ID NO: 1183
  chr14:61104623-61104864
  hyper

SEQ ID NO: 35359 - DNA, 1003 bp, Homo sapiens
  chr14:61109265-61110268
  hyper
cccttgtctggccttcgaatccatactggcagcctctcctctcaggcactccgcgggccgggccactaggccccctgctcctggagctgcgctatgatccgggtcttgagatgcgcgcgattctctctgaaccggtggagaggaggctctgccccgcgcggagcgaggacagcggcgcccgagcttcccgcgcctctccagggcccaatggcaagaacagcctccgaagtgcgcggatgacaggaaaagatcttcagttcttctgccgctagagaagtgcgggatacaagcctctattggatccacaacctggagtcctgccttcggactttgccaaagacttgcaggcggtggggaggcagtaggaaatgaagccccctccagcctcagccgccgccgcgttcggtgcagcagcagcagtgccactgccacagagcagaggaaggcccgctccgcgcgagttctgtgccaggtgtcccgttggccctcagcggacaagggagagccgctaataagggtcgctgctcagcaaactcagagctcatccataagtgccaacgccactgcttctttctggaagcttccactccggcccggggtccggccccagccacgctgtcctagcccagagaacaggttcaagaacggtggtgcccagccccagcggtgcccttctccgtccctgtagctcgctgggctcttgagcccctacccactaagccaaaaattcgggaaccgggagccaaaccccttggcctctgagaatttaggaagcttcgttttcagccaagaggtcaaggcgagcagagagtggggactcgaacaatcgcgtgtttaggtttaaaacgttaaaaaataaacatcactcgagtgttttttttttttttcatttcacttggcacaatgctgtatggtttcgtcctacaaactatttataagccgttgttcattacttttggctaccgttatgacatctgtagaggagaaacgaaaagtggcttta

SEQ ID NO: 35360 - DNA, 329 bp, Homo sapiens
  chr14:61114393-61114722
  hyper
cctaaccggcccctgcgctcaggttttcccccaaactctttggcttcgcggagcgctctccccgccacagccacctccccaccgtccttctgaatctctgtccgaaacgctatagagaacagaaggagcctgcccaggtggccgaaggtgttgccccgaggtgggggaaagtagagaccaatttttaaaatattgccttgtgagctccagtgcgagagagggctgcgactggagaccctttcctcgtctgggcatgcggcgcggtcagccagaccgacgggctgcagtgccgggccacgcgcgagcgagcacggcgaggatcaaccctt

SEQ ID NO: 35361 - DNA, 1052 bp, Homo sapiens
  chr14:61114997-61116049
  hyper
caacatttcactgcccgttgatttagaaactcactctccacccaccactcatagccgcggccagccagggaggcataaagaccaaatctagcgccaatatttcccgacactcacatcccagagaaacccacgcgcgggtgctcaaagcaaatgaggccccatccttagcaaggaacctcagagttcatgaactttcgctgcagcgccgcggagggcctgcgcgccgccccgtggacgggctccggccggcggggaggacttggtggctggtgcctgcgggggcgggagggggcggaggagaaaggacggcttcctagggtcgcccgagtcgcgggaagcacgccgcgtacctttccttggcctccgcggcccggtctctttgcctccggttcttaaaccagttgctgacctgggtggtggtgaggccggtggcctcggccagctcccgcttctcacgcggcgatgggtagggattgtgcgcgtaccactcccgcaggacacccctcgacttctccttgaagcagtagctggtctcctcgccgtcccagatggtgcgcggcagtggaaattttcggcgcacccgatatttgcccacggcgcccaggggtcggccgcgcagcttctcggcctccacgtaatgcgccttcagccacagttgctgcagtttggggtggttgtgaggcgagaactggtggctctccaggatcttgtagagctcacggaagttgccgcggtggaaggcgaccaccgccttggccttgagtacgctctcgttcttgtgcaggtggtcgcaggcgggcagtgaccacaggaacctgcccaggcgctccaggtttccgccttgctgcagaacctcgcacacgcacgccacttgctcctgcgtaaagccaaacgacggcagcatcgacatggctggggcctgccggggcgcacggcccaggcgcacgcggcagggagcagagccgagaggcagggggcggcggccgcagggaggggggcgcggctgttcctaacctcctccttaggctttgcaaaggcgaaaaccggagtcg

SEQ ID NO: 35362 - DNA, 122 bp, Homo sapiens
  chr14:61116488-61116610
  hyper
gtcaggaccctgcaacgcgggacccgtcgccagtatcacctaaggggagtcgcgcacaactccgcacaaatcaatgactccaaaccttaattcctcccctctccctccgtactcttgtcctc

SEQ ID NO: 35363 - DNA, 153 bp, Homo sapiens
  chr14:61116875-61117028
  hyper
ctcccagtcggacagcgtttccctcgttcacaaaagacctccatgatttgagaccaggcagagagctgtttagagcatacttgctgagcacctagagactccgagcgttcatttgtgatttggtatcttaatgttctgcgattgaaaccagca

SEQ ID NO: 35364 - DNA, 358 bp, Homo sapiens
  chr14:61118778-61119136
  hyper
aggccgtgactgggccggccaacatttttcctcccgcttaatccaatagatcgcgtaactggaaagggaaagtgctatgcgctttataccaaggagtctacctgctatttcgatccctcggttaggggaaccaattgttataaatgttaattattggctcggatatataaggtttcccaaaatggaacctttcactgaaaaccgctgaaagaggtaaaatgacatgaatttacaaaccacctaaactaaatgatccattttaaatcgcacacagaaaggtttgagttgttctcgtaacataaaacctttgctgtcaatgcaaatcgcacgaaaagcagagatgcgttggagatttaaa

SEQ ID NO: 35365 - DNA, 70 bp, Homo sapiens
  chr14:61124556-61124626
  hyper
ccccagccagtcattcgcgttgaagcgccgcagcaagtggcaatgcttttggccgcgcattgcccaggaa

SEQ ID NO: 35366 - DNA, 155 bp, Homo sapiens
  chr14:61188472-61188627
  hyper
tctgccccggccctgcggattccgttggtttccgagcgcgggatccgcggcctctagtgggcgcagggcaggtggctcggcgtaaccaaagcgccttctctggacctctccgcatatctgcggaaggcgcacgcacatcccggtgcaccttttgt

SEQ ID NO: 35367 - DNA, 50 bp, Homo sapiens
  chr14:61655782-61655832
  hyper
ggacagcactgggatcgaaagacgatctgctccttcggaagaaaacacag

SEQ ID NO: 35368 - DNA, 39 bp, Homo sapiens
  chr14:61748115-61748154
  hyper
gagccgcacctcgcccgccccttccgaggtgagcaggtg

SEQ ID NO: 35369 - DNA, 42 bp, Homo sapiens
  chr14:61788181-61788223
  hyper
cgggcactggcctcccgggggcttgcgcggggatccacccac

SEQ ID NO: 35370 - DNA, 483 bp, Homo sapiens
  chr14:61788722-61789205
  hyper
ctcctgcacctgtcccgagggctggcctgagacgggactcccggttctcccgctgcgaagcagcgcggccccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacgcccctgggctacgaccacttcgtggccaactgcaccctgcagttccaggagctgctgcgcacgaccggcgcctcggacaccttcgagggttgggtgagtagcggtgaccccttccc

SEQ ID NO: 35371 - DNA, 154 bp, Homo sapiens; identical to SEQ ID NO: 4151
  chr14:62279322-62279476
  hyper

SEQ ID NO: 35372 - DNA, 104 bp, Homo sapiens; identical to SEQ ID NO: 4152
  chr14:62279519-62279623
  hyper

SEQ ID NO: 35373 - DNA, 229 bp, Homo sapiens; identical to SEQ ID NO: 4153
  chr14:62279624-62279853
  hyper

SEQ ID NO: 35374 - DNA, 82 bp, Homo sapiens
  chr14:62279898-62279980
  hyper
cgagttctgggtcgggtttgtgcgtctgccttttggggatcagggtggcttgcatggctcggctgcccggtggcccacgggc

SEQ ID NO: 35375 - DNA, 156 bp, Homo sapiens
  chr14:62583714-62583870
  hyper
ccctctccccaaacccgacctccgtaggggacaccgagccaaggcctgcagcgagtgacctgcccggggaggcgcgggaccgaggctcacctacccgggcccgcgagtctcgcccagccccagcctcccaacccactctgccggccccaacttagg

SEQ ID NO: 35376 - DNA, 360 bp, Homo sapiens
  chr14:62583918-62584278
  hyper
cggcgttccagctctcaaccttgctcccagcagcccccgccggcgcactcgacctacaggaaagttgctcccgagctgtggaggggcgtcatcgcctcctagcaacgctcctagcaaccgggtaacatctgctccctgtggtccaatgcgagctgagaacagctgcgcgcccgcctagcgctgcgaacccggagtgagaggcgcttcagagactggagggacggacctgcaggagccagggctgcccgccgagctgcagttgccgctactgccgctgtcagcgcccgactgaagagtgacagccgcaaaagcaggagtgagcaccgaaccccgcgcttctacctaacaggtgcatgcgcc

SEQ ID NO: 35377 - DNA, 13 bp, Homo sapiens
  chr14:62584279-62584292
  hyper
atctggtgagtgg

SEQ ID NO: 35378 - DNA, 151 bp, Homo sapiens
  chr14:63511856-63512007
  hyper
caaaaatgtgttctgcggtgccaccagccctctcttgccccccggcatcctgggtctggagagcagcggccaggatccgcggcgggggagggggggatgcaggcaaagaaggtggaggaagaggaggaaaaggtggaagagaagattgagc

SEQ ID NO: 35379 - DNA, 646 bp, Homo sapiens; identical to SEQ ID NO: 4156
  chr14:63512063-63512709
  hyper

SEQ ID NO: 35380 - DNA, 414 bp, Homo sapiens
  chr14:63512740-63513154
  hyper
cgctgctaccgcccccctccgggctccggcgcctgaaaccttcctgaacactggcgctttccgcaccgcccttaccccaccccggagcgggagcgcgagccctgaagtccgagcgcacagccggcgcccggaatggcccctgcgacccgggccgggcttggcgtctgggggagcgtgcggccgcccaggggagtttcccccaggaccgctgagcgcaggaggcgatccgcgagcccgccaccgctgcaaagttgcgggaaaggttgcacttgatgtgaagagtaggggaagagggtgaataattcacacccgagagagggggagtgaggagggcagtgttagcgatggaaaaacggtaaaggctgtgggggcgaagatgcgccagggtggagcagggcacgaatcacctctaac

SEQ ID NO: 35381 - DNA, 30 bp, Homo sapiens
  chr14:63670862-63670892
  hyper
gcaggcagtaatccccgctttccatcctct

SEQ ID NO: 35382 - DNA, 30 bp, Homo sapiens
  chr14:64760774-64760804
  hyper
gccttctctaaaatgcggacacgtgctttt

SEQ ID NO: 35383 - DNA, 66 bp, Homo sapiens; identical to SEQ ID NO: 11941
  chr14:64761073-64761139
  hyper

SEQ ID NO: 35384 - DNA, 226 bp, Homo sapiens
  chr14:65007311-65007537
  hyper
aaatctgttgggtcacgggccagtcactccgacctaggcaagcctgtggtggagctggaagagtttgtgagggcggtcccgggagcggattgggtctgggagttcccagaggcggctataagaaccgggaactgggcgcggggagctgagttgctggtagtgcccgtggtgcttggttcgaggtggccgttagttgactccgcggagttcatctccctggttttcc

SEQ ID NO: 35385 - DNA, 39 bp, Homo sapiens
  chr14:65007552-65007591
  hyper
cgcctttcagtcaggatgtctgcccgtggcccggctatc

SEQ ID NO: 35386 - DNA, 258 bp, Homo sapiens
  chr14:65008997-65009255
  hyper
cgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgagggg

SEQ ID NO: 35387 - DNA, 315 bp, Homo sapiens
  chr14:65016501-65016816
  hyper
atggataggccaatacgtcgccacggcttttaagactgggaaacggggcaccaggctgggctttagaaatcgctggagaagcctgggtgcggccgcagcccgcgcggcctaggacggaagcgacgccccgccccgctccgcgccccgggcagccgtgtgcaggcgcctgcgggcggtatcctcggcgacgccgtatggcttccagggcgaggccatgtaccgggtgcccgagttttatgcgaggaggaagcggttaggtgggcagaccccttacttgatggatgtaagtgcagccttggtcgcccccatacccgg

SEQ ID NO: 35388 - DNA, 30 bp, Homo sapiens
  chr14:65170683-65170713
  hyper
aaaagcggacacggccggctctggtaggat

SEQ ID NO: 35389 - DNA, 52 bp, Homo sapiens
  chr14:65170984-65171036
  hyper
accccggctctggctcgccgcgccgcgaaggttgccccggcccccgcagagc

SEQ ID NO: 35390 - DNA, 38 bp, Homo sapiens
  chr14:65345951-65345989
  hyper
gtggctcccagcacccggaggcccggccccctctgctg

SEQ ID NO: 35391 - DNA, 30 bp, Homo sapiens
  chr14:67878885-67878915
  hyper
tccgacgcggcagggcgacgcctccctggc

SEQ ID NO: 35392 - DNA, 308 bp, Homo sapiens
  chr14:69726355-69726663
  hyper
ctcaggactctcccccgcccagccgcccctacacaaggactcgccgaacacaccttgaatcccgcgccagagcgcagcccggaactgcagctcgcggcgcgggcccaggtcgggggtcgcgcgtctccagtcggtgactcaaggccgctcggtccgggggtgggtgtgggtcggcaggaccgaccagggccgcgcgggggcagctgccgggcgttcggtcacctagcggtgggagccgaggctggctttggccagtcgccattccgccgcgggcgtctgtctcgccgggttcccgggcgcgggaggaa

SEQ ID NO: 35393 - DNA, 521 bp, Homo sapiens
  chr14:69727096-69727617
  hyper
ccacgcagcatcctccggcggccggggcgcgcagagggcaggcaggaggtcggagcagctccgcgaggaccgcaccatcccgctcattgtgagtacgccccgagcgtcggccggccggctagggagccgcggcgcgcgtccagaccctgcgcggcggccgagggcgcggggcccggccagggctgagtgcccgctgcgccgggccggctttgtatatgttggagcattcctgcccgttgttatggcaacctctgccgggcggcggggctggggcgcaccgactaagggagggtgacagagggtgggggctgggagaaagtgctgcaagtttggtgggcccggcgtgcgcgcgcggctgggaacgtggcggctctcccggctctgcgctgccggggccgggagtctgggggctgcgggagcctcgtgtgccccggaaggctgccgggcccagcgcgcggcgagcgggcggtgggaaccactcgcagccgagcgcgtaggtggcagtgcgcagcccctctcca

SEQ ID NO: 35394 - DNA, 81 bp, Homo sapiens
  chr14:69727831-69727912
  hyper
ggtgggcagtgtcagcgcccgaacttggcgatacccttgcatgaagtcagcctcgcgacatctaagcgggcagggaaacaa

SEQ ID NO: 35395 - DNA, 58 bp, Homo sapiens
  chr14:69950779-69950837
  hyper
ccaggaagagaaatccgatccgatgcgcgctaggcggcggcggcggagcacagtgaaa

SEQ ID NO: 35396 - DNA, 30 bp, Homo sapiens
  chr14:69951121-69951151
  hyper
agcggacgtggccctcgtctcgatgtcggc

SEQ ID NO: 35397 - DNA, 324 bp, Homo sapiens
  chr14:70014623-70014947
  hyper
agggtgggcgagacacggccgccttccttcacatccaacgccggtgaggctcagcactcattgtctcactggcagcacagacaaagccttgcgggctccacgggataatcaacagcgagaacgcccccagggacctccggaaagagacaccattggttgcaggcctccaggttctcgtctgcctggtgagtgaggtggcacgcagcgtcagtcgtctgcaggaatttgtgctggggtaaatgcgcgcttcgtgcagaccgcagagctggaggcggagggctggggtccctgggccgcgggcgggttccgcgtgcccctccctcg

SEQ ID NO: 35398 - DNA, 510 bp, Homo sapiens; identical to SEQ ID NO: 11948
  chr14:70346020-70346530
  hyper

SEQ ID NO: 35399 - DNA, 40 bp, Homo sapiens
  chr14:70346833-70346873
  hyper
ttccctgtggtctcacgctggcgcccggtccagcgcgctg

SEQ ID NO: 35400 - DNA, 147 bp, Homo sapiens
  chr14:70653698-70653845
  hyper
gccgctgcaagtcaccgggtcgccaggggccgaggaggcttcccttttggtgccccaccggaaggccggatgtgttcctatcacgtacccacattccacccccgctcaactccctcctccccccacccccttcgggtgtttcttgac

SEQ ID NO: 35401 - DNA, 227 bp, Homo sapiens
  chr14:70654063-70654290
  hyper
gagagaaggaagctgcgatgagcgggtaaatttatggtactgcattaaaggcatttcttctatttaaccccaccccgccaccaccaccactaccacaccgttaaaaataaaatacaatgaattaagacgaagaactgcttttttccccggagcaaattgctttcatcatctttcccagtggctcgggtcctctgggcaggtcagccagggcctgtaggagcagcagc

SEQ ID NO: 35402 - DNA, 42 bp, Homo sapiens
  chr14:70654291-70654333
  hyper
ctagcctctgaatcagggctttgactgtgtgtgtgtgtgtgt

SEQ ID NO: 35403 - DNA, 204 bp, Homo sapiens
  chr14:70654393-70654597
  hyper
ttagttatatatttcgattctctccaccgagtcccggatcacgcagaccaccaggggctggagagtgcagcactggagaaaccctccttctccctcgcccccttggccccagcggtgggtgctctggggctgcagctcccgacccgcggcggtggagtcccgagattggggtgagcgcgtgcgtgcgtatgtgcacgcgggcgc

SEQ ID NO: 35404 - DNA, 41 bp, Homo sapiens; identical to SEQ ID NO: 1186
  chr14:70654598-70654639
  hyper

SEQ ID NO: 35405 - DNA, 147 bp, Homo sapiens; identical to SEQ ID NO: 1187
  chr14:70654640-70654787
  hyper

SEQ ID NO: 35406 - DNA, 858 bp, Homo sapiens; identical to SEQ ID NO: 4164
  chr14:70655032-70655890
  hyper

SEQ ID NO: 35407 - DNA, 211 bp, Homo sapiens
  chr14:70655919-70656130
  hyper
cgaattcagatccaacccctgccccgcggccacccaccctagtcgttggagcctggcgcccgcgcctcccggccggcagcacgtcaaaacggcggcgcgtcctgacctggattccgccgagttgggagctccaggcagcaggcgggcgcgcggcaccggctttccccttgtcctcaggagacgctgcctgcaattccgaaattaagtctcc

SEQ ID NO: 35408 - DNA, 602 bp, Homo sapiens
  chr14:72398631-72399233
  hyper
aatacataaaaatgacgaggttaggaacaatatcgctgacggtcgcggtgtcccgttttaatttagagggcgccagcaacacgtcagtgagggagattcagaagccgccgggcacctcaccccgggccgggaatccctaagagaaccttgacgccgctgaagtttccggaccgggccagtttggaattgacgaaagcagcctccgcccggtcgagccagtctctcggttttctcggcggcttcttgaggatgaggcatttctaggttttctcctcctcgagcaaatcacggtctgcgccttccgcggctctgggaacaggtgagccgtgcggcggcgcccgcgggacgcgctcaggtgccggtccccgcccgccggcccctccctgcagcacgcggtccgggcccaggtgccggggcccaggtgccggcgcccaggtgcgcggggcacggggctgcagctccgctcggcatccgacagcgggcgccgctgcagcagctcgcgggccgcggagctgaacggcttcgcgagttggggcagctcctcgcgctcggccctgctcggcggcgagagctccgcctgggcgccgcgttcctacagccgc

SEQ ID NO: 35409 - DNA, 2 bp, Homo sapiens
  chr14:72399451-72399453
  hyper
cg

SEQ ID NO: 35410 - DNA, 459 bp, Homo sapiens
  chr14:72399780-72400239
  hyper
tgtccatttcagatgcgtgacaggtgcccgtgtgtgtgtgtctgcagtttgggactgtggaagcacgagcttacataagtggttaggcaagctggcgtgtggacttgtgtgggatgggtgcaggtctgcatataaatcatgttcctgggtttctgggtgtgaagcgcacaccgacggggacgagagcgcagaggatggcgcttttagatacttccagtcttccgatgttgtgatcgcaggtagggcagctttgcctctaatcaggcgttcattaactttttccctgaacaagctcgcccatttgtggtttggaagaaaagaaagcgagtctccgcggtgaggtgtggagggcaggggcgggtggggaggtttgttgtttgggaactgcgctagcaaaggaagcggtggctattcgcttggagaggatgacaaatgaactggttgcgtgaggagtgaaga

SEQ ID NO: 35411 - DNA, 76 bp, Homo sapiens
  chr14:73358964-73359040
  hyper
tagaaacagcatcagcggtgttgcagcgaaagcaaccggcagcgaggatgcggcgaagttacgcccatttattctg

SEQ ID NO: 35412 - DNA, 88 bp, Homo sapiens
  chr14:74208209-74208297
  hyper
gttagcaaccccagccgctcccaggaaaccagccagcagcagcggagggcagggctgggcgggcacagggtcccgactatacccagtt

SEQ ID NO: 35413 - DNA, 176 bp, Homo sapiens
  chr14:74254402-74254578
  hyper
gggtccctgtccccacgttctctctaaaagtctgcatgatgtccctcgtcatttctacgggttataagtgagcaagacgtttaccacgtatcacacttctgggggctatttcaacgcccaagctggggctgcagaatggtttctgttctaatcctcccccgcgatttccacctctt

SEQ ID NO: 35414 - DNA, 351 bp, Homo sapiens; identical to SEQ ID NO: 1188
  chr14:74706046-74706397
  hyper

SEQ ID NO: 35415 - DNA, 605 bp, Homo sapiens; identical to SEQ ID NO: 1189
  chr14:74706940-74707545
  hyper

SEQ ID NO: 35416 - DNA, 176 bp, Homo sapiens; identical to SEQ ID NO: 1190
  chr14:74707572-74707748
  hyper

SEQ ID NO: 35417 - DNA, 120 bp, Homo sapiens; identical to SEQ ID NO: 1191
  chr14:74707791-74707911
  hyper

SEQ ID NO: 35418 - DNA, 464 bp, Homo sapiens
  chr14:74707912-74708376
  hyper
aaaaatgtccaaatctgctttaaaccagaccaagaaacggaagaagcggcgacacaggtgaggcccccgctttctgttacctctcctgcccgcgcaccccgctgccgtcccccgttccgggatcgggtctctcggaccctattttcgccgacaacggatctgaggtccgaggccgtgccagggcgcagaccacgggttgtttggcggaatctgcccgggggccttggcgtcggcaccggttgagcaggatgagtggccgccgggaaagcggcccggttcgggctttctcctccttgttcaggagaaaggaaaggctccaacacaggccaaactgagccacagagtgggggcggtccccagatccccgcaccagtacattctgagagccacacagacccggcggcgggcagattagctcccacctcctgccagagccggttctttgccctcggcctcaaccgccg

SEQ ID NO: 35419 - DNA, 318 bp, Homo sapiens
  chr14:74708774-74709092
  hyper
cccttccgcaccagccgcactgctaccagttccttgggtacatttgtaaggtggttttcaaggaaataaaggagaaagaaccaaaaatctgcctgcctttctgcgggtgctgctcgcaggtgctgccccggcgctcacctcggagctatttccccgcaccccactccgtccccatcaggtggggccgccacagactctgcgccctttcaagacatttctccactagggcgttctctggcacccccgccgccacatcgttttctcccaccctaatttgttttcagcctctttgcaccctctctgcgcttttctatgctt

SEQ ID NO: 35420 - DNA, 30 bp, Homo sapiens
  chr14:74725251-74725281
  hyper
aaggactgtgaggggcgagaagggaaccgc

SEQ ID NO: 35421 - DNA, 182 bp, Homo sapiens
  chr14:74892589-74892771
  hyper
gcggcgcccccagaccgccccttacctgtcccgccgcggacggtcccgcctcctccgcggggctcgggggctcggcatgggccggtgagcgacggcgcccccgcctcgcggtcgcggtggaactcccaggagggctcccctgctctcgtccccgcgtccctgagcagccgccgcttcagcac

SEQ ID NO: 35422 - DNA, 18 bp, Homo sapiens
  chr14:74892798-74892816
  hyper
cgccgccgcccgccccgc

SEQ ID NO: 35423 - DNA, 56 bp, Homo sapiens
  chr14:74893057-74893113
  hyper
gaagtcgggggagcccggaggaggcggcgaagcgaggggcgcgcagctggaacccg

SEQ ID NO: 35424 - DNA, 348 bp, Homo sapiens
  chr14:75077895-75078243
  hyper
tgcgaaaggatttaacgtcggggctccgggagagttggtaagaaaggatgaggatgatgatctatctgccttcaactcttcgaaagcggatcaaatcttccaatcccgattttggaacctcggggctgtttcccgaagtactaaagacagagggacgagggtatgagagcggcgccctctcctctcgcctgcacgcccctccacaaatgagccctggctcccctctgtaccctccaaacttccctctcccatgctcaccccgtgagccgccctcgcggcggggttgggggcgcagccccagaccgctgtggggtccccaggcgtgggagagccggcgcggcccgggtc

SEQ ID NO: 35425 - DNA, 247 bp, Homo sapiens
  chr14:75078651-75078898
  hyper
cggggcggctggagagtggtgcgcgcgggcaccgcgaagagctttgtggtcggcacgctggacgcccgcgggctgttctcccggccccgcccggcggccagcttctctgagtctagggggccctgaagcggccgactgggggcccggctctcggcggaacgagggctgcgcgccccgagcctcgagtccgcgctcctactccagctgggctcgcacggctgctgcaccttcgcgcctcctccctgtg

SEQ ID NO: 35426 - DNA, 230 bp, Homo sapiens
  chr14:76604575-76604805
  hyper
tagagagattcagcccggacaatcagggttggcttcacggaggagggggtatctgagctgagctttgatgaatacgtcagatttgggggaaaggttgctgctggatagcggggcaggaagaacgagcgtatctagttgtaatgccaacaggtcagggggggaaagttggggaatggggtgggaggaggaagaattagactggccccttccatcatcgccatccttctgtg

SEQ ID NO: 35427 - DNA, 425 bp, Homo sapiens
  chr14:76605040-76605465
  hyper
caagaaaaaagggagcgcagcgccgttcccacttgttagattgaaggcgcctctccagaggggggaaggctccaaattgctaattagcgcctgtgaaaaggcctagctctgatatgcgcgccgctgaaaggccgacgttaatgaagccgcggcgcgcccgcttccctttgactggccttcatccctcctccgcgccccgggccggcccgaacaatgcggcggggagcgcaggctcccccaggcctcgccgggacggcccgggcagcgcgcgcggggggcggcgcggcgccggcgaaatgtggagggggagataaggccgagcgcagggaagaggctcactcccaggggcccagggaaaatttgcagttattatgaaggagatgagacagattaaaagcccttgtgttcgccgctttgccccttta

SEQ ID NO: 35428 - DNA, 109 bp, Homo sapiens
  chr14:76795936-76796045
  hyper
gctgtattaaatcaccgaggtgcccatgtagcgcgggctctcttttctcctctcaactccccccaccacccttgtgggcacacacagacccgggcgcacactcacatgc

SEQ ID NO: 35429 - DNA, 92 bp, Homo sapiens; identical to SEQ ID NO: 11971
  chr14:76819300-76819392
  hyper

SEQ ID NO: 35430 - DNA, 84 bp, Homo sapiens
  chr14:76842636-76842720
  hyper
tcactgtgccctgcccgggctcgcaccttgcccgtgcccttcactcgctcttccgcgtgatttccccgccgtctttctctacca

SEQ ID NO: 35431 - DNA, 202 bp, Homo sapiens
  chr14:76843184-76843386
  hyper
agagaaagcctttcccgcgggcgctttgttttattatttccatcctggggaccaaaaatgatcccggcaagagagagaaaatcgaacgtgccgcggcggtttggaaactgcaggcggccagtgccgctctcgcctcgcggtctccgtggggcgccccgagggtgcgcacgtggcgcggcggatccagggcgcccgggggatg

SEQ ID NO: 35432 - DNA, 262 bp, Homo sapiens; identical to SEQ ID NO: 11972
  chr14:76843732-76843994
  hyper

SEQ ID NO: 35433 - DNA, 187 bp, Homo sapiens
  chr14:77227599-77227786
  hyper
tctccatggagtttgcgctccctctggcacgttgaaaacgtcctccgcagcttcgcaccggcttcgcggcgccctgacagctgggtgaggagggagcgaatgcccaccggcgtccttggggtaacttgggacagaggcaccgccgcggggggcggaggactgggcgcgaaggcgctggccctttaag

SEQ ID NO: 35434 - DNA, 239 bp, Homo sapiens
  chr14:77228556-77228795
  hyper
ctcccggacttgtctcgtcgcgtcggagaaatcgccccccagcgccgctctcccgcccgggggtcttggttccgagctcgcgcggccgggagtcgcctcggtcttccttggggcgcgcgcagatgtgagcgtgcgagagttgtgtaggggattttgttccctccgaaactgagacccagggcgcccagtgggcacccgtgccttgactctgtcctttctgcagccgctggtccgagctg

SEQ ID NO: 35435 - DNA, 308 bp, Homo sapiens
  chr14:77591237-77591545
  hyper
gcccactcatcaggccgattctcctcaccttacgcttagatgagtttcgagtaagaccactgctggcatcaagagtctgggcccatgatctcgccctttcgggctaggcgaggcagacccaggttggctgcggcccgcggtccccgcgcagccaacactggcagccaagcgcggggcgcgcgcgccgggagagtggagcgcggaggcccgacggcgccccctcccggcgggcccgagccacggccgcgggctctggcgggtgccggggaggccacgcgcgacggcgtcgcagccggagcccagacaga

SEQ ID NO: 35436 - DNA, 104 bp, Homo sapiens
  chr14:77600264-77600368
  hyper
cgaacatttcagaacccaggacagctcctgcagggcacggggaggggaaacaccagagccgctttacacccaggccaccggcataactgcgatctaggcaggct

SEQ ID NO: 35437 - DNA, 87 bp, Homo sapiens
  chr14:77606262-77606349
  hyper
ccagagacccgagcccgcagcggcctcgggtctaggccccacctgggggtgagtgttgcctggggttttgagcgagctcggcgcctt

SEQ ID NO: 35438 - DNA, 99 bp, Homo sapiens
  chr14:77606757-77606856
  hyper
gtatgtatatatctgcgtgtacagacacgcagcctctgctatctagctttaaaaaaatcaattgaaacaatcgatacactcacactcgctctcgggcac

SEQ ID NO: 35439 - DNA, 1396 bp, Homo sapiens
  chr14:77606921-77608317
  hyper
cgctggctgcccgggctatttctttgcgaagagcgttttcatttgaggcgaaattaaaatccccccttcgcgcccgcctcccgccctcctgctgagagaaacccaaacaaccctcatggcgccgaaatcctttccatgccgacaagcccgccctgggcgcacgagtggatgcttggccagcctttcctgggatcgaccccgccgccgtgctcagccctcaccacgtccccatcccaccccacgcctcacagccggggttcctggccagcttcggaagccaccgagaaataggattccgtgcgcccgagagaacttttccaggggctaaggaatcggccagccggaggcgcgagaaaagttctgggaaggcggttgcacctaggatgggtggatgccacggggcctccgtccaggctgtcccgtccgcacgggtcgactggtcaccttggaatcccctttgcaggtcccagcgccccccgggaacccgcagcctccgcggagagcgtgggcctctccctaccgctggggcgcagcgcagtgcacgcctgagggtggtcgccgggggctgggcacgcccccagtcctgcgccgccgggggctgcggcggtgctgcccaccccagagagccctcggcctggggctccggcgaagcaagtgccttcccggcgccggtcgccaggggggcgcgggagcagccagatgcgccgcagcgctgggaaggcggcgaaggacaggggctaggggagtgaggggcgctcggcaggcagcctcagccctggccctgcgcgggagaagggacagcagagaccgcccgtggggccccggggtgtagggagctgtccgttcagccctggcgcccgcctcgcccgcggcagagggcggcacagccggagccttggaaagaccggcagcgccggcagccgcgggcttctcggccactgcctcccggacgcacgggaagccgccccccgcgccgccgccgccgcactgccgccgtcgcagaggggtgaggaaatcaactcaccgagctctggtcgccgacaagaggagccccggacgccggctctcgccctgcccgaggctgcaaagttgtggactcggcccggctggctcgcagcctgcgcttcgcttcgggaactgggcaagtagcggggatgtggggaggagggagcgggcagctgctggcttcccacttgggcgccagcgagtaagggccaggaagcggcggggatggcagctgggcaccccccagccccgccacccctccctccgctcctgggggcggtgctctggccgccagtctcagcatcgtggacttgccccctcctcccctctcgattccccttgagcgggctggggcgccctgcctggtttcagcgcccgttccagctgggag

SEQ ID NO: 35440 - DNA, 127 bp, Homo sapiens
  chr14:77737019-77737146
  hyper
aggggctgtgccacccgtcgccgcgccccgctcctctggcgcacatctggcaggcgccccagcgccccggcagcggccagttttccctccttcggggccggtcctgccgcgtgacccctttcccgcc

SEQ ID NO: 35441 - DNA, 439 bp, Homo sapiens
  chr14:77737147-77737586
  hyper
aggcagcctccacccgcatccccgggcgctcgtgtagccctcacctggcaaacaggacggtgccgtgctccagcgggctgcggctcactgcccgccagctctgccggatcagctcgggctccgggcgctccatgctgtcccggggacgcggagcgcggggctgggaccctcagggctcgggtgccgtcaccgcacgtgccgcgccatctcctccgcgacgcggtcccctccgcccctcgtacgccccccgtgcctccgcccggcgggggccgcagccgctccttccctggcgcgggagagaaaaggcgcgcggccagtcgtaggtggagacaccccagctgtgcttccggggaccccgcttggccgctgcgccctgcgccccgcagccgccagagccgccccaccccgcgacgcctgggctgggcgctttaaagccgcc

SEQ ID NO: 35442 - DNA, 549 bp, Homo sapiens
  chr14:77964498-77965047
  hyper
gctggccacccctgccggcggctggagagccccactgtgcctccgcttgtctcatggaaggggctcacctgaccgtttgaacctcagcggccctggcccgccactccgcaaagcgccagattcctcgcaccggcgggactcctctccgagctagcgcgcacctggaaagggggctgcaggcgaggtccgctcagggcgaggaagcccggccaccgtggagtgtcggccacctcactccgcacagaagtcaaacttgtcacccggctggtccgcggcagcccggctcgcggtcacgcgcgaggagtggaagccccgaagtccggcgcacctgggcaacgcccggtgtccgggagcttccggccggccccggcccctctctccatcggggggtcgctgcctgtgtgtgtcccggtcccgctccccgcacggctggagccggcgggctggggaggtgggaccgacagcgcgctccgcagcccggtgccgccgccactcacctctgcgagcctcgtgaggctcccaggccgtggtccgcggagccgcggcttc

SEQ ID NO: 35443 - DNA, 190 bp, Homo sapiens
  chr14:77965493-77965683
  hyper
cgggaagctgcggcccggcgcgctccggccctgcgctgcgactcctgcggggccctgagggtccgacgccacctctgccctccccgaccgcgctccaactgcgacctggaccggcggtgccgcgcgggcgagggaggcgcagcccgacgggagagtggcgcgagtcttcggatgccgggcagatgtttgg

SEQ ID NO: 35444 - DNA, 30 bp, Homo sapiens; identical to SEQ ID NO: 11983
  chr14:78624601-78624631
  hyper

SEQ ID NO: 35445 - DNA, 30 bp, Homo sapiens
  chr14:79745212-79745242
  hyper
ggtcgcccaagccaccgccaggcagggagg

SEQ ID NO: 35446 - DNA, 117 bp, Homo sapiens
  chr14:85996479-85996596
  hyper
ttgtagttagttgtacgttcgaaacctgtcgccgtcacttgcgcgtttggcattatccattgtcaccgcggaggaacgagcgctcgagatatcatcagtgcccgcaaatctccgcgc

SEQ ID NO: 35447 - DNA, 36 bp, Homo sapiens
  chr14:85997566-85997602
  hyper
gtgagttccttgagccgcttgcgtgggacgcaggga

SEQ ID NO: 35448 - DNA, 105 bp, Homo sapiens
  chr14:85997821-85997926
  hyper
gttgcaagctgaggtcggggtactgacaacgggaatgaagccataggggaagaggataactgggacgggctggacccatacttgatacccgggaaactcctagag

SEQ ID NO: 35449 - DNA, 15 bp, Homo sapiens
  chr14:85998560-85998575
  hyper
tagttttaaactctc

SEQ ID NO: 35450 - DNA, 54 bp, Homo sapiens
  chr14:85998629-85998683
  hyper
cgggctcgttctccctcttctgttcagattcagcctcaccggacttgttacaac

SEQ ID NO: 35451 - DNA, 10 bp, Homo sapiens
  chr14:85999522-85999532
  hyper
gctccaggag

SEQ ID NO: 35452 - DNA, 134 bp, Homo sapiens
  chr14:85999596-85999730
  hyper
cgcgaattcattactgtaaacatatccgggggtgtcaggaggggtaggggtgggggccgcggcgcctacattagcccggccgcgtcggattgaggcagtagtgtggtctgagcagcctccagacccacgccggg

SEQ ID NO: 35453 - DNA, 59 bp, Homo sapiens
  chr14:85999838-85999897
  hyper
cgccgagtcccgggatcctccaaatccgaggagctccggcgccgcggggcagctttctg

SEQ ID NO: 35454 - DNA, 35 bp, Homo sapiens
  chr14:86000128-86000163
  hyper
cgctgcggggaggcgcgcgccgctctgaggctccg

SEQ ID NO: 35455 - DNA, 91 bp, Homo sapiens
  chr14:86000400-86000491
  hyper
gcccttcctggccctcgcgggtctggcagaaagtaagagggaggcgaagttcaagatcccggggatgagcaccgagcgctggcagatcact

SEQ ID NO: 35456 - DNA, 262 bp, Homo sapiens
  chr14:88789384-88789646
  hyper
aagaaaaagtaagatcggcgaggggtggatgaaaggatggagaggaaggcttggggagatggaagagccaagctgcttcccaaaagcggtgccggcaggttaggggctgcgcagcctgaaggctggggctacggagaagcccactgcagtgtcactccagcccccgaaggcgtgtgcgcacacactcccgcacacacacacccgcacacacactcccgggcgcgcgcttgggcgggcacgtcagcctcgctcggccgcgctg

SEQ ID NO: 35457 - DNA, 171 bp, Homo sapiens
  chr14:88790076-88790247
  hyper
aggcgctgcaggaggcggaggaagggccgctgcggctccgccgcagacctcggcctccgggtcacctcttctcaccgctctcaccctgagctctccctccttctcttttctcacttcattttttttcctcccgcgtctggctctctcgcctgagtcccgaacccacgtccc

SEQ ID NO: 35458 - DNA, 236 bp, Homo sapiens
  chr14:88790298-88790534
  hyper
cgctccgcatctgctgcgctctccccgcccggggaagctcgctcccaaggcacagcttggtcccttccccagctacctgcagccggactggggccgctggtcgttggctggaaaggaggcttgagagaggcacgggggcccccggaggaaagcggagttgccaagacccggcagctcccggaagcggcggccccgggatcctgggaccagcagggcagatgcgaagggacccagac

SEQ ID NO: 35459 - DNA, 447 bp, Homo sapiens
  chr14:88792916-88793363
  hyper
aggaaaacaaaacatcgtggcgcaaagtctccctgcactcgccggcccccagcaggagacccgggctggcggccactgcgtcctgggtgcactcggtggcaaagcgctgctaccgggcacgggtctctgcagctcaaaacctgcccggctggagcgcaccaatagttgccccaccactttaatgaatgccgtgtggcccggcatgggaaggctgggaaagcccgaaaaccccagtcatctctggcaacgaagtttccccgagttggctggctcccttaccccctccccacgctccagcccggggtagctgtgagaccggaggagacgatgcctgccgcgtggggagtctcagggtggctggcaatgaacagctcagccagagaagagtcgaacacggattccggggcgagtcaggagaatttcctgggacagcgaatggcagggagt

SEQ ID NO: 35460 - DNA, 30 bp, Homo sapiens
  chr14:89493162-89493192
  hyper
ggagaggcgcgtcctcgaggtaacagggat

SEQ ID NO: 35461 - DNA, 30 bp, Homo sapiens
  chr14:89493428-89493458
  hyper
tctgggcaccctcctcgggtgctgcccatt

SEQ ID NO: 35462 - DNA, 145 bp, Homo sapiens
  chr14:89817889-89818034
  hyper
ccacttcctgtgaagcgtttggtctatggacagcctatttttaaaaatgtaagtccttcctttgaggccccccggaactggcagcaggccgacgggcaatcgttcctctggccgcacactttcaagtgaccgaatgtacccaaac

SEQ ID NO: 35463 - DNA, 548 bp, Homo sapiens
  chr14:90084100-90084648
  hyper
aacataaaggtatctcgagcaaactgcacccaaatgaaaaaccgaccctgcagaaatctgtgcacaagagggctatctgaaactacagcacgattttaaaagaaggttttgggtgactgttttcataagtctcaatctaactgaccaatcagtgtgagagttaaagtgggctccagtcattcgtgcagccttcagagctctgcaccctccgagctgctctcctctccaaggcagagtcggcgatcaatgaaaaacagggaacaaaaggaatataacaggatgtcttccttagctaaggaaaacgattccctttttcctcaatgagccagtcgcaccctgcctacgacagctccacacgggagcttccagcagaccagtcctttcgggtgaggcacattttacatttgcaatcatgtgtcccaactgctagcaaatgtgtcaccttaagcacagcctgtgacggagggctccccgagcccaaccaattgaaactaataaattaaataaattaataatcccacaattaaaacctccggagaaagattgca

SEQ ID NO: 35464 - DNA, 110 bp, Homo sapiens
  chr14:90085840-90085950
  hyper
cagacagaggtttgccgggtgcactggtgacattggccgttcacagacggtgagacgcggtacgggatcgataaagatagatttcaaaaatataacgctaaaaagaaaaa

SEQ ID NO: 35465 - DNA, 625 bp, Homo sapiens
  chr14:90526555-90527180
  hyper
agtgagtaacagagccgagaggactgctaacagcaccagggtttctgatgaaaatgcactcgccagagctgtgtttctttattcgaaatcacacggttttactcaacagggctcctagcccttctgtctctgctcctggtgcgtaagggcggtgtgtggggctctgcgcctgaaaccgctctctcggaaggtgggaagatgcccacgtatccattcctctccgcgtacagattcgctcccacacgcccgggcgggtgattccggagggccgcgcggggctgtgtgcgcgggcgggggcgggatgtgtctggagggggcagagcgccctctcccggccccggagggcccacgcggaccggctgagcgtcccaccagccggttctgcatccactacccagatctgcgcgccctggtgggagcaccgcagccccgggtcggcccttcgaacgccgagcgtctacccgcggagaccagcgcaggaggcgggcccgcgcgcaaggaggcgggcgacagggtggagtcgccgcagctggcagccgcacggctctacctgttgcagcgtcggagcgcgcccgcctgagaaggcagagcgcggtgcggacctgtgctccgcgcgccggctggc

SEQ ID NO: 35466 - DNA, 380 bp, Homo sapiens
  chr14:90527551-90527931
  hyper
gagcctactagtaggcgcagaggacgcccccgcgcaggatccagagaccaagggcgctctggcatggtcaaggcgagggaggctgcccgggggagaagcccctaacttcctttgctccctgttccaacctccctttctggtctcctctctccagcccgtccgcccaacggatgcgcagcgttggggcccggccggaggtcggagccctcggacgccgcagccctcggacgccgctcagcacagcccctctctccgtgcgcccgccctggaccccctccatccctaagccccggcagccgattcggagactcgggaggccacaggctcagcgcgacaccacgaccacaactaggaggcaccatcgtcgatctacctgggga

SEQ ID NO: 35467 - DNA, 519 bp, Homo sapiens
  chr14:90528183-90528702
  hyper
ccggggtggaaactgcgcccgcatcccagcgccaagcagacgtgaactctgcgcccgttccccgggaccttcagcgttaaggagaactccgaggagagcagggggagtggaggggaacggcggcgacaaagcggatttgaaactaggagtcaaggaggacgtggggagctggcgccacaggagctaccgaggcggcggccgggggagcctcgcggcctgcgggagagcccggcggtcatgggcgagccggcggtggggcgcccgggagctggctgagcgccggggcccttatttcccgggggtgtgggcgagactccgccgacgcccggtgccgtgggcctgggggctgcccccgggggcccggccatggctggccggggtttcagctggggcccgggccacctgaacgaggacaacgcgcgctttctgctgctggccgcgctcatcgtgctctacctgctgggcggcgccgccgtcttctccgcgctggagctggcgcacgagcgccaggccaagcag

SEQ ID NO: 35468 - DNA, 213 bp, Homo sapiens
  chr14:90528934-90529147
  hyper
tccggggggcaggaccgaccctctcatcctttcattcatccatctgggcgcccagccagactccactgacatgagctgtcgcctgatcaacaggtggtattgcctccccgctgctctaatgtggtccaggcaccggcagcttcagcgtcacctggcagcttgttagaaatgcagtctcagtcccctctgcagacctgccgagtcagaatctgc

SEQ ID NO: 35469 - DNA, 295 bp, Homo sapiens
  chr14:90850099-90850394
  hyper
cactcgaactgccaccgagccgacccttcctgttttggaactcagggcccggccacccgagaagcaccctcatgggcactttgtttctacaagggcccgtttccatttccttcctaaggtttccttatcccctgcggcaggaggggcccgctgggctcgggttttcagctgcgttggagctgcagaggctgcggagtgaacgcggccaggagcccgcctgggagcgcgcagcgctctaggagccgagagccgctgcttggccctcgctggccgggtaaaccgaggggaagctcct

SEQ ID NO: 35470 - DNA, 53 bp, Homo sapiens; identical to SEQ ID NO: 12000
  chr14:91580352-91580405
  hyper

SEQ ID NO: 35471 - DNA, 30 bp, Homo sapiens
  chr14:91581588-91581618
  hyper
aaggaaaggagaggccgagagtaggaagaa

SEQ ID NO: 35472 - DNA, 30 bp, Homo sapiens
  chr14:91720177-91720207
  hyper
ggccaagttgtgctccgattccacgccccc

SEQ ID NO: 35473 - DNA, 416 bp, Homo sapiens
  chr14:92040467-92040883
  hyper
taagggggcgggccccgttgggtgctcatgacgcaaaggtccctaggatttgctcctcacagcgggagcgccctcgagaggaaccgcgtctgcgcctcccgagacggaccactcgggcgcctccgccccgcgccctgcctcgggggccgccccgcgcagtgagctcagcgtggaggcggcagcgccctcgcccttccgcgccctcccagcgcggtctctcctcgtccgcgcgccccgctccccaggcgtttctgggatgctggttggccgggcacttacgtgtttcaaagcgggtgacagccgccgctcgggtgtactgttcgctctctcccgccaggatccgagttcttgttccccgacaactcgtgggagtgcccgctccagcgtggtttctccttctccgggaacggccccag

SEQ ID NO: 35474 - DNA, 542 bp, Homo sapiens
  chr14:92789280-92789822
  hyper
ggtaaaggaagggctcgttgcagctccatatggaagaaaggagagaaaaagggagaaggaaggggattatattggtcagtagaggtccaactactgaagagaagagtgcacgggggagtgcgccctacgggacgagtacacgtgctgggaagggcggggggtgagaggcgggcaggaggggaggagtagggaggcgagagcagcgggcgggaggcgccacggcctctcagacgctggcgcccgcagccgagaagccagagagaaagttcccggggagagctcgcccctgggagggccgacgtcgagcctgctcgccgcgagggtctcaggtaccgcgcgtccagccagccttcccgcggcgcgcactcggccgcccgggctcggctcgtcgggaagcaggggaacatcgccggctggcagccggggcggccgccgccaaacttggaggaggaggatgctgcgagtgggcgcggcggcgcggggcgcgggggcgcactgagtgctccctacggcgctgctgccagggctgtggccgggcgagc

SEQ ID NO: 35475 - DNA, 140 bp, Homo sapiens; identical to SEQ ID NO: 12004
  chr14:92789959-92790099
  hyper

SEQ ID NO: 35476 - DNA, 358 bp, Homo sapiens
  chr14:92790436-92790794
  hyper
gccgggcaggtagagcgcgcccagaagagctgatggacgctctgggctgtggcgccggttcccctgagctacgagcggcccctgggggggctcaggacgcggctgcaggtgtgtgttactaagacgaaagcaagaaccgcttccgtcccgggagtgcgcccggaatgggcagcgcaactgcggggtgcaggcaggattctcttggtctggggtgggcgaaactgagtggcccgctttcctattctgcagagccgcaggaaccgccactgcgtctcgcccctgccctggttcaaaggggtcccctgggtgccctgaggtgtttgttcttcccaaaccctaaaggcgttggggcagtctg

SEQ ID NO: 35477 - DNA, 1159 bp, Homo sapiens
  chr14:92979611-92980770
  hyper
gcatccaagaggaggcggcgtgcacatctgtcaggaatgtggaggaggcgccctggctctggtctgaggttgcccttgaacgatttcgaggctccctcgggcaaggctgtggctccgagtgggacgaactccccgccagctctgggcctccccacctgccggcccgcggtcggcgccggcacaggcggagggcgtcttccttcccctgcggccccaagccaagtggaagacttttctctaagtttccctctccgaagccccgcgggcctcccgcgccccagccccagccacagcctgtggaggcggcaccccgaggttgggcgcccgtgcggcgccttggccccagcaccccccgccccgaggcccggccccgggggcgcggccgcccgggcctccgtgtgccccagggggctccgggccgcgagccgctgccgaatggcttttgacaaaaaaacccttgaccaccaaggccagcctcttcctgaaagccccgctcgctccgatacaggaagtagaagggagcgagagccccagagcgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacggggtaagtccgggcggccgccccctcctccctcgcgatccccacggcccgcgtcctggccgccccactccacttcttgtcccagagagtccttcgggcgcgtgacctcggggttgtcgggctgatacgggacccccaccgtggccgaggccagaacctggttctgcggggcagggggcggccctggtgactccgctggacccgatgttggctaaactttcaaggccaggcatttcactgggaacccagtgcacactttaggctgctggtggacggattacgagggagtgcgtcgctacctgtcagcgccggggctgcccgcgtggacgcggccccctccctggcgtctgccccgcctgaactttgcaaacaaaactcgcggtcccagccccgccagcctgctgcacccgctgctctgcgagtcgcagcgcgcgccctcgggtactagagccc

SEQ ID NO: 35478 - DNA, 62 bp, Homo sapiens
  chr14:93389271-93389333
  hyper
gccccccgcctcccacgccacctcttggaaaccagatacccgcctcgcggccaagacccacc

SEQ ID NO: 35479 - DNA, 92 bp, Homo sapiens
  chr14:93389602-93389694
  hyper
ggtgccaccgcagcccgaccccggccgccagtccagccgcccctcgcccggtgcctaggtgcccggccccacaccgccagctgctcggcgcc

SEQ ID NO: 35480 - DNA, 224 bp, Homo sapiens
  chr14:93389712-93389936
  hyper
cgccgctgtcctggctcttctgctctgcgccgggcaaggtgagcgagcgcggggagctcgcgggagagggttccgggcgcccctgcccaccttgaggtccgggcaccgcgcggcgccccgcacccctccacacttcccttcgggcgcggcgagttttcagcaccgcggacagcgcctccgcctcccgcctgaccctgcagtgtggcctccgcctgggacccaca

SEQ ID NO: 35481 - DNA, 269 bp, Homo sapiens
  chr14:93897179-93897448
  hyper
ctaaccttccgggaccgaattctgcaatttgatgtgcgttttgtccgaatggtagcgacacgggcctaagggagggggaaagcgagggggtggggggtggggggtatgcactcttttcctcgcaacatcgctggcggagcgagggagctcacacgacacagattttggggcaaagcctttccaactggacagcaccatgtccaccaaagcggagcagtgtaagtagcagccggcccggcattccggcccggcctcggctgggagctatt

SEQ ID NO: 35482 - DNA, 30 bp, Homo sapiens
  chr14:94226381-94226411
  hyper
aacagctgccgtccccgagggctgcctgac

SEQ ID NO: 35483 - DNA, 165 bp, Homo sapiens
  chr14:94254294-94254459
  hyper
acatccccagagccccgcgtgtacactttagctccgcgcacagctccagaatactgcgtgcataccttggccccatggacacctccagaaacagccaagcacacttactgcgccccattaacccccatacaactcactctcactgtgagcacacttcaaacccgg

SEQ ID NO: 35484 - DNA, 481 bp, Homo sapiens
  chr14:94254498-94254979
  hyper
cgtgcacacacactgatccccgtgcacacccaccgactcctgcctgcaccctcgctgaccctgcatgcacggccccaagaaatctcacgctgcctgcacccacactgcccagccggcctcattgcgcacactgcaacataggcacctccgtgcgctgcccctttgcacgcctccgcccagccccgatctcccgctcccgggcgtgggttcccccacgcctccatctccgcccgcacccttccaacgcctcacgctaccttgcctggcggcggccccagccgaccctgggctcggggaaaagaggtccgcgttccccccgcggcagctctgtttcccagcagccggacagcccccatttaaagccagccgcctccccagtcccccgccctctaggcggggcctccgtcctcaccttggcggctgcgcgggcgcccgggggcttcacatgccggggaggagcgcccggcgctggagcaaaagt

SEQ ID NO: 35485 - DNA, 7 bp, Homo sapiens
  chr14:94255277-94255284
  hyper
accctca

SEQ ID NO: 35486 - DNA, 59 bp, Homo sapiens
  chr14:94255304-94255363
  hyper
cggcgggaggcgccggcagggagctcccgctggggcagcaaagccgtgggtggaggcga

SEQ ID NO: 35487 - DNA, 23 bp, Homo sapiens
  chr14:94255584-94255607
  hyper
cccccaagcctctcccgaggctg

SEQ ID NO: 35488 - DNA, 46 bp, Homo sapiens; identical to SEQ ID NO: 12016
  chr14:94255669-94255715
  hyper

SEQ ID NO: 35489 - DNA, 368 bp, Homo sapiens
  chr14:94405660-94406028
  hyper
ataggcgtcgatgttcgcgccgtggtccagcagcagctgcattgtgcgcaggcagccgtggcggatggccacgagcaaggggctgatgacgtcgcggttggggtcggcgccgtgttgcagcagcagctcggtggcgtacacgttgttgttgaccaccgcgaagtacagcgcggagctgcgccggtcttcgtagaggcgcgcgcgctcgggggccagcggcgtgttcacgtcgaagcgcgcgctcagcagcgcctccagcacctcgtcgtggttgcgctcggccgccaggtgcagcggactgacgccgctacggcgtatgcgcgtgcggctggtcaccggcagcagcatctgcacgatcctgccgggtc

SEQ ID NO: 35490 - DNA, 85 bp, Homo sapiens
  chr14:94641576-94641661
  hyper
actctttctcagtgtcgtcctggtccctgtctacaagccctcgcgaccctttgccgccatcctgagtcaccgctcatcctttcct

SEQ ID NO: 35491 - DNA, 66 bp, Homo sapiens
  chr14:95233491-95233557
  hyper
cttgcaccaaatacccgaggtagcccaagagaaagaacaaatccctgcagccggccgttgccggaa

SEQ ID NO: 35492 - DNA, 30 bp, Homo sapiens
  chr14:95234025-95234055
  hyper
ggggaagaggcaactcgcatgtggagctgg

SEQ ID NO: 35493 - DNA, 162 bp, Homo sapiens
  chr14:95234549-95234711
  hyper
gtggcccgtctacatcgccatcactttattgtactgtcacccttaatttaactataaatactacggtgggggctagtcgcgggcggcctcgggctgctgggctgtgcgcgccctgaccccagacgccgaccctcccggctctgtacactatttacagctcct

SEQ ID NO: 35494 - DNA, 358 bp, Homo sapiens; identical to SEQ ID NO: 4177
  chr14:95235025-95235383
  hyper

SEQ ID NO: 35495 - DNA, 182 bp, Homo sapiens
  chr14:95235513-95235695
  hyper
cggtaccggggacaccagcaccgaaccggggccctcgtagcctgcgacagagtggggcgcacggtcagccgcccgccctcgccaccgcacgcatgcacgcccgccagcccccgaccctcttccacttagaagtcgtctgcaaggggatgctgagaattgggggtgcacgggaatcaggggtg

SEQ ID NO: 35496 - DNA, 425 bp, Homo sapiens
  chr14:95236081-95236506
  hyper
gcacgtgcagctgcccgtagaagtagttgttgtagccgaggcgggagccgctgaccgcggccgggaggcccgcgccgccgggggccacggggcgcgggtagaaggcgccatagtccgaggaggcgccgccgctggcgccgtagagcgagtccccgtgcagggccgggaagacgacgggagccgccgcgctgtgcgccaccggcaacaccgagtccttgcagcgcggccgggcggctaggatgttgtcgatgctgaacatgctggcgggcatccccgagccccgcgtcgggaccggggggcggcgggaacgcgccgaggacagagccttaaagtgggggggtccactctcctccagccgccgaccaaaccgaaagagagcgccggcgagcgcgcagccctgcgcccctccccgccccctgcgtccg

SEQ ID NO: 35497 - DNA, 125 bp, Homo sapiens
  chr14:95237011-95237136
  hyper
cttttttccccctttcggaattggttttgttttagaaaatgtgaggggctgcatcccctctcaagcaggattgaaaattccaccactcctccgcgcccccacgtactcaccgcctgatttacctc

SEQ ID NO: 35498 - DNA, 55 bp, Homo sapiens
  chr14:95237867-95237922
  hyper
ggaaggggcagtacccgacccaggcgatacccccgagagccggagagggagatgg

SEQ ID NO: 35499 - DNA, 271 bp, Homo sapiens
  chr14:95239421-95239692
  hyper
cgcggaggcaggccccgggaaaggcagtcggcgctcggtgctcgcactgcgcctcggcgggcggaaactcacaagtgtcctcaacgtgctaaacaaaccatcagggccccgcatcgcctggcgcaattggaataacaaatgcgacgcacgcaaattgtccacctcgtgttgctaagcgattgtttgtcggccccgcacgcacagctcagcatgggaggaccgcgagcgtccagaggcagccggcgagcgcttaggtcggaaatgcagtaaa

SEQ ID NO: 35500 - DNA, 30 bp, Homo sapiens; identical to SEQ ID NO: 12023
  chr14:95240484-95240514
  hyper

SEQ ID NO: 35501 - DNA, 29 bp, Homo sapiens
  chr14:96342281-96342310
  hyper
gcccaaagccacattcgccacgctcccgc

SEQ ID NO: 35502 - DNA, 26 bp, Homo sapiens
  chr14:96342605-96342631
  hyper
cgcagcgcgcgtcagcgggggctccc

SEQ ID NO: 35503 - DNA, 364 bp, Homo sapiens
  chr14:96342879-96343243
  hyper
cgcactgctgtgcttgcggccgggtgggcgccccgccgctgcggtcgcggtcgccgctggtaagctgcgctctggggcttggggcaggaagcagtggggggcgctcgaagagcagggcagctacggccaccgtggccgccggaccggccatgtgctaaagtttctggggctcggcgccccgctgggcgcgcagcgcggggagcagacgcgccgtgggtggggcagcgcggtgctgctggcgcccggcccccgcggggtgcagctctgcgcgttctcatgctgtctctctctctttccctccgcgctgcctctccgaggtcctcccgccgagccccggcgcggggcatgaggagcccccgggtgc

SEQ ID NO: 35504 - DNA, 116 bp, Homo sapiens
  chr14:96343319-96343435
  hyper
cgcccggcggccagccctatccggcggcggccagcgggtcaacgctgcccgggagaatgaggcaggagccggcggcagcctcctttttttccttctcctcgccttcctgcggctcc

SEQ ID NO: 35505 - DNA, 118 bp, Homo sapiens; identical to SEQ ID NO: 12028
  chr14:96343667-96343785
  hyper

SEQ ID NO: 35506 - DNA, 173 bp, Homo sapiens
  chr14:96505338-96505511
  hyper
aaagccaggtcactccgatcttggtcctcaggctcgggataacgtgtcagccccaagagagcgctgcccacagccccgggtgggttgggttcaactgcacggggcggggcgccaacagctcaggacttgggttgcaggctggttcttgcaccaaccagcggggcggcctcggg

SEQ ID NO: 35507 - DNA, 153 bp, Homo sapiens
  chr14:96505900-96506053
  hyper
aagtttggggaggttcggggccacggtctcgccctccacgctggggctgggcagtggcgcccgcccgcgatccgcgtcccggtcctttgtcccgagccggacacccccacttggtgcacgcgtcgggggcggcgatcgcggctctcccggggt

SEQ ID NO: 35508 - DNA, 30 bp, Homo sapiens
  chr14:96506466-96506496
  hyper
ccccacccccctccccgacacaaacaggct

SEQ ID NO: 35509 - DNA, 157 bp, Homo sapiens
  chr14:97058943-97059100
  hyper
cgcccgggcccgcggattgccgggtcggttctcagtcaccgcacaggtgccctggagagtgcgaccaccccctgccctccgccccgcgccggccctcggctcagtgccccgcccttcctggagcacggcctgcgcatgcgcgcgccccagggcccag

SEQ ID NO: 35510 - DNA, 221 bp, Homo sapiens
  chr14:97499277-97499498
  hyper
atgggtctgggagtccgaaggctcgcggaggagagtgtgatgtggggtctgctcccagagcgcgcgcgctgtggctcttggaaggtggggctctgaggaccggggtcctgcgtgcatagacctggagcccaccttaaagacgctgcttcagggacgcttcaacaagccccaacccacccaactgcgtggcgctccccgcctttgggcgccctgttagggtt

SEQ ID NO: 35511 - DNA, 4 bp, Homo sapiens
  chr14:97499846-97499850
  hyper
gggg

SEQ ID NO: 35512 - DNA, 336 bp, Homo sapiens
  chr14:97684961-97685297
  hyper
gaagggccccagtgacgactggattcggaattttcctctcacttcgtggtagtgaagaatttaactacaacagtaacaacactaataattctaaaagccgtgggaggtcagagcgggcgctgcccggcgtcacccctgcagcgtccggatcgctccgcataggcaggggtggtgccccctccccggggcacagaaacgccacatcccgggggcgccgcccagaggctgtctctgtttctgtgtcccttcatgaggctctgtcccacaaaggcagcctgagccaggaccctaaagaggcctggtcatcgggaccggagggagttccgcttcccaggc

SEQ ID NO: 35513 - DNA, 564 bp, Homo sapiens
  chr14:97685395-97685959
  hyper
cgctccggccagctgcccgggaagcgcccaagcacacgtcccgagtcccagattggattaagttgcccaactacctactttttctctctttaaggagaagcctaattggagaagattcggttttcttcgccatggcaggtccctttctcctgacccgcagttgcaggggctgagggtaggcgcaggtccgccctggggtcgaagccaccatcgggcctcgaggttgcccccctaacatccggcctgcacgcctggcgggggcgcaacagtgtctcacggctcgggagctcgtttttggcttctgagcaaggtatttttttcatctgccgtgtgtttagctgaattcagtatatttttctcgcacttctcgcttttttttttttctttctgaatctgctcttctgctttgcgggcccctaatctctcccgaatctcgggcgcccggcccggcccaggcgagcgctcgcggttggggacgcgggtggggacgcggcggtctgggcgctgcaggatgcgcctggccgcggaggagacgaccagggagcgggtcgccagatcaagatc

SEQ ID NO: 35514 - DNA, 170 bp, Homo sapiens
  chr14:99584575-99584745
  hyper
gcggcaccatgtgtgcgacgctatcatttacactgaggagccgggtatttagaaaacagggctggtaccaagcgcgccatctgtggccaagcgttcccggcccaccgcaccatattgtgcaaggcgcgggctgaaggaaacagcgtcccgtgtcgcgcagtgtttgtttg

SEQ ID NO: 35515 - DNA, 30 bp, Homo sapiens
  chr14:99713234-99713264
  hyper
ggaaaattgcagtagcggggaggcaggtgg

SEQ ID NO: 35516 - DNA, 38 bp, Homo sapiens; identical to SEQ ID NO: 12034
  chr14:99736151-99736189
  hyper

SEQ ID NO: 35517 - DNA, 30 bp, Homo sapiens
  chr14:99736401-99736431
  hyper
acaccgtacctggcccgctcgcgctcgctt

SEQ ID NO: 35518 - DNA, 30 bp, Homo sapiens
  chr14:99736980-99737010
  hyper
ccgcccctggccctacggctcccccagccg

SEQ ID NO: 35519 - DNA, 58 bp, Homo sapiens
  chr14:99738350-99738408
  hyper
gctgccgagtccccgcgagcgctccccagcgctcccctggcgccgcgggcccgggggg

SEQ ID NO: 35520 - DNA, 70 bp, Homo sapiens
  chr14:99739091-99739161
  hyper
tttccctggaaaagtcgcttggtagtttttacttttgttttatggtcgcgggcggcgaggggaggggagt

SEQ ID NO: 35521 - DNA, 169 bp, Homo sapiens
  chr14:99739709-99739878
  hyper
gacaaggccagaccacggcccccgtggacaccccccattccccaggctgtggccaactttgtcaatttgatgacctggcctccagggctgggcgcgccacgcggctggcctcctctcccttctcagggtttctctggaggcggccagggcgggtcggggcctggctccg

SEQ ID NO: 35522 - DNA, 175 bp, Homo sapiens
  chr14:99740538-99740713
  hyper
ccctaggacacacagcgcgtcagggacaggtctggacccaaaacaccgcggcgtgcctgcagcccagcgccgccggcggtccgggactcgaaatcccgacccacgaccctcaccttcctggggttgattacaaggaaggcagaccccgccagtggcaaggcgggacggggaggac

SEQ ID NO: 35523 - DNA, 49 bp, Homo sapiens
  chr14:100111198-100111247
  hyper
aggcctctggccctgcgcctccctggctaaagagcgccctgtggggagg

SEQ ID NO: 35524 - DNA, 54 bp, Homo sapiens
  chr14:100111503-100111557
  hyper
gggctgccgtccctccgcctcttcccccgcggggcgtagcgatggcccgggcca

SEQ ID NO: 35525 - DNA, 155 bp, Homo sapiens
  chr14:100111764-100111919
  hyper
cgtgcgccggctacgcgagggacctgctgtgccaggtgagcgggcgcgcggccaccgggcggggcggggcgcgggaggccgagtcctggagcagagatcggaaccccgcgggggcgagggccaagagtgggcggcggactcgggaactctaagcc

SEQ ID NO: 35526 - DNA, 363 bp, Homo sapiens
  chr14:100125656-100126019
  hyper
ctgcacctggctcagcggtcagccggcgccccagcacctgccccgcggagcccgtgagccctggctcagggcgaccccgagccgcgccctctcccaccccgcccgcaggtcggcgctgctgggcaaggtgctgcgcatcgacgtggaccgtaaggagcgcggcctgccctacggcatcccgcccgacaacccgttcgtgggcgaccccgcggcgcagcccgaggtctacgccctgggcgtgcgcaacatgtggcgctgctccttcgaccgtggcgacccctcctcgggcactggccgcgggcgcctcttctgcggcgacgtgggccagaacaagttcgaggaggtggacgtggtggagcgcgg

SEQ ID NO: 35527 - DNA, 236 bp, Homo sapiens
  chr14:100260026-100260262
  hyper
cgttcccgccgccggcgcattgtgttggagccgcggggccgcgcctcgctccgggccgccccgggctccccgccgccaccccggctcccggcactggcgcgcggaccccgccggctccagcacccgcggagcgcgcccgggcggaggcgcgtggggcacagggcggcggggaggcccgggcagcctccgcgttccggggaacgtgttgcttttttgcttcccgacccacatctgtt

SEQ ID NO: 35528 - DNA, 485 bp, Homo sapiens
  chr14:100437465-100437950
  hyper
gacctcgacggccctcggatcagggatgccccgagtccgagcgggcagggtgctcagcagggccaggtgatgggaatcatggggccatcgagcacggaccctggctcccccggtggcctctgtgagctctggggtcaggcggggactggaggagcgtccgcgccgggagggagcgcaccgcgccacgtgcccgcccggcgccccgcccccaccccggccacgcccctcgcgcttccctcaaagccccgcccctcagccccgccactctcgtccgccccgcccctcgcagcctcaagctcagcgctcccggaggcgcggacggtggggccccgcgccttttgtgtcgggctttgaccgccgcgcgcgctcattcacctcagcggccgcgggcggaggggcgcacgcgcgcgcagtcccctcggagggcggtggggcgaacagcaacgcgcgtaccctagctcttggctgctgtgctgagactagcc

SEQ ID NO: 35529 - DNA, 204 bp, Homo sapiens
  chr14:100438017-100438221
  hyper
cgagtctcaggcggacgcgcacgcgttcccgccgcccggaccccagccggctcgccccccgcccccccatcccccggcggcggcccccaggcacgcgcccgcgcacacgccggcccgggcacgcgcccgccaagatggcaggggccggggcccagctgtcagtcgccgccgccgcggcccttccccgcagctagcggccccgac

SEQ ID NO: 35530 - DNA, 749 bp, Homo sapiens
  chr14:100438222-100438971
  hyper
cccacccggagaagatgagcccccgctgccccccgcagcccagtcagacgcggagccgccgcgcccggggccggctcccccgctagcgcccgcgtcccgcgccccgccgccgccgccgccgccgccgggtcgcccctggcccggcgcgcccgtccccggcagcgacaatgaggtgagtcggggccggcgcctcgtgggaggtggcagcggccagcgtcggaggggctgggctgggggcccgcggtgcccccgagggcgggaggggggctccacgggcgcgggggcttccagagaaccgcgggggctctgcagagattcgggggcattcagagcgcgggaatggcttcgcgagagccgtgggggcgtctggagagccgggagggtctgcagggcttgtggggggcagtgttctgcaaggggcaggcggcgctggctttggctgcttgtggggtcctcttaggctccggggggcctgcggcggcctgggaggcagacccccgcgggcaggtgtggccgtgtcccgaccgcgcgaggaccgaagttggcggaagcccctgtgcggtgccttccagcccggaggaggctggcctgaagcccccaggcgttgccgaagcctccccctgccagcgcccagagccgcgtttgggcttttacaggtgtagtttcccctcgacttggagcccgtcaaccccttcgtctcctaattctcaaccccccttttttttcttcttgcacgccagtaaagtgca

SEQ ID NO: 35531 - DNA, 270 bp, Homo sapiens
  chr14:101033483-101033753
  hyper
cgcctcggctcaggctccggaaggaaaacacgggaggggtgttcccaaagtaggggtcagggtgccaggggaagtcgtggaggaagtggcaaatattcaaactggctgatcccaggcctgccgcgcaggtggtcccgtgaagtctaccaaggcttaaagtttggcaccgggagggaggccgcgggggacactccccagaagctgtcgcgggattcccccaaaatggctccaagacgcggctgcctggtccagccgcgaggactccatccc

SEQ ID NO: 35532 - DNA, 175 bp, Homo sapiens
  chr14:101033978-101034153
  hyper
gggtagggggcagcccggccctcagtggcgctagccccagcccccgccgcagcggcccgggccggcggaggagccccgcgcgaggctccccagcgcctcgcggcgcgcacacacgcaccacacacacgcacctggcccgcagccccgccgaggccgcccgcgggccctgggggat

SEQ ID NO: 35533 - DNA, 601 bp, Homo sapiens
  chr14:101034879-101035480
  hyper
ccccagggattaacccgtgagcgcccggctcgccggcggggctccctgccttgcttgcgcagacccgcccgcgcgcggcttggagaccctccctgcccagccccgctcagccgggcagcccctccgcgcgccgggcagggggacccacccgccgccgttaaccttgtgggcgcgggcgagcgacggggaccgcgagcggcccgggcgggatcgcacttcctgcgtggagctgggggcgccgggcgggctctctatcacccgggagaggccgctccccggggctttgcccgtctttctgtgccgtgactggcactcaagggggacaggggtccgagctcagggaccacgcgacagacctgggaagactgatgactgcccatcccggcccctcgcgccgggcgccgccgccgcgtccgccgggagcgcgctccgctcgggtccgggccccacgccgcctcccccaccgccccgccgggcgagggcgcagcccggccgcagcgccaagctagaaggcccggccccggggcctcggccaggctcggccaccaacttcccgggtgctcgggccggccttccggcgctctcccggcctcagtttcct

SEQ ID NO: 35534 - DNA, 177 bp, Homo sapiens
  chr14:101193397-101193574
  hyper
gcccagagatgaccgcgaccgaagccctcctgcgcgtcctcttgctcctgctggctttcggccacagcacctatggtgagttccccggcggcccggctcgcgccccctctggggaagcctgcgactccccgccggccgcccggtgccccgcacgccccgtctcgtgagccccaactc

SEQ ID NO: 35535 - DNA, 269 bp, Homo sapiens
  chr14:101543828-101544097
  hyper
gggatgcaatttccccggtgtttttcaggcccagagctattgaataaatgaagtgcgcgccggcggagtcagtaactcactgcgcggctcccggcaggcgggggcggagtgggggccgcagaaccggacgtgcctggcgaggttcagaggcgctagcggtgtggtgggtgggcagcgccgggatggctggagggaggggctacggggggaggcgctgccgatcccacactgatctggcggggaggagggaggggcggatggggtttgct

SEQ ID NO: 35536 - DNA, 171 bp, Homo sapiens
  chr14:101923096-101923267
  hyper
gttactatattaaagcgcttcaagttttcatagcgctcgtcaaacagagacctcggaacgctctgcagacattaattaatgttcgctccggccctggaagccatttcaccaatggaaattccgatgagaaaggaagaaacgaggggttcaaggccgcgccgttgtgagtcc

SEQ ID NO: 35537 - DNA, 166 bp, Homo sapiens
  chr14:101923521-101923687
  hyper
aagaggagagaaaggcgaggcacagtgggtgcgcaaagaaaaagaggttctcagcggagcgtgtgtgaggcggggggttacgggggaggggagacggggcgggtgtgaagtctgtgccgggaaaagaaaaatatgagtgttctcttttgtgtgcgcacaaacagcc

SEQ ID NO: 35538 - DNA, 52 bp, Homo sapiens
  chr14:101924030-101924082
  hyper
gacgccctggcccggtgtccccgacgcgcctggagcccgggagggaggcgcg

SEQ ID NO: 35539 - DNA, 15 bp, Homo sapiens
  chr14:101924423-101924438
  hyper
gaggccatcaaaggc

SEQ ID NO: 35540 - DNA, 33 bp, Homo sapiens
  chr14:101924457-101924490
  hyper
cgttgcccatgaccaggccgagggcatgaaagg

SEQ ID NO: 35541 - DNA, 214 bp, Homo sapiens; identical to SEQ ID NO: 12051
  chr14:101924858-101925072
  hyper

SEQ ID NO: 35542 - DNA, 6 bp, Homo sapiens
  chr14:101925699-101925705
  hyper
acccgc

SEQ ID NO: 35543 - DNA, 286 bp, Homo sapiens
  chr14:101925706-101925992
  hyper
gcccgacccgcgctagggccgcccaccccctcggaccccggccgggtctctccacagcctccgtgcgcgtcccagaaggaaaatgctagcaaaccggaaggccgcacggggccgagccggcctcagcccggccaggagaggccgtcggtgccccgaggaggaaggggacccggcccgggacggccgccccgcggtacccaggaaggacgcccgccgttcccagcaccccagcgtctgaaaaatgaatgtgaactccgcaagcgtgctcccgcggacattttacatg

SEQ ID NO: 35544 - DNA, 290 bp, Homo sapiens
  chr14:102026194-102026484
  hyper
ggggcggcaggcgcacgggacgctggcggcggcggcggcttccgacttgggctcagaccccgccgctccagacaagtccccgcgactgcgacagtgtctcgggcagttcagctccccagacgggagacagaccctcgcgacctggttcaggccttgccctgggggacactgcagtccaaggcgaaaggagacttgctcccggcctctgggtccctaggtcaaggcacctccccgccccgccgcccctgagcccaagtcgccaaccccgcgccgcgcgcagcgagggatca

SEQ ID NO: 35545 - DNA, 125 bp, Homo sapiens
  chr14:102026883-102027008
  hyper
ctgggggcgcagggccggcgccgctttccccagctctccggtctccggcgcccggcggtaacccgcccgcgggctctgccctccgcacctctcagcccggccccggcggccgctgacccaggaac

SEQ ID NO: 35546 - DNA, 391 bp, Homo sapiens
  chr14:102029904-102030295
  hyper
ctaggctggcaggggcgctggaggaggatggaggaggaagagggtctgcggcggtgcccggggcgctcctacaaccgcacgcacccacctggacggggaacttagctgcgggagaagagcgaggtagcggagcgccgcgggatcctggaaagcggcgggagaggcaagggggccctctcttgctcccgcgcgcgcacacacagaccgaacagatgcagctgcccctgcagccgccgatccaacttaactgagtatccggcggtgtgtggagggggttgggtgaggtggagggcgagaggggctttggacccggtacagcctggctcccgaccgctgcaggcaccactgcgcacctgactcctccctggcccccttccggcacctgcaacct

SEQ ID NO: 35547 - DNA, 256 bp, Homo sapiens
  chr14:102030653-102030909
  hyper
ctcgcctgttgcgcccggagtgagggcgacccgggggacgcgggattagcttagcccgcagcccctgtgccagcgaaaccttgaacattaagtgaaaggtgggggacacagtgaaagccgctgaggcgggagtgtacggatccaggtgaggggactgggcacggcaacttccctggcgcgccaggacaatgcctgggaacccaggattgtcagggtcgccgggggtgggggtgagtagtgtcggtttgcgcgcttg

SEQ ID NO: 35548 - DNA, 50 bp, Homo sapiens
  chr14:102031530-102031580
  hyper
cagccactccccgcacgggccgcactcgctctggtcgcagctccagggaa

SEQ ID NO: 35549 - DNA, 305 bp, Homo sapiens
  chr14:102247792-102248097
  hyper
acccgcgtgggctcccgccgggccctcctgccgccccccagcctccccgcccctgcccttgccagcctgcgccttcctgggcgcctgacgcacccctctgccccaaccacgttttctcaagagtgttgtctgtcccggccttccaaggagacccttagctcccgccggccgcctccggagcctccggcatgggccccaggccggggtcccgcctttgccccggcctccgctgcctcgccccggagcccggaggaggggagccggccacccggggaagaagcggaggacgccgatctggcctcctg

SEQ ID NO: 35550 - DNA, 777 bp, Homo sapiens
  chr14:103021342-103022119
  hyper
cgctttgggtcttgtcgcgcccaggccagcgccagcccaggcttgccatggactggctcctgggcgttagatgaatgaatcgactcaacccgggccgccacgttgtgttcagaacaccgacagtcgctcccaggcaaccagcacctgctgcgccccgtttccagcgacctccccaaccgcgtggactcgcatccacgtgcccggcggggccgcagcagaaaggctcggaccccccaggacgatcggccggtgggggccggtggggccgcagactcggggggcggggggcgccaggcttccgggtcctgcccccgccccgtggggaacagcaggacggcgccgaggccgtttcgctttcctccgcgcccatttgccgggaggggaccccgtgctccgacctgaaggtgacggcagagcctgcgggaggcctaggccggtcccgccctacgggtcccgggggcgaccctcgcgctgacattggcgtccaggccgcggcccctgcctccgcgcccacccacgccgggcctggccctcgctcccccgggaaaagccccgccggcggccgcgagagcgcggaagcgcagccgtagtgaccgcgagacaaagacccggcggcgggggaggcggcggagagaccccgccagcgcggagaccccagggaagcttctctggaagacctggtgctggtccgctctcccgggacctcattttccttatgtggacaacgggggcggggtcacagcagcccctcgggcttatagccgggttgttctttcc

SEQ ID NO: 35551 - DNA, 81 bp, Homo sapiens
  chr14:103389208-103389289
  hyper
cggccctgcctccctcgtctggcgagtgcgcagcccggaagtgcgcggccagtgcatcgggcggtgcgggagaggagagga

SEQ ID NO: 35552 - DNA, 225 bp, Homo sapiens
  chr14:103389663-103389888
  hyper
tcctgattccaaggccgagaagaggtctgtgctgccccatcctcctccatgccccagttgtcactgtccttaacaacgctgtcctctgctccagcgccaggcaaactgggggcagtgccgggaggctatctaggcaggcgtcctgcagggcgcgtttgagcgggctctgcaggtatcagtagaagtccgttggagagcgcccgggcagggcgcccacagtctggc

SEQ ID NO: 35553 - DNA, 30 bp, Homo sapiens
  chr14:103390143-103390173
  hyper
ccgttgagttcccggcggacaaggtgcctg

SEQ ID NO: 35554 - DNA, 699 bp, Homo sapiens
  chr14:103394683-103395382
  hyper
ccaggggactgggggcggggtgggcgcggagcaggcccggacccccgcgtggcgccgcctcagcccgtgtctcttgcagctcctgccgctggatggggaactcgtcctggcttcaggagccggattcggcgtctcagacgtgggctcgcacctggactgtggcgcgggtgaggcggtcgggcaggggcggggctctggaaaggcatgttcaggggcggggactggagggaaggcgcgtcgaggggggcgaggaccggagggagggcgcctccgggggcgtggtttagggagtggcggaagtgtcccgaagcggggcttgggaggtcgtgctcagacgcgtggcgtggcgtggcgtggcgtggtgtggcgcggcgcttgttccgtggagctcagggatgtgctccggctcaggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccgggtgagcactgaggggagggaggctcgggtcccctctccccacctcggcccgaccccgcccctcctggtct

SEQ ID NO: 35555 - DNA, 92 bp, Homo sapiens; identical to SEQ ID NO: 12062
  chr14:103550468-103550560
  hyper

SEQ ID NO: 35556 - DNA, 328 bp, Homo sapiens
  chr14:103655240-103655568
  hyper
ccgatttaaaactcgcgccaacgcggctgcgcgccttgtcctccgcccaggaaccctggaggccacggcctcgcccggctcctgcgctggcactggacgtcccgccggctgtacctggcgccccgtggcctcgctcccgaccgctgccccgcagaggcctcccgaccgccgaggccctcgccacgcccgggtgcccccagggggcgccggcttccacccacagagctccccaggcctgggcgggcgcagggagggcgcgaccggggcgcacccgcgcgggaacttggcagagactcgcgggacgtggcgggggcgcctcaggaaacgc

SEQ ID NO: 35557 - DNA, 77 bp, Homo sapiens; identical to SEQ ID NO: 12064
  chr14:103655569-103655646
  hyper

SEQ ID NO: 35558 - DNA, 32 bp, Homo sapiens
  chr14:103673859-103673891
  hyper
gctggacacgcagttcgcgtgcggccgctccc

SEQ ID NO: 35559 - DNA, 30 bp, Homo sapiens
  chr14:103686765-103686795
  hyper
gaccgtccttcctaacggcacttcaccccg

SEQ ID NO: 35560 - DNA, 307 bp, Homo sapiens
  chr14:103687082-103687389
  hyper
gtcgcgctatccaggcgcccgcccaggcttggggagctctgcgcgcgggagccggcgactcctcggggcaccagggcgtggcgagggcgtcggcctcggcggggaggccttggctgggccgtcggggtggcgccgtgccctggaggtcgtggctggaagcgaggccgcgggggtccaggagcgctcatcggggcgccagatgcagcctgcgggacgtccagtgcccgcgcaggggccgggcgaggccgtggcctccaggcaacgcgcagccgcgttggcgcgagttttaaatcggtgccttcccagc

SEQ ID NO: 35561 - DNA, 514 bp, Homo sapiens
  chr14:103739923-103740437
  hyper
ctgggttgagcggggcggatctgggactccgaggcttcctacgtggggcgggttcccagcggacgcctctgccgcacccctggcggggacccagctgcgccccttcccgcggccctcctagggcctgggtgcttggaggctcgaggccccaagatccatgtcgcccggaatcccggtgcctaggccttgtcgcgggccctgggaccaactcgcgggggtcaggagctgggggttgagagaaagatgatcaggtgggttggagaaaggagacgcttcccgctgggcgagtgagcccaggacgcggcagaagagggcagaccctaggggaccgccgcgtccccaggcgcgcacgcgacccctccccgcgccgaaaatcctctccccgcctcagtctccccgcctccgcctccccacccatagtgtcactccgaccctagccctgggtccaaacgggcaggagaggtcgctggtgcctccgcggtccccgccgcgcgcagaactcggccgagtgcac

SEQ ID NO: 35562 - DNA, 72 bp, Homo sapiens
  chr14:103740539-103740611
  hyper
cgcagcagccccggcaggcaccctccagcggccgtgggcgcctggtagctatggaggcggtagaggtggaaa

SEQ ID NO: 35563 - DNA, 35 bp, Homo sapiens
  chr14:103745329-103745364
  hyper
cgcgaccgcctcctccgccccggctccgtgggatg

SEQ ID NO: 35564 - DNA, 212 bp, Homo sapiens
  chr14:103745577-103745789
  hyper
gagtgggcaggaccacgctggacacgcagttcgcgtgcggccgctccccgagcagtgcgcggcgtgggcggaggagcggctccgcgaggagatcgaggcgaacgcggcgcccgcgttgctggaggtcgtggacgcggcgggcgccgagcacctggtcacgctccaggacctggacatccgccacggcgacggctccgcggtgctcccgggcg

SEQ ID NO: 35565 - DNA, 300 bp, Homo sapiens
  chr14:103989154-103989454
  hyper
gacgcaggcgaacagcggccgctccgcgctcccgcggctcttaaggggcacaacgcgggccgcccattggcggctatttatagcccattcattccattggcccgcgccgcggggtggtgccgccgctttgtccgccgcccgcagcccccaacaccctggccgcccacccgagctgtcccctcgctgggaccccgcgcagcctgcccagtcccccgcccaagacctcgaggccgaaacctcaggtccttggatatctggatcccctcgcacgcccttgcctctgggcgggaaactgaggcg

SEQ ID NO: 35566 - DNA, 136 bp, Homo sapiens
  chr14:104601737-104601873
  hyper
gccaggccataggtgcgcgctggcgccgctgaaaacgttctccttccctcgcctgtccaccttccaggtcctgctcaaggcgcctaatatcccctgggcagggtccctgacacttccttaactcccaaagaccttc

SEQ ID NO: 35567 - DNA, 140 bp, Homo sapiens
  chr14:104601963-104602103
  hyper
cgaggctggggcagcccacaggaggagcgcgggacccgggcttgagtttgcacccaggcagagcgcccacccccgcccctagcttcggaccctgaaagtaaagtcgtcgtgcccggcagccagcccgaatcttccagccc

SEQ ID NO: 35568 - DNA, 466 bp, Homo sapiens
  chr14:104602310-104602776
  hyper
gggccaggaccccaacgcgccgtgtcctcaggacagattggagggggaaggggctgcgattatgccccagtcggaagggttttacagcagccgcgctgccctctccctgccggatacccggcagtagacaccgacgtctgggggctagcgaggcaggtgggcgcggaccgcgacccgattctggcttccaacctccgcccagtggcgcgcggggccgtcgccccacacctccagtccgcgtggctggtgtctggctcgccgccggggcggaaggggcgctgtcggcgcaggcgggcggggccggagcgcgggggcgcgcggcgcggagcgagcgcagggctcgggggcgcggggcgcggaggaccgggggcttgacgggcggccctgcgcggtgcggggcgcggcggcggcgggcgcgcggccagtgaacgcgcgggcggggcggcggtggcgggaggcactaggg

SEQ ID NO: 35569 - DNA, 267 bp, Homo sapiens
  chr14:104603085-104603352
  hyper
actttcccccattagcgttgtccaagtctccctctgccttcaaggctgtgtcccaaccggacccacccggaggctgtggctagggcggagagcgcagcgcagggattctcgggctcaccttgcgccttgctaggatgggcgaagtagggggtcggggcccctgactgatcgtgagcccccgaggtgactccagccttgtgcaccccgtgttctgcggatatgggatgtgagcttgtgcttcccgaagcgccgcggcggtagaagcgc

SEQ ID NO: 35570 - DNA, 488 bp, Homo sapiens
  chr14:104604185-104604673
  hyper
acaagcaattaattccggagctgagttcccatctgccaggcctgctgacaacaggtccggcgcacgcccgcaggacctcccgcttcccgggcggcacggcgcgcacacccacttgcgggcacacgcgcggctgtaaagacacgtgccgttcgcagacgcgccgaggcacagatacgccggcgcggtcgctgcccggctcgaggcgcacaccgcggcgacactaacccacgcgcgacagttagacctaaagtggcccgcgacacgcagagtacgctgggcttgctggaaaggcgcctgggagtctcggggccggggtcccgccccttcctcggcccacctcgccgtgggccttgggcaagagcgtcccctccgcagcctcagttttcccgcctgtagagggaggggcgtcggcgcctcctgggagacgcgcagccctggtgtcccgggagaggggcgggaggcgcatgcgcgcgcgcaactagatcctc

SEQ ID NO: 35571 - DNA, 386 bp, Homo sapiens
  chr14:104604884-104605270
  hyper
cccgagcgcgcccaccggagccaccgcgctcctcgcgacactcgcaggctctgcgaacttccgagcggctgggccgggccatgggggcgcctcggggccggatcacgtagccgcggcgcccccggagagccagcgtggccgggagcgcctgccgggctcttcccgcgccccggccatggtcggccgcggcgtccctctgtgcgctgcgcagcccgcggtacgcgcggcccggcctggagagggaggcgggcggcgggggcccgggacggcgaagatactcgcggtgtgcgctggatccctgggggccgggcctcctgctgagggtagcggacccgcaggcgggacctccggggatggagggagtgggtgagcgccagggtcgtgcc

SEQ ID NO: 35572 - DNA, 244 bp, Homo sapiens
  chr14:105070950-105071194
  hyper
gtgaagagcaggcagcggccgcggaagtcgtggccgttctcggacagcgggaccaccaccacgaagctgaacaggaaggccaagaagtagcaggcgcactgagcgaaaaggaaattgttgagcgccatggccggcccgggcgagagcggcggcgggaaggccgcgggaggctgcgccgggcggggaggccgcgggaggctgcgcagtggcggcgccggcaggtcccgcgcgcccctcccgggac

SEQ ID NO: 35573 - DNA, 30 bp, Homo sapiens
  chr14:105292388-105292418
  hyper
gaccgcaacccctggcgctggttggagggc

SEQ ID NO: 35574 - DNA, 437 bp, Homo sapiens
  chr14:105310006-105310443
  hyper
cgctgctctgttacccggagccaggacgcgcatatattcccagaatccgcgctcagtgcgttcggtcccccgggacacctgttctctgcacaggcgcgtctgggcgcagcgggggcagacacgcgttcccgggcagcgactccggaaggcccgagggagtaaatctggccctcccggttcagcacaaagctcccctggccgcctttcaaaaccgaccgcctcccaactctccgcggacacgagtggcggctgcctcccctcccctcccctagggccgcgcacgcctcccgcagggtctcagtgcctcctgggcgggggataattcctgtccccaccggtgtcctgtactcgcggggtcccgggtgtaagttctgggtcccgggctggctccctggtgagcaaagccgcatcgctcgaattccagaaacccttctcgc

SEQ ID NO: 35575 - DNA, 349 bp, Homo sapiens
  chr14:105310485-105310834
  hyper
cggaggtggatttcggaactcaggagagaagaatgagacgctccctagtacccctagtcccccaggggtgggaggggactgtatctcaaaataagattctgcaactcgacttttataggggaaaccaggcacgcatttcaaaatcttctcatccgtccccacctccttgcgccgcttttccgcgcctcctgtgccacggaagctgccctctgctcctgctgtttccagcccggcagcccccagacaggatctagcttggcccagccgggccctgcttcctctgcctggggtcctcaggccatgcaagtgaggaaacccaggctcagaggggccacgtaactcttcccaa

SEQ ID NO: 35576 - DNA, 220 bp, Homo sapiens
  chr14:105433940-105434160
  hyper
ccaccgcactgggagcggctgttcctacactgcctgtagtggggatggagtgcagaggctcagcgagcggcagacctgcctctggccacagagctgcgcagtggggacccctccagtcactgggctggcaggagcctggcccaggaacacaaacaggaagggggaaatcctgcccgcctcgggataaggctgcgcagccaggctaccggcctcggacccg

SEQ ID NO: 35577 - DNA, 19 bp, Homo sapiens
  chr14:105434286-105434305
  hyper
cgcccggcctccggttctc

SEQ ID NO: 35578 - DNA, 151 bp, Homo sapiens
  chr14:105512040-105512191
  hyper
atgtgcaaaatgttccgcctgcgaaggttccgcggtggcggggacactgctccggctccgctcccgcccgcccgagcgctcggatggggccgcctctgcactgcgtggccacaggcgcggcccggctgcccacgggcgccctttgcagctg

SEQ ID NO: 35579 - DNA, 186 bp, Homo sapiens
  chr14:105714232-105714418
  hyper
ggattagccccaggccgggaggctagaggccccacaaggagcgagcctgcgactgcgatccacaggcagagccacagaggcagggcgcgccctggggcccaagctccagggctgcaggcccagggccagatcctgacttgcccacccgccggctgtgtgaccttcagcgcgcgactaacctctctg

SEQ ID NO: 35580 - DNA, 197 bp, Homo sapiens
  chr15:23158330-23158527
  hyper
cgccgggcgggtcaccgcaccccgagatgtgcccccaaggctctttcgaccgccgtgaagtggcgggcccccttgaagtggccggcggctgcccggctccctcgaggcgcctccctggcgctcgcaggggcctcgcagagccggcggggatcccaccgcggctcagtgtctagggccggtcccggcagccctctctc

SEQ ID NO: 35581 - DNA, 32 bp, Homo sapiens
  chr15:25915272-25915304
  hyper
cccacgtggccagcccgcgtgagaaatccagg

SEQ ID NO: 35582 - DNA, 135 bp, Homo sapiens
  chr15:26107609-26107744
  hyper
acagagaggccttggcggcgctgtggcttcggtcggcaccgggtcccgcgcagccgggccctccaccctgagtggagctgccttctaagcacccagcccctgccaatcactgtgcccaacaccaagttcccgggg

SEQ ID NO: 35583 - DNA, 482 bp, Homo sapiens; identical to SEQ ID NO: 4188
  chr15:26107845-26108327
  hyper

SEQ ID NO: 35584 - DNA, 283 bp, Homo sapiens
  chr15:26108548-26108831
  hyper
cggccccgccctcgttccgcgcccggactgggccacgccggatagcgggaaacaaaaaaagcccgagctggaaacttcagagaggtttagtttcgtttcccagaagcatcagttcggtcccaaaacgctgcaaacgcgcgctgcctgcagtaggagagaggaaaccgcgaagcgcgagaaaaggcgcccccgtccccaagcagcccgcgcgcccttccaggggccagacctgctccatcctggacggcgaaacgacctcgggagaccccggttaggaccttac

SEQ ID NO: 35585 - DNA, 23 bp, Homo sapiens
  chr15:26327541-26327564
  hyper
ccctgtctgcgcctgcgcctgcg

SEQ ID NO: 35586 - DNA, 299 bp, Homo sapiens
  chr15:26327610-26327909
  hyper
cgaaaggcggaggcagggctgggcgctgtggctgctggcactacccagttcttcagcagcgctgtgcctggaggcccccagcccctcgccccccggctcgcgggaggcggcaccagacctcctcaggccctggtccctaggaaactgcagcccggcctcagtttccagaaagctcctccgtgcgatttgggaagagcacggtttgaatggttgaaaatagaggggctgaagaaccgagccgcgcgggcctggctccggggctgagttccctagcgggcgccgagcggagcctgccatta

SEQ ID NO: 35587 - DNA, 30 bp, Homo sapiens; identical to SEQ ID NO: 12083
  chr15:27016662-27016692
  hyper

SEQ ID NO: 35588 - DNA, 161 bp, Homo sapiens
  chr15:27017654-27017815
  hyper
ggcgcggggcgcgggcggctctgaggactgggggctatcccaggaggggcgcgggcgaagggcccccactcccacccgccgctgctccgcggatgcggcccccgcctccctccgcccaggccgccgccgccgtgggtcgcgcttcccgcaacggccgcgcg

SEQ ID NO: 35589 - DNA, 45 bp, Homo sapiens
  chr15:27018284-27018329
  hyper
gcggggagggaggagcgcgcgcgggcgcggggcgggggaggaggc

SEQ ID NO: 35590 - DNA, 63 bp, Homo sapiens
  chr15:27018746-27018809
  hyper
gcctcccgacggtgcctgcagaacgccgggaagcccccgcctcacctgcggggctcagagcct

SEQ ID NO: 35591 - DNA, 146 bp, Homo sapiens
  chr15:27111977-27112123
  hyper
caggcctctatcacccgactgctgacactgccctcccatccctgctctacaagcgggcggtggtgactacacgaggcgccgaagatgctgttgagggccctggagaaacttcagcagaacagggcctctccccttgcaggccgagc

SEQ ID NO: 35592 - DNA, 17 bp, Homo sapiens
  chr15:27113012-27113029
  hyper
cgcgctcccagcccagg

SEQ ID NO: 35593 - DNA, 140 bp, Homo sapiens
  chr15:27113477-27113617
  hyper
cgaggtggaagtacctgttgtgtctcccaattccggagtttgcgggggatgggggttgggggggcttcttgggaaaatgcttcttttcgaagcatactgttcggatgcctgtgagcacctatttgcgttatgcgcatact

SEQ ID NO: 35594 - DNA, 301 bp, Homo sapiens
  chr15:27212887-27213188
  hyper
aacctggggcaaccacggagcagcggatgcgcgctgaagggcgcgtgggcagcggggtggttccgcggcctgcggggcgcagcgcgccaccgcgggatctgaaaggcgcttcctggcaacgctgctagggtcccgccgcccccgccgaggtgaagtccaacccgcagctgcgcgggcagcccaggtcttccccagaacctccggagccgaggacccagcgccaagccaggagcaaagcagcgcgccaggctggagctgttccgtcattaccgccacgtctgcgcttcggttgtgagaaccg

SEQ ID NO: 35595 - DNA, 177 bp, Homo sapiens
  chr15:27216067-27216244
  hyper
atggctggaggaaggcggaccgcgggctcgctctcatggtgccaaccccggggacctttcttcaggctccctgcgggatccccagcctcccctccccctcggagctccgcccccttcctggcctcaaactccgagtccattcaaacctcgccttcctcgccctgcgcgttgtcaggc

SEQ ID NO: 35596 - DNA, 39 bp, Homo sapiens
  chr15:27216830-27216869
  hyper
cggctgggctgcggcacggcgggccgggaggggactggg

SEQ ID NO: 35597 - DNA, 30 bp, Homo sapiens
  chr15:27603952-27603982
  hyper
ctgcctttctccctacgtaggagggcctgg

SEQ ID NO: 35598 - DNA, 42 bp, Homo sapiens
  chr15:28339778-28339820
  hyper
cgtgtgggctactgccggccctctctccggctctgcgctctt

SEQ ID NO: 35599 - DNA, 279 bp, Homo sapiens
  chr15:28340309-28340588
  hyper
cacggctgagtgctccgggcatggtgggtctgcgggactcggagcagagctcgagctggcggatccccggttggcgcccggcgggagggcaggagtggcccagccaggccgccctgcgcactccccgcccgggtgcgcccgggggaccgcggccctcccaccccgcccctgtgaaacgacagccggcagcaggcgccgcacgccgacttcacagtggcggcgatcaacagcgtgtggaaaacagcttcttcgtaaatcttaagaacattgtggccgggc

SEQ ID NO: 35600 - DNA, 336 bp, Homo sapiens
  chr15:28341644-28341980
  hyper
aggcctgaagaagcccgtccaggggtcagcctcctcctcagccggtcctgggctgagacaggggtgtcccgctgagggcagtgtagggtgcggtgcccccaccccacttcgggcctggaccgagaccgcgagtgtgaccgtatatcccttcaggtggatttttcaacatgtgaacttggttaaaagcttctagaacgttaagccaaacatcgtggctttccatccgttttctgttcttgtttgaaagagtacgcctccttccagcctgggaggaggggcggggcccgggagagggcctcgggaggccgcgggtgggctctgccgagggccgcgttc

SEQ ID NO: 35601 - DNA, 39 bp, Homo sapiens; identical to SEQ ID NO: 1196
  chr15:28341981-28342020
  hyper

SEQ ID NO: 35602 - DNA, 40 bp, Homo sapiens
  chr15:28342521-28342561
  hyper
cggccccaaggagctgagggagctccggcttgtggagtct

SEQ ID NO: 35603 - DNA, 54 bp, Homo sapiens
  chr15:28344134-28344188
  hyper
cgcctggcagagagccggagggggtgctcagggggcagctgctgcaggcccagg

SEQ ID NO: 35604 - DNA, 73 bp, Homo sapiens
  chr15:28344223-28344296
  hyper
cgtctgtgcacactaacctttaggggaacttgccttgcttcctaagccgcgactcagccggggctgtgtaaac

SEQ ID NO: 35605 - DNA, 78 bp, Homo sapiens
  chr15:28344614-28344692
  hyper
gccccgcccacagctcgcccgctccgcacccccggcccctcagctccccagcccccggcggcgcgggctgagagcagc

SEQ ID NO: 35606 - DNA, 340 bp, Homo sapiens
  chr15:28351758-28352098
  hyper
gcagggtgggggcaccgggcgcacgcggggaatttccccacgaccacggccacgccaaatgcctgaacctccacggctgccggcaacagcgagcgcagggagggggctgtgcgcgcgggggccctggtggcggagcaggcatcaccccgagagcgccgaggtttgtggtcgcaaccccgggagcaccgctgcgggaggagcggcgtggccgggcagaggcgacttcctcgcaggcagtaccgggccccgcggccgcctccgggcctgtcctggtgccccgggcttccacccggcgggctggcgtgcgggggctggtcttcgccgagatcctgctgggagc

SEQ ID NO: 35607 - DNA, 22 bp, Homo sapiens
  chr15:28352099-28352121
  hyper
ggctctggccccacggtgagcc

SEQ ID NO: 35608 - DNA, 270 bp, Homo sapiens; identical to SEQ ID NO: 4194
  chr15:28352152-28352422
  hyper

SEQ ID NO: 35609 - DNA, 43 bp, Homo sapiens
  chr15:28352957-28353000
  hyper
cgacaggcggggagaaggcatggcccaccggctcaggagaaag

SEQ ID NO: 35610 - DNA, 158 bp, Homo sapiens
  chr15:29077236-29077394
  hyper
tgagaaactgacttccgtaggagtgcgggtgtgcgtgcgtgccgcggaaatcccgccttctggcgcctgcggttgccccctggcctcagccggtaggctcccaagtaggaagataaaccgcattgcacgaagcgggagagtccagaggagcggcgaag

SEQ ID NO: 35611 - DNA, 196 bp, Homo sapiens
  chr15:29077428-29077624
  hyper
cgccttgcgattggccctaagcgcgggtggctggggttgcgagaggcatcaggatccctggcggcgcctgagccagcggctgctaggaggctgtgtccgcaagccagcggggcgaggcgcctgggccctgcgcgtcaggtcccggcctggggcaccggggctgccagcgtcggaggaggtgcgggcgcggggttgg

SEQ ID NO: 35612 - DNA, 51 bp, Homo sapiens
  chr15:29077646-29077697
  hyper
cgcggaccgcccgcggctcagcctccggtctctctccgtctctaagtggtg

SEQ ID NO: 35613 - DNA, 320 bp, Homo sapiens
  chr15:29130728-29131048
  hyper
gccgagcaagcagggcgcggcggccggggcaaggtgcggagcctcgcgttcaccggctctacctgcggagcctcgcgttcactggctctacctgcgggaccagacccctgcagctccccagccagcacggccggggcacgcccgggaatctgtgtgctccccagggcccggggcgttcggggcgccgcgccttccagcgcctgggtcccagccccgatcccggagaccggcccggggggacccggggtcccgagtgcaccctcctgccctgcagactgtcccagcgccggggccagggggcgcaggacctcgcgcacgcc

SEQ ID NO: 35614 - DNA, 99 bp, Homo sapiens; identical to SEQ ID NO: 4198
  chr15:29131532-29131631
  hyper

SEQ ID NO: 35615 - DNA, 152 bp, Homo sapiens; identical to SEQ ID NO: 4199
  chr15:29131755-29131907
  hyper

SEQ ID NO: 35616 - DNA, 174 bp, Homo sapiens
  chr15:29407300-29407474
  hyper
gagagctgaggagcccggcctacagaggggcccgctggggaccgggcagggaatttgggtctggggacagcagcagcaggccgggccgtctgtggtgctccccctggtggctctgtgaggctgagtgcgtggcgaccatccttgcagcctgtgggtgggcgggtgggtggaggg

SEQ ID NO: 35617 - DNA, 43 bp, Homo sapiens
  chr15:29407771-29407814
  hyper
gaggcaggaggcggccggggcgttggaatcctttcagccctgc

SEQ ID NO: 35618 - DNA, 15 bp, Homo sapiens
  chr15:29407866-29407881
  hyper
cgctgataaacaagg

SEQ ID NO: 35619 - DNA, 30 bp, Homo sapiens
  chr15:29561245-29561275
  hyper
gtttctttggatctccgaaaattaaatgct

SEQ ID NO: 35620 - DNA, 524 bp, Homo sapiens
  chr15:29861915-29862439
  hyper
gacagtcactttaatcgagacgtctttcttctatggagatttgttcaccactggcttctctgatttggtggttaagagtctgaaaatcggtcatccttaaggtctggagctcagaaagcacgccgcccccccttgcctgccccctgccccaggacgccggatgcgggtcgcctgcccagtcccgtcgcccacaaaccacgccgttctgggcggacgcgggaaaccagaagtccccgaagccaagtcagcgagcgaccacaggggccgcccggccgatccccgatatccgggctgacccaaaacccgacgggaggcgcccctcccccgcccccccaccccaccccccacccccaccgcccccggtcagggccgccgcgagggtgagaggcgcgcccacatgctgctccgctccgggttcggctcccacctcctcgcctcggccgcggccgctcggatggcgaggtcgtgtccccggcgcgcgcggtccccggcgctccctccggccgctgcgggctcggaggacg

SEQ ID NO: 35621 - DNA, 43 bp, Homo sapiens
  chr15:29863048-29863091
  hyper
cagggctgcggcggccgcgcgccgggagcgggccgggccgggc

SEQ ID NO: 35622 - DNA, 70 bp, Homo sapiens
  chr15:29863540-29863610
  hyper
ttcagagcctggggacggctcgggatgggcgcgcggggcgctgaggacggggagacgggctgggagcaga

SEQ ID NO: 35623 - DNA, 90 bp, Homo sapiens; identical to SEQ ID NO: 12105
  chr15:30260547-30260637
  hyper

SEQ ID NO: 35624 - DNA, 331 bp, Homo sapiens
  chr15:30260871-30261202
  hyper
cagcttcctcttgagcggcaggaggctgccgcggttggagggggtgacgccgatggccatctgcagcaccgtcaggtatttctggtacttcatcttgtccccgctccgctcgcgggcagggccccgccgcctccgccgccgccgcagacacagcccctccaggcgccgcatagatcagctctgggccatccgccgccaccacagctcccaccgctcccgcgcccgccgcacccgcagctgcggccgtgcgtggcccgggctcccgctcccgccgccgccgtcgccgtgcgtgcccggccgctcccgccgccgccgccgtgcgtggcccgca

SEQ ID NO: 35625 - DNA, 181 bp, Homo sapiens
  chr15:31775293-31775474
  hyper
gacttgtttcctatccgtctactacctgagtggcgtcagtgtaggttcaggcaccattaggaacgtttgaccaaacacgtacacggcactgacagaggaggcgccggccttccggtggaccagggcatgtaaaaaagacaccgacacaatggaaaagaaatcctcgaaggtagaacctcgc

SEQ ID NO: 35626 - DNA, 155 bp, Homo sapiens; identical to SEQ ID NO: 4201
  chr15:31775483-31775638
  hyper

SEQ ID NO: 35627 - DNA, 105 bp, Homo sapiens; identical to SEQ ID NO: 4202
  chr15:31775678-31775783
  hyper

SEQ ID NO: 35628 - DNA, 2 bp, Homo sapiens
  chr15:31776145-31776147
  hyper
gg

SEQ ID NO: 35629 - DNA, 67 bp, Homo sapiens
  chr15:32162215-32162282
  hyper
acgcagtcacagctccggtgcccggcgagcggcctcgcgcgcggctcggggccgggccctgcccggc

SEQ ID NO: 35630 - DNA, 130 bp, Homo sapiens
  chr15:32322366-32322496
  hyper
gcttctggctgagagcgggagcgggctgagtggggacaaagaacgcaagggagaggtagagcctggccttgggcagcccctggcctggccagaggcgcgaggccgagagcccgctcggtggagactgggg

SEQ ID NO: 35631 - DNA, 129 bp, Homo sapiens
  chr15:33009633-33009762
  hyper
gggcgccggggtcagcgccctcgaagttgggggcctcgggcggggccgccggggagccacgacggccgctcgaccagagcatcccgcagtcccgttccctccagaggggaagaatggccgaatctggca

SEQ ID NO: 35632 - DNA, 578 bp, Homo sapiens
  chr15:33009821-33010399
  hyper
cgcaggcgatgccgggcggccgacagggaaagcccagacctggggcagagaaggaatgaggggccgccagccggggggatttcctcccgctcttccctctccaacgggagcggaaaatgtgatttgctgtgcattccaggcgcggttccctggggtgacctctcccagccggcccgggcggggggagcagacaaagaggcgaggcgggcggagaggggaccccgcggggaagcaggaggggtgcggggggcgggggcagtaccgggaaagggggcggatagcgggtctggcggcggcggcggcgcctggccaatggagaggcgcggccccgggcgccgcgctctgccgccggcatttaaacgggagacggcgcgatgcctggcactcggtgcgccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacaggtgagcgcggacgcacccggcagggatgtgagtgggc

SEQ ID NO: 35633 - DNA, 276 bp, Homo sapiens
  chr15:33010400-33010676
  hyper
gagggaagagggccgcaaaccaacccaggacccgctcagttccacgcgcggcagccctccgtgcgcgcaggctcgggtgcgttgttcgcgggggtgaattgtgaagaaccatcgcggggtccttcctgctgaggccgcggacaccgtgacctcgctgctctgggtctgcagggaaacgtaggaaaaaaagttgtcaggagcgggcaggatgacccccacatcccgtttccacctcccggaggcccccgaacacgctcctggtgctggtggcagcag

SEQ ID NO: 35634 - DNA, 446 bp, Homo sapiens
  chr15:33010720-33011166
  hyper
cgccagagcgcaggagcatccggacctgctagtcggccgctgactgcgcggcgagttgccttgagagggtcccatgtgcttggggcgccgcgctgggtctgggggcgtcttggggcgcccattggagtccgcgggttggagcatccggagaatccatgatgtgtgcatttgccgatccccgaggtgagatggagactggcaagggcagagccgctgtgttcagccacagcggaaaaccgaacggtgggtaatccgacagctgcggtgcggggcgcggccctggccgcggggtccagcgaacccgcagtgctcacaaggcagacaccacacgcgctcgcggaccggccacgcactcgcgggcgctcgcttctctactccagcctcttccccgccccgcgcacgcccgggctgaatggtagacgttctggcgccgggcagcggccacc

SEQ ID NO: 35635 - DNA, 202 bp, Homo sapiens
  chr15:33011167-33011369
  hyper
gctggttcccacttccgcgcgcaccccttaaactgtgttctagaggccccagcctcgccttgcagcgcctcactagctcctgaggactagggactggcggctgaggcgggttggcggctgcaacgagctgggcgtctttcgttctctctcgctgcctggctggctccgctggcccctccacagcttgcggagcaaggccata

SEQ ID NO: 35636 - DNA, 41 bp, Homo sapiens
  chr15:33011630-33011671
  hyper
tccctaatgcattcccgggtcgaatccgtctactgccttcc

SEQ ID NO: 35637 - DNA, 30 bp, Homo sapiens
  chr15:33486950-33486980
  hyper
acaggccacaggccccgccttcctagcacg

SEQ ID NO: 35638 - DNA, 808 bp, Homo sapiens
  chr15:33602801-33603609
  hyper
ttaggggacatcctccggtcgccgcggggcgcgcgcctccgctgagtgtgcggtgcggtacccagcggtgcgggggaggctccaccgcgccagcccagggcccccgcaccgcccccgccagctcgacgcgcccagcgttgcgctctccacggagcgggcggccgcagcgcacttggctggggcgagaggcgagaggggtgggcggactgcttggttggcgttggcgctctgcagtgcagtggagtgttagcccagctccctatatggtcggggattagcttggcgctgctgaggctgaggctgagccaggagctggaggaggaggtggaggacgaggacgaaaaggaggaggagaaagagcgcagcagcagtcagcgcacgccgagcggctgccgggggaagcagaggcgccggaggctggggcaccgccgacgcctcgggagccatggccgaagggggagaaggaggcgaggacgagatccagtttctgaggactgtgagtctccgcggcgggggcgaggccgtgggcaggtggggaggagcgcggagcgcggcgaggaggggctggctgcgctgcgccgcggtgccgggtgcccggtgccgggcgctttctccgcacccgcgggctgcagaggcggaccggccacctacccgcggggccgcgaggggctgcgtgggaaggggcaccatctcctgcctctcccttgttcccctaccgccacccctgccccaggccctccacctaggaccgctcgctctccaggcaacttgctacttggtctgaaacccttgatgcccaaacttcagc

SEQ ID NO: 35639 - DNA, 128 bp, Homo sapiens
  chr15:33603647-33603775
  hyper
cgttggaagccctcgccccggggtcggccctctgacacctccatactccaccccagccccattcctcttccagggcgcccccacgcacaggggaacctccgggaaggagccagcggggcaggggggag

SEQ ID NO: 35640 - DNA, 772 bp, Homo sapiens
  chr15:34728851-34729623
  hyper
gggcttaccaaggcccgccgcccgacccatggagccctgcttggggaccgggggcctcgatgttctccttcaccatctgcggccagatctccctccagcagccttgccaggcagtgcctggcgtggagaaggggccctgcagaggcgcaggtccgcaccgtgcccccaacccggcgcctgcagcccaggggcaacaaggtgtggggtttttgagtttttccctctgggccttattatacagggaaagggaaggggcgaagatccgggctcgagttctcccagggaagtgaacccagaggcgatcccaaactcagtagttgccgcccggcacggggacttgatgccggcgccaagccgggcagcggaacgcaccagcggcccgaccagcccggcgagacgcgagcgggcggccccgccagacagcgccacttgccggcgccgagagtggcccctcgccgcggtgagcccctcccgggatgcgaaagccatcgcctagtccccgccgcacccgcccgcccatcgtgggaggaggatgggccggtccgagaggcgtaaggccgccgggctgcacccctagatcccagcggcggcctccccgcagccccgccgagtccggggggcagcgctcgggagctcttggcccgcagcttacgcgccgccccccacgcgtccgggtccccgcggcgccgcgggcggcccaaggctgccgccgccagcgagtcaggcagccgaggttccccagcttacctggccagggcgcggggctgccccg

SEQ ID NO: 35641 - DNA, 89 bp, Homo sapiens
  chr15:34729954-34730043
  hyper
gagctcgcgcctagccgcacacctcgactgctgattagcccgacagctgaatagcggcgggagcctaccgcgagcggagtacggaaagc

SEQ ID NO: 35642 - DNA, 388 bp, Homo sapiens
  chr15:34786556-34786944
  hyper
gccgccgcggggacccgccacccacctcccggggccgcgccgcggcctcccgtccaccgccaccatgaccgccaacggcacagccgaggcggtgcagatccggttcggcctcatcaactgcggcaacaagtacctgagggcggaggcgttcgggttcaaggttaacgcgtcggccagcagcctgaagaagcagcagatctggacgctggagcagccccctgactaggcgggcagcgcggccgtgtgcctgcgcagccacctgggccgctacctggcggcggacaaggacggcaatgtgacctgcgagcgcgaggtgcccggtcccgactgccgcttcctcaccgtggcgcacgacgacggccgctggtcgctgcagtccgaggcgcac

SEQ ID NO: 35643 - DNA, 241 bp, Homo sapiens
  chr15:34787232-34787473
  hyper
cgccccgagccggccactggctacacgctgcagttccgctccggcaatgtggccttccgcgactgcgagggccgttacctggcgccgtcggggcccagcggcacgctcaaggcgggcaaggccaccaaggtgggcaaggacgagctctttgccctggagcagagctgcgcccaggtcgtgctgcaggcggccaacgggaggaatgtgtccacgcgccagggtatggacctgtctgccaatc

SEQ ID NO: 35644 - DNA, 34 bp, Homo sapiens; identical to SEQ ID NO: 12120
  chr15:34806507-34806541
  hyper

SEQ ID NO: 35645 - DNA, 378 bp, Homo sapiens
  chr15:34806978-34807356
  hyper
ctacggcgggaggggcgcggaaggggagcctgtccggagccgctgtcacggccgcgactacccagcggggccgcccagccgagctttcgcgactctgcctctgcctgccgcctggacccttgtgggagcgcggctggaaaatggcaagggcacggaggccttggcgggagctgtgtggcggcctggggggctgctccctttgtaaccgactccacccacaggaggcgcggctcctgtcaagccgcagcttcaaagggcaacataaccactgcccccactaccgcctgggaaagggctgcccctaccctgcccccgtcaccctcacccctcacccctcaaccaggcgggccctgcgcgcaccagtttcggcgggtgcac

SEQ ID NO: 35646 - DNA, 40 bp, Homo sapiens
  chr15:35014171-35014211
  hyper
gctgagctggtgacccgggcaggaccggagccaaaggatt

SEQ ID NO: 35647 - DNA, 46 bp, Homo sapiens
  chr15:35047103-35047149
  hyper
ttcctgctacttcagcgggcacctggcgctccggcgcggcagcctg

SEQ ID NO: 35648 - DNA, 424 bp, Homo sapiens
  chr15:35047293-35047717
  hyper
cgtcggagcccgaggggccggggacgcgcgcggggggagaggggcaagagtcctggaggcccggcggggagcggggcgatttcgaaaggaaggactgcagcgcccctcggggcttctcggggagcccaggtaacctcacctgaccgccagacccaagcaggcggagggggagccgggagcggacgcgtgggtgagtggggaggggagtgagtaggtatcttctcttctctcggtgcatccctcaccttttcgctttttgcctcctggagacaactgaaattccttccctagatggagatgctggctgagggagggcgagtgggggcgaccacttttaaatctcccttaggggacagagtggctgagagtgcttctgcagagtggctgcggttcggtgcctctgtggatccgacagtgaagtgag

SEQ ID NO: 35649 - DNA, 44 bp, Homo sapiens
  chr15:35087666-35087710
  hyper
caggcgaggagtgaacgcggagggccgggcgctgactcaccgtc

SEQ ID NO: 35650 - DNA, 30 bp, Homo sapiens
  chr15:37175266-37175296
  hyper
aaatgtcaaagacatcggttattttggtgc

SEQ ID NO: 35651 - DNA, 291 bp, Homo sapiens; identical to SEQ ID NO: 1200
  chr15:37180507-37180798
  hyper

SEQ ID NO: 35652 - DNA, 44 bp, Homo sapiens
  chr15:37394668-37394712
  hyper
aggggctggcagaggcgcggatagcgcgacgccagggagagggg

SEQ ID NO: 35653 - DNA, 60 bp, Homo sapiens; identical to SEQ ID NO: 12125
  chr15:37403027-37403087
  hyper

SEQ ID NO: 35654 - DNA, 110 bp, Homo sapiens
  chr15:37403115-37403225
  hyper
cgagttctgagaccttggcaaacttccctcccccaaccgccggcgtgacttctgagttgtcactaatccgaacctgatattcaccagagctccttcggtcaccgacaacg

SEQ ID NO: 35655 - DNA, 59 bp, Homo sapiens
  chr15:39873175-39873234
  hyper
ctggcccccacctcccgcttcctgcccggccgccgcccattggccggaggaatccccag

SEQ ID NO: 35656 - DNA, 30 bp, Homo sapiens
  chr15:39873453-39873483
  hyper
aggaccaaagctgcccgggacatccacctg

SEQ ID NO: 35657 - DNA, 483 bp, Homo sapiens
  chr15:40211761-40212244
  hyper
cacccaggagcattccgccggggccatctgaggagggggactcccgcctggatcccgctccatcctcgggccacgagaaagccctatttgaactcttctgctcccgcgtgggggctggagtccaccgtccctgcttaactacactgcagctacccgggatccttaagcttccttcaactctctgcactttgccaggcacccgaaacccacggcggctgggcggccctgctcccggctctccgagcctgtaccctcggggaggcccggtccggaggcgccccgcgggaggcttaccgagcagcgagcctatgaagatgacgacctgcacggtggtggtgaactggcggtacagctgcgcctcgccgaactccccgagcgcgctgcggttcacacccgcagcctcggcgccggacgcgttgtgcggctcgctggcatttggagagatccagctcccgttatgtcccatggcgaggctgggactcc

SEQ ID NO: 35658 - DNA, 30 bp, Homo sapiens
  chr15:40212680-40212710
  hyper
gacccctctccttagcgggaggagaacgtt

SEQ ID NO: 35659 - DNA, 660 bp, Homo sapiens
  chr15:40544738-40545398
  hyper
ccctgaaatcaaaatcgcggtcaggtgaagccggcgctgcaccaacgtgtaagcgcggcccctcctcggcgttcccgcgccgaggtccctcccgcggagggcgggcccggctcccacgacctcttcgagcgttcctgggcttcccgctccgcaggtgggttccccggctgccccggaggttcgcggcgagaggacgggcctcccaacacgcgcagcccccttcctgggtgcccatgccccgaagttcgggaccagccggcgccaggcgaggggccttgggcgcaggcatctggagctccgcgtccctggagcgggacctccctccgcgggcgcccgcccggcgcggggcattcgcgtccccgagagggcgcagcagtggggcctgcgagctggggccgggtggccgcgccgggtcggagtgtggctggagaggggccgccccggaagcggtgctgcgcccaacgtccccttctccccgtaagccccgcaaggagcctgccgcctcttgcacctgagccaggagttcagtcgggaggcgggcgcggagcggttcccagcgcctggacgtcagccagtcgcaacacccgcgggaacacttgctacatttgccataatgcatttctgatctgtttccgcgcaggcctgcggaggactggccca

SEQ ID NO: 35660 - DNA, 284 bp, Homo sapiens
  chr15:40575513-40575797
  hyper
gagcggttcctcctccgcgctcccctgggaatgcggcggcggttgcggggcgggggcgggggctgctcgccgggggccacatgcacccaaccgggccaatcccaaagtcgcagtcttctctccccgccctccgcccccaaccgagtcggtgccctcggctccttagaaactggcgggacctcggcctcgtcggggaagactgaaagctgcccccatcggtccagggtgaaaggaattgggaccccatgagcgcagaactggaccacgcgcgagctaggggtggc

SEQ ID NO: 35661 - DNA, 156 bp, Homo sapiens
  chr15:41787106-41787262
  hyper
gccgtctgctcccagcgcccgcacgaggcgtggacgcaggggagggaggggcgtgggcctgggagctctggctgggagcggaacgcagcccacccagtgcgcgccctgcctcccatcttcccggctcgccgctcctgagcgcggcagagaggggcg

SEQ ID NO: 35662 - DNA, 1079 bp, Homo sapiens
  chr15:41804733-41805812
  hyper
gggtaagggctaactcggtggcgactactgccaccttgaagggcactcaaggtggacctccccgcggaatagtccaagacgcaagtcggtgcgcacgtggacttcgttaccctgagggtgaaacctccaactagcaggtcactgtccaccctacctccgccgtgcacttacagatactggccagggcccggcacgcgccacagctgcacgcctctcagctgcccggcggcccccacggtcaccaccacgctggtccccgcgtacgccccgtcacattgtgtctgtgtgggcccatgccggccgctggccccgcaggtagaaaacagccaagacccctcggtgcctgagagcaaggagcgaggcaagggtcgtcgagcccctggctgggccagaggggtctggtatggtgagcgaaagaggaaggaggcgtctaaagctcacccggagaattcagcggggaggctggctccaagatactaggcggggcgctgactttcgggtcccgggggctgggacttgccagcggcaggggcgaggaccgcagaaaagtctcctgggaccccgggctagagcagagaatggcgcctgaaaggtgttgggagaaggcgcaggacgttaaggcgggtggaaataggatatgaaagaaagagagaaccccgcaacagctgcccttgcggtcgcggccacacccgtcacccggcccagccgcgctctcagcctggaagccactacccgactccggtcgcagaagccccgcgggtgcgcgctgataggtctgccagtttctctcctcgagcgcctttcccagtgaataacttaggggccgcaatgaatttggtcctgcagcctccccaatgctttcctcaacttagattggtggccccgccccaaggcggtgctgagaccccaaagaatgttcctccttcccaagctgcgtgatccagactctgggattcgcacgcacttggcgcttctcggcccgcactccagaagcacggaccggagaaatttggctgtgagagttcgaggcctctggaggaaccactgacacctggcctgttgaccggccacccccaagc

SEQ ID NO: 35663 - DNA, 54 bp, Homo sapiens
  chr15:41877632-41877686
  hyper
accagcgcctttgtccgcggcgcagaagggccccagctgcggacagagccggcg

SEQ ID NO: 35664 - DNA, 45 bp, Homo sapiens
  chr15:41913327-41913372
  hyper
gggacacgaaaggaacgcccgggaggtgagcgccaggagatcggg

SEQ ID NO: 35665 - DNA, 218 bp, Homo sapiens
  chr15:41913733-41913951
  hyper
tccgggacccgcgagcggagcggcgcgtgggtcggttgcggtcggccccggcaggtatgcgcaggcgccttgcttgccacgcgctacgcccgtccccacgcgcctggtggcgtgttcttggcgcgaagtgttaagagtctgggtgtttttgtgcgttggggggaaggagagggtggcgggggcgggggggcgctgaggcgtcacgtggacgccacagc

SEQ ID NO: 35666 - DNA, 320 bp, Homo sapiens
  chr15:41952475-41952795
  hyper
ctgctgctctggggccgtttggactcctggtgttgggggaggggtcagggaggtgctgctcgcgtctccttttgcgcctgcgcggcgggctccgagcgggtaggagcgcgtgcgcggtgacgtggacgtccggtgcgcgcgcgcaggctcttcagctggagcggacacacggtgtgcgaaccgaacagaataacccgcccccagcgggatgtgaaggactccgggtgaggccggccacgccccgcacggtaactctcgggcctgggtggagggcatcgcttagtactggcccgattggagtttttcgagagtttgaagct

SEQ ID NO: 35667 - DNA, 30 bp, Homo sapiens
  chr15:42868444-42868474
  hyper
gtttctttctatgctcgacagctgatttaa

SEQ ID NO: 35668 - DNA, 57 bp, Homo sapiens
  chr15:43810817-43810874
  hyper
ctgcagctgcccaaacggtccccctccccttctgcctcactgcggagacacctgccc

SEQ ID NO: 35669 - DNA, 170 bp, Homo sapiens
  chr15:44486726-44486896
  hyper
gaaaagccagccatacgtccttgcccgggcagagagccaaagcctgcgcccccgacggggcggccgggctaggagcctaccgccctacccgcctccctccgggcgccccggaaaggtgcaccttactcgggcgggctcgaggaaccaggacggggcgccctcacccaggg

SEQ ID NO: 35670 - DNA, 82 bp, Homo sapiens
  chr15:45403599-45403681
  hyper
cgttctgcccggtggcggggtcgggcgccgcccacatgagcagggggttctgcgagtctcgggggaaagcggggtcgggccc

SEQ ID NO: 35671 - DNA, 202 bp, Homo sapiens; identical to SEQ ID NO: 1202
  chr15:45403798-45404000
  hyper

SEQ ID NO: 35672 - DNA, 80 bp, Homo sapiens
  chr15:45404102-45404182
  hyper
cggggcaaccgggcgtttccacgctcaccacgtcggaaagaacatggtagcctgcgggcatggggcgccaatacgtgaca

SEQ ID NO: 35673 - DNA, 128 bp, Homo sapiens; identical to SEQ ID NO: 12136
  chr15:45405031-45405159
  hyper

SEQ ID NO: 35674 - DNA, 67 bp, Homo sapiens
  chr15:45405416-45405483
  hyper
tcccgctgagctgcacggcgaaatgaccttccagtctcagggagccgcttgccgcacctctccccgc

SEQ ID NO: 35675 - DNA, 239 bp, Homo sapiens
  chr15:45406627-45406866
  hyper
agcagcccacctccacgcttccttaacggagaggtgcaggactcagacttcaccagcccactcggtcccagccttgtacgcaaagagacgccaaggacgcgctctcccgcgtccaggcagccccagcttgctggcttgcctgcccgcctgcgtgcagcactcggccggcgtgcagcatgaccctgtggaacggcgtactgcctttttacccccagccccggcatgccgcaggcttcagc

SEQ ID NO: 35676 - DNA, 28 bp, Homo sapiens
  chr15:45406867-45406895
  hyper
ttccactgctcatcgttattctagtgtt

SEQ ID NO: 35677 - DNA, 296 bp, Homo sapiens
  chr15:45421385-45421681
  hyper
tcctctcctaactcacgtaaggacccggctgtgaccggacaaaccgggtctggggtgcttccagtcactcttcaagtcactcccaaacttctcagactgcacccgaggctctgcggcgccgcctccctctcccggcctggtacagagaagggctgggtgcgccaggacagtagtaccggggtctgccagctccgcagaggtccctccaatcccccctcctcctctgcgcccccccacccatgcccagcaatcccagcagctccagcgcaaacctagcgacgcagttccgggtctgg

SEQ ID NO: 35678 - DNA, 140 bp, Homo sapiens
  chr15:45421706-45421846
  hyper
cggtgggacccccaagacctcacgaggatccccggagggagacgtgactccggggtcttagaggggtttaggtcggatgggtgacttgctttgacgcctggcctggtctgtgggtggcaggtgatcgatggccttggact

SEQ ID NO: 35679 - DNA, 351 bp, Homo sapiens
  chr15:45427369-45427720
  hyper
cgcatcccgcccggagaccccatgttcgaccccgaccagcgcggggacgtggtgctgcccttccagagaagccgctgggaccccgagaccggacggagtcccagcaatccccgggacccggtgaggcggggaaggcggcgggaagggaccgcaccccagccaggtgggacctgggcttcgggcctggcagggcctggaggggagaggcgcccactccccagccgcggacacccgccgggccccggccttccctagctcgccgccgcccatcgacccgggctcacccgccgcgtgccccgcaggccaaccaggtgacgggctggctggacggcagcgccatctatggttcct

SEQ ID NO: 35680 - DNA, 82 bp, Homo sapiens
  chr15:45427771-45427853
  hyper
cggggcccgaccccgcttttccccgagactcgcagaaccccctgctcatgtgggcggcgcccgaccccgccaccgggcagaa

SEQ ID NO: 35681 - DNA, 71 bp, Homo sapiens; identical to SEQ ID NO: 1203
  chr15:45479446-45479517
  hyper

SEQ ID NO: 35682 - DNA, 59 bp, Homo sapiens
  chr15:45479774-45479833
  hyper
gggggcgacaggggtggcgagggcggcggagccggacgaccccccggagtaggggtctt

SEQ ID NO: 35683 - DNA, 78 bp, Homo sapiens
  chr15:45670588-45670666
  hyper
tccgatgtagtgcaccgcctcggcgccgcggctcccgccgcgcagacaccgcacccgcagcatcgccctggcccggct

SEQ ID NO: 35684 - DNA, 13 bp, Homo sapiens
  chr15:47476968-47476981
  hyper
gatttcaaaatgc

SEQ ID NO: 35685 - DNA, 253 bp, Homo sapiens
  chr15:47477012-47477265
  hyper
cgcaagctgggcgagttggatccgggtcggcagccggctgaaccgccacgctgccccgctttttttattttctttttagatacggcatctaattggtgggtgctgggaggcagggctggttgggtgagcacgagtacctgggtgtagggaacgacctaccttcttgctttccttggggtttagaggggaaggggtgggggcacccagagccccgaagcccggagcgtcccgcgctagcgggcttgcgcgcggc

SEQ ID NO: 35686 - DNA, 158 bp, Homo sapiens
  chr15:47477354-47477512
  hyper
cgctcaccgggctgtaaataaaagtgacgacttggaggagtgggggtcaaggctgccgggagggaaaaggcttgcccattttagaaaccgacttggagctcggaagagcaaacgtagtcgacagagaaaaccgctcctgagtgcgaaacttagatctg

SEQ ID NO: 35687 - DNA, 146 bp, Homo sapiens
  chr15:48009524-48009670
  hyper
gagggcgagcgcgcccggccggccgcgcctcctgccgtccgtgcccgggggtgggacccgcgccgggagctgccgagtgcgtggagggagccaggctccggctcgcctgatggattgacttggagatggatcgaattacaccattt

SEQ ID NO: 35688 - DNA, 81 bp, Homo sapiens
  chr15:48009881-48009962
  hyper
ccaatgaggtaagaccgttttcaacaatttgctaatgctcttgtggcgcccggtgggggtcggaacctgagatcccgaatc

SEQ ID NO: 35689 - DNA, 740 bp, Homo sapiens
  chr15:48010082-48010822
  hyper
tggacagttgatttattttccaagctgctctctctgcctgccgtgcaagggacgcgcaaagggctagagaggtttggcggacgcgtcaaaactggcaaagctggcggcttagggggaggggcaagtggacttggaggccctcctccactgtgcacccccttggaaaaaaagcggagggggcatcaagtaaaagtttcttgccaggcagagccagctcggcgtcccccgcacatagctggggttagcaggggttgcttctctgccgggcacagcgtctccaggagccagccggggagagctgagccaaggccgaaggagccgcctgcgggcttagccgccccctcccgcccgttggccccagagcggacgctgggacgcccggggtctggcagctctgcgcccggctaggagcgggcgggcgagcattagcctgcgtcctggagaaggggcgcagcgccgcagttgaggccggagcagcccctcgcgggcgtaggatacctgtcagtgagcgcccggattgcacggcccccgggtagtgcctgccggcgaggggcgggagctcgggtgacttggccatccccatccccggcccaggcccggagggcggccgcttcccaccgtccctctccccttactggcagagcgcgctgcgggcggactcccgggcccggagcagcccaccggccaccccaccgcccacccggctcccggtgtctcctcccggccgctctacccagcaa

SEQ ID NO: 35690 - DNA, 49 bp, Homo sapiens
  chr15:48011314-48011363
  hyper
gaacttgttaaaaggcgaaatgtcagggagctggcgggggtgggggtgt

SEQ ID NO: 35691 - DNA, 143 bp, Homo sapiens
  chr15:48470373-48470516
  hyper
gcaggtgcgggctgtcgccaccagtggccccgggcacctcggccttgttggcgtccgccatcccgccgccgctgcctccgcctcggccgcctgagctgaggggctccgagcgcgacaatggcggctgccggggaagcggtaac

SEQ ID NO: 35692 - DNA, 72 bp, Homo sapiens
  chr15:48470517-48470589
  hyper
gatcccgatttgaaaaggccccgagcgctcagtaacccggatctcgcgagaaccggtcgagactgggtgact

SEQ ID NO: 35693 - DNA, 487 bp, Homo sapiens
  chr15:48936726-48937213
  hyper
gagagtcatcctgcccgttgttctggatcttgaaacttgggagacccacaccaaaggagggaaccggttcctttaccctttaagcgcgtcgtgtcctccaccgcctcttctcttggcccgactggctctggtttccttcacgttcccagcctccaaattggcgtccgccccatggctcgtgtaggacgctaaaagcacggtaaatcccagggcgatctccagcagacgccctcgacgcatgatgccgagccgccaccggctcccgccgcctcttgccgcgcccggggctcggtctgcggccgccgctgcgccctgaagcgcaccgcgccgccggggtcccgctatcccgccgcccgtcccccgggccgggctcctcccgccttctccaggcgctgctcccacttcaggcggcccctgccagctgcaacacagagacaaatccccgaggcggggagactttcagggcatcgggatgctgaagcctcgc

SEQ ID NO: 35694 - DNA, 432 bp, Homo sapiens; identical to SEQ ID NO: 1206
  chr15:48937214-48937646
  hyper

SEQ ID NO: 35695 - DNA, 638 bp, Homo sapiens; identical to SEQ ID NO: 1207
  chr15:48937709-48938347
  hyper

SEQ ID NO: 35696 - DNA, 242 bp, Homo sapiens
  chr15:48938348-48938590
  hyper
gttgccccggaggccctggcccgagagaaaaccagtccccgctgcccgcgcctcccggtagcgcgctccctgcgcctctcccgccggacactcagcagacgccggaggccgggaggctaagactgggcgcgtcgcaggccgggaccgcggcagaggctgctgtgccgaccgaggagagggctctgccgcccccacttgccctgggtgtcgagagcccactccagacgcggctcttctgaggc

SEQ ID NO: 35697 - DNA, 374 bp, Homo sapiens
  chr15:51385846-51386220
  hyper
tcagagctgcacaagcgccgggagctgtgggcacgtgaggagggcgagcgggtcctaggtgcgtagacccgtgggtggggggcggagcggaccggtggaggtgggcagagaccggcggcaagtcgacccacggctgtgggtggcttcctcctgttgctcagtatcagggagaggcgggggaggacattcattttttttcttccctaagtaagcatccacctattgctttaataactatcgattgtgaaaagccggcggggcctcttaaaggcgaagtcgggaggcgcgcgcccctgcgtctgtgttcggggaccagtccgcggggaccttctggaccttctccgccggctgcgcggcagcgatggaccctgtgc

SEQ ID NO: 35698 - DNA, 414 bp, Homo sapiens; identical to SEQ ID NO: 12151
  chr15:51559380-51559794
  hyper

SEQ ID NO: 35699 - DNA, 116 bp, Homo sapiens
  chr15:51633989-51634105
  hyper
gcgctgtgccagtggcgcgggctgagctcggcgctgcgggctttggaggcgcagcggggccgggagcagcgcgaggacagtgccctgcgctccttcctggccgagttgagccgcgc

SEQ ID NO: 35700 - DNA, 126 bp, Homo sapiens
  chr15:53075739-53075865
  hyper
cggcctccgaaggccctttcacccaccccacacaagaggaaacaaagacttctcagctcaaggcctcagggctgcctcctgactccggtcagtttgcaggaagaggaaacaacaaaacaaaggaac

SEQ ID NO: 35701 - DNA, 1016 bp, Homo sapiens; identical to SEQ ID NO: 1210
  chr15:53075985-53077001
  hyper

SEQ ID NO: 35702 - DNA, 461 bp, Homo sapiens; identical to SEQ ID NO: 1211
  chr15:53077065-53077526
  hyper

SEQ ID NO: 35703 - DNA, 231 bp, Homo sapiens
  chr15:53078005-53078236
  hyper
ggaatttcctcctgtcgcccttcttccaccagccgctgttatttcgtgaccggaaggcgcctccccaaacacagcgccacgtgcaagagggttttgaccctctgcaacaggctgccggcaactggaggacagaggggcgtggagaagccaccactctcccgctgcggagcgaaggaaccgagctcagtgagccctgacctcgcaaggtggttggaacgagactggggaggg

SEQ ID NO: 35704 - DNA, 251 bp, Homo sapiens
  chr15:53078741-53078992
  hyper
aggcaggcgctccttcgatagcctcctgggtgccacaagcacctgccaggcaccatgtttgcgcctccagcgtgcgggtcccagcactcaggctccctccccctccacagtgccgtcccctgagctcggctatgtagctctccacgcttggaggtcagagggcgctcctgcggccaggtttccatggctcagaggtcgtctctgaacagaacgtgtcagtctgtccttccagggggcgacagcaggcagtg

SEQ ID NO: 35705 - DNA, 414 bp, Homo sapiens; identical to SEQ ID NO: 4224
  chr15:53079264-53079678
  hyper

SEQ ID NO: 35706 - DNA, 175 bp, Homo sapiens; identical to SEQ ID NO: 4225
  chr15:53079717-53079892
  hyper

SEQ ID NO: 35707 - DNA, 96 bp, Homo sapiens
  chr15:53079970-53080066
  hyper
cgaatcctcctgaaatccccggtggggttcgggctgggctcagctttcttctctgcctatccgcggtctcggggagccaggcgcggtgtctgcgct

SEQ ID NO: 35708 - DNA, 256 bp, Homo sapiens
  chr15:53080299-53080555
  hyper
actgggaccttgggacggtcagcctccctctcctttccacagccaattccatgcgcagagagcgtcctaacccttacaactcgtctgtgctacacacccaccgcccaatggctctgaaactttttgcccatactcttagattgaggtcaccccagccagcgccaaaagaatgagcgcgggagggggtcacagcagccagttcggccaaacatcgacgctgctccggcacgctccagcccagcgcctgggatgtgtc

SEQ ID NO: 35709 - DNA, 58 bp, Homo sapiens
  chr15:53080933-53080991
  hyper
gtgtaccttatctcccgcgcgcccagctccttggccggctcacctgctaagcggagcg

SEQ ID NO: 35710 - DNA, 243 bp, Homo sapiens; identical to SEQ ID NO: 4229
  chr15:53081054-53081297
  hyper

SEQ ID NO: 35711 - DNA, 622 bp, Homo sapiens
  chr15:53081398-53082020
  hyper
cggccgagcatggccgggtggtgggcttcgaagccgttgggggtgagcatcttgtcggtgggcatggcggcccccgggtgggcatagtgggggagcccttgctgggagttgtggatgctgcccagaccggagctggagaggggcgagaggctctggcccatgccggccacgtccttgtggtagggggtatagaggttattcatggaggccagcccgcgctcatcccgcatgagcgtgaagctaccgctcacgttgcccgccaggcgctggtggtggtgcgggtggtggtggtgatggtggtggtggtgatggtgggggaacttgtccgagactgtggagatgggaggcagcggctgcagaggggtcaaggtggtgtaggtggtgggcatgctcatacctgggggagtctcgcaggccatggtcatggtgggatgcagggggccggccaggctgtgctcaggggcccggtggtggtggtggtaatctccgccgccgctgccgccgtccagcagggacgccatgcccatggagcgcgggtgcgcggggggcaggtggctgccgcggtgcgccacggagctgcgcgcgtgggggctgccgcccagcaggtcggcaggggcgggca

SEQ ID NO: 35712 - DNA, 285 bp, Homo sapiens
  chr15:53082758-53083043
  hyper
agcgcgacctggggccgccgctgcaatcccaggagactcgcgcctggctcgctcgcctcccttgcttgagtgggctctgtcctcccagcccggggacgctcgtgtcgggcttctagcggctggagtgctgtgcttggagacatcgcccctctctctccagttgctgcttcccggtgcagcttgcccggggagctggggactgtgtcatcaccccttcggctctagcccactaagctttatttcccggggggctgctgggagtgcgctttcccacccttgaattca

SEQ ID NO: 35713 - DNA, 19 bp, Homo sapiens
  chr15:53083116-53083135
  hyper
cgttgacccggcacccttc

SEQ ID NO: 35714 - DNA, 13 bp, Homo sapiens
  chr15:53083136-53083149
  hyper
tcctcccagatac

SEQ ID NO: 35715 - DNA, 1823 bp, Homo sapiens
  chr15:53095746-53097569
  hyper
tcaaaaaaacaaacacgaattcagccgctgctttaataacctctgaccagaggagctgattttgccaccgagttatcggtcagtgctgcgaggtcagtggcctgtgatcatgtttatagcaggtttggcttggatttggtgacacagccagcaaacctgggagattatgaaaccgtgaaccagcccagggaagtgtagtcaagtttcagtttgggcatttctccgggtgagggaatccggtgggctccatttctacaaggctcacaaacgcaggtgcagttcggccgccgcacgctgcctggcgggagaaacgcgcacaaaccgcagacgcgtgctcctgtagttgccactagctcggggcacgcccgtgttatttacaccctgctcgggggcccccctctcatttgttactttaaactcatggggaggaactgttagctgccgtggcgggactggcaggctgggaggggggcgcccccgctcggctcccgggccgtgacgcggccgctgccctccgcccctggcttccaccctgtttgcatggccacaagctcagcggtggaccagcgtggccaggcccccggagcccttgccccggcctaccgcccctacttcttccccctcaccaccccccccaaacgcttgtgagactggcttaccctggtgggcgagtcgcagcgcattagcggatttcatggcaagttgcttctgtgacatgagatcaggttcgcgttcgaggatttgccccctaggagggaaggaaaggagagtcaatctgcataatttcaaatgagaaataaatagggaaacagggaactgaatttcaagccccctaattcctccctccccccgaacctgtgagccaccccgcaccccccacaacacgccccgtgcacaggtaaaaaaaaaaaaaaaaagtaatcagcacacgtcgcaggtgataccttttattgtgctcattttaaagacaggaacaggatggcctcctgcccgaagactttctctgcagccaggcccggggcaggagggtcagctgggcagcatccgggcccgcggattcctgcaaggtcgcgaggtgagaggtgcggggaggatagacctcgggctcggcgcacagggtctgggccagacgcacaagcccaaattccctccagcttcttcggctccatctttaagtccaggcaaagatcaattccctctctctcttgaacacacacatttgcagccataaataaacagctcccagctaaatcaggaaccggagaggagaaagggaaaaagaaaggagaaaagagaaggattgagaacccaagcgcgagtctcgcctcttccgggcgccgactggctctttttggtcaggccagcctcgcatttggggatgcaacttgcatttgaatagctgcctgggcttgttatggacccgggaaagctctgaaagggaatcactatgcaaattgtcccagttacaatcgaaaggttcgatctccaggagctgcctgacggaagttgatgtcagctatctatgcattagggttgcattaccgccttcgtcggcctcctcgccacccccgctcgcgcctgcaggggaggctttttttttttttgcttatgtttatattttccctcagtaattaaaaaaaaataaaaaaagaaaataaaaggctgaaggtggtggcatagctggctagggcctgggaggcccacgggctgagaggggaggaggtgcggaagggcggggttgggtggcggggggggtcgttcttttgcagcaggtgttgatggtgcgtttgaaatcaaacatttagatttttttttcgctttgc

SEQ ID NO: 35716 - DNA, 130 bp, Homo sapiens
  chr15:53097777-53097907
  hyper
gggggccttttggggcgccttttaccccagagctcagaaagctccgggcagcggggtggtggcgggatggccagtagccagggcccacctggcggcccgccgggatgtggaggcccactgggttccggcc

SEQ ID NO: 35717 - DNA, 309 bp, Homo sapiens
  chr15:53098381-53098690
  hyper
cgcccgccccttgctggcagagtccgggcaggactgccggggcctggggccgcagtccccgcgccgctggccgcccgcagcttctggcgcccccgaaaatgaccatctgtcattcaattaaggtttcagggcagctgatgggggagccagggtcagcgaccccaggacaaaacggcctgctgcctcggataggagaagttcaaatgttaaatgcagaatattgtgccctctcccagtccggggccccacccggccgcaggtccggccagtggacagcagtagggtgaagggcaacggtcattagcactt

SEQ ID NO: 35718 - DNA, 111 bp, Homo sapiens
  chr15:54051776-54051887
  hyper
caccagcctgggacccggcagcccgacctgcgctctgggggtgcctgccttacctgagccgtggggcggaggagcggcagaggccaggcaggctggcgggtctcgccctta

SEQ ID NO: 35719 - DNA, 399 bp, Homo sapiens
  chr15:54270498-54270897
  hyper
gcagtggctacagtgcgtctcctgtgagcaggggctgtagctcaccctctcggagctacgccgtgctacggcggcaggagagggagcccgggcgctctcggtggaggaggctggggatcgcagtgccggtgctgcattcagaaaagactcagccgcagccggcgatgtgtgaagttcccagcacgcactcagcccggctgctcctcaccctcaaatgttgatgagcctgggcgctcctcaacacacgggagagatcccattttgctttctgggagaaagagatgagaaatgagccgcggaaggtatttggcaatgagaagagtgaaaggcagtttcttgccagcagctaagttgtagaattgcttcggaggctacccgggagtgcgatagaattgacaa

SEQ ID NO: 35720 - DNA, 32 bp, Homo sapiens
  chr15:55879909-55879941
  hyper
gcgggacgcgggctgcgcggacttaggcccgg

SEQ ID NO: 35721 - DNA, 607 bp, Homo sapiens
  chr15:55880176-55880783
  hyper
ctgcgaggcaagcctcggagccgaggcacggccgagggcggtggggacgcgggccgactttgcaaagtttgggaggaggacgaggcctcggggcggcggggcggcggggcggcgtgcgggcaccggcggggctcagcggcggtggccgggagcgcggcctgggggcggccccccacccggggccggcatgtgctgagggcgagtgcgccgccgccgccgccgcctcctcccactccttcttcttcgccgccgcctcaggagccgctgacaggggaagcaggaggctcgcggcccggccctggcggcacactcacagcgccctctgaggaggaggtctgctctctcgccgctcccgagtcgcagacacaaaagcccccagactggagccgcctgtaaaacccgctctggggcgggcgagggacgtggcgcggccccgcggcttccccgccctgagctccccagccccgcgcggggacgggcttcggggggcgggggccgctgcctcgtcccgcggcgcctcccgccaccgccgccgcctcgcgctccgcctcggcccagcccccacggcccgcgcgcgcctcttgctccaagccggggctcgcgggcc

SEQ ID NO: 35722 - DNA, 121 bp, Homo sapiens
  chr15:55880890-55881011
  hyper
cgacgctaccgggcccagctttcgcaaggaaagggcatctccgaacttcgtcggaggccacagcagcaggcgtctcggcctcgcagctagggatcggaaagatgaacgtaccatgcgagga

SEQ ID NO: 35723 - DNA, 42 bp, Homo sapiens
  chr15:56034387-56034429
  hyper
ttcccccctcctttccggggcacaaatcggccacttcacttc

SEQ ID NO: 35724 - DNA, 72 bp, Homo sapiens
  chr15:56034651-56034723
  hyper
gccccggcgggctggcgacccggagtccggccggtcgcggaggcgcggacgcggccggagccgggacaatgg

SEQ ID NO: 35725 - DNA, 375 bp, Homo sapiens
  chr15:56034885-56035260
  hyper
cgcagggcgagagcgggggccgggggtcagcgccaccacggaggaccccgccgcgcgctccccacgccccatcgtttcctctttccccatcccactcgcgcccgctcccgccccacagcggtaagagaaagcagaagaaagcgcgcccacctggcaaaggactgagcagcagcaggagcaggagcgcgcggagcagcatccccggcggtcgcagccgggcgaggggtcgcagaggaggcgccattcagcgtagccgcgcgggcatgctccccggccgcccagagcccctgtccgtctgcggcccccgccccgggcgctctctgctctgcggctggtcgcacgcagcctggctccccgctccggctccggcaccgg

SEQ ID NO: 35726 - DNA, 206 bp, Homo sapiens
  chr15:56035304-56035510
  hyper
cgctcgcgagaagcaaggggcctgagagtccggctgggggcggagtgaggcggcggctgcagagggcgggggcggcggagtggacagcgccgcggccgcgggcctgggactactttctacatctggcccttggtctgggccagggaggtcggcgcggccggcggagggagacgctgggagggggccagtggcggccgggtcggagc

SEQ ID NO: 35727 - DNA, 65 bp, Homo sapiens
  chr15:58357155-58357220
  hyper
cacatgaaacgctgacgttggagttactgtacttatcagtcaggtttccgtgaaatttgtcaaac

SEQ ID NO: 35728 - DNA, 21 bp, Homo sapiens
  chr15:58357799-58357820
  hyper
cggggtcggccttcacctcgc

SEQ ID NO: 35729 - DNA, 241 bp, Homo sapiens
  chr15:58358522-58358763
  hyper
ccgactcccctcagccgggccgaggtgcatggtggccagagggtcagggagaggtggcagtgggtgcgagtccccctcgcctcgggctcagaatgaggatccctgcgagcgggtcagcgcggggcggcccttgccaggcgtcgcccgcccagttgctgccctctgccggccgggaccgcccgggcggcttgcgctgtggcgggaggatatgggcagtgatcatccccggctcctccgagga

SEQ ID NO: 35730 - DNA, 159 bp, Homo sapiens
  chr15:59729656-59729815
  hyper
tggaaagagccaggacgcgctgggaggggatgaagctgacgggagaagaaagggctgggaagaggaggggtgttcggggttcttcttctcgtcgtgtctgctgcgatgagacacgatcctgggtcccaactgcaggtgtcaaggcgattcagtaaatga

SEQ ID NO: 35731 - DNA, 30 bp, Homo sapiens
  chr15:60286804-60286834
  hyper
tattcactaatccagcgcattgccaaatac

SEQ ID NO: 35732 - DNA, 548 bp, Homo sapiens; identical to SEQ ID NO: 1212
  chr15:60287038-60287586
  hyper

SEQ ID NO: 35733 - DNA, 33 bp, Homo sapiens; identical to SEQ ID NO: 1213
  chr15:60287643-60287676
  hyper

SEQ ID NO: 35734 - DNA, 80 bp, Homo sapiens
  chr15:60288786-60288866
  hyper
aagtggcaaagttttcgaaaaacctcgccgatcctctgaagatcgggttaatgatttaccccactcgccaaccacctgat

SEQ ID NO: 35735 - DNA, 316 bp, Homo sapiens
  chr15:60289310-60289626
  hyper
tcagccaacagcccccgcgctgctagagcgcccaaagcagaggccggccgcgaggagggccagagtgcaccgcgggggggtttgcaccgcgctggggttggcaccgcgcgctaggacccacgaagcggcgcgctagtcccaggtgagcacgaaatgagcggaaggactctgccgcggaggggcggcgagcgcctggctgcgctgcaggccccgccaagccccgccccctagccattcttagctgggggaggccagcacggatcagccgctttctttcttttctctctttctttttcaaacccgctttgtgggtggc

SEQ ID NO: 35736 - DNA, 30 bp, Homo sapiens
  chr15:60289876-60289906
  hyper
caaacaaagcagaagcgcagggttttaagg

SEQ ID NO: 35737 - DNA, 30 bp, Homo sapiens
  chr15:60292201-60292231
  hyper
tcccgaaatccagcacgttaaagccaggcc

SEQ ID NO: 35738 - DNA, 354 bp, Homo sapiens
  chr15:60295917-60296271
  hyper
agtcaagtcaaatttcgacctaactctccggggactggggggcaagggtgtgttttcattattataacccatgcaaccaaccccgggtagtgctaagcgcaggaaaagggtcggcttcaggggaaagccgtgcctaaagttacctaacgatacaaaccggatacaacgcagaggaaacagaataccccagccaagcaatttccatgtcaaacatcatccgcgcggctgctccatctgtgaacgtgagtggtcgcctggctccctcttccgcggcggccgcttcctcataccttcacacggcgcacaccggccggcgcgtccagctgcctgcccagtggccgaggctcttccccc

SEQ ID NO: 35739 - DNA, 135 bp, Homo sapiens
  chr15:60296483-60296618
  hyper
ttctgctcctgtcaccgcttaaaactatcagatggttcgagggaggacatggaggcagccacctagctcagcggagacgcggagcccacagcagcgccctccggagccctaacacgtcgctgccaccatccgcgc

SEQ ID NO: 35740 - DNA, 64 bp, Homo sapiens
  chr15:60296860-60296924
  hyper
cgtccctgccccctattctggccccagtaccgacttacttcccggctatcctcgcgccgttcgc

SEQ ID NO: 35741 - DNA, 676 bp, Homo sapiens
  chr15:60297151-60297827
  hyper
cgaggaagaagatgcctcggcccggccgcaacacgtacagcgaccagaagccgccctactcgtacatctcgctgaccgctatggccatccagagctctcccgagaagatgctgccgctgagcgagatctacaagttcatcatggaccgcttcccctactacagggagaacacgcagcgctggcagaacagtctgcgccacaacctctccttcaacgactgcttcatcaagatcccgcggcggccggaccagccaggcaagggcagcttctgggcgctgcacccaagctgcggggacatgttcgagaacggcagcttcctgcggcgccgcaagcgcttcaaggtgcttaagtccgaccacctggcgcccagcaagccagccgacgcggcgcagtacctgcagcagcaggccaagctgcggctcagcgcgctggcggcctcgggcacgcacctgccacagatgcccgccgccgcctacaacttgggcggcgtggcgcagccctcgggcttcaagcaccccttcgccatcgagaacatcatcgcgcgggaatacaagatgcctggggggctggccttctccgccatgcagccggtgcccgctgcctacccgctccccaaccagttgactaccatgggcagctcgctgggcaccggctggccacacgtgtatggctccgc

SEQ ID NO: 35742 - DNA, 238 bp, Homo sapiens
  chr15:60297941-60298179
  hyper
cgtgcccattaagcccacgccggccgccgtgcccgcgctgcctgcgctgccagcgcccatccccaccttgctctcgaactcgccgccctcgctcagccccacgtcctcgcaaacagccaccagccaaagcagccccgccacccccagcgaaacgctcaccagcccggcctccgccttgcactcggtggcggtgcactgacccgcaggagcccacgccccctctcgttctcctccccac

SEQ ID NO: 35743 - DNA, 49 bp, Homo sapiens
  chr15:60883305-60883354
  hyper
caggcgcttggcacccgcaccggtggctaggacccgcaggacagtctgg

SEQ ID NO: 35744 - DNA, 136 bp, Homo sapiens
  chr15:61519885-61520021
  hyper
ccagccctccccaaccgccgccagaagccgagtgcaagaggagggggcgcgctgggccggtacccaagccggggctggagaaatcctctccgtccccagctccaggcggctcgcgcgagcacgcttcctccggagt

SEQ ID NO: 35745 - DNA, 54 bp, Homo sapiens
  chr15:61520408-61520462
  hyper
gcttgcttttgtagacgctccctccggatgcgcgtggagcgccccacaggaccg

SEQ ID NO: 35746 - DNA, 190 bp, Homo sapiens
  chr15:61520773-61520963
  hyper
tcgggcagccagggccgaaactgtcaagaggagaaaaggtaaagcggaaggagggtggccataaacagatttttttgccccttcttaaaaggacactgccgctttaaaagtttctttcccgggcccccactccccgcatctccgtattttgggggagcgtatttaattgaggcaacgcagctttcctcca

SEQ ID NO: 35747 - DNA, 94 bp, Homo sapiens
  chr15:61521200-61521294
  hyper
ccgcgcccgggctcccgccgccccctccccagcccctctccagcctcctacctctgctggtgctggaatagctctgtctgcgcaccggggcagg

SEQ ID NO: 35748 - DNA, 161 bp, Homo sapiens
  chr15:61521311-61521472
  hyper
cggattcctggttcagcggggtctccctggagccggcggccgcgtccgcgccgctgctgcctggctcgctggcggcggggtcgggggctgccggagctgactccatgttttttcccaatgtagagatcgctggagatggcgagctccgagactccctctat

SEQ ID NO: 35749 - DNA, 138 bp, Homo sapiens
  chr15:61521809-61521947
  hyper
gagaacagagcctcccgcgccccaatcctcccctctccccagcccagggacagaaattaaaatcggtgagatgattccgtgcctacttctgagactctctcgggaacagaactcgtccccatccgctgccagcttggg

SEQ ID NO: 35750 - DNA, 32 bp, Homo sapiens
  chr15:62456269-62456301
  hyper
gcgctgcattgccaacgcgcagtgcccggcgg

SEQ ID NO: 35751 - DNA, 30 bp, Homo sapiens
  chr15:62456901-62456931
  hyper
cacacggggcaggtgcggcagtgacagcgc

SEQ ID NO: 35752 - DNA, 141 bp, Homo sapiens
  chr15:62457155-62457296
  hyper
aggaacagagtttctcgaggagccgcatccttggaggctggggctaggagtggcgggaagaggtgcgcctgcgggggagagaagctgctgagtttgggcgcctggagctgctgcagcccctcgacgcggctggatccctcc

SEQ ID NO: 35753 - DNA, 176 bp, Homo sapiens
  chr15:63334493-63334669
  hyper
ggcacaggggggcgacgcgcatccaccacctggtccgcgctctcccggcctccggcagctcagggcgggctcggttggggaccctaatggctgggtgccggccctgggagaagggcacgcggagggcggagggttgcgcctcggccccggctcggccccaacgccctctccctggc

SEQ ID NO: 35754 - DNA, 30 bp, Homo sapiens
  chr15:63335974-63336004
  hyper
aggagctgcacaaggcggaggacagcctcc

SEQ ID NO: 35755 - DNA, 38 bp, Homo sapiens
  chr15:63673771-63673809
  hyper
ccttcagcccaggggcggctgagcgctcaggagtgtta

SEQ ID NO: 35756 - DNA, 36 bp, Homo sapiens
  chr15:65204199-65204235
  hyper
ggccgagaggacccccgcatccgtttggggagtgcc

SEQ ID NO: 35757 - DNA, 121 bp, Homo sapiens
  chr15:65360172-65360293
  hyper
tggcgacgccctggacggccacgcaggtctgcggccggtgggccccgcgcagtgcgcccgcccgtcggggcccaggggagcgggatgcaggcttccctggagcgcgcggccccggacccgt

SEQ ID NO: 35758 - DNA, 76 bp, Homo sapiens
  chr15:65360323-65360399
  hyper
cgggctgccaccccgcggggaggaggggccggtggagcctggcgggcggggccaccccaagcgccaccaaattcct

SEQ ID NO: 35759 - DNA, 15 bp, Homo sapiens
  chr15:65648085-65648100
  hyper
gaatccggcattgtg

SEQ ID NO: 35760 - DNA, 15 bp, Homo sapiens
  chr15:65648136-65648151
  hyper
cgcacgccaaacgag

SEQ ID NO: 35761 - DNA, 530 bp, Homo sapiens
  chr15:65669295-65669825
  hyper
tccaggcagcagaaccggcggaccgcgagagccagggcaaggtctccgcgtgtgcacacttcggggaagggcaggggcacgtgagcatccccgcggctcgctcgctctcgctttcggtggcttctcctctccttcttggctcacgggctctgtcccgggtcgctccctagccacgcgccgccctccaggaatctccctcgtcttctcctgtctctcccgcgcactcctcagcccagtaccagctccaaatgcaggtcgtgccatctccgcccagtgcagccgtcagagtcccggtctccgctccccaggctgctgtcccctgtcttggctgcctcgggctatgtccacggccgggcacccagcaccccagctcgtccgcctcggtcagcgcttagccttgcggtctcccctggctcgtttccctcggtctccacgccagcccgccccgcttgctcccgcttcgctgcactccttgctcctcagtctgggctccgggtcctgccccagtcttcctccggggggttccgtcc

SEQ ID NO: 35762 - DNA, 151 bp, Homo sapiens
  chr15:65670634-65670785
  hyper
ggaagtggacaccagcggactggggagtgggtccgggctgcggaaagacacacagctgcgggatttgctctgacccactctttctgctgcgccctcctccaagtccatattttagagataattctctaaaaagctgcgtaaagttgtcaaa

SEQ ID NO: 35763 - DNA, 185 bp, Homo sapiens
  chr15:65714138-65714323
  hyper
acactccccatgagccgcccccaaacgcacaccggacaggaagcgacagagctgtgggtggaagccgcagccctagacacacacccttggggacttcgctatcccctccccagccctttctccagcttggacaactctgacttaccccgtacccactccgcactgggctgcggactggatgaggc

SEQ ID NO: 35764 - DNA, 18 bp, Homo sapiens
  chr15:65714819-65714837
  hyper
ccatggcacgcactgcgg

SEQ ID NO: 35765 - DNA, 38 bp, Homo sapiens
  chr15:65715098-65715136
  hyper
tcgctcctgcctctccgggcgcccgcccttaccgcgcg

SEQ ID NO: 35766 - DNA, 120 bp, Homo sapiens
  chr15:65715528-65715648
  hyper
gtgcctcgccctctccgggtcgccgcgggcccccgtgaggccgcctgttgctgggtctgtctcttagtctccccgtctctgagtcttctggtctctctgcctcagcgtctctatttcttc

SEQ ID NO: 35767 - DNA, 121 bp, Homo sapiens
  chr15:68112086-68112207
  hyper
cggcctcccaccaaatccggaccctctccagcctcagtctctggtccgcaacaggagtgaggtgggcccggagctctgagcaccttctcaccggctccaaggcccccgccttctcctcact

SEQ ID NO: 35768 - DNA, 89 bp, Homo sapiens
  chr15:68112552-68112641
  hyper
aacctaattaactgacgaaaactgccgttaattcaactagtaaaagatatgtgcttgcggaggaggcgcgtccgcgcagcctcagccca

SEQ ID NO: 35769 - DNA, 237 bp, Homo sapiens
  chr15:68113226-68113463
  hyper
gcccttgttgagaatcggctctgcaatcggtaaagtgcggtccgcggtgatattaacccgccggacgccggcccatagtagagccccagctcctacccccacgacctgctccccggtgcccagccctgagcagcggggcttccccagcctctgtccacgcgcctttctccagctcagaccagggacaggagctgggtgggtctcctggcactggccagagcgcggggagctgtccgt

SEQ ID NO: 35770 - DNA, 695 bp, Homo sapiens
  chr15:68113751-68114446
  hyper
gctaagaataattaccgaacgagattgtaattatggggtgggggagcctgggccgagggagagggaatgagctggcggggacttgggggcagctctcggactgggaaggaaaataggttcctgtgttctccccggggaaggtgtgggaggaaagacagcgggatagttggagcgggacagaggcacagcctgggaaagacacccgaatggaggggccagaggcagaaagaaaggggccgagcgggttccaggactcccctgggagaaaagggaaaggcagggagatccgagacagaaagaccggaaccgaggagggggaagagggcaagaacgcgatctaaaagagaccctcagaggagacagagcccacaaacttgggagaggttttcggggcctaggagaacggtaacctacgtcagccagggtagccgggaagaaggcaaaggagtctgtgggctgggcctgccctctcctcagtcccttcaccaggcctgagctatcggttcgcgcttccagagtcccttcccagggtctctgcgagccaggagggaaaggaagagaggggagaagtggaggaaaaggggagacacgccccagaggagttggaacgcaggagggaaaggggaccatacccggtagcccgagggaaaaacgaggcgagaggggagaaggcgaccccgcgctgctacccgcgg

SEQ ID NO: 35771 - DNA, 30 bp, Homo sapiens
  chr15:68114981-68115011
  hyper
tcagatcactcccaacgatgacttggctcc

SEQ ID NO: 35772 - DNA, 1309 bp, Homo sapiens
  chr15:68115276-68116585
  hyper
caccaccctggccctcgcctgcggccggaaagtgaagtactcctccctgcgcccgttcctcttgagtcccccttagccccatcacccggttttggcccagaccaaaactggctccttggccgggagcactgggccctccccacttcgttcttggggacaaactttatggccccagggcctttcctccctcctggcctctccagctagagcgggacgcaggtgcagggtgctggacgcaggtgtgcggccgcttacctggggcgtgcaggccttgggctgcggggaggcggcgggcgccgcgcgtggcccgcgggcgggcggacccggggagggcgctagcgactgcgcgggcggtgggtgtggcgccccggctctcagctgtcaggcgcgcctgccccgccactcgggctgtgaccgcgccgtccccgccgccgcgccatgcgctccaggcttcggcctcttcttccggccagtccccggcctcggggtcaacggctcagggttcgcatctccgcgcccggggtcccggcgccccgtgcccgctgagagcgggaggggccgcgggtgggagcgcggagaaccagggagcacggctgtgcgcgcgcgcggggaggggccgcgccgtcacccggagagcccggcggatcccggactcccgcccgccgctcctcccgccgcgcacctccgctcaccgctcgcccggctccagccgccgccgcactgtgagtacccacgtccggtagcccgccgcccccgcgctctgctcctgcagcttttttttcgtttagttctgatttgggctcctgtggctgttgtttttatgattatacctaaagacaccaccgcctcgctcccaccactgccagtctcccgcttcgctgccctccccaagctcgtccatctagctccgggagccgacgggggttcctcaagctgctctggctgctgctccttgtcgctgcatatggctcttcgcctgtgctttccgctttggcccccgaaattccgttcctttcctagggacccccttcttctgactccgggcccggacccccctcctctcactcagggaaaaccgcgcagggacccaggaccctcaactggggtacgctctcggctcgggcgctgtcttcactgtatgcgggccaggcatagttgccgatttcgagaaaccgagaagctgtcatttcccagcgctgcgcgccctccagccacctccaggagggcgcgaggcttgtcagccggggagttaggacagtgtttttgcctcctacaatgatataaaggacttcaacgcgaaataagggtc

SEQ ID NO: 35773 - DNA, 1209 bp, Homo sapiens
  chr15:68117465-68118674
  hyper
aatctttctgctcaacgaacgcgggcgccagccgtgagaggagaagctcgggtttgtggaaactggcaatgttgtcccctgaagccggctcgggcaccaagctgggtgcggtgggggccgcgctaggtccgggtgcgcaccgagcgctttggagagggtcaggttcagcaccgcgaacagcggtagcctccgcctctctccttccctggcagacacggttccctcctccttctcctcacccccctccttctcttcacccccctctaccccctgctgtctggagatgggcagtgaccgcccctcccccctccccacccctccttgcactgcccccgcccgcccgcgtgcatgcgcgactgagcagaggggcggccgatccccgaagtccgggcttcaggacccgggccggcagcaccggctgcgagggttgccgaaggcgcacggatctgggcgctgaaaaagccaggatttggcaatggctttgctgtgtggccttgggcaagtcactctgcgtatctgggtttcacttccttcccaatccgaaaacgggattgggttccttgcagcccgggcattcctgaggtctcctttaccccttctcctcccccaagccccgggggctgttgttaacggcgccaacatgggtctgagtaacaaaagacgcctgtccagggggtgaatgagtttggactccccactgccaagtatcccccgcgcgcccaactcggagcgccctgctgggcgggcccgagcctcggcggcggcgctgaaaatggctcatctgctctctgctttctctatttcgcaggagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaagtcgttcctgggcgagc

SEQ ID NO: 35774 - DNA, 775 bp, Homo sapiens
  chr15:68119578-68120353
  hyper
cgcagcggcagtggctgcagcggccgccgccgccactgtgtacccgacgtttcccatgttctggccagcagcaggcagcctcccggtaccgtcctaccccgctgctcagagccaagccaaggccgtggcggcagccgtggcggcggcagcggcggcggcagcggcagctgctggcagcggtgccccagagcccctggacggtgccgagccagccaaagagagtggcctcggcgcggaggagcgctgcccgagcgctctgtcccgcgggcccctggacgaagacggcacggacgaggcgctgccaccgcccctggccccgttgcccccgccgcccccgccgcccgcacgcaaaggctcctacgtgtcggccttccggccggtggtcaaggacaccgagagcatcgctaagctctacgggagcgcccgggaggcgtacggcgcggggcctgctcgggggccgggacccggcgctgggagcggcggctacgtgagcccggactttctgagcgagggcagctccagctacaattccgcctcgcccgacgtggacaccgcggacgagcccgaggtggacgtggaatccaaccgcttccccgacgacgaggacgcccaagaggagaccgagcccagcgcacccagcgcagggggcggcccagacggtgaacagcccactggacccccttccgccacctcctctggcgcggacggtcccgcaaactctcccgacggcggcagcccccgcccccggcgccgcctcgggccacccccagctggc

SEQ ID NO: 35775 - DNA, 38 bp, Homo sapiens
  chr15:68120630-68120668
  hyper
cgcgctgcgaaactgggcccacccgcaccctccagtga

SEQ ID NO: 35776 - DNA, 5 bp, Homo sapiens
  chr15:68120954-68120959
  hyper
caact

SEQ ID NO: 35777 - DNA, 809 bp, Homo sapiens; identical to SEQ ID NO: 1217
  chr15:68121149-68121958
  hyper

SEQ ID NO: 35778 - DNA, 239 bp, Homo sapiens
  chr15:68122469-68122708
  hyper
ggcagtatccgggtcacggtttctttgcctctcttgaaattcggtttgttgccttcaagagccagataaggaagacaatcactcgcccgccgatgatttggaaacgaggaaatcctatccagaccaaaggagtatctcccagccaagtcctgcaaatacagacagaggtgagccagcccttgaacccatcgctctccaccgcacccaggagctgggacccaggtcgcccaggttcccag

SEQ ID NO: 35779 - DNA, 488 bp, Homo sapiens; identical to SEQ ID NO: 1218
  chr15:68125223-68125711
  hyper

SEQ ID NO: 35780 - DNA, 297 bp, Homo sapiens
  chr15:68125947-68126244
  hyper
tcctcctgatccgctcggttgagattccctgaccccaaagggttggtaaggccggggaggggaaagggtggactgcgcggtgaggtgagcctggagaggcgcccagagtgaccctcgcgactgtctccccagaagcccacgacgccctgcaccatttctcctgcaagatgctgacgccccgccactgcactggcaactgctccttcaagccaccgctgttgccctagggccggcctggccgcacccctgcgccctcaagccatgctgctccttgtaaatacccgctgctgcggtggc

SEQ ID NO: 35781 - DNA, 85 bp, Homo sapiens
  chr15:68126922-68127007
  hyper
gaggtgggagtgcaccggcggagcggggcggcggaacaccgtgcaacaggtgggggtgggagccgccccgcgggttctggggctc

SEQ ID NO: 35782 - DNA, 736 bp, Homo sapiens
  chr15:68127766-68128502
  hyper
ggctagtgggggtcccgggttgagcccttcttttatctttcctgggtctccgtttcggcctctatgaaataacacgcaggcctccgtccatgcggctcgtagaaggcgggcggcaggccccgcgccaccggccagcagctcgggaccgggagccctgggctgagggggccgggaagtttcgtggcgggttgtcttggtgggccttggacggagccggctagtaggggcgtgctctgggcctccccgaagctgtgcagacgaggagtcccgctgcgcggtacagccaggaagccagtccctagagtcctttgcgctgggggtcggagccttggagtcccaggatgttccgacggctaagaccagagcggacacaaaggagataacaatgaagagggcgccggcaaatggcgaagcatcgcctccggacaggccatctccgggcagggcccctctagggagcgggaacgtttcatatgcatgggacccaccagatccgctttccgctggaccggtggcgaaactgaggtccagagaggaagagactggagtctccaggccgcgccagggcccgcggaactgcgacggggcgggacagcgcgggtgtgggagtttgccggcccctttccccaccgcggattgcacctttggaagctgcacttttcttctctgtaaaatgggcatcaccattaccacccaggcaggaagttccgtggctgcggctcgacagaggagccag

SEQ ID NO: 35783 - DNA, 115 bp, Homo sapiens
  chr15:68260535-68260650
  hyper
tccatgttcacaaaacgcagcccgactggtggaactcgcgactccagacgcagagaagctgtgggcagaggcggaggcagagggtgggaatgcagcctggcgttggagtggggag

SEQ ID NO: 35784 - DNA, 40 bp, Homo sapiens
  chr15:68549442-68549482
  hyper
ctgcaggcctctccccgccagcgagcgcacggcagcggtg

SEQ ID NO: 35785 - DNA, 65 bp, Homo sapiens
  chr15:68569420-68569485
  hyper
aagcagagcctggcacgtagtcgacctctaatattcattggataaacgatcgtttcaaatcctaa

SEQ ID NO: 35786 - DNA, 529 bp, Homo sapiens
  chr15:68723523-68724052
  hyper
tcagggctggcttcccgctcccagccgcgcgcccctcgggccggaggttcctgccgcgccccgacacctggagtgcattaggcggcggcgcgcgtctaggcgacggcggctttccccagattattgaataattgcataattccgagcgcgggttgggaggcaatgccgggtccctaccccgggtgtcaggtaacgtttcgggggtcctgcgctgcgcgactgtgtcccgccgctgctggccgggcagacgagagctagcccccgcctaccggccatcgccccggggctttgctctgtctttggccggaggcactctgcgcagccctcacccccacccttcagccctccggggccgccgcgcccggctctccaaactttgagatgcttccccggagccaggcaggagggcagccagggcacactctcttggcgctgattcccttccccagccggggccgtgcgccctcggcgctcccgggacacccgagtgcccctggcagccgtgcgggaaccccggcatgggccttgg

SEQ ID NO: 35787 - DNA, 265 bp, Homo sapiens
  chr15:68870820-68871085
  hyper
ggccaccctgtgccccgggccagcgcgaggtgggggtgcgggcagggctcccgggcttgcggctgccacgcccctcccagcccgccgcgccacactcacggcccacgggccgactttgcgagcctccagggggcgaacccgaccgccttctttgcccgcgcagcgcctcggccgtccagcctgtgacttcaccagcgtccccgggccagcgggacacccgagagcccggggcgccgcccgttctcccagccggcaggtgccggga

SEQ ID NO: 35788 - DNA, 173 bp, Homo sapiens
  chr15:69136224-69136397
  hyper
acatacacacacacacgtgtgtgtgtttcggggctgctcaggaggacaggcggctctgcgctgcggctgtggtgggctccgtgcacaccgcgctaggctcatagggcggctggcaggtccagagagcggcgtgggagcagctgctgccacggtggcagcggagatgaaggtgt

SEQ ID NO: 35789 - DNA, 30 bp, Homo sapiens
  chr15:69366538-69366568
  hyper
tctcgctgcccggggcgctctgcgctgcgc

SEQ ID NO: 35790 - DNA, 86 bp, Homo sapiens
  chr15:70877578-70877664
  hyper
aagctctcttatccccgggcccctgcctcccggtaccgccgatgcgcagcgattgccaggcaggtctccgccgggctgggagagcc

SEQ ID NO: 35791 - DNA, 43 bp, Homo sapiens
  chr15:71055227-71055270
  hyper
ctgccctacctggtgcgagccccggccccggggactggggagc

SEQ ID NO: 35792 - DNA, 37 bp, Homo sapiens
  chr15:71055857-71055894
  hyper
cctgcctgccacctgcgggccccgggcagcagacgtc

SEQ ID NO: 35793 - DNA, 79 bp, Homo sapiens
  chr15:71146120-71146199
  hyper
tcaaccccctctgcccgaggagttgtcgcgcgcagtcagcgccccgaactcgcgcgcggcccggcgccccctcggggcc

SEQ ID NO: 35794 - DNA, 131 bp, Homo sapiens
  chr15:71408456-71408587
  hyper
ctcccgcctggggcccgagagccgggcaagtctcggtcagcgctccttgagtcctggcctggggcctcggatctgtgtgtctgtctgtctcagtttagttgctgcaacccagcgagcgcctggagcccgag

SEQ ID NO: 35795 - DNA, 143 bp, Homo sapiens
  chr15:72476743-72476886
  hyper
cacagccagagcttgcgcaggccggggagctgccaggagtgccgcagccgtgcccccacctgctgggctcccgggaaaaggagcgcgcgcccctctgagccccttcctggtgcagtgcgtgtaccaagcgtggtaactggcct

SEQ ID NO: 35796 - DNA, 101 bp, Homo sapiens
  chr15:72490031-72490132
  hyper
cggaacccccgagaccggcccccgggccgcaaccccttacccgccctcctcggtggcctcgctccggcttaaagcggtcatcccggcgcctgcacccagcg

SEQ ID NO: 35797 - DNA, 211 bp, Homo sapiens
  chr15:72564738-72564949
  hyper
ccacccctgcggagacggggcgagccccgcacccttcccgtggcccggccgcaccgccctgtgcccgtggtggcggccacacaggccagcctggcgagtactcacggcgaccccgggccgcgcgcggccgcagccgacgggacgagcggcccgggacgccccgcgggggcggagcggcaggccaaggggcgggggccgggcctggcgggcg

SEQ ID NO: 35798 - DNA, 30 bp, Homo sapiens
  chr15:72565377-72565407
  hyper
caggattctctggttcgacaatggaagtcg

SEQ ID NO: 35799 - DNA, 30 bp, Homo sapiens
  chr15:73611158-73611188
  hyper
cctcagccattcagacgcgggggaggtgat

SEQ ID NO: 35800 - DNA, 727 bp, Homo sapiens; identical to SEQ ID NO: 12210
  chr15:73659600-73660327
  hyper

SEQ ID NO: 35801 - DNA, 278 bp, Homo sapiens
  chr15:73660446-73660724
  hyper
cgagggcagtggccgcagccggatgctcctgcggctggggtcttggcggcccccggccccctcctcctcggcgtcctcttcctcgtccatgatccacgccttggcccccacctgctgcgggaggctgtagagccgcttgcgcatggacggcggcagcttgtccatggcgccaggggccggggtcggaccgggccgggggcaggagcgcggcgccgcggacgggctccaggtccgcccgccggtcagtccgcccgtggggacgcgtcctttgccgccgg

SEQ ID NO: 35802 - DNA, 132 bp, Homo sapiens
  chr15:73660793-73660925
  hyper
cgagtccccgggctcgccgcgctacacctcctcccgggcccggctgggcgcggggaccccgcgctcccttcttgcctccctccctccctctggcgttcaggggcgcggcgcgccgcccggctccaggcgccc

SEQ ID NO: 35803 - DNA, 245 bp, Homo sapiens
  chr15:73661607-73661852
  hyper
cctcagctgggtctccgactttcctcttgggaggcgaccgggttcgtctggatgcagagtcccggccttcccgcaaccctcctggagagggggcttccggaaatgcgccgcgtcggggaggctcccacggttttcctgtgacatgggcagggtgcgaaccccgcgccagtctttcccctgcaaagcctcgcagcagccaggcaaggagggcgtggggaaacagggagacacgcacagggcgcgcg

SEQ ID NO: 35804 - DNA, 164 bp, Homo sapiens
  chr15:74044686-74044850
  hyper
ggggtcgggaatgagcgagggtccggcagatttggggctccgaggccacaggtgaccggggcgcggggaggccgaggagacgccgggcaggtcccagcgcgtgagccaaagtcggagggctgggagggcgccgggatcccctcagcccacgcccggcattcccc

SEQ ID NO: 35805 - DNA, 30 bp, Homo sapiens
  chr15:74045079-74045109
  hyper
ccacggctcagttcacgttccgaaaggtcc

SEQ ID NO: 35806 - DNA, 44 bp, Homo sapiens
  chr15:74045854-74045898
  hyper
ggcgcggagggacagcgttctggggacttcgttcctttcccacc

SEQ ID NO: 35807 - DNA, 164 bp, Homo sapiens
  chr15:74421982-74422146
  hyper
cgctgaaagaaatgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttga

SEQ ID NO: 35808 - DNA, 471 bp, Homo sapiens
  chr15:74422386-74422857
  hyper
gcagtgggcttcaagcgctggtttagccacaaaagaccagaagtaaagagttccggcttaagaggctgggcagggctgcggtgggctggggaggggggtgtcccttcccagcacgccctgcagggctgtgcgttctggtgtcgggttagactagcaggcggggcgggggggttggggcggcggggcgggggagactagggcttatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccc

SEQ ID NO: 35809 - DNA, 30 bp, Homo sapiens; identical to SEQ ID NO: 12214
  chr15:74428205-74428235
  hyper

SEQ ID NO: 35810 - DNA, 322 bp, Homo sapiens
  chr15:74428801-74429123
  hyper
ggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtc

SEQ ID NO: 35811 - DNA, 302 bp, Homo sapiens
  chr15:74658095-74658397
  hyper
ctcgggtgaacgcagcgagcgagggcagaggccagcagaggcgaggagtggatgctgcagggccgcaggccgggcagagaaacgcataccgggtcgctccctgcttcgccgccgcctcctggcagggccagcgaagccagtgctccagcgcccccgtaacacctcaaagcgcacggagtccgtgttggggaacttggcggcagagtgactgggacctaggacctgcggtggggccgccgccgcctccgcggggccgagcgcctggacctcgccctgaggtaaacgcgggtcgacccgggggg

SEQ ID NO: 35812 - DNA, 52 bp, Homo sapiens; identical to SEQ ID NO: 4248
  chr15:74658501-74658553
  hyper

SEQ ID NO: 35813 - DNA, 43 bp, Homo sapiens
  chr15:74658554-74658597
  hyper
ccaaacttgaccacgctgcgaccttttcactctgtgctctgac

SEQ ID NO: 35814 - DNA, 140 bp, Homo sapiens
  chr15:75119374-75119514
  hyper
tgacacccaaaaccccgctccagcatcatgctccggccaagggggagtggggggaggggcgaccggacgagggaccgaccggagcctgggacgaggaagggggtgcacgtgcgtttctgacgaaacgataatcccttaat

SEQ ID NO: 35815 - DNA, 30 bp, Homo sapiens
  chr15:75250808-75250838
  hyper
gggcgggcgggccaccgggaaagtgctggg

SEQ ID NO: 35816 - DNA, 320 bp, Homo sapiens
  chr15:75251094-75251414
  hyper
ggctgaccccctccccgtctcctggtgggatcaggaaccctcggggtatgctccgaaccgggacttcggtctcggtccagtctccatgggccccacacagcggtgggggctggaggcacagcagccttgggaagaaacaaagactgtccgcagcgcgtagcggggcgtggagaaccgagggctgtgtaaggtcaggccctgagaaaaagcccccgaaaggctggaagttacgttggaacgggctggttgtggaaggagcgagctctccgtccccgggagtatgcaagtttgggctgcacgatcacttggaagggattggg

SEQ ID NO: 35817 - DNA, 333 bp, Homo sapiens
  chr15:75251478-75251811
  hyper
cggttctgcgtccggccaggttggccctcgaggacccagccgtccccaacctcctaaactgctgtcggatgtagaagactcgcattcactgctctccacagtcggtgaagggagaacgccgaaaagggccgcattccctcctgccggtcccctccccttcccgcgctccctctgcagcacttaaaatgtaaatgtacatcgtgattagccgcggggtcgctaattacagctgaagccattcattacactgtcagcgcgcgtcgcagcccgccggctgtgcgctccctcctagccgtgaaggggtgtagggggtgggggcgggagatgcgggga

SEQ ID NO: 35818 - DNA, 15 bp, Homo sapiens
  chr15:75470896-75470911
  hyper
ctgtggggggtgggg

SEQ ID NO: 35819 - DNA, 15 bp, Homo sapiens
  chr15:75471217-75471232
  hyper
cggtttccccatctg

SEQ ID NO: 35820 - DNA, 34 bp, Homo sapiens
  chr15:76005149-76005183
  hyper
gggagctgagtggagcgagcgcggctctgctcct

SEQ ID NO: 35821 - DNA, 26 bp, Homo sapiens
  chr15:76627511-76627537
  hyper
taaaggtggaggcggagctcaaaagc

SEQ ID NO: 35822 - DNA, 276 bp, Homo sapiens
  chr15:76627575-76627851
  hyper
cgcggggccggtgaggaacgttcaccgtggaccatggtcgaataatgttagcgtgcactcggggcctcgccctagccttctgcaaagcctcggcctgcgccctcggctgcatccgtttcgacgccaaccaacctcatgctcttagtagaacggcagtagcgaccgcgccctcaggcccacaagcccgaaggtctgggcagggtctggaatggcggtggagacactttatccgcaggcgtttcacctcgcgccccacccaggcgcacaccaagttct

SEQ ID NO: 35823 - DNA, 30 bp, Homo sapiens
  chr15:76628327-76628357
  hyper
gaggggcagcagcagcggcagcagcagcaa

SEQ ID NO: 35824 - DNA, 462 bp, Homo sapiens; identical to SEQ ID NO: 4252
  chr15:76628564-76629026
  hyper

SEQ ID NO: 35825 - DNA, 58 bp, Homo sapiens; identical to SEQ ID NO: 4253
  chr15:76629162-76629220
  hyper

SEQ ID NO: 35826 - DNA, 281 bp, Homo sapiens; identical to SEQ ID NO: 1221
  chr15:76629814-76630095
  hyper

SEQ ID NO: 35827 - DNA, 29 bp, Homo sapiens
  chr15:76630096-76630125
  hyper
gccccgcgcccttccccggcagagaagcc

SEQ ID NO: 35828 - DNA, 490 bp, Homo sapiens
  chr15:76630519-76631009
  hyper
ggagccgtagcagccagggagatgagggcggccgcaggcccagcgctgacaccgccgcaccttgggcccgcaggctgttcggcatcaagtgcgccaagtgccaggtgggcttcagcagcagcgacctggtgatgagggcgcgggacagcgtgtaccacatcgagtgcttccgctgctccgtgtgcagccgccagctgctgcctggggacgagttctcgctgcgggagcacgagctgctctgccgcgccgaccacggcctcctgctcgagcgcgccgcggccggcagcccgcgcagccccggcccgcttcccggcgcccgcggcctgcatctgcccggtaagcgcgccggggcctgtgccggggtgagcggggtgtatgtgcgtgcgtgtgtgtaggggtacgcttgtgtccctaacgagaagttgtcagttgtgtgtggttccgtctgccgggatagtgtttttctgtatcagtgcggaactgtgtgctg

SEQ ID NO: 35829 - DNA, 74 bp, Homo sapiens
  chr15:76632517-76632591
  hyper
cgaaatcgggccccggggggctgggccacccggaggttgggctcggggcgggtgggtggcggcccctcgctaac

SEQ ID NO: 35830 - DNA, 159 bp, Homo sapiens
  chr15:76634951-76635110
  hyper
gggggtggggctgggcgcatgcgcgctgagggccctcccagaagcaggagcgccccattggcgacccctgggcacctggcggcccaggcccgcgggcaggaggcgggacccgtttgggcgggaaacctgcggcacttgtggcggttgagcggcggactc

SEQ ID NO: 35831 - DNA, 180 bp, Homo sapiens
  chr15:76638317-76638497
  hyper
ggtcagctgttagggcgtgggggagggagggggcagggagcagggacgaggaagtggaagaataggggattgtgaggagtgatttctttccagattatcgagactcaagactttccagaacgtggcaaagagccctggaagaaatgtcccaggaacgccgcggtcaggaccgaggctccc

SEQ ID NO: 35832 - DNA, 120 bp, Homo sapiens
  chr15:76638855-76638975
  hyper
gctgcggcccctcagcctctggagagccggggggcggccctcgccccggcagaaagcaacctgtggcggcactgcgtccccgcgagctacaaccagacgcggccgcgctcacctgggcgt

SEQ ID NO: 35833 - DNA, 158 bp, Homo sapiens
  chr15:77924553-77924711
  hyper
gcaaccccaggagggcgcagccagggccgatggcggcccccaggggcactcgccgcggggctgcccgctcggggctcggccgcggccgcctggctcacctgcatctcgggcgcgccttcggtccgctcggctcggtcaccaatcgcatgtctctccag

SEQ ID NO: 35834 - DNA, 159 bp, Homo sapiens
  chr15:77927216-77927375
  hyper
caggcacccggcgggcgcgcagacccgctggggggcgggggcgggggcgagggctattcctggtgcggtgactgacgcaggcaaggcgcggccaccacatctctccgcccccgactcacctgctccctgcctcagtgatctcggcggagaaatggggga

SEQ ID NO: 35835 - DNA, 429 bp, Homo sapiens
  chr15:78111440-78111869
  hyper
cacgccccccacggacgcgcacccagcaccccacccccgccgctgcccccgaggctcccgcccaatcagaggccgcgcgcgccgcgccgccggcgggcagacacaccggctccccggcctgcgcccctgcggccctggccccgctgcagcgtcccggcccggccacactcaccgtcccgggcgcgccgtccgcgcgcggctccgctccgggccggcatcccccggctcggctgcctccggtccccgctccggcctcggttcccgctccgcagggctcggctccgcgatggtggccgcggcggcgagcgcggcagggagggcgtgtgtatgcgcgtgagagcgcgcagcgtgtgcatgtgcgtgtgcgcgggagggtcccggctcccctgcgcgtcccgctcctgcctcctgctcgccacgatgcgatgc

SEQ ID NO: 35836 - DNA, 400 bp, Homo sapiens
  chr15:78111916-78112316
  hyper
cgcacacacgcgcacacccaggcgcgcacacccggctccgcactcccgactcgccctcctggagcgctcacaaagaccccctgccgggacggccggagcctgcggagcgcggccctgggcccctccgggacccgccggccttaggtgccccgctgctccccgtagggaccccgcgggcggcccggctcccgcaccctgcctggccgggccgcggccgcgctcccagcccgaacctgggcccaggtgccgactcgggcttctcgcactcccgcgggaagcgccggccccctccgcggcgccgccgcccttctcccccccttccagtccggcctctccggcgcctccctgccttgtcccacctgcccagcccggtcctcgttctccccgctgctctccgtct

SEQ ID NO: 35837 - DNA, 300 bp, Homo sapiens
  chr15:78236768-78237068
  hyper
gacttttctcacgcccgcacacactgtttgcggagaggccagggcagacaacctccacccgtttccggagccactggcgccccctcattcccgctccagcagcccatgcctcgcttcacccctggtgcctcatcatcgcaccaggaagccagggcccgggaatttctttttccggtccgacagggtcaactgagtcgacgatcacttgacttggactaacggcctctgggagggcggggcctgctcgagtgaggccgggagcggaccgcagcccgctggaggtgccgggggcgaaatgct

SEQ ID NO: 35838 - DNA, 113 bp, Homo sapiens
  chr15:78632556-78632669
  hyper
gggctgggagttgagcgcataccgagtaggggctgcgggggagcgggggcagggccggcggggcggggccagaagcccggcggggttgggggcgctctcctagtgactcaagg

SEQ ID NO: 35839 - DNA, 39 bp, Homo sapiens
  chr15:78632683-78632722
  hyper
cgcaaagcgccagtctccgccttgcgagctcagagtgtg

SEQ ID NO: 35840 - DNA, 74 bp, Homo sapiens
  chr15:78633047-78633121
  hyper
ttgctgaatgtttggcgccctcctcgatggtgcggactttatctcgtgctagatcatagcgaggagagattact

SEQ ID NO: 35841 - DNA, 141 bp, Homo sapiens
  chr15:78912231-78912372
  hyper
tcccaggcaggaggtcggttgagagcgtatggcgttctgagtagtgcaggcctcggcaccgagggcggaaagcgctctgagctcacagccgcacgacagaccgccggcctgggccctccaggaattccctgcagccttgcc

SEQ ID NO: 35842 - DNA, 531 bp, Homo sapiens
  chr15:78912441-78912972
  hyper
cggcttcccccagcaggctcctctggagagcgggaggaagacaggaggcgctctcccggtggagggtccctcagcgacgcagccaggagcgctaggaggctacaaccggaggagaggctggcgctccagctccagccccagtcccgaagcgactcccctcttcccgaggtggccttggccaagtcttcagccatctccgtcaaatgaggaggtgggcgggatgcagacggtggagcgggaggcttgggcgcgccagtttgggagccagtgcgcggggcagggcgacgggcagcgcggggacgcgaatccccaactcctgcgcccaagacgaaggacccggtctcgacctccccatcacccggcgcgtaccagcgcccgctcagtgactcccaggtttggtggtggctaggggtgggaggtgagccgaaagggaaaaagccaccccacccaagtcgccgccgggctggagccagtctgcgcgggttccgagtccccggcgacggcgccagccctctccgctcgcccgcgcgg

SEQ ID NO: 35843 - DNA, 242 bp, Homo sapiens
  chr15:78913228-78913470
  hyper
ccccagacctggagccgtgcgggcggagacgcgcggggctcctctccgcttcgccgccgctgggtttccagcgccctcggacccgcgggaggacaggaaccatccggagtgaagctgcgccaggcgcgggcgggcgggcgggcgtgcgcggggcggggcgtacgtgcggtaggggaaggggctccaggtcccagtccccagcgccgggcgagctccttctccgccgggctgggtgctccggc

SEQ ID NO: 35844 - DNA, 201 bp, Homo sapiens
  chr15:78913480-78913681
  hyper
cgaccagatctgagcaggtgctgtcaccaccaccaggaaggagagggactcagtttctgtcccaggtttccggggcgtgtgcagctcccgcagggggttgggaccaccgggctaggcgggcgccgtaggagagacgctaacacaccctgggaaggacgccttgtgtatctcatgctattaaataattgttaaatattttag

SEQ ID NO: 35845 - DNA, 253 bp, Homo sapiens
  chr15:78933391-78933644
  hyper
ccctccctccttccccgaaaagaactcaccgcgcccgcaaagggcgaccaggaagaaaaggaccagggaaggcgcgcgcctcatggccggcggggccgggtggcagccgccgcgagctccgctgtggggtcacagggcacccgtgagccgcgcggtcgagtgagcgccggtcctggcccccgaggtttgctggcggggcggcgctcactaggaccccgcggagagccccgccgagccccgcccactcagggat

SEQ ID NO: 35846 - DNA, 36 bp, Homo sapiens
  chr15:79103265-79103301
  hyper
ccagaagcgcggcttcgctcccggcccggcccgacc

SEQ ID NO: 35847 - DNA, 900 bp, Homo sapiens; identical to SEQ ID NO: 1224
  chr15:79382098-79382998
  hyper

SEQ ID NO: 35848 - DNA, 269 bp, Homo sapiens
  chr15:79382999-79383268
  hyper
agccgcggcttcttgaatccagatataccattccccgctggaacctcttctccgctccgcagagccccagtacccggaagatgccgcccgaccctcctccggtgccgggcaaactgagggactggcgatctgcgcgctggcgaggggcaggcggagtcatgtgacgccgatccctcgaagagcccgtttcagcagcgcggacagggacacacgcacgcagccccgccgaggcgcagagccgcgcgcaggctgcaacttggtgcctcctc

SEQ ID NO: 35849 - DNA, 56 bp, Homo sapiens
  chr15:79383328-79383384
  hyper
tcccctcatctccccttctctccctcggatgttaaaaagcaaatcagatcaatttt

SEQ ID NO: 35850 - DNA, 708 bp, Homo sapiens
  chr15:79383438-79384146
  hyper
cgccccaccgcggcgcactgtagacctggggttaagtgccagttgtcattttctcctccaaaggctcgccccccccccccactttatttctaatacgaggtggaaggaggaaggtgggtggcgaaatagagctgcaaaagcgtccagtcctagtctttgcatagtcagccgggtcacattgaattccagcatccggctgcactcccggcggcttccccagctacctgaggacagtacagggggtgagatggggtggtggttggtgaacgttggttactttattttatattattttattttgagagttgccataattaccggcgccaccccccgtgcaccctgaggtctggttggcgagccgctgctgggagttttctgcaaataccccccaaagcctgaaggcgggcttcaaacgcaggcgccggggaccatgggagccttcaaatagctgcgctggcgcaatgataccttaatgatagattttccgttcttatttttagctctcattcgcctacacagttacacggcatttatccgagaacgtcacagcgcccgcatgctgcaccgggagggcgcgcgggccgccgggcgagccgggagctggggcggggagcgcgcatcgctgtctgccgcagagggcagcgagctcgccccgacccggagcaagccgcgcctggcccgggcgctttgcagcggggatgggtgccc

SEQ ID NO: 35851 - DNA, 222 bp, Homo sapiens
  chr15:79502064-79502286
  hyper
cgccgggaaatcaaacgtccatttacatcttgtcctgcaaagcttcatcaaaacttctttgccggccagtcacgtccccttatcacttttccagcccagctttgtgactgtaagtgttggacggagaactgataagggtaggtgattgacactcacagcctccggaacccccgcgccgcctgcacttgcgtgatggggaaaacctggcgttcccgctctggg

SEQ ID NO: 35852 - DNA, 720 bp, Homo sapiens
  chr15:79574779-79575499
  hyper
agaacaaaggggacacgagttcaaattcctgccagggtctgagacctgcaacgtcagactttgggagcgtcccctcacttctccggaccccaggagtggccgcgcctgctccgcgctcaccctcggggagtctaggagccccctgctaagttgctgagcgagtcggagccccaagagctagggtcgagggggtggggcagcaggcgcctctgccgaggctgcaggtaggcacttccccacccccgcggccccctccttcctccttcctcgcagctcgcacacccacacaaccctcgcccgtcgcggctggagagctgctctcggcgccagcgggcagcagcgcgtcgtcagccagcacagccggccgaagaccaagccggaggtctggggctgcgcagagacctgcacacccgcagcgcggaaccgggggcgattcctatctttctttcatgcttctttctttttcttaaaaccaaaccaaaccaaaccaaacccaaaactcccctgctcccaccgcaacttggaggagcggtggaccgatttgaaggaactgacgcagaggttttattcacgaaccttgaagaagttctgggcaagtgactcaacaggacccgcggggcccggggtagccccagctcccggcgctggttcagtctggcagtgccctctggcagccaacccgcagctgcaggtaggggtgctggacgccccctgattttg

SEQ ID NO: 35853 - DNA, 252 bp, Homo sapiens
  chr15:79576060-79576312
  hyper
gctggcacactctgccggcgcggccggagccccggagttcagcacctcggacagagcccgagccccgccgcccgaggcgcacagtgagcgtggaacagcccggctccctagcccccggccaacgctgctctcagttcagggcagctacgtaacaccgcccctagctccgcgccagaaagggctctcgaatcgcaaaagcaaacgtgttcgatttctgatctgcttctaactgcttcccgtgactgcagaagg

SEQ ID NO: 35854 - DNA, 15 bp, Homo sapiens
  chr15:79724105-79724120
  hyper
ccccgcgggtggctc

SEQ ID NO: 35855 - DNA, 210 bp, Homo sapiens; identical to SEQ ID NO: 4263
  chr15:79724351-79724561
  hyper

SEQ ID NO: 35856 - DNA, 187 bp, Homo sapiens; identical to SEQ ID NO: 4264
  chr15:79724606-79724793
  hyper

SEQ ID NO: 35857 - DNA, 634 bp, Homo sapiens
  chr15:79724863-79725497
  hyper
cgcccggggcgcctcggaggtaagttcggagagcccgggccgggcggagggcgggagcgcacgagtgtgtgtgtgtgtgtgtgtgttcgcggtgtgcccgcggctcggtgcacacgcgcgcgggttgtaaagtcaggagctgcgggagcgcctccctgcctcggcttggccccggagcattgcgggccgcggaggtgtgggggcccttgtcgctgcgctcagggcagcggcggaaaaggtgtgtgcggatgcggggcggggccgcacctggtggacagagcagggattcgggaagagaagccacggaagatgatcatgcagtttggggcaagttttcctggttgagcatcgcttcaggaaacggtgttttgagggttaaatatgtgagctatctgtgcaaaaagcctgacacatcagaggcgcgaagtaagatggaaagctggacaagccccaggtggaccgaccggtgcatccaattcttaaattgagatttccagtcacgttgatgtggaatgggatcgttgttcttcccgagggtttgataaggatgctcaacttcacctgtcagaaagcacgggagctgggcctggcccgcggggagcgtaagctcgctcacacgcggtccaactcaggc

SEQ ID NO: 35858 - DNA, 30 bp, Homo sapiens
  chr15:80543967-80543997
  hyper
tgaggctcagaacagcgagggtgcctgagc

SEQ ID NO: 35859 - DNA, 133 bp, Homo sapiens
  chr15:80544203-80544336
  hyper
cggcagggctcggcccgacttcagcgagcagatcctccgcctgcggccggtgacccgcgcgacgccccggcggcaccgacaatgctgtgctccagccccgcaggcgccgcggcagcgggtcccgggatgctcc

SEQ ID NO: 35860 - DNA, 302 bp, Homo sapiens
  chr15:80544364-80544666
  hyper
cgtgcgctcccggggtcctggctgggccggcgccgagcccagggcgaccgcggatcgccggctacggcgtttcccggtgacgggggcgcgggctcgcggggcgcggggggcgctgcccaggcccggctcggcaggagtcagagcccccagcggcgcgggcgagcccgggccagcagccgagagggggctctgagcggagccgcggccgtcctggcattttaaaggcgaggcagctggacgctgttcaagcggaaacgcagagagaaacttcagcccccggggcagagcgttggcagcgaggg

SEQ ID NO: 35861 - DNA, 38 bp, Homo sapiens
  chr15:81073195-81073233
  hyper
ttcccagacccaaggcgttggggcgctgggaaagagga

SEQ ID NO: 35862 - DNA, 456 bp, Homo sapiens
  chr15:82336760-82337216
  hyper
cgcgccgttgagtgccgtgttcttattccgggaggcgcggatcatggagaagtgctcggcagcagagatgatctccctccgagccatggccacatcctccttcctgcccgtcacaacaaagacaggctcctccccgcgaactggggtcttgatgtaagtattggtcttcgcccgcagcgctttgattttacaacctacgaaccagggtgcggaggagggagtgggagagagagacagacacgcccattatcctggggtaaccgcggggaccggggacagcccgcgtccaggacagcgagacggcaggacaagagatgggcggaaagggggcgtctccctcactgacctcgggccgcgccacgggctgggcagcggatcccacccgcgaggcgctcgaggaacagcccattggctgcctggccctcccccagtgactgcagtcgtcccgaaccaaac

SEQ ID NO: 35863 - DNA, 283 bp, Homo sapiens
  chr15:82339904-82340187
  hyper
aacaatgaggccatgcggccgcagccgcacacgggctgactggggagatctcgtggtgccgcggggcggtcccggggctcgaaggcagaggctcccctaggtgtgccctgcctgaccccggctacaggaacgagcgctgtgggcctcggtttctcacccgtaaaatgaagaaaataatccccgcctttaccacctcgtgggtcgttcggaagattaaatgcgacagtggatgggcgcgcgcttacaaatcagtagacagttccgcaagcgcctttacttttga

SEQ ID NO: 35864 - DNA, 438 bp, Homo sapiens
  chr15:83314955-83315393
  hyper
agcagacactcttcccgctagcaagggaccgcaccgtcacctgaggggcagccaagaggcgggcggtgcacctgtgccttccagaataggaaccccacccacttgcccctcttccccaccaacgacacagcccagtagttgactcaggtgccaggagagagcgcggggaggctgggcggtagccagggagaccaagggaagcggttgccagagaaatgcggcgtcagtcagggccggggctgcaggcgcggggcgggggaggagagacgcggcctcctcccaggcgggcctggcgggaggcaccccggcttctaagagcgaattcggctcccgactctcttcccccagctgagagcacggtgcaaggggccagggctgcagggagcaaagtgcccccgaaaaataagcgcgcgcccacgaaagcgcccaagagcccag

SEQ ID NO: 35865 - DNA, 409 bp, Homo sapiens; identical to SEQ ID NO: 4268
  chr15:83316231-83316640
  hyper

SEQ ID NO: 35866 - DNA, 410 bp, Homo sapiens
  chr15:83316641-83317051
  hyper
gggctgacgggctgaccggccagccggcgggcgagagacgcgcacgcacgtgggcactatttttgcagcgggccgcgcgcagccccgcaccccggcagcttatgaagctcctacgagccgctcctcggagccgccccccggccggatgcggagcacctgtgtcggccccgcccgggccctcgcctccgccccctcgcgccccgcccctcctagcaggccgagccgaggagggctccgccgcccacccggaacccggcggggactgccgccgctgctagccacagctgccccctggggggccagagacctaagcctgagcgcgccatcacctaagtgacccttgccgagtcactgtctgccctgggcctcagtttccctcttaacgaaagagggcacgatttacaagcccc

SEQ ID NO: 35867 - DNA, 700 bp, Homo sapiens
  chr15:83348912-83349612
  hyper
cgtcgcaggctcacccggcgcttgatggacatggtggccacgttctggagcacaacgtactgcacctcactgcggagaggacgggtcagagcaccccgggcccctcggttggggcaagggtcagcggatgaggggaaaaggtggggcaagtcgttgcggggagaggaccagtgcggagggcaggactacggtcagtgtggagcgggtgggcagaggtggaagcggctggtgggcgtgagggggcggagccgggcagcccgtggggcggggcaggaggcgagggagggggcggggctgggggcggagcgcacctgtggctgcgcagcaggcgcaccagcgccttggcgatgacgcccacttccgccttgggcgccaggtggaagtagagctgcgccaccgccatcaccaccgcggcgctgcggctctgcagcaggggtttggtgttgcgcagcagcagccggtggtcggggtccatgacatagggctttcgggagggggcggccgcggcggccgtctcctcagaccccgcgcccttggcctcgtcctcctctgagccgtagaaggctttttccgcgttctcctctagtagggattcctggacggggagaccgacgggtctgtgggcgcctccccgggacacacttcggcccgctctgcctgggctgggcccacttacgttctgggtggggctcaggaactg

SEQ ID NO: 35868 - DNA, 65 bp, Homo sapiens
  chr15:83349671-83349736
  hyper
cgatcagcaggttacagagtttccggtagtttttgtgaatcaggtcgatgcgctccgggcagacc

SEQ ID NO: 35869 - DNA, 30 bp, Homo sapiens
  chr15:83378057-83378087
  hyper
agaaacacctggaaccggagggtttctcct

SEQ ID NO: 35870 - DNA, 30 bp, Homo sapiens
  chr15:83378625-83378655
  hyper
tcaatcagggccgcgcgctgaggtcttaaa

SEQ ID NO: 35871 - DNA, 165 bp, Homo sapiens; identical to SEQ ID NO: 12261
  chr15:83378857-83379022
  hyper

SEQ ID NO: 35872 - DNA, 127 bp, Homo sapiens
  chr15:83620954-83621081
  hyper
caggggcgaagagaccgcggaatggccgaggcaggaggccggccagggcaccggtccccgtcaggtgcccccgtgcccgggctgtatgggaggggaagggccacgggctccgcgcccaggccagggt

SEQ ID NO: 35873 - DNA, 28 bp, Homo sapiens
  chr15:83775821-83775849
  hyper
gccaggtttaaaaaccggatgccggctc

SEQ ID NO: 35874 - DNA, 112 bp, Homo sapiens
  chr15:83775890-83776002
  hyper
cgaggtttcaggggcattttgtcctttcccacttctgggccgtgggctcccccatagacgatcccgcgggcccttcctcctctgacaccctcggatctggttccacctttcc

SEQ ID NO: 35875 - DNA, 116 bp, Homo sapiens; identical to SEQ ID NO: 4273
  chr15:83776022-83776138
  hyper

SEQ ID NO: 35876 - DNA, 112 bp, Homo sapiens; identical to SEQ ID NO: 4274
  chr15:83776157-83776269
  hyper

SEQ ID NO: 35877 - DNA, 37 bp, Homo sapiens; identical to SEQ ID NO: 4275
  chr15:83776270-83776307
  hyper

SEQ ID NO: 35878 - DNA, 385 bp, Homo sapiens; identical to SEQ ID NO: 4276
  chr15:83776332-83776717
  hyper

SEQ ID NO: 35879 - DNA, 112 bp, Homo sapiens
  chr15:83776768-83776880
  hyper
cgcgccaggtgcccggggtcacaggcgtcaatacggccatgcccctgccctggaggggcccaggggccggtggggagcggaacaaacacggacactacgaacctggccgtgt

SEQ ID NO: 35880 - DNA, 378 bp, Homo sapiens
  chr15:83875705-83876083
  hyper
cgttcgcccgggacccagggtatccaccaatgaccctgcccggagccgaagcctccgtcgcaggcccgctgcccggcggcgtggcttcccggtcggcaccggctttccaggaggaaggcagcgtcgggcctgcgggggccggacccgccttcgaaagtgggcggaaggatggccgccctggcggagtgcgggcgaggccgggagcccttgcctcagccccggcccggtcttcttcgtgccgcgccgccctcagccctcaccacagccggccgcgagctgcgggctcggggctgaggcgatggggaaagggggcgggcgcgccatcatgaaggggaaaatggtgggcgggcgggcccgcgcgcggccgcggtactcacc

SEQ ID NO: 35881 - DNA, 282 bp, Homo sapiens
  chr15:83876201-83876483
  hyper
cgcgaagatgccgggaggccgcccccccgcgggccgacgaattgcgccgcgctccccgcgggcctcaagccgggcggacgagcggccgctccgacgaggggaagcggcgaggcggcggctgaggcaaggggtgggcggggggcgcagcaggcccggcaaatcacggcccggcagcgggggaggggagcccccggccgttcggcgctcgcccgcgtccggccgcgccaaggtccccgccgccgccgccgccgccgccgcgcgcgctgctcaccagcgccgcgt

SEQ ID NO: 35882 - DNA, 495 bp, Homo sapiens
  chr15:83876654-83877149
  hyper
cgctcccctccccttccctcccgcgcgggccggttaattcctaggtacacggccggctttcgcggagaaaccgagcgcgccagcccggcttctcggctggcgggcgggcggtgggcgcgtcctcccccagcaccgaagcccgcgccgggcgggcgggagtgcctactccggaggacgcccgccgcctgctctcttttgttcttggcccggagctgcctgccgcagcccagccaatcaccacccggccgcccccttcccctcccgtccgtgccactctgggggttctccccactcgcgccccccgctcccacgcccacctcccgctgactcgaccctctcctggctacccccagccagccacttccgcggctgctctctggtgagtgggggacaaaggcgctccaggcctgggggacggcggcgcgaggggaccctctgctgggcaccaagctgccggaaagagcaccgctccggagtcagcgaccttattggatt

SEQ ID NO: 35883 - DNA, 216 bp, Homo sapiens
  chr15:83951897-83952113
  hyper
gagcggtggcagccccgcagccacaaagagatgccttaaatgagaagaacatgtttctacaccgcatttgtgaaagtttggctcggagctacgcgctgattaatatcagatctccttcactcgcctcgccacaatcttgtcacatctggctgacaaatcccgaggaactccggcaaagccaggcggcggcggggctccgggtctgggcggcggctc

SEQ ID NO: 35884 - DNA, 54 bp, Homo sapiens
  chr15:83952768-83952822
  hyper
cgccccgttctccagagaaacaatccccggagagaaagacggccagtgtgaaat

SEQ ID NO: 35885 - DNA, 34 bp, Homo sapiens
  chr15:84034378-84034412
  hyper
ctgtacagactggtacgggcggaccgggctctgc

SEQ ID NO: 35886 - DNA, 98 bp, Homo sapiens
  chr15:84115713-84115811
  hyper
ttgtccctccctaggcgcatttctgagccttcctttcttaaacatacaccgagcgaaaatgcgccggagggaggcgatgttgcctgtgagccaaagcc

SEQ ID NO: 35887 - DNA, 42 bp, Homo sapiens; identical to SEQ ID NO: 1229
  chr15:84115812-84115854
  hyper

SEQ ID NO: 35888 - DNA, 206 bp, Homo sapiens
  chr15:84115931-84116137
  hyper
cgacccccaggacatccccacgcccagcttcccaggccggtcttctgcgcggctcaagtagcccaggtctccacgcaacaatgaagcgtgggcggccccagcagcttcatttgcatatcgccgcggcttggccaatgggctgcgcaggggctttggaacgcagtgttgccatcggcgtgcgcgcgtgtgtgcgagtgtgacagcgg

SEQ ID NO: 35889 - DNA, 176 bp, Homo sapiens
  chr15:84116377-84116553
  hyper
cggccccccgaggctcccgggcctttgggactcctgttccctgaagggcctctctcggggctcaatttcttcccgcctaggagggcgcgagggtggggtgaggggccgcctgctctctcctcggcgtcttggcgccttctccttcccattccctggcccccggctctgccctgggc

SEQ ID NO: 35890 - DNA, 113 bp, Homo sapiens
  chr15:84116651-84116764
  hyper
cgcgcgaggggaggacgaccacagggagtacgatgccggcagggcctcccccgagtctccagccgtttggttgggagagcctcgtggggggcccatcctccaccggccaccgg

SEQ ID NO: 35891 - DNA, 49 bp, Homo sapiens
  chr15:84116828-84116877
  hyper
cgaaatggccccgtctggactgtgcccggctccccggctggggctctct

SEQ ID NO: 35892 - DNA, 121 bp, Homo sapiens
  chr15:84322476-84322597
  hyper
ggcggcggcggtggcggcgtcggcaatcccggctcttggcacaacgcctggcggccggcccagggcgaggagtggcttccaggaagcgggcggaggagcgttccagccgagtcccgccgtc

SEQ ID NO: 35893 - DNA, 44 bp, Homo sapiens; identical to SEQ ID NO: 12276
  chr15:84322993-84323037
  hyper

SEQ ID NO: 35894 - DNA, 89 bp, Homo sapiens
  chr15:84748531-84748620
  hyper
attatttacctggcccgggtggcattttactttgcatccttgattgggagtctcaggggctacgaacaaacgttttatccccgggtagc

SEQ ID NO: 35895 - DNA, 720 bp, Homo sapiens
  chr15:84748678-84749398
  hyper
cgtcccttcatctccgggggacggccactctcagggttcccgaggagcccgctccgtgcacctaggccctaggtcggctcccaagccctggcccgccgctacaccagcggtttcttacccgcaagtacaaatgtgacacagacaccagctcctcgtgctcttggctcccagggtttctttcaccgcgcctcagcacctgcagcttctccactcttacagcgcccgccgtcgtcaaggcaacagagggatgcccggtgacagactcggcgccggcttccggcgccgtaagagaagcgtccgcgcgggcgttctggacccgcagagttctcggcgtttccgaagctcttggtgtggccgggacccgggagaaggagcagggctggtggggctgctgcagccggtgagtgtgtgctggcgctgggggctggaacctcctaggccagtctctgggcggtgccgcaggaccctgctcgctgcggctctgaggcggaaacaggggctggggccgagcgcgggctggaagctttggtccctggagtgtcgcttccagtctggggccgaggcggtcgcctgtgtagacccgggatcctcaaatagaacgaatccgggaccctgcagaaatgaagggcatgtagtgtagaggtttttcctttttatttagaaaggaatgaaagaccgacagtgcacctgcttggatagtaagcacgtgacccaaaactt

SEQ ID NO: 35896 - DNA, 778 bp, Homo sapiens
  chr15:88799221-88799999
  hyper
ggaagaggttcccatcgtccggccgccggcaattgatctcagtcttgctgcagacacaatttgcagggcaagccagcacggagcccacatagtccagccagacgcttcccagcaagaaaatccgccagaaactacacttggctgggcaaagagagacatccatctccgatcgctgcttctaaaaaagaggaggaggagaggagaggggggtggggtggggggagtggggagagcagggggggaaggaaacaaagacggcgagggaggggggaagggggagggggggcctctgcctttgaaacgccgagcgatcagatgcaaaatccttcagcgtctgaaaccatcgcggacgccgccgccgccgccgccgccgccgggtgggagccgcgaggagcgcctagtggcgcggtctgccgggcatggtggccggctcggcgatcgctgactcgccgggtccgggggctctggaagcgaggcgcgctctccgactccgagactttgcagggttgcaacagacggtggggaggcaaaaaaaaaaaaggaaaaggaaaaaatggtgctaaagtcaccaagtcccacctactgggcagaattaaaacggacacaccacgcacctgcaaaacacacacactcactctcacacatacacacacccggagcccgaggaaaggaagagaaggaagatgcagtaggagctgcagcagccgccgcgaatggctcgccgcgcggctgcagaaatgtacaagtgctccgagccttacgaaacgcacgggttatc

SEQ ID NO: 35897 - DNA, 302 bp, Homo sapiens; identical to SEQ ID NO: 1234
  chr15:88800000-88800302
  hyper

SEQ ID NO: 35898 - DNA, 592 bp, Homo sapiens
  chr15:88800412-88801004
  hyper
cgcgctacccggttttgctgcaatccggaccgcggtaggaagtgaaatgaacgtggcggaggtgattggggagtgctcccaagccttgggtggggggcgctcccaagcctgggtgggtggggggcgcaggctcacggacggcgacggggggtgccggagcgcacagacaccccagagaagcacccagagccggggaccgggaccgcagacgcgcagtccttggtctgaatgacactcatttccgtaatctagagtctggggctctggtcttggctgggaggggactgcgggacatggcacgctaggtgccccccgtgcccgctgcgctttcttggaggtgggttttgcattcggccttgagcaggcatggatcggggaaggaagaaacaggggtcgaaagggctgcgctggagagccgaggtggccccgggcgagctgtgcgtgcaagagaaatggccgggggaaattgagatgcaaggggcatattttggcaagcgccacgccagcaccgtcagaggccggcttctcgggctcagctctcgggtgagctgagctggctgccgggtgagggggcgggcgggctgctttctcc

SEQ ID NO: 35899 - DNA, 4 bp, Homo sapiens
  chr15:88801005-88801009
  hyper
gatt

SEQ ID NO: 35900 - DNA, 152 bp, Homo sapiens
  chr15:88801088-88801240
  hyper
cgagagctcagatctcatccgggaaagaagtgtgtgtggggggggccccgcttttgcgctggtagggatttttttcttaataaaacataaagatgccaagtgtgagctgtttgctgaaaaaaaaaaaaacgagcattcgctgtgggaaagga

SEQ ID NO: 35901 - DNA, 30 bp, Homo sapiens
  chr15:88801449-88801479
  hyper
ggggaaggggtatgccggtgtcaccgcctg

SEQ ID NO: 35902 - DNA, 63 bp, Homo sapiens
  chr15:89147617-89147680
  hyper
gtgtctcttctggtccgggcacaactggattcagcactaatgacggactctaccccagcggag

SEQ ID NO: 35903 - DNA, 1700 bp, Homo sapiens
  chr15:89147722-89149422
  hyper
cgcggaccggcaccccctcccccaaagctgttgccatggccacaggggacatttgatgtgaagcgcggctcccccctctccactcgctttctccgctcgccttcaggatgacgtcatgaacatccgtggccctgacaggccacccgtgggttggtctcagctttaaagcagctgttctcctctggcccggcagccgcggcgactgtgtttgcacccggcggaccatgccaggactacggacccggacaggactgatggcctcagagaggcaagtattcaaggggcacttcacaaacagcttcctcaaaccccaccccctcccccgcactgcgctgctacttgcactgcggctcctggggggaagcaaagtaccggcagctgggtggtgaggggctttcttccagaaagaaacggagagcaagtggtcttcctccctagccgcggcgacccatgccaggtaaaaatcccagccgaggtccccggtcccgtcccctcctccaggtcaagggctcgggactggagaagcagccaactggagctgatattcgggaagctaagcctgaggctgctctggagggccggagaagcgagcggccaggcttggcacccgccaaatgtgccttgccaaaatgaagaggaaggaaggcgactccggagcccagcaggtgagcgctcctacgggatgctgggcaggctagaggtgtgggggcgtctggttccagtacctgcccggggcgacgcggaaacccagcttgcagtttgtttcgctcggtcccgcgcccagtaggagaaagacggccccacagcctcgcgggagccggctctcgcaacccagccgccccaagcccgccgtcgcccctcctcccgcgcttctcgcccctgattctagatgcagctgacttgttgcatgcagaagagcagctgggttcggcgttccaagcctctcctctttgctttgcctgccaccagatctgagcgccaggctggccagcacccagagagcccagagccgcaggaaaaaatgtgaaaagtaccaggagaccactgggtaatcgccccagtgcaaagggcctttcttcctacccaccgcaattgcagcaaataactccagggaggggaatcagaggcgccggggattgcgccctgggagagccctatctgctgaaagagagcgcctaatgccgttacttcccagtgtagcctttccactcggcagaccaagcgcctctccttcgagtcgctacccgcttggagtcggctcagaatcaggctgctaaaggtccctggagcccctcccccagcgaatccgagcctgcagcttcagcaccagaggctggacagcgccccggccctagggtgcccatggtcggtgcctgcgcacggctcggcctcccagcccacgccacttgcgctcgcggcccctcagaccccacgcggaggaggtcaggaggtgacacaggttcgcggaagaaagcgggactcatcttcctcatttctccagggatttaggtgtgggattctaggagagcattctctctcgctctggccacgaccagtggaaaaacttggcgccaaatttaggcagtggtgcggggagcagaggcacgattgcaggcggtgagcaaaggggcaagcgggacagaggatctactgtgagccccaggctctggtgttccgtgaaaaatcgccacatttaaatc

SEQ ID NO: 35904 - DNA, 397 bp, Homo sapiens
  chr15:89248428-89248825
  hyper
ggaggctgacgggggcgcagcttttcctcctgagtgttcgctgcccgggctggcggcgcggagccggcccgccgccgtctgcccctctgcccggcccttttttccagcagttctgccaagaggagcggggtgcggggcaggagatgaggaaggaggaggagaagaaaagggagaggagaggaggagacgcaaagggaagggaggggtgggaagggaagaggaggcaaagggtggggagaggaggggaggggaggagaggagaggggaggggagggactggatcgggcgccaatcccgcccgccgcgcgccgcccgggctccctcgggctctcatttaccccggccgctggcagcgggacccaggcgccttgccgcctcgctgcggccgcttggtccc

SEQ ID NO: 35905 - DNA, 324 bp, Homo sapiens
  chr15:89346003-89346327
  hyper
gtccttggtctctcccggggaatttgaagacccagagactcgcagctccccgtgagcctccccgctgacgccttacctccccctctccaccatcccctgccatcccggtgtacgccacccccaaaaaaactttcagccagctcctcggtgagggtcgttccaaatcgtggccgacagtagcgggctgcaccctccttagatcgcgtcgtggccagcctcagctgcagaaccccgccgggcgcccgggagccctgtcccgccgcggcggcctcagagtccgggcacttggggattctctgagggtgcagccctcctgggcccctc

SEQ ID NO: 35906 - DNA, 448 bp, Homo sapiens
  chr15:89346346-89346794
  hyper
cgcaatgcagatgcgggccctccagcccttctcgcgccgccttcctcccgccagccccggagctgccgggtccgcgccgccccggggagcgctcctctcccgccctgagcgcaggccggcttccccatcggcgcgccggtccggagccagggtccagcgcgctccagacgcctctgccttcccctccccctgtcggccgcccctcggtccctgggggtggggtttccctttgcgctcgccccctcccgcccccacccctcacgggccctcccctcccccgcccgtccctatgtatgtgtcacagcgcgccatgcccgcccgcccgcccacctacctccccgccgctccagagggggctcgcagagctgaggacgcgcgcagcgctgctcaaggtctctctctctcagcaccctcgccggccggcgtctgacgcgggtgccagggtctc

SEQ ID NO: 35907 - DNA, 422 bp, Homo sapiens
  chr15:89346881-89347303
  hyper
cggacaggacgccggcaggaggaggggtgcgcagcgcccgcgcagagcgtctccctcgctacgcagcgagacccgggcctcccggccccaggagcccccagctgcctcgccaggtgtgtgggactgaagttcttggagaagggagtccaactcttcaaggtaactgtctccttccctccagagcgaggctctcccagggcgcccggcgagccaggaacgggactgagactgcacgccccggggctgggggctgcactgccttggtctccgccctagagctatgtgtgccgggggcgcagcacatccaccggctgcgtccgcggtggagttgagcaaactttttggctgttgcagactcagtgaatggggcaaaggaacacgtgaggaggggcacttgtctcctagtccgccaggatgaagga

SEQ ID NO: 35908 - DNA, 58 bp, Homo sapiens
  chr15:89438805-89438863
  hyper
aaacccccgcgctcccgccagaccagccccttaaaggaacacgcgcacctttccctcc

SEQ ID NO: 35909 - DNA, 455 bp, Homo sapiens
  chr15:89903431-89903886
  hyper
cccacaagaatcatccgaggctgcaccgtgaccagcccctcaagacagagcgagacccaaataacccccgcgggcggacccgcagcgttctgtgactccaccgcggagtccaaaaggcagctgagggtgggagcggaggggaagggaggggggccacaggcgctcgggcgagggaggcgcgtcaatgggccgcaggggccggatcggtggcctaatggattcaggcctgcacggcagaggcgcacccggcggcctgcccgcgctctcaatagcggacaatggagtcccggggtgacctgaacaaagaatttggaagtagttaaactgcagaacacgttctcggcctgggtgcctcctttcaaaaggagcgctgggagaagaaaagaaagcactggggggtgaagggagtgagaaaatgcccaggggaaaagttggtaggtcgccctagttgccgc

SEQ ID NO: 35910 - DNA, 131 bp, Homo sapiens
  chr15:89905759-89905890
  hyper
gcggccaggagcccccgctccgccactgccgtgcctgcctcccgcagctgtctgccatgcgctcgccggggcaggggcgcccggagggcggctagagctgggcctgagcccgggaacgcgcctgatcaggg

SEQ ID NO: 35911 - DNA, 145 bp, Homo sapiens
  chr15:89906124-89906269
  hyper
ggggcttccctttgccgctgggcgggatgagaggtgcgctcccactgcgggtgggaggcaggactcagtcatcccgggcaaagggttgtggggcagtgggaagcgcccagaggtgaggactttgggtgagcggaaaggggaaggg

SEQ ID NO: 35912 - DNA, 137 bp, Homo sapiens
  chr15:89908862-89908999
  hyper
cccaaagccccaacccgccctaggcttgcaggccggcctccgcgcgcggttaccgcgagtctcgctgaggagccattttgtgcagcatcctgcttaaatcacactccgaggggctcgttcctcgctccctcttcccc

SEQ ID NO: 35913 - DNA, 30 bp, Homo sapiens; identical to SEQ ID NO: 12296
  chr15:89909322-89909352
  hyper

SEQ ID NO: 35914 - DNA, 1575 bp, Homo sapiens
  chr15:89910521-89912096
  hyper
cggcctctccgtgagcgctctcggccctcctgtggagatcgccacgtcctatcacacgcgtccctaaaccttgtcactcgagcattcttgtctcccaaactctgatggtccgcagtgggtactgggctccctgggccctgggaggaagacggaggagtttgggtgaaagatcagacggtgcgcagccctgaggcttctgagggcagagggtgcgcttccttgccctcggggcggggaagccgtgaacgccgaggccattgtaaggctgggtggtgcggagcgcgggaagggggctgggatttgaatgggagcctgtgattggccgatccctggactgacgtcacttccccgcggggcgattagcctgcgagaggagggccggcggtccagtgcgctgggggcggccggggcgctcgaggctctctaagcgctccgcgcgggtgccctacgtgagccccgggacgccgtcgaggcaggccggcagcgccggtgccaggacgcacggaacggggagcaggggagaaatgcgccgggagggcgagggaggaagggaactgggcgggggctgcgggcctaggtggcgggagtcagcgtgtgcgtgtgtctgtccatcccctctggctctccgcgtgcgccccaggatccgggcacggcgtccgctcaggctcccgcgctcggcaggcagcagcacgtggagcccacggcgcggcagcggcactggctaagggaggcccgtttctctctttggttatctagctgtatgagtgccacagagccgtcataaagctagataaccgaaagtagaaatgattctcacaacttctgcgtgcgagcgcccgccccaccgaccgccccggcccggcccgcaagagccagaggagccgagaggagcccagcgccggcccagcggactccagctcgacggagcggccgcgccccgaccaggtacctgacctcggctctctctctggggacacttgcagtgccagctttcccccagtcctcctctttcctggtcccccacccctatcccccagcgccggagcaggaaccccaaagtggagcgggccggggagagggagggggttggggttgcagaggggtcgctggaaggggaaggcgccagccttcgccttcaccccataaatcaggctggaacaatccgctcccggagccgtggacggggattttgggatgcaaatgcgatgggagagagacagcggtcggtagggggtgggtggagggagtgaatggggtgggctgggggctgccctgccgctaacaatgcggcctttatcgaattattcgacgagtcagcccctgagcgccattagcatacggctggggggttgccggagcttcgcccctcggtgaggtcaagttcttgataatttgatcacttttcacgggctctggcagctgcctttgtgtgcagttggggggtctgtgtgcagcgtgaagcggagcagaactggcggggagtgcgctcaatggcaaggggccagggcaggggcctccctccccgacgggtcggccctgccctgcatacaaaccaagagccggcgggtgggcggg

SEQ ID NO: 35915 - DNA, 375 bp, Homo sapiens
  chr15:89913180-89913555
  hyper
tcctactttggtccccggttctcctcagagataatcatgggcagaaggttttctgaatccctttgtaccccacctccattttgaaaggccagtttccctttttttctgacaggaggctggtgaagggtgactagagtgtttcgggattcacgaggctatgggctgcatcccttgggccgtccctcccttcccaatgcacctgggagcctgtgtgctgatggtgacctcatttcggaggaaaccggagcagcacttcctgcccccttgccctgcactccctgccttcctccctcaccggccaacgggtgtgggcaaaccctgggccccgggcttcgatcttcccctcccaccacccctacccgtttgctgtgttgc

SEQ ID NO: 35916 - DNA, 315 bp, Homo sapiens
  chr15:89914135-89914450
  hyper
cgtttgggcttcatttttgtctccggtttgtgctactctttcttcatccaaaaaggcgttggagatcccgagaatctgctgcagcttggaagccagaatcttagagaatctcggatacttctcaccccattcctttcattttacacctagaaatggtgtaaaaaggcccagtggctcacggaaggtcgcacagaaggccactgacagggcagcgatcagtacagccaccgtggtgggcgaggcatccggggcttccttttctctggtccacgaactcccaactccgaacgctgtgggactgcatgggcctctgcc

SEQ ID NO: 35917 - DNA, 608 bp, Homo sapiens
  chr15:89914866-89915474
  hyper
cgagccggcctgttcgctggctcgggcgcccggttccgggctgggcaaggagcgcttggccatgagccgcgggacagcccaggcgggacggatgcgccctccagggcccaggcgaggccgcgcggtgcagaaccgccgggatttctccaacccgggtatgcgcacccacagcagcggcctttggaggccgcggcgccattttagtggccttccttcccccttggcatctgtcgtgtatggtgtggctgggtgtccccagctccccccatcccgctctgactttggctgccccctccgccagcctggatagagtgaccaatcagctctgacctagggtgggatgcgcgtcaccatggcgacggctagggcgccctggcagtgctgcccatcgcagagggcaagtcttcactccgcctagatgggtgtgaagggaaggtggggacaggtgggggggaggggcggatggagggaggccgtgatgcctcgtccgcattcccaccccattttgcctagggtcagttcagctgggtcaggcaggggacaaatggatggtgtggaaggggcctgggtaggggcctgggtttgtcctggggcggctcttccacgag

SEQ ID NO: 35918 - DNA, 82 bp, Homo sapiens
  chr15:89921956-89922038
  hyper
tctacaccagggcaccgcctgggcctacggccttccgaacccgaagcgcccgcagcccagagctggcatcaggccatcaggc

SEQ ID NO: 35919 - DNA, 248 bp, Homo sapiens; identical to SEQ ID NO: 1239
  chr15:89922499-89922747
  hyper

SEQ ID NO: 35920 - DNA, 1149 bp, Homo sapiens
  chr15:89942626-89943775
  hyper
cgccccccagcagcccgggccgcgtttgaccactagtagggcagaaccactgaccggcaggcggcgctccccggggctcccggctcgagccccagggcaccgggaggagtaaggaccccgagcgggagggagacgactggggggcgcgcggcacaaagagctttttattcaaatttgtttagagtttcgcgaatttgcatgaaaaatgtgtgagaaaagccagctccggtgacctcatccgcacctgccattaacgttcaattagcggctgaatagcggccgccgacgcgacgtgcagagaatccggcctgccccgcgcagcgagggcggcgggccaggcccgggatagggtgggaccgagggagggggacgcggcgtagggccccggcctactcctctggcccggagacccaggacctcgtccgcactccaactctccgagggaacgcggggatctcaggactcacgagcccaagattgtttggagcgcgccgggagccttaggatgcctggctccctctgggcgcagaaaagggcgggcttgcctcctccccaggacggaaggtggccggaagagccccgtcccagctcagatgggcttccccgccatcttccggacaaagtgtcaagtacaagttcaagttcagggccaggcccgggggggggcgctgagccttacccggccgcctttgttctctggcataatcgctcccacgtccccctcccgggcggggcccagcagagacccccgccccgccccgccccgccgcgccccgcaggagcctcctcctcccgccggcgcggcgcctgtgccctggtcccggtgtccccgctcggtgccaccgaaggatctaggggctcgggccggggagggggtggaggggggagtggaggcgcgatacgaacccgtgggagcctccccaaccccgcagtcccagcggcaaactgtgcttggtcggacggatgcccgcgcggaggtaagagccctttgcgggattcgcccgtatccctgtgccccgccccccgcctgggactacgcgggccccaaggagcggggcggaggatggtgtgctgaaaaccggctgggcagccccgctgggcctccggtggggtggggggcgcactgtcgctccagggctctggggagta

SEQ ID NO: 35921 - DNA, 109 bp, Homo sapiens
  chr15:89945180-89945289
  hyper
gtgtgtttagattcccgatgattcatcactgacacgctgatgtcagaggagcctgggaagatgtttacatctttttaaaaaagggaaagcgaaacgtttttctgcaaaa

SEQ ID NO: 35922 - DNA, 39 bp, Homo sapiens
  chr15:89949371-89949410
  hyper
ttcggggccccctaccgaggccggccatgatcttgaggg

SEQ ID NO: 35923 - DNA, 326 bp, Homo sapiens; identical to SEQ ID NO: 1240
  chr15:89949616-89949942
  hyper

SEQ ID NO: 35924 - DNA, 501 bp, Homo sapiens
  chr15:89950236-89950737
  hyper
gcaggcctgaggagtcgggctgaaggtgcgccagccattattgcctcagacctccggacgctacgtaccccaagcacctgagctactagtggtatatcagacaagatttctgggagcagccccaggagtccctccgcccgctcccagtccgcaagcgcagaggatcctgcgctctgtcccccaaggtcttggcgtttgctgagctctctccgcgcgcgtcgaggagaggccgcctctcgtgagcaaaagctgggagttgttagagattccgcagccgctctgagggcgagatcgggtttgtcccacgacctcggcgccaggaagctgtagaaagagacagaccccaattttctccccttggagttgaaacaaaacctgaaagcccgaggttgcccgcaccgccagaggtggcgcctaggcggcgggggcgaccagagccgcgtgcccgcgcggttcccaggcctgggttctgtttcttcctattttagttagttacttagc

SEQ ID NO: 35925 - DNA, 205 bp, Homo sapiens
  chr15:89951081-89951286
  hyper
ggatttaagtaccttggcgaggcagcgcaggcggctgttctaatcgccgtctccaagtacctgctcatgaataaacaccaaccccatttatcaggtacttagcgctcattgtgaaggggaaattggcccttttctgaaattgtctatccacaacccatctgcgcagttctggttgcagaattcccctcacccttgagacacacac

SEQ ID NO: 35926 - DNA, 31 bp, Homo sapiens
  chr15:89951346-89951377
  hyper
taagataaactcgcttttcttccggtaagtg

SEQ ID NO: 35927 - DNA, 90 bp, Homo sapiens; identical to SEQ ID NO: 4295
  chr15:89951465-89951555
  hyper

SEQ ID NO: 35928 - DNA, 682 bp, Homo sapiens
  chr15:89951771-89952453
  hyper
gctcctctgggaacccggatgggccgaacagcagcttccggcagaggccctcaggtttcagagttctccaagtggggagaagggcggcctgctcagcccgcgcacccgtggcagcaccacagagggaataaaagcagggtaaacaatttgaagatccccacgaaggcaagagagtaaatttacaaactcatttgcgtccggaatacttgcttctttttcactcatacattccttctaaaatgtgggctttctgtgtacatgggcgcgcattcccaggactcggttccctgggtggaattcacccaggaatacaatcgattttctgaacctgcgtaaggccacaggcagctctgaaaatgaaagcgtttgctaagtgggggagatctcaccgatcgaacgtttaaaaatggctttgtcttcattcagctctcccgatttattctgtgttttacaaatagaagctcagagcttctgtcgcccagtccttgcatgactcatggcggtggccacacgggtttcagggataacgggatgtttagaaaatcgctgcatatcggagtttcctagcacgttccatttatactgaacgcaggcggccgctgaaaatccagcctcgactcttgctaatgactgggtaggaccctcggggtcctgcgacggtgctggagggtgttcccggctc

SEQ ID NO: 35929 - DNA, 419 bp, Homo sapiens
  chr15:89952699-89953118
  hyper
cgctccaaacacagatgctcatttttggaatattctagaaaaataacaagatcttgtttgtcgttatgattcacgggaggtaactgatgggagggccatttacatgagggcagacactgtggggcgaaggtgacttctggacgtaggctttaaagtaggaacggctccaaattcccaatatctccggccttaccggttgcaaatcggacccctgcgggaaaaccagacacttctgtttcgtggctttcgggctgcctccagcccacgcaggctcgtttagtccccgtggagtcagccccgagccttcctagtcctggaacaagggctccaggtcgcggccgcgggaagccgccaagagggcggggagtagggattccctccagctccgcagggcatctcacaagcgccttcttctgcgc

SEQ ID NO: 35930 - DNA, 199 bp, Homo sapiens
  chr15:89954287-89954486
  hyper
tttcaggttttgtcccgacagactttcagcaagcggcttagctcagccctggcgctgccttccaggaaagaggggcagcagcagcctcggctgagccgggtgcccttgtgggctatctggtgggggctcgcgggtccttgccttctctgcctggggtaggtgggaggtaggttcttgaacttcccggggcttctccctg

SEQ ID NO: 35931 - DNA, 89 bp, Homo sapiens
  chr15:89954753-89954842
  hyper
atccctggctccccacggccaagccgagaactagcgggcgcaggttgcattgtgcagactcccggggtcaggtcgcagggtcacgtgca

SEQ ID NO: 35932 - DNA, 184 bp, Homo sapiens
  chr15:89955001-89955185
  hyper
gggatagtcgcaccgacaaaaatcacaggaaggagcgcgcagttgactgtgggcgggcgggacggcggagccacttacagcgggacctgcgagggtgtgggtacgggactccccaacggaccctctagtttgtaaccgtgcgaacactggagggattcattatgtgcaccgtggaggcgcggac

SEQ ID NO: 35933 - DNA, 54 bp, Homo sapiens
  chr15:89956300-89956354
  hyper
gtgcctgcaaagccacggctcctaatcagggtaatttaatatattttaagcccc

SEQ ID NO: 35934 - DNA, 151 bp, Homo sapiens
  chr15:89956422-89956573
  hyper
cggccttatttgacggatggaaggagctgctatgagaccacagccctttgtgtcccccacataagctgggcttccccgtaattagaatggtattcccagccattgaggcttttcatgaggcagaacaaaaactccccgagatgaatatccc

SEQ ID NO: 35935 - DNA, 40 bp, Homo sapiens
  chr15:89959963-89960003
  hyper
gcccggccgctatcccgagtcggtgcgtgcctatgctgca

SEQ ID NO: 35936 - DNA, 85 bp, Homo sapiens
  chr15:89962817-89962902
  hyper
ctccgttggggtcaccgacagaggctcacttgttcaggcacttcctgggtcagcctttccgcctctgagacgggctctcccatct

SEQ ID NO: 35937 - DNA, 269 bp, Homo sapiens
  chr15:90039563-90039832
  hyper
cgctgggcctgcaggcggcgagacttacttgggtagcgatagtagaattcgttctccatgtcgctcaagttcttgtgcgtcctctctgaccaccagtgggcgtcggcctcgaagtcgtagcgcacgaacaccccgaagagaatcaccataatcacctgcaggagcaggcaggtgagcggcagccgccagcggaggttggtgttccaggccatgctgcaggggtgcctggccgggctggcagcgggcggttcggacgctcggaggccggc

SEQ ID NO: 35938 - DNA, 65 bp, Homo sapiens
  chr15:90293501-90293566
  hyper
ccttgtgcgggtgtccgcgctcgtgggctccactctcagggggcccctagcgaggggagacccag

SEQ ID NO: 35939 - DNA, 158 bp, Homo sapiens
  chr15:90319855-90320013
  hyper
gagaaactgcgcatgcgcacgctggcccgcgccctgcacgagttgcgccgctttctgcctccctccttggcgccggccggccagagcctgaccaagatcgagacgctgcgcctggccatccgctacatcggccacctatcggccgtgctgggtctcag

SEQ ID NO: 35940 - DNA, 25 bp, Homo sapiens
  chr15:90320089-90320114
  hyper
cgtggccccgcagaggcgcagacgc

SEQ ID NO: 35941 - DNA, 177 bp, Homo sapiens; identical to SEQ ID NO: 12318
  chr15:90357883-90358060
  hyper

SEQ ID NO: 35942 - DNA, 298 bp, Homo sapiens
  chr15:90358102-90358400
  hyper
cgtctttttaaagggaagtaaccggacccgaccactactccacccgattcacccctagcgggccgcccgcccgcagctccgcccgggctcctcccccgtccgcccgcggcttcccgggagccccccagggctcctccgctcctccgacggcccggccttccccccggggcctgggatgcaccagggctcctgctgcccccgacggggtccctgtcgccgcagcccgcgggacccgccggccacatctggacggcatctgccgcgggggaggggctcagagcctcgccctgagtgtccc

SEQ ID NO: 35943 - DNA, 156 bp, Homo sapiens
  chr15:91427788-91427944
  hyper
ggggcctggaggagcggtgggagctgggggcgcggcaggcaggggcagagcaggcgttccgagggccagagacccacccaggtgggggtaggggccgcggaagggcggggatggccgcaggggcagggctcaggctgtgggcgcctgaggcttcag

SEQ ID NO: 35944 - DNA, 73 bp, Homo sapiens
  chr15:91642967-91643040
  hyper
gaacagcaccatgatcgacgatactttgggggcggcgtgatcagaggattccccttcccgggaacttgcgtct

SEQ ID NO: 35945 - DNA, 68 bp, Homo sapiens
  chr15:91643277-91643345
  hyper
agaagcagagctgcccgcagcgaatacttttaatgcccgggccgggaagaaagcgggttaggatctga

SEQ ID NO: 35946 - DNA, 142 bp, Homo sapiens
  chr15:91643657-91643799
  hyper
cagggctcccagactcgcctgcctgggctgaaatatacacgctcgcacagctgagtgctgttcatagtaaatggcacaaaagatcggagagtcttgaaaaaccggcgcagaaaagcaaggacttgcccgctgcctggagctg

SEQ ID NO: 35947 - DNA, 45 bp, Homo sapiens
  chr15:92936662-92936707
  hyper
ctgcctggctgaaaccgccttctcgccgcgcgctgggggctgtcc

SEQ ID NO: 35948 - DNA, 732 bp, Homo sapiens
  chr15:92936922-92937654
  hyper
ctgaataaagccaggcgggagaagcaaaggctagcgcctggacgctggagttggtgggaggaggcgagcagaggcgcggagcaaagctgtcaaactgcgcgcggagccgggcgcggggcgggggaagggagaggagggagggaggggcaggcgggagccgggagggagcgagcgggctcgccgcgcctgagcaacccctgcctgtcgctgccgctgccgctgccgctgccgccgccggcccggactcgtccggagcgcagggtgtctgcccagctgcgcgcggcgcgcggaggctccggcgtccgccgctgcgccctccggcccctgctcctcgcgccggcccgcgtgggtcccggcgggcgcgaacccaccatgcagctgcagttccggagctggatgctggccgcgctcacgctgctcgtggtcttcctcatcttcgcagacatctcagagatcgaagaagaaatcgggtaaatagctgctcccaggcccgtgccacgagccctggcgggatctctccctccttctgtactctccaccctccgaccccctttgtgtgcgccgcgccccgctgtagctccgctggagagatggggacggtttggcagaaggtggcggcgacaggggcccgggacggtttggggagaggagggtgggggcgcggctgctgtggggtgtccccgggcggggttcacgggaagcccccagctggcccgcgtcgggaagcggact

SEQ ID NO: 35949 - DNA, 39 bp, Homo sapiens
  chr15:92937696-92937735
  hyper
cgccggggtcgagggagggcgccggggagtgtctcgggc

SEQ ID NO: 35950 - DNA, 325 bp, Homo sapiens
  chr15:92937736-92938061
  hyper
ggcggaggggccgagagtggagggaggcaggagtttctttgtctccagcacggccgctttctcgccttggcaaagtgggcagggggcgcgcagggatctctgagctgggggaggggttcctggggccggagcggagggcggggttctgcatgggctactgggaagcggaatgtcccctgcacacacagacaggcacacgcgcctcccgccggcccgggagcccggcgtaggagctggcaccactagagaagggctcgcatagctggactgagaccccccgccctcgcctggctttggacgttcagccaagccacggcaaccccgg

SEQ ID NO: 35951 - DNA, 53 bp, Homo sapiens
  chr15:92938325-92938378
  hyper
ggccgggcccctctccggaacctccaaagggcggtagacgacaggtggggagg

SEQ ID NO: 35952 - DNA, 305 bp, Homo sapiens
  chr15:93198707-93199012
  hyper
gccccagacccaaaccgggtggtgttcccgggccccgggccgggcggtggccgcgactcgcgctcgggttcgggccacggcgcggagacggactcggctctgctggcgcgggcggcgggagcggccaggagcgcgagcagcagcagcggcaggagcggggcgggcagcggcacggcgcgcatagtgcggtgggtcggcacaggatcgggcagggcgcgcgcggctgagctccaggatccgcaccagcacggaggcctgcaccgggggatcctgcggcggaggcggctgcgcggtgcttggcagga

SEQ ID NO: 35953 - DNA, 35 bp, Homo sapiens
  chr15:93257618-93257653
  hyper
acactcgcccatatacgcaacggctgagtgcactc

SEQ ID NO: 35954 - DNA, 465 bp, Homo sapiens
  chr15:93615914-93616379
  hyper
cacggctccatctcacggcaactcgggcagggtgcccctctccgggtccccaagggcaggcatcgcacccacgacggggtgcgggagaaacaaaagacccgtggaaataggaggcggggtccggaggaggtccggagaacttgagcccggactcactcgcgcacatctggcccagcattgaggggcggcccagggacccggccccgcgcgcccggccggcagtgccttacctgcggggaagctgcagagaaggaaggcgagggtcggccagaatcccagggctgaacgtcctgcccctctccccatacccatccatccagctcggcctgttaccactagcctctccctggaagaagagttcagaaaaaaagaagaaaataaatcacgctgcgaagaaagggcagcctcgctccgccggcgggagcagcgagccgggaggctccgtccacctcggccgcgggcgcc

SEQ ID NO: 35955 - DNA, 257 bp, Homo sapiens
  chr15:93616396-93616653
  hyper
cgcgccgccccccgcgcgcccctccctcgccatccatcactcggttctccgccaatgtcgacgcggccccgcgccccagccgcctgcgcaccgccccctcgcgctcgggtttcagcgaggccggcgaggtagccggaggcggccgggcggggacccaggctgcccggccgcagcgctcgccgtgaggacctcggaaaaccacggccctagatcagagggcgcgccacgctccccgaccctcgcgccatctccagccc

SEQ ID NO: 35956 - DNA, 1098 bp, Homo sapiens
  chr15:93631632-93632730
  hyper
cgtacgccggcgcgccgaggcaaagggccgccgggacgcgagcccacgcggtgcactgcgccgacatccccgagggcaggagatggccaggcagctccgcagccgggcgtcgagcgggaggcgggggcccgggcggcgcgggccaatgggggttcacggcgggacagtcgggtggccggctccgtccggggctccgcgagccgggctgagggaaggagctcccagcccgcacacggtgtaagggacgtgtgccgggtctgcccaaccacgcgcgctggcggctgcccgggggagagtattttaggaaaaaagaacaaacaccaaaccacaaaaactttcctgctgccaacagctaaagcgatagaggcgcagcaaagctccaaatgtgggcaagatgggagcaagatgagacgcggggctaaggaagaccaaagcagcgccgtggccccggcatgtgtcggcggcgcctcggagatgtcagagccgggtctgcccggctcccgacccgcgcttaccttggcggctgcatgagcccctgcggcccgcggggggtggcgctggcggggctgcgggagaagagggggtgtcggggcgccgctcgtctgccccggggcaaggtgggaggggctccgctggcgctggtccccgccgccccggccggctcagcagcggcccggggagcgcctcctgctcccgggctgcatgcctgcgagcgcctggcggagccggcccgggagcgaacggccagtgcttccccggcccagcggctcgggcggcgcagccagcgctcgggagacaactgcagagtggggcggccgggaccagccccctccctcgcccggcccccgcccgccgccgagcgcggcgtcgcgaggttcgtttgcgcgccgaggggagggggcgggccgggcgcccgggccgcgggcggggggcgcgcgcgggcggggccggcagggaggggcggggaggagcggggtgcgggctcgcgttgccccgccccgccgcggccccaccctcccgcatcagcaccggctgggtgggtgcggagtgcgccagcggccaagtcaagactccttgaatgctcaggttagggggcgc

SEQ ID NO: 35957 - DNA, 535 bp, Homo sapiens
  chr15:93632731-93633266
  hyper
ggcggcaagtgcggcgactccccggggcgcctccaactttccgaatcgcccgcagggttgcggtggagcgcacggtgtccttcagttaggcggtggtcgaggggagttcctctgagatttctggagaaggcggttacatccaagacaaatgctgttgcgctctgcggagacgcacctttgttctatagagattttgttgttgtttaagaatcttcctgaaaaaactaatacatatgtattacatgctaacacacgcatacattcttgcgtagaattgtacataactcaggagtgtctagagtgaaaagaccgtatcgcactccctcccacggccgcggctctcccacggccgcggctcccccgcggtaaccttcggtcagggtgtgctctgccgcggttctttccagtctctgcgcttttacatgcacacgcacagattgcgagtggaatctcctgggcttttcaaaagaatgttttcaacattaagcgcatgcacacagtggcttgaacacggccacgtcgggagcagtaaatc

SEQ ID NO: 35958 - DNA, 64 bp, Homo sapiens
  chr15:95388665-95388729
  hyper
ggagaagaatatctcaagcccttcgtagaagttcctctttgtttccgtacggcccttgatacca

SEQ ID NO: 35959 - DNA, 144 bp, Homo sapiens
  chr15:96865078-96865222
  hyper
ccgccacccggcggccgcccctgacaccgagtgggtgggaggaagaggcagctggcggggatgggccattgagacctcttgaaaaatattaaaagacaggatgggtagagatttctccgggagaaagttcgagggtgcatcggg

SEQ ID NO: 35960 - DNA, 51 bp, Homo sapiens
  chr15:96874282-96874333
  hyper
cagcagcagcagcagcggctccggcggcggcagcagcggcagcagcgactt

SEQ ID NO: 35961 - DNA, 74 bp, Homo sapiens
  chr15:96884425-96884499
  hyper
tgtgaaactctgcctcgaatctcgcttttgacttggtcctatgagctgagccaacatggcgtctcccactgcac

SEQ ID NO: 35962 - DNA, 30 bp, Homo sapiens
  chr15:96897398-96897428
  hyper
cacacaccccacacacgcactacgagaagg

SEQ ID NO: 35963 - DNA, 157 bp, Homo sapiens
  chr15:96897853-96898010
  hyper
ccgtgcggctggctgcgcctaggagttccgccacgggtccgacggggcaccctgggtccccgcagcccgtcacaggcgtttgcacatttgtgtgcacgaccactggcgggggcgttgagcctctgctagccgcctcgggctccgcacacccttgggt

SEQ ID NO: 35964 - DNA, 326 bp, Homo sapiens
  chr15:96911366-96911692
  hyper
gctttcaggtgaattcgttccgggcgttcggtgtccctgggcttgcctaggggtactggggacccttagtgggccagaacccgaagctgaacgtgaataagggacagggtaggacctgaaattgcagagacatagaaaatcaatacgtggtcgggagtcaactgcgcgcgaccaagggctctgccctccctctctccgttgatttggacgctgggaagctgcccgccgtccttccccaccccctttgcccagccttggcaagacctctccggaaacatactcgcgttaaggaactgggaaagcttcctggcccggagctaggagcc

SEQ ID NO: 35965 - DNA, 198 bp, Homo sapiens
  chr15:96911763-96911961
  hyper
cgctgggatccatctcctcagccccggtttcccgctctgcgagcgggggaagaacctgggaactgcaggatccgccacctcggtttttcagacacagcctctggcctctttccttggcctgccaaacctttgttcacttctctcacccgttgtctgctctgctctatccctcagcagggttctcgtttggacaagagg

SEQ ID NO: 35966 - DNA, 125 bp, Homo sapiens
  chr15:96952646-96952771
  hyper
ccggcggggcagggccggggagctggggacggggtggtctttagggtggcggcttcccccgaccccggacccgggaaccggccgccggcgcggggcgcgatctgcactgccggtcccacaggagt

SEQ ID NO: 35967 - DNA, 4 bp, Homo sapiens
  chr15:96953095-96953099
  hyper
gccg

SEQ ID NO: 35968 - DNA, 36 bp, Homo sapiens; identical to SEQ ID NO: 12337
  chr15:96953131-96953167
  hyper

SEQ ID NO: 35969 - DNA, 242 bp, Homo sapiens
  chr15:96959719-96959961
  hyper
cgaatttcggggcttgaaagcgctaccggggcagccagattactacctcccactctcacctccatccctccccgccccttgcccgtcccacgggcctcagatttgggcgtagggctgggtagggcgcctgggaggagccagagggggcggatcaggccgggatttggcgccaggtacccccacccgcccgcgtcccggggtcgccagctgactccatgtgagcccacttggcaccggccccc

SEQ ID NO: 35970 - DNA, 36 bp, Homo sapiens
  chr15:96960508-96960544
  hyper
gccgcggacgccaggcgcgagcgcaaggttaaagtc

SEQ ID NO: 35971 - DNA, 65 bp, Homo sapiens
  chr15:96960746-96960811
  hyper
ccggtgggaagtcatcgaagatctcccttttaccaccagctctacggggtcgcttttctcttaag

SEQ ID NO: 35972 - DNA, 73 bp, Homo sapiens
  chr15:98504114-98504187
  hyper
ggcggccgtgggtgccgagggccgcgtgaagagcctgggtctggtgttcgaggacgagcgcaagggctgctat

SEQ ID NO: 35973 - DNA, 372 bp, Homo sapiens
  chr15:98836021-98836393
  hyper
taattaggtaaactacgccaagagaggctcagaaacctgcccaaaatgagctggagcatcagcaggggttccaaatggcaggcgtcctctcccctctgtcccacaaagaacagtccgtcccctgggctgggagctgggcccggagccccggggcagcccgcccggccgtgctcgctgcgcccccgggctgcgttcatcaagcgcaactccaggcgcgcgccgcaaccgcgcagggcaaccgggggctctcccgccgaacccgccctcacttacatctttctcgtcgcccttcaggggctgctagtttgctaatgctgccaggaagctctcctcccagttttctagctgccgttccagcgagcagagagagag

SEQ ID NO: 35974 - DNA, 109 bp, Homo sapiens
  chr15:98965273-98965382
  hyper
ggctagtgggacccccggtgcgccgccgccgatggggtcttagggcctgtctgtctgggctagagccggcccgggagcctgtttgcggggagtgcgggtcagcaaagct

SEQ ID NO: 35975 - DNA, 267 bp, Homo sapiens
  chr15:98971698-98971965
  hyper
accgactcggggctgcggacctcggagcgcgcccggcgggctttggtttgggcaaggctgccatcgtgtggccgccgtgggtatttccctcggaaagcggccgggcagcgagcaggcgcccgcgcctcttctttttacgggagtccgcgctctccgcaagtctgtcctgagatcgccgttttctcccaccagccagaatggggctcactgctgcaacccgggtctcagtcttctccagggcacctcctgggccgtgccccgagcctt

SEQ ID NO: 35976 - DNA, 138 bp, Homo sapiens
  chr15:99193529-99193667
  hyper
gttcctggccttgcccgtcactttggcccgctcctcgttgggttacctgcccccggcgtcccggggctgggcggtggggtgaggggaagcgctctctgggcagccccccgggaagtgcgaggccgggagtcttcctca

SEQ ID NO: 35977 - DNA, 95 bp, Homo sapiens
  chr15:99193974-99194069
  hyper
tggttttgttgtggtcggcgtcgtgtcgccctctcttctgccgccccgcacttcctttgtacgtagttaataagcagtgtcgctccacattcgct

SEQ ID NO: 35978 - DNA, 32 bp, Homo sapiens
  chr15:100346202-100346234
  hyper
cagccctttcccaggcggtagcggggacggtg

SEQ ID NO: 35979 - DNA, 581 bp, Homo sapiens
  chr15:100881263-100881844
  hyper
aggcgctgagcgagacgagggagccggggtggccgagcacacggcccgagtagaagcacagctcggcggggcggccgcggcgccgggccgcgcccgcctcctccacctcgaagcctcgggacaggaagcgcaggtcgcggcgcagctgaaggtacaggtcgcgcccgaaggccggcaggtgcagcagcagggcgcgctctccgggccgggcgcgcggggcggctgggggcgtgcgggggcgtcgccgccgtcggggcccgggggctgcgggcagcggcggcaggtgcacgtcgtcggggcgcacccgccacgggagcaccacctccacgtcggccgccgcgtcgccgacagctgcggggagagaggagacgcgtcagcgcggcggggcccgcccggacgcccgccctcccgctggccgccagccgcgccagcgcggggacagcgcgacccggagccggcgctgccttcccttccctcgcccggcacctccacgctggcccgcgccacccggggagggtctccggcgcagccgcgcgagcacctcccggaacggcgccgcgcatcggcgagcggagacccgg

SEQ ID NO: 35980 - DNA, 126 bp, Homo sapiens
  chr15:100881966-100882092
  hyper
cgcagagggaaggtagccgcaggacgcggggtgaagagggctgtgggagggggcgctacctgtgcccgggtccagtccccaaaccagcagcagcagcacgggcaggacgagcggaggcagcagggc

SEQ ID NO: 35981 - DNA, 173 bp, Homo sapiens
  chr15:100913423-100913596
  hyper
cccagggcacccctccgacccccgctgcgaggggtttcccgcgggaggtggacgaagcgtgggccaggacaggcgcctggcactggggtttcagagccgcgagtaggccctgaaggccgggagggaccgccagtccccactggaagccgcttccgtgcagcccgggacaggtg

SEQ ID NO: 35982 - DNA, 12 bp, Homo sapiens
  chr15:100914039-100914051
  hyper
cgggagggaggg

SEQ ID NO: 35983 - DNA, 15 bp, Homo sapiens
  chr15:101420369-101420384
  hyper
tttcgcgggacgtct

SEQ ID NO: 35984 - DNA, 240 bp, Homo sapiens
  chr15:101420425-101420665
  hyper
cgaagccgggaaaccgaggccgtccagcgcccgcgcggggccgggccgcccgcatccctgcgaggccccgacgtgtccctgcgctgcccgctttgatcgcgagtggaggtgcgcgccgcgttgactcggagcgcgctggttttggggagctccctccccaaaaacccctgcgatgatttccagggtggacgagtctggctttgagagggtcggagggtccgagagcgccaagagagagtc

SEQ ID NO: 35985 - DNA, 126 bp, Homo sapiens
  chr15:101420734-101420860
  hyper
cgccttccgtgcttagtttatacccggctcagcagcagaacgaggaggagtaggaaggtgctcgcttactgacgaaacctccccggagcccagaggtcccggtgtttacacacaaggcgcgcgctc

SEQ ID NO: 35986 - DNA, 18 bp, Homo sapiens
  chr15:101420971-101420989
  hyper
cggcgagattacctgccc

SEQ ID NO: 35987 - DNA, 62 bp, Homo sapiens
  chr15:101459070-101459132
  hyper
atgcaaattgcaggtcgttaacgctttagaacgacacatttctgtatcgccccgtgaagagc

SEQ ID NO: 35988 - DNA, 221 bp, Homo sapiens
  chr15:101460044-101460265
  hyper
cctctgcctttggagcgaacccagtcccttagcggggagcgggcggagtgtgagcgcgcgggtgagcccgtgccggggtgtcggcaagagaccgcccgggagcctctcgctggtccggggcttcctggggttgcggggcggcccagcgaggcttcaccctcctcgatgtctgggtcacgcttcttgcccaggtggtctctggctggcgcagatacaactgc

SEQ ID NO: 35989 - DNA, 41 bp, Homo sapiens
  chr16:204480-204521
  hyper
cgccaataaaccaatgaacgaagcagcgtccacctggtctc

SEQ ID NO: 35990 - DNA, 723 bp, Homo sapiens
  chr16:215150-215873
  hyper
gctgagcgccgcctccgggacccccaggacaggctgcggcccctcccctgcccttcaccctcccacagttcctgccctgactccaataaatggatgaggacggagcgatctgggctctgtgttctcagtattggagggaaggaggggagaagctgagtgatgggtccgggggcttcgcaggaactcggtcgtccccactgtcgtcgcggcctggggttcacttggggggcgccttggggaggttctagcccctgagcaccggagctgcggcccgggtggagcggagcagtcccgggccggcccgcggcgtctcctggggtccttgagtcggacgggcgtttgtgcgtctcccggcttcccatatcgcacaaagattgtcacttcactaagcgtattggaagcgtgtcggggctcagggaacttttccacaaagcctgacgtccgaatcccgggactctggcagctacgggggtccctgaggccggtccctccccgactcctaagagagtagggggtttcctgcccggtgttctctctccggttcctcccatgtgctccctcctggcagagcagtaactttacccgaggggagtaaacagatgcccctaaagtctgcagtaaaggtgcccacgcgcaacggcgtgggtcaatgccagaaaccctgggatcccggaggtcgaggcctccacacagacgggaacccgggctggttacgttccccgg

SEQ ID NO: 35991 - DNA, 48 bp, Homo sapiens; identical to SEQ ID NO: 4305
  chr16:215912-215960
  hyper

SEQ ID NO: 35992 - DNA, 285 bp, Homo sapiens
  chr16:215961-216246
  hyper
gcgggcgcggcccccagagcacgtcaggcggcgccatgctcagcgcccaggagcgcgcccaaatcgcgcaggtctgggacctgattgcgggccacgaggcgcaattcggggcggagctgctgctcaggtcggtagaggcggggtctccgggagctcagggaggtggagatgagggttttgggcgcgtgggccgccaacgccatccaaggtccttcgggtgcggatccccgggctctgggcggtgtgggcgctagtgaagccccacgcagccgccctcctccccgg

SEQ ID NO: 35993 - DNA, 393 bp, Homo sapiens; identical to SEQ ID NO: 12349
  chr16:216583-216976
  hyper

SEQ ID NO: 35994 - DNA, 208 bp, Homo sapiens
  chr16:223321-223529
  hyper
cttcaaggtgagcggcgggccgggagcgatctgggtcgaggggcgagatggcgccttcctctcagggcagaggatcacgcgggttgcgggaggtgtagcgcaggcggcggctgcgggcctgggccgcactgaccctcttctctgcacagctcctaagccactgcctgctggtgaccctggccgcccacctccccgccgagttcacccc

SEQ ID NO: 35995 - DNA, 113 bp, Homo sapiens
  chr16:230203-230316
  hyper
cgccactgcactcaccgcacccggccaatttttgtgtttttagtagagactaaataccatatagtgaacacctaagacggggggccttggatccagggcgattcagagggccc

SEQ ID NO: 35996 - DNA, 556 bp, Homo sapiens
  chr16:230496-231052
  hyper
cgcggaggaccgggcgctggtgcgcgccctgtggaagaagctgggcagcaacgtcggcgtctacacgacagaggccctggaaaggtgcggcaggctgggcgcccccgcccccaggggccctccctccccaagccccccggacgcgcctcacccacgttcctctcgcaggaccttcctggctttccccgccacgaagacctacttctcccacctggacctgagccccggctcctcacaagtcagagcccacggccagaaggtggcggacgcgctgagcctcgccgtggagcgcctggacgacctaccccacgcgctgtccgcgctgagccacctgcacgcgtgccagctgcgagtggacccggccagcttccaggtgagcggctgccgtgctgggcccctgtccccgggagggccccggcggggtgggtgcggggggcgtgcggggcgggtgcaggcgagtgagccttgagcgctcgccgcagctcctgggccactgcctgctggtaaccctcgcccggcactaccccggagacttcagccccgcgctgcaggcgtc

SEQ ID NO: 35997 - DNA, 337 bp, Homo sapiens
  chr16:609979-610316
  hyper
atggataagcgctgacggcccctctcccgcgccccgcgccgctgacacccatcacgccgcggcggggacccgggagacctggcggcctctgtgcacccccgcggcagcctgcgggcaacgggggcgggaggcgccgggcgcccctgactcggccgcacacctgcgccgcagtccgctctccgtccgctgcctcccgggttcccggccgctccaccgcgcgccccgagagctgagccggtcccggcgcacgaggccggtgagtgcgcgccagggggcggcggggggcgcgcgggcggcgggggcgcggggttcgggccgggggctgctccttccctcc

SEQ ID NO: 35998 - DNA, 158 bp, Homo sapiens
  chr16:610343-610501
  hyper
cgccccccggagcccggagcccaggcgcacgcgcgcccgcctctgccgccaacttcgggaggtgcgagcggcgtcggggggacgcgggcggcggcggaggctgcgggagtcgctgccgctcgagggaccgcggacccgggaggtccggctcccggcgc

SEQ ID NO: 35999 - DNA, 185 bp, Homo sapiens
  chr16:680959-681144
  hyper
gggcctgggagcccccgcacggttcagacagaggggccaggctgaagctggagaggaaccagcgtcacacagacggcctctgagaacttggagaccccgttacccacccagcaggggtgtcaggacaagcatctgctgcaggcttcagcctcaggggcaaaagggagccccggggtcctggtggg

SEQ ID NO: 36000 - DNA, 564 bp, Homo sapiens
  chr16:725381-725945
  hyper
tcacaggcctgagcccgggaaggctgtgagagggcgaacggtcttgcatggggggttttaggtgccccccatccccgtgactccatttaccagcggctgccgtggaggtagtccagtgtgctggagctgcgccagagcgggggtgggggccggcgctgagacgcggtgctagctggaggcggttcctgtccggggtgtgcgtccgcgtgcagggtgcgcgcgtgtcttggccgcgcgtggcggcgtgtgcggcaggggcgggcaggcgggcgactcggtgacgcggcccaagcgcggcgccgagcggagcgggcggagcgggccggctggggcggagcggagtcgtccgcagagcagcccctcccggccgcggccgccgaccccggaccccggcccccggccaggctctatggacaggagctcgctgctgcagctcatccaggagcaggtgcgtcggggggtggtctggggagctggcaccgcccccaatgcggccctcctgccgctgagctgagcttgtgcgggaccgagctccccgaaagccccgctcggtacctacctcat

SEQ ID NO: 36001 - DNA, 1028 bp, Homo sapiens
  chr16:750383-751411
  hyper
cccatgatcagaaggcgcggcctccggaggccgacatcacaacgtttgcaagggccggctggggtcggcacatgattcgacctcacggccgcccttaggggtggaggggtcgctacctcaggtttggggaaggaacacgaggctctgaggagcgaatttgccccaggtgtccggggaggcctggcgcggggctgcctcggttccctcccagagccggggagaggggatatcgcaggatgccggcgcccgaggcggcagcaccaggcccacgggcgccccagtctaaatatcctccgtgcccctagagcggggaccctcgctccccagacccggaagcgccgccttccccgccagggacgcctgggcctccgcagaccccgccggccggcgcgccacccgcgccagcaccatggacagcggccgccccagccgcgcgctcagggccaggcccgggctggcttccaccgcggacggctgcggggtcggggcagccccgcaatcccaaatcccggcagcccccgctcagcagggaggggccccgggggcgaagagtgggggagaagccgggaaggatccggaggaggcggcgggggcggcgccaggggaggaataatcccggcgcagtgccgatttaggttgaaaacgctcccagtcatgggcctgcacgtggagcgccggggctgggggaggcattcgcggggctcctttcccgccccgctcgggagctcacgtttgccggcgcccacagtcccgtccccacctccaggcctcagggtcgagatggagaaaccaagccgcactttgagagcccacaggagggaggggacaggctgaggagcggccgtctgggtatgggtccggggcctggcttccctcatccacacccgcagcgctgccagaaggcgctgctctgcctgtggtcagccctcgacccgtgtgcttggtgggagctgcatccccgcacaggcagccccactgctccccaatctcgcgtccacgttcctgccggcccccgctgctcctcacac

SEQ ID NO: 36002 - DNA, 38 bp, Homo sapiens
  chr16:863839-863877
  hyper
gtggagccacaggtccgtgtgatcgtccccgtgacccc

SEQ ID NO: 36003 - DNA, 316 bp, Homo sapiens
  chr16:1030443-1030759
  hyper
cggaccagctccttctgccgaccgggccggggagaccgcgtggctcagtggctgcagcggccaccggcccgggcgtgggggctttgagggcaccggcgcggtaggtcacccgggtttcgcgggccgcaagctcggagacgcgcgtgtcccgcgttggctgcctgacccggaatggcgcagccccttcgcctccagcgcgctggttgaaaggatccgagccaccctcggggacggccgggccgaggccacctcgcggggcggccttgggcggggacccggacccgcggttggacgttcgcctcggggggggcaatgt

SEQ ID NO: 36004 - DNA, 161 bp, Homo sapiens
  chr16:1031121-1031282
  hyper
cgcggccccttgaagcgcgttacctggacgtgcgctgtccgcagactctggacgagctgggcctgggcgctgcgcggcggaaccgaccctgtcctggaccgcaggcagcagctgaccccgcgccaccggcctgcgggcgagacctcaggcgcgagacgggc

SEQ ID NO: 36005 - DNA, 100 bp, Homo sapiens
  chr16:1031402-1031502
  hyper
cccgaggacccgcttcctagctgagcgtcaggacggggggcggactctcaggagccgcgcggcgcccgcagaggagaggaagcgccggagacccccctgc

SEQ ID NO: 36006 - DNA, 378 bp, Homo sapiens
  chr16:1031741-1032119
  hyper
taaagaaacttgttgcgggtcccgcagcgggacccgagcctcggcggcggcggcggcggcggcaggggcgagggtcggggccaccgcgcggcgacctcgggtcccggagcgaccgcagggcagccccgggcgccggccccggtgcgcgtctcctgtgcgcgcccctccgcgcgcggccccgatgctggacatgagcgaggcccgctcccagccgccctgcagcccgtccggcaccgccagctccatgtcgcacgtggaggactcggactcggacgcgccgccgtctcccgccggctccgagggcctgggccgcgcgggggtcgcggtggggggcgcccggggcgacccggcggaggcggcggacgagcgcttcccggc

SEQ ID NO: 36007 - DNA, 34 bp, Homo sapiens
  chr16:1032389-1032423
  hyper
cctggtctcggactgcgagcgggggcctggaggg

SEQ ID NO: 36008 - DNA, 519 bp, Homo sapiens
  chr16:1203265-1203784
  hyper
gggcgagccggagccggagtcgagccgcggccgggagccgggcgggctggggacgcgggccgggggcggaggcgctgggggccggggccggggccgggggcggaggcgctgggggccggggccggggccgggcgccgagcggggtccgcggtgaccgcgccgcccgggcgatgcccgcggggacgccgccggccagcagagcgaggtgagacgcggcgaggacgcgcgcccgggaccctcttcaacttgcgcgaagcgggccggggagcccctcggggtgggggtggggccgctggagggagggagggggcgggcgggggcggggggcgcgtttgtctctaataagaaaagacaaagacatcccggcggccgcggctgttcccgcagctccgcgccgcgggaggcagggcgggggcgtcgccaccggccccgggtcaccccctgtcctctgcaggtgctgccggccgccaccatgaccgagggcgcacgggccgccgacgaggtccgggtgcccctggg

SEQ ID NO: 36009 - DNA, 156 bp, Homo sapiens
  chr16:1203807-1203963
  hyper
cgttggtgggggcgtccccggagagccccggggcgccgggacgcgaggcggagcgggggtccgagctcggcgtgtcaccctccgagagcccggcggccgagcgcggcgcggagctgggtgccgacgaggagcagcgcgtcccgtacccggccttgg

SEQ ID NO: 36010 - DNA, 109 bp, Homo sapiens; identical to SEQ ID NO: 12362
  chr16:1204002-1204111
  hyper

SEQ ID NO: 36011 - DNA, 180 bp, Homo sapiens
  chr16:1204128-1204308
  hyper
cgcccctgttggtgggacctggcgtgggccgggcgcgcgggggtgcagggcaggggctggaggaccgcgctctaatttctgagagtggcgggcttggggggccaccgggcgcctccggactcccttccccagggccggctccggacggagaaggtggaagcgaagcggtgaggcccccgc

SEQ ID NO: 36012 - DNA, 324 bp, Homo sapiens
  chr16:1382374-1382698
  hyper
tgcccaggtgcccttcgggtgaaaactccaaagtctgaccaccccccaccccttgtccccaaagggctgcgagtgtccagctgtattcgaccaagggcaggtgcgaccggggggccgctgcgccctcggcaagtctgagagcctcaggcccccgacaggaccatgcttagcacggacttctcaaagtgtggtccctggactggcggcagcagactggagctgggaagtgcaggcgctggctggcgtggggaccacacctgtgatctcagcgccttaggaggccggggaagggggatcccttgagcctgggagtttgagaccagc

SEQ ID NO: 36013 - DNA, 324 bp, Homo sapiens
  chr16:1382818-1383142
  hyper
ttgcagcgagtggagatggtgccactgcgctccaacctggttgagagctatttttgagagctttttcgagactctgtctgaaaaaaaaagggaaaaaacgcagatcgcgcccccacccagacttcgggaccagcgggttggggacaggacccatcaatgccttaacaaaccctgcaggagaccgcgggcccgctggggttccaggacagcgcagcggaggaagagcggggagccacccgggaggggctggcggggtccagtgcagaccccaggggctccgggggctctggccggctgtgaccccacaagcgccaactgggccct

SEQ ID NO: 36014 - DNA, 49 bp, Homo sapiens
  chr16:1383733-1383782
  hyper
ccccgcgccggcccacggtaagtgccgcgggctgcggccagtgctgttg

SEQ ID NO: 36015 - DNA, 50 bp, Homo sapiens
  chr16:1384020-1384070
  hyper
cggagcggacggggagggtatccgggcgctggcgacggcctcccccgcac

SEQ ID NO: 36016 - DNA, 254 bp, Homo sapiens
  chr16:1384494-1384748
  hyper
agcgctgcgcagacacgggcgaggggaggaagaaggcgcctcgggctccggtctcctgcgctcctgctgggcgccagcggctggaccttggcagccgtctgaggcttcggggagcccaaggccaccggcagcgcttgttagaatgcagattcccggggttcgactggaatgagaccccggggagcagcgtttgcagcgggcccgccaggtgacctgcacctgggcaccgccatcggcttcgcaggggccatctg

SEQ ID NO: 36017 - DNA, 197 bp, Homo sapiens
  chr16:1922108-1922305
  hyper
ctcgggccacagcctcgtgcaggtgcgacggccgcgcgaccgttagcgcgaggccccgccccgtcctcagcgactccgcccccaccgctcactgactccgcccccaccgctcactggctccgcccccaccgctcactggctccgcccccaacgcgctcagactcagccctcgggggaggggaggggagcccggttcc

SEQ ID NO: 36018 - DNA, 453 bp, Homo sapiens
  chr16:1968132-1968585
  hyper
gggcgcgggggccggcgcgggggcgcgggcggccggcgggcagcggccggggagggcgcagaggcagtaggcgccgagcaccagggccacgagcagcatcggcgcgcgggacgcccgcagagcggccccttgcccggcccctgcgccctggccgcccccggccccgccgcccaggccgccgctacctgccatggggtcgcgccgctccaggcccgggagcgggggcagcaggcgggcgcgcatctcggcccgcgcgccgctcagtccgtgggtgcccggcttgtgctctgcgcccggcggtcccgcagcctgggagcgggcgcggggcgggaccgggggcggggtctggacgccctcccccctccccctcccccgcccactccgcctccgaggccactgcctgggctggacccgccggcagccgccaccacccgggcgcgactcgagctgccg

SEQ ID NO: 36019 - DNA, 114 bp, Homo sapiens; identical to SEQ ID NO: 1244
  chr16:2040847-2040961
  hyper

SEQ ID NO: 36020 - DNA, 1 bp, Homo sapiens
  chr16:2040980-2040981
  hyper
c

SEQ ID NO: 36021 - DNA, 531 bp, Homo sapiens; identical to SEQ ID NO: 1246
  chr16:2040982-2041513
  hyper

SEQ ID NO: 36022 - DNA, 619 bp, Homo sapiens; identical to SEQ ID NO: 1247
  chr16:2041581-2042200
  hyper

SEQ ID NO: 36023 - DNA, 39 bp, Homo sapiens
  chr16:2042464-2042503
  hyper
gcgctcccgggtgggcggggtcagcgcaggagagggagg

SEQ ID NO: 36024 - DNA, 114 bp, Homo sapiens
  chr16:2069994-2070108
  hyper
cgcgtggtacaagcacgtggcgagtccccgctaccacacggtgggccgcgccgctggcctgctcatggggctgcgtcgctcaccctatctgtggcgccgcgcgctgcgcgcggc

SEQ ID NO: 36025 - DNA, 47 bp, Homo sapiens
  chr16:2070147-2070194
  hyper
cgcagcccgcgaggctcctctcctgctgccctcgtgggttcaggagc

SEQ ID NO: 36026 - DNA, 32 bp, Homo sapiens
  chr16:2287088-2287120
  hyper
cctcagcgccgtgtccgcgctcatggagcaga

SEQ ID NO: 36027 - DNA, 30 bp, Homo sapiens
  chr16:2287491-2287521
  hyper
cccctcccctcccgccgagctctgacgccc

SEQ ID NO: 36028 - DNA, 76 bp, Homo sapiens; identical to SEQ ID NO: 12372
  chr16:2892527-2892603
  hyper

SEQ ID NO: 36029 - DNA, 15 bp, Homo sapiens
  chr16:2892626-2892641
  hyper
cgactctgccaacag

SEQ ID NO: 36030 - DNA, 57 bp, Homo sapiens
  chr16:3016793-3016850
  hyper
aaggtgaggagtgggcggggaccaggggcctgggcgggcctcgaggtggggcctggc

SEQ ID NO: 36031 - DNA, 275 bp, Homo sapiens; identical to SEQ ID NO: 4311
  chr16:3017156-3017431
  hyper

SEQ ID NO: 36032 - DNA, 259 bp, Homo sapiens
  chr16:3068171-3068430
  hyper
tcctaggccgagtgtcgggacaggggcggaggcgggggtcttaaagaagcggtgacgtcactggaccaccgccccggaggaggggcagagaccctgtccctgacggcagcgggcgtgcgaatcccaggcttgtcagaggggggcgctggaggctggggtcgctgggcccgcctcgggctggcagacgtccagactcacccagggtgagggcgccaggcttagggtagaacagagcttgagactccgcttcaccacttaa

SEQ ID NO: 36033 - DNA, 73 bp, Homo sapiens
  chr16:3096869-3096942
  hyper
cagccaggcccccttcgaaccccgccggcggcccgggctggggcgcaccatgcggctgcggctccggcttctg

SEQ ID NO: 36034 - DNA, 248 bp, Homo sapiens
  chr16:3209117-3209365
  hyper
cttcccgcttccgtccggcttgcggcccctcgccttgcccggctacaggaaggactcgcctgcgcctcctgactggagccttccacctgggagttctgagtgcgcctaaggcctggcgctgaggcagtggaccccagatccgggacccgaaaggagggcaaacacctccaccgccgcgtctgcctctgcggacgtggccctagatcccgggtggccatggaacttggtctgggcgtgtagttttcctt

SEQ ID NO: 36035 - DNA, 119 bp, Homo sapiens
  chr16:3220438-3220557
  hyper
cgccccggaatctgggaggcggcgtgaccaggtgcccgggttccatccgctggggctgggcagcccccctgcccccgcccagtacagaggctcctgccgggggaggcgtccatcgcgtt

SEQ ID NO: 36036 - DNA, 303 bp, Homo sapiens
  chr16:3220590-3220893
  hyper
cggagactgagttggctgcggccaccgggtccccggacaccgtcttcattcactcccaccctcagtcaagcacctgtacccgcagtcctttcctaaaagaagaaaaacggccggtcgcgcgctgtccagagtactcagtcctggatccaggaggtggctggcggtgagctgatttccgggttcttaaacccgggcccggggcccaaggccccgcctggtggggtctcatcctgcagtttgagaaaccgaagaaggtaggagagggaggaagcgccggctttgcctgtgaaagattctttcatt

SEQ ID NO: 36037 - DNA, 560 bp, Homo sapiens; identical to SEQ ID NO: 1248
  chr16:3221141-3221701
  hyper

SEQ ID NO: 36038 - DNA, 453 bp, Homo sapiens
  chr16:3221786-3222239
  hyper
cgcagacccggtaaccccggcgcaggggaaaatacagcggggagccccaggctgcaggcctgaccctgagcatcccctaccaagcccagtgtggatgggctctgtctccaaggggctggttcaccagggtctccccgcagcgaccccagaattctgccaatcacttggggacggcgatgagctctatccacttcggaatcagccgatttgtgccggattggtggcaggtgtctgaaatgtcagcggaaatacacgcacgggaggctcgttggtctaggggtatgattctcgcttcgggtgcgagaggtcccgggttcaaatcccggacgagccctagaagtggttacttttcccttgtcattttagagaatatagagctagaaaatcggggaccgagcctgaagcctcaactaccagtcgcgttgctccgcttcaggtcggtccaggtctgtg

SEQ ID NO: 36039 - DNA, 232 bp, Homo sapiens
  chr16:3224952-3225184
  hyper
tcagccgaacagcagcggcaaaggctaagggtcctagaaaggaacgggaaaccgtcacctgcccaggtgggacgcgaggcaaggaacccagcgcaggaggccgctgggtcacggaggtttcctgtctgcttcccgccgtcactgccggccgcctcccaccttctcccggccccctgcaacccagcccaccccagcccacctccccctggtggggacacggttttctttccgg

SEQ ID NO: 36040 - DNA, 148 bp, Homo sapiens
  chr16:3225459-3225607
  hyper
acactcaggaggtgccggcctgtggggcgtccgcgggtgggcctctgacgcagagaaagacccagatccagctacctcgggggcctcctgctgcgcctcgcctttggggcaggcctgagggcaacgcttactgcggagcaactgtgtt

SEQ ID NO: 36041 - DNA, 17 bp, Homo sapiens
  chr16:3232618-3232635
  hyper
ttttggaccaaaaaccg

SEQ ID NO: 36042 - DNA, 322 bp, Homo sapiens
  chr16:3232695-3233017
  hyper
accaacgagccacacgccccgtagcctccggcttgtctttgtggccttcgtggagtcctcgtggccagaggtggggacccagcagagcagagctaggaggagactccgatttcctgaagtctggaagagacaagttcaagcgcgggtggacgcggagggagccctgagcccccgcttctccctgcgccgcacaaaatggggagcatcccctgtgcccccacaatccggggccccccgggccctcgcccgcctccgcctctcagccctgggctggggatccgcgcgtcacgccgcgtcgcgtagtgaggagctccagctccgg

SEQ ID NO: 36043 - DNA, 133 bp, Homo sapiens; identical to SEQ ID NO: 1252
  chr16:3233198-3233331
  hyper

SEQ ID NO: 36044 - DNA, 670 bp, Homo sapiens; identical to SEQ ID NO: 1253
  chr16:3233434-3234104
  hyper

SEQ ID NO: 36045 - DNA, 257 bp, Homo sapiens
  chr16:3234195-3234452
  hyper
caacgagccgccgcttcccctctgttttgttgttgttgttgttgttttttgacacgtccttccgcccctgacgcagagcgagactctctccatcgccccaatagctcagtccttagcgcgcgcacctgcgaatctgggcttttgggttcgcggccaccctcagatttgcgaggcaggctttactgctgctggataaaccaaccaggttatccgttgaggttatgagctggtggtttcaatgtcgtcctgatatgaaa

SEQ ID NO: 36046 - DNA, 201 bp, Homo sapiens
  chr16:3237826-3238027
  hyper
tatatcataccagcacgacattgaaaccaccagctcataacctcagcgggtaaccttgttggtttacccagcaggagtaaagcctgcctcggaaatctgagggtggccgcgaacccacaagtcaagattcgcaggtgcgcgcgctaaggactgagctattggggcgatggagagagtctcgctctgcgtcagggacggaag

SEQ ID NO: 36047 - DNA, 1500 bp, Homo sapiens
  chr16:3238147-3239647
  hyper
caaatcccggacgagcccccttttccttctcttttttcccatttcgcattttcagcaaggacaggagactaggaaggcggagggaggctgctattggcagggcctcagtggagacctcccggggtcccgggacgcagacggacgggcctgaatcgctcgccttggtgaaatgggatccagcgctgccaactgcggcaactgcggttaaaggagacgaccccgtgcagcaggaggaggttatttagaataaggaagaatgcgccgggctcattggtcgctacaggggcataaattttttctaggattccagagtatggctgctccagtcccaggtgagccctcctccgcttaaaattccagtttattcggagaaggggagaataccggaagcgggggagaagggaggggagtgagtgagaggagggaggcggggaagaccgggcatccgcgggcagcacttcagtcggccctggcggggtgggggtctcggcccttgtccccacccccagaccccggggccttcccactgagagcgagggaattcgcggctttgatctggaggggacagggagccccttttagcccagatctgctggattctcgggagtcaggtgaaatctggatacagggaagggcagagtgacagtaaagggtgccccggaaccgatgcccgacgcctgctgccccacggccttcattcttgctcctcctcacgtcctggggactggaggtcccgccagctccccccagtgaagggcaagggggcgcatcgcagaatcgcccctggtgcgcagcgtagttggtggcctaagccgtcttctccgagagctcagccatcctgggcacttgaggccaggcaggcgctgcggggctggttcagtcgatggagaaaagagactctcagcgtcagcctttagggttcgaggcccacgtgggaaactcgctttctgggttttggcttccctggggagaagggaggaccggagccggagaagcgtgaggtgcggcgaggtagggtgcctggtagctggtgtctcgtgcactccgtcaggcctttattgaacacccattggtgccacgctgagggactgcagcgtttccaaggcgagcttgcagtgatcgaggctcgcagaccctcagcgcagccgctgcctgctattgggaggttcccatgtcctgcggaagctggagctcctcactgcgcgcctcggagacgccgaatccccaactcaaggccgagtggcggtggcgggcgaggacccagggcccttctggattgtggtagcgccagggctgctccccattttgtgcgtcgcggaggaggggccggggctctgggcttccgccacacccatcctcacttgaaattgccccttccaggcgggtctgaaataagattctactcactgggtcctgctgggtccgccccagccgcccccaggatgctaggacgcccacaaagataaccttaatgcgtaaatcgtgtggctcgttggtcta

SEQ ID NO: 36048 - DNA, 141 bp, Homo sapiens
  chr16:3239707-3239848
  hyper
cttttggtgcagggtaaaagtcgtttcctgctcttttttagattcggctcgacttacagacctcagcgcaggacgtggacgccctgcaaaggtaatttgtacaaaggtctcaagctatgttgacgccgcctactatcccac

SEQ ID NO: 36049 - DNA, 35 bp, Homo sapiens
  chr16:3241024-3241059
  hyper
cagtaggttacagtgcggagcgacacctgcgagga

SEQ ID NO: 36050 - DNA, 208 bp, Homo sapiens
  chr16:3241501-3241709
  hyper
cccggctagctcagtcggtagagcatgggactcttaatctcagggtcgtgggttcgagccccacgttgggcgacttgttttcttccttgctaccttggagttctggaaacagccagcatttaatgaacactaccaggtgccacatcgcgctctgtgatggtatcccctcaatgattgaattttggtctccgcgcgctcccagcagcaa

SEQ ID NO: 36051 - DNA, 37 bp, Homo sapiens
  chr16:3355197-3355234
  hyper
gaggcgacccttacccggcgaggctcccgggaccaaa

SEQ ID NO: 36052 - DNA, 603 bp, Homo sapiens
  chr16:3355250-3355853
  hyper
cgcagaacagacgcggcagtgcgacgcctcccccactggggacacgagacagcgacagccacgcggtgagccggtacaaggccctctaggcttcagcgggtctggatactcggtggcattaacccttccctaccgccggggaagacagcagtttctctggcgaggaagtaggccgggctcaggcgccttagccagagggcgggcctgcgccaccctcggaaagcgtcacttccacttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgaggtaaccgagaagcggcttcccctatggcttcgaccctggagccgctggagcggcggcggccgcagggaggcagccattttccgtaggcggtggccgcggcgcttccgggccgcgcggctggagcctgaggcggggccaccgtcgggcacgagaaaccattctctccccgcttttcgcagctgtatcccagaggcgcggctgaagctcgct

SEQ ID NO: 36053 - DNA, 18 bp, Homo sapiens
  chr16:3551488-3551506
  hyper
aaccgaacagcaggccgg

SEQ ID NO: 36054 - DNA, 160 bp, Homo sapiens
  chr16:4363920-4364080
  hyper
ctgcctgcctgaggtcggatgcggtcggctgcagggcagggctccgggctgaagcgcagcgattcccgccgccgtgagggggcgctctgcgggcctcggcctcggcccttccggacgcccgcacaggtcgccggacccagagagtcggcccttaatagcc

SEQ ID NO: 36055 - DNA, 505 bp, Homo sapiens
  chr16:4377915-4378420
  hyper
acccctgggcccttgcgtgtgggggcgctgccctgggcgcatcccaggctgagtgctcgagagacgcggccctgggctctgtgcaccctccacgctgcgctgtcccaccggggggaaactgaggaacggaaggctccaccaggaggcgcagaggggcgtggggccggcgggccttgcgctgcgcccggggagcatccacggggtgcccccacctgaccgagagccggctcctgccctcgggaccccgcagtaattagcacccaggcctctggctgagcttgtccagagccaggctgtcggccttacgctggggagagccacggccacccgctcatgggcactcactcagggttccctggttgcaggcccgctgctccccgctctgggcctccgaggctttcaggagagcaggaacctagctctcgcctgcccccttcacccagccgggaacaaaagcacagagcagagcccagaactggctgctgccggtcggggcgggggtgga

SEQ ID NO: 36056 - DNA, 186 bp, Homo sapiens
  chr16:4587903-4588089
  hyper
ccggggatgcgcggccgagcgccacatcccgactccacacgtcggcgagccgggcgcgggtgcaggacactgctgggctccgggacggccaaggtcacccgcggggctcggcaggggctggctcggccacggggctcctcctcgaccccctttccttgagaaaacaactcccacccctcccctccc

SEQ ID NO: 36057 - DNA, 453 bp, Homo sapiens
  chr16:4588308-4588761
  hyper
cgccggccccgctttacctccagaagcccggtgcccgaggccggccgaaagcggagaggggcccgggtccggacaggcgccggcagaacaagaccctcagccccgcgcggctttgcgcgcacaacgaaaccccccaacccaccgcccaccccaccgcccagaggcttctaggacttgtagtccgcccggtcaccccccccaccacaacccgctctgagaggctggggactacggtgcccggcatgcaccgcccaggcgccgcgggcgggggcggggagggggcgccacggtccgaggtcacgccccgacctgaggagagctggcgcccagacccttcccccggggaggagggctcccgcgcgaagccgtctccgaatgcgtccagtcgactcaccgtccccgcagccctggggcagcggccgcaacagcaggaccgaacgcctcggcagctgg

SEQ ID NO: 36058 - DNA, 507 bp, Homo sapiens
  chr16:5037518-5038025
  hyper
cccccccaccacggccgctcactgccgctctgcccccaggcctacgagaagcgtttccccacgtgcccacagatcccagtcttcctgggcagcgaggtcttgcgcgagtcccgcagcccggacggggctgtgcacgtggtggagcggagctgccggctgcgcgtggacgccccgcggctgctgcggaaggtgggcggccctggggctggggggcggaggaggggacctgttgcggaggtgcgggagggctgggcgcgggagctggggaccagggcggcggggtccaggaggtggagcaggggcgtgtgagttgatatttggatggaggttccaggatgagggtggcgggaccagggcccaggaggggcgagggctggaaggctgggctggggagtagcgggaactgggcggggttcgcggggccagggccggagctgggtggtgaagatgggttggcggcagggcggaagtcgggggttggtgtcctgggtccgggctgggtgggcg

SEQ ID NO: 36059 - DNA, 44 bp, Homo sapiens
  chr16:6069508-6069552
  hyper
gcggtggggcgggggcgctctgccagccccgggaacagcagagg

SEQ ID NO: 36060 - DNA, 61 bp, Homo sapiens
  chr16:6070141-6070202
  hyper
tgtgtggaaagatctcgaggcgtgtccccccctacccccaggaggccgagaccctgagccc

SEQ ID NO: 36061 - DNA, 289 bp, Homo sapiens
  chr16:6533425-6533714
  hyper
cgtttgctgttgcctcggacttctcccgtgctgtgttttcccggtgaggaaacaggaggcactttgcagccgacaatgaaatcttggcagctaattgcagtcgtgggagatgcccttcaggtacggcgagcgaagaagactctaaaacactgtcagggaaggagagaaagagggagagagggagggagggaagggagagaccaggcagcttctgcagaggcttcctgaagcccactgactccgcgggagggggttgcagagggacgggggcgggcgacagggggaggag

SEQ ID NO: 36062 - DNA, 33 bp, Homo sapiens
  chr16:7354091-7354124
  hyper
ttggaggcagaggaacgccgggatctagcacat

SEQ ID NO: 36063 - DNA, 24 bp, Homo sapiens
  chr16:7354634-7354658
  hyper
gctctctgtggagcccgggcacct

SEQ ID NO: 36064 - DNA, 75 bp, Homo sapiens
  chr16:10133426-10133501
  hyper
gggcagcgaggactgcgcagcagcgggagggaccggtggcgttgggcgcggggagggtctgcgcggggagggtcc

SEQ ID NO: 36065 - DNA, 64 bp, Homo sapiens
  chr16:10133502-10133566
  hyper
cacccgggagcgggggcggctgctcgctctactcctgggaggggcctttcgaaggaccaggtgc

SEQ ID NO: 36066 - DNA, 726 bp, Homo sapiens
  chr16:10274299-10275025
  hyper
agtgagaggcagggccgcggtgagcaaggcgaccagaagaaagggattaccaacttggcttcctgctctaggagccaggcatggaactcagcagcaggataggctgctgggatcacggactccattccgagtccccgacgccatccacatccctcgatccatctctaactctatccacaactccaattcgagctaattctccatcccccagccccttctcgcatccagcttcctcatcccctgtctccaggcacttccccatccccatctctgtccatatcccccaccgcattccccaagttcgccgcgggccacagaccctaagcgccgcgcgtgttctgtaccccaccaagctcctaggtgcacagaataaaccctccatccaacccctcccacctgggatagagaggaccaagttatcaaccccgccccctgctggcgcggagcgaactacagaccccgcagggcgtgcggaggcggcacccagaccccgcgtcccagcttgagagctcagctagttggctgaccccgccccctacgagcccgtcgtgtgcaccacacactttgctctacgcccagccccaactacagacccggctcctctcagtcagagtacaccccaagtgcttgggagtgaggacgctgcctggtgggcccaggctccgctgtgcctggggaacttggggctcgccccacctcgagccaaggggccgtggagagtccttc

SEQ ID NO: 36067 - DNA, 250 bp, Homo sapiens
  chr16:10275248-10275498
  hyper
ctagcctttctactgcgggcgctgttgccaagtcctaggtgcacgtgggcagtgggccgcacacgctcataggcacgcgcgcttttctgcgcacttcctcagactgctgtagcggtgcccacggccagccggagtcctcacatgtcctcaggtggtgcacacgcatgaactgcggcaggtgcacagccctgcgtacctgcaaataccagcacggtcgtgcacgcgtgccctgacgcgcgcctctcgggac

SEQ ID NO: 36068 - DNA, 147 bp, Homo sapiens
  chr16:10275801-10275948
  hyper
agccaccgggtttagcgggttcccgcatgctgcggccccagcgcgctcccctggctgtcccgcgctgtccgcatcgcccccacggggggcggctatcccagccggaggctctgcagcagggctctaacggggcggaggagagaagga

SEQ ID NO: 36069 - DNA, 30 bp, Homo sapiens
  chr16:10276341-10276371
  hyper
agggggagggaaggacgcgggctcccgcgg

SEQ ID NO: 36070 - DNA, 202 bp, Homo sapiens; identical to SEQ ID NO: 4323
  chr16:10276597-10276799
  hyper

SEQ ID NO: 36071 - DNA, 251 bp, Homo sapiens; identical to SEQ ID NO: 4324
  chr16:10276800-10277051
  hyper

SEQ ID NO: 36072 - DNA, 334 bp, Homo sapiens
  chr16:10277071-10277405
  hyper
cgctcaagcccaagaggcttcgagctccggcgggcgaaagcgtctcctgcccgcagcctctctcctaggtgggtcgagacagaccccgcagtccctcggcggcgacgcggagcgcggccacccgttccgagagcgcacggcggcaaataaggccaggataggtggctggctggcgacgggggcgcctgcggcggcgcgcgctgctgtccgtggtgttggaaccacgctctccgcccgctcccgggcgtctggtgcggctgaagaatcaattattcagatctctgctaccgcttcctcctcccccagtgcctcgcgctgggtacagttatccccc

SEQ ID NO: 36073 - DNA, 239 bp, Homo sapiens
  chr16:10480064-10480303
  hyper
cggccccggaggcctcggagcgccgggcctaccggacgtttgcggcgaagctgccctgactgaaaagcgtccgcggggccgtctgacaggtccgggaagaggcccctgaggggcggacgggcgcgtctccaccgttttcgcagagggatactggtgaagcgggagtggtgtgcggcctcaggtccgggcggcactggggttagggactgcggagggaagtggtgcgtgttttttgtcct

SEQ ID NO: 36074 - DNA, 69 bp, Homo sapiens
  chr16:12897833-12897902
  hyper
tctgggatcgacctgcgcgcctggcgagtggagactgtctagggcacgcgtgggcggggataaggcttt

SEQ ID NO: 36075 - DNA, 1178 bp, Homo sapiens
  chr16:12994459-12995637
  hyper
gaaacacagaggagacgggaggctggaagctgaggaagcaaggcagagctctgcagcccccggtgaggatttccggggggatccgtggggacaggggccagccagctccagagaccgatgcgcgggctccaggtccgggagggtggctgaggctgggtgcccaggccttgcgctgcgccagatccgggagcgcagaggcggcgccgcggtgttccctcctgtggagcgcagaaaacgctgcgggggcgaagagggacagaaagcggcaggttcgagaggctgggggacttccaaggaaagaccttccaggacacgccatagcctcggccttgttcggctgtcccctcttacccccgaccttctttgattcgttcatcccgagcccctctcccccggagggtgcttatccctggctcaggggcttgccacctgtccttcccagctccgcctgggtccttgcttgggcccagagagttgagccatgcgggttgcgctcagggctggagggcgcagccgggaagggcaaggaggccccgcacgcctgggaggggcgatcctgaccagactgcacccagtctgtcttggagtgaaagccatttagtctgtccccatcctctccgagtcatccttcccctgatgcacagatttcggccgccgctcctgcacacgcaccggtgaaaaagctacgagctgagccgcctctgcgctctggacagggctgagccgcgcctcctacccagagagggcgcgggaggtcctgccgcggttttccacctgcctggaaatccgagcggctcctctagcctcggctgctgccgagctcgctcctccccgtccgctcgcctggctcagctctgcacgccccccagctagctcccgctctagtcacctcttccccgcgcccccgcccctctagagctcgcgcccgcccccccccacccgcgcctcctctgcccgccctcctccccctcccccttccctcctgccctcccttcattccacaagtgtcgcttcgctctcttcagcgcacttggcgagctggtgaggtgagagggatactgcgagagggctaggggcggccagtccggggctgccggccaaggctaggcgctgccagcccgattctcctctgctctccacccccgcctcacccagtggccggccggacctgcaccccg

SEQ ID NO: 36076 - DNA, 1630 bp, Homo sapiens
  chr16:12996073-12997703
  hyper
cggagaggccagcgagggcgctgaggcatcggacgcgcccccgacccgggcgcccacgccggacttctgccggggctacttcgatgtcatgggccagtgggacccgccgttcaactgcagctcgggcgacttcatcttctgctgcgggacttgtggcttccggttctgctgcacgtttaagaagcggcgactgaaccaaagcacctgcaccaactacgacacgccgctctggctcaacaccggcaagccccccgcccgcaaggacgaccccttgcacgaccccaccaaggacaagaccaacctgatcgtctacatcatctgcggggtggtggccgtcatggtgctcgtgggcatcttcaccaagctggggctggagaaagcgcaccggccccaaagggagcacatgtccaggtgggctgcctccccttcgccctcccctcggggcttcgctctccctgctctctcctccccaccttcccccaggcaatggcgctccccacggtccccgctccccgcatcccagcctctccgctgggggatgtcaccgggaagccaacttcggcttggaacacggagaaggggcgctgggctcagcacaggtgtgggtctgagcgtgttcgtgtgtgtgtgagcgtgtgtgtgtgtgtgtgtgactctgctccctcaccctctggccgcctcctcccgctggtgactgaggcggacttgagacacgtagcctgggagcccgtggccccgaaatcttcgggtttggggagagggtccatggcacccctcggattccaggtgctagctttttggtaaacaggggcaggcgagcccgaaaggggaggggggcgtgtgtgagcccgagcgcgcgtgtgtgaaggagggagggtcagagtgagtgccgcctgcaactcgtacgactcgcgaaaaggagacgagggaggtggagtgaggggagggcgagaacaaaagccttgcttggagcggccgcctcgctttcccagagcttcgccgtccctggatttgggacctcagctgcccccgcccctttacccacctcatccctttctctggccaccacttctccctgcccggggccgtggccatcgctgcagattgagccccttgccctggctggcgtggactccgggggcccgagccccctcctcgcgcgccctcacttccaagcaccctgatttcgtcaactttcgggtttgccttgttcattatgcaagccccagcaccagctagttccagcagatgggagaaggctttgggggattaatggagctatttgccttttgctttttttaaattttttttattttaagtgtctaaatcgattcgcaaactccgtaactttggaggcggaggacgcagccactaggagcactaagcccccggccgcgggagaggctgggggttggcgtgaggtccgggcgggcggggtggaaggagtgactagcggcctgcgaacagctggatggttggggcataagctttaactgtcccctttcagagtctgggcaacgaagtcgctgtatttttctctaccctctccccaccccttcttccgcgccccctctgccgggggcctgtgtgtgtgcgcgcgtgtgtgcacgcgctccgtgtgatgcctaaa

SEQ ID NO: 36077 - DNA, 764 bp, Homo sapiens
  chr16:15528335-15529099
  hyper
ccccttctgggtacccgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaagtgagtactggggcggggggcggggggccggggacagctggggatccatgcgcctgcgcgggtggtcgcgggagcgcgaggaacgccagcagtggacccagggaagcgcccccgcagcggggctggcagctcagggggatacgcagctctgcgcagcgacgcgctctccccgcgaacaaaagggggggaccctccgggctgagcctcactgggagggttgggagatggccaggcagctaaggcaggagcctgggctcgacttaggagtcccggatccgtcagctcgcagctggtcctgtgaagtcgggtctctcccacagcccagggaggaggatcctctctccgcctgggatgcgccagggcgctggagacgcgggaccgtcctggaaagcgcccacgtccctggagaggggggagtgtctgctggttttccgcttgctttcctaccccctgcgtgaggtttcggagcgcacctgaaattcc

SEQ ID NO: 36078 - DNA, 484 bp, Homo sapiens
  chr16:15950853-15951337
  hyper
acgcacctcccaggccggagcgtccaaatctccctgcgcgtcctcggacgcctctctttatagacccggagctgcccgcggctgggaaaggggaggaggccgaaggggtggagttggggagggtccctcgcggccccctcgccgcgccccctgcagggcgcacccccggcgggagcgcaaggagctggggcgctcgggacaagggtgcacggaacaggtgcgcaccgcacaagggcgcacggaacaggtgcgcacagggacgggagtctcagccccggccccaggcggtcgcagacgctccggatccctagagaaagggggtcgagcaggcagtgtctgtgcgggatgcttgagaacgtcttccctgagtcggttccggccgcaaaggctttaacctcttcctccccgtgtcggggctgtggtggatctgacttgacatctcccaccccacttcccattttattggcatcgcactgtctggaaa

SEQ ID NO: 36079 - DNA, 80 bp, Homo sapiens
  chr16:15952285-15952365
  hyper
tgcaggaattcccagcgccgcataccagctctgggctgccggctccccctgactaaatatggtgccgagtggccttcctg

SEQ ID NO: 36080 - DNA, 30 bp, Homo sapiens
  chr16:19422447-19422477
  hyper
aagaataatcgcacccgtttctcaggtgct

SEQ ID NO: 36081 - DNA, 462 bp, Homo sapiens
  chr16:19567065-19567527
  hyper
ttggtaaggaagcagcggcgggtgggctttggagaggggctgtccttacttgtgatggggtcggcctgggtctgagagtgtgaattcctctctgtcgggttctggtggtcgaccggccacccccaagttgtcttgaccgtagaatccctggccgctaccgcggtccagcggagcaatctgaagccagactggcgggttcttggttctctccccgtctgctgcctctctgcgccttccacgggcccctgtccattcattccctaaagaaaacttgagtttccaggcttccgcgtccccagaagttggcgcgggttctggggtcgctggatgagggtaatggtggactcagcttttaaagtctggacgagtcgggagatctggctgttggtcagtttcctcagctcctctgttcacctggagacttgcttttctcatctgtaaaatggccgccattcatcctat

SEQ ID NO: 36082 - DNA, 251 bp, Homo sapiens
  chr16:20084648-20084899
  hyper
aacttcctttccccccgtgtggaaatatccatagttgcccttaaagcttaaactttttccgagggggcgccagggaacgcacgggggaggacgggggattctgggtagggttgcccggcacttggggttcctggcttccctccctctcccccacgcccctcacctggtaaaccgaggcacagcaagaggctgtagtagaccacgggcacgaaacccaagccgcaggccgagccgggggaccaccaagacag

SEQ ID NO: 36083 - DNA, 118 bp, Homo sapiens
  chr16:20085303-20085421
  hyper
cggagtgtgtgtggggtgggagggatgcggaagaggagggggtcccagccgcctcgcttggctccactttcaggggagaagatgcagttagacctgggagccccgaaggaagaccgga

SEQ ID NO: 36084 - DNA, 372 bp, Homo sapiens
  chr16:21294924-21295296
  hyper
acggatgaagtatctcggaagccggagaagggtggtctggggctcttgggagcatgcgcggggtggggcggtggggggactgaggtggcgctcccggctcctccgcgcgcccccggcaccttccgcgcgtccccggctccccacactccgtccccggctccccacactcccaccccggtctgccccgggcgcccccggttccccacctcctggtgtgcctctggcgggtccgcgcaggatcaggctacagactcgcccgcgggcggctgcgcggcgggccgttggggagggtgttgggatgaggagccccaaccagatggacgcgcaccccgcagcggcggaggcggcggcgaggcttgagcagtgagtgct

SEQ ID NO: 36085 - DNA, 34 bp, Homo sapiens
  chr16:21295340-21295374
  hyper
cgctggccgctgctccagacgccagggggcccac

SEQ ID NO: 36086 - DNA, 116 bp, Homo sapiens
  chr16:21675345-21675461
  hyper
ataggaagtcccaggcggggactgtgacccccgccgctgccctggctgagttcccacctgggccgctgcagggaggaggtcgcagagctgccggctggcgccgccccgccgctctc

SEQ ID NO: 36087 - DNA, 386 bp, Homo sapiens
  chr16:21831571-21831957
  hyper
agctttggtcccagacgcgcagaaggaagcggcctgaatcttacccagtcctcgacgcgcccagcgtcttgactgcagaggacgaagcggccgcatctcccgacaaacaacgtgtgaagcagcggtgccgccattgggccgaactaacgcgaccgctgcgcctcaggccggatgcccagctccttccagccacagcctctgtcccggaagttgcgcgtgccagcgcaaccttcagacaatcaggggccccgtgtggggagggcgtatgctctcggcgggctagagcgccgctaaaacgcgctcttcgttctacttggaggacttgttccagccagcgtgagtgcgcgagtgtaaggagagacgggaaggatcggctccatccagcc

SEQ ID NO: 36088 - DNA, 195 bp, Homo sapiens
  chr16:22173697-22173892
  hyper
gaatgcaggtgctcccgcgccgggagtgggcgggcagaagagcgggcggggggcggtccggatgcctcgtcccgccccgccccgcccctttctgccctcctcgggagaaggaggtggcccggtggccctggcggcgcggagactggcgcagcgcggggagcacgcagcgccgcgggagcccgggccaggtgagcg

SEQ ID NO: 36089 - DNA, 377 bp, Homo sapiens; identical to SEQ ID NO: 12422
  chr16:22203596-22203973
  hyper

SEQ ID NO: 36090 - DNA, 604 bp, Homo sapiens
  chr16:22824473-22825077
  hyper
tctggacatggtcaccgagaactgtcctgtaggcattcacttaggaatcattcgaagtggaattgctcctggatacgttctccttgtactctgtttcctcctcctagtgtctctgtgtgaagaagccctcctcactcagccctcggcgaccctctggtaccctggacagctccccggggagcagtctaccgctaggcggcggctgctaagagaggaaccctcctgacgcggagtctgccgctccggggctcgctctccggcaggcccggggagaggtggggtgacaatgggttggggtgcgcgcgtgcctcataggtgcgagacagagcgagccgccggggtgtgagtcagcgcgctgggggctaagaagctgggtgaatagtcacggaatctcactcacgctcggctcctccacccatcccgtctacagcgcgtgtcccagtccagggcgtgcgtgcgctcggtgtccgattccgggctgtgtgtgtccatttggcgagatgtcgagagcggggggagtgtccttgtcggtgtatctgggcccaggttaggggacttctcctccccacccccgcgtgggtgtgggggtgtgtccgggctaggg

SEQ ID NO: 36091 - DNA, 313 bp, Homo sapiens
  chr16:22825157-22825470
  hyper
cgtctgggtctgtctggtctgcatgtcggcgcgatctcgacctggattcgtgtccctggatgtcgagaggccagcgtggtgggggtgtccagcctcccggaggagtactatgccttgacaccttcgtttcaccgccccaaagctggcctggggctccgtagggagtggcctgcatggggagggcccgcgtgctgtgtttctgggaggggtaagagagtgggggcgcagggggcgggccaggtccctgggcgcggcgcgggctcgggggacccgcgcggctgacgtcaggccactccttaaatagagccggcag

SEQ ID NO: 36092 - DNA, 140 bp, Homo sapiens
  chr16:22825885-22826025
  hyper
ggtgccccctcggaaaccatgacccccggcgcgggcccatggagccatggcctatagggtcctgggccgcgcggggccacctcagccgcggagggcgcgcaggctgctcttcgccttcacgctctcgctctcctgcactt

SEQ ID NO: 36093 - DNA, 75 bp, Homo sapiens
  chr16:22826252-22826327
  hyper
aagctgggtaccaagcggttgccccaagccctcattgtgggcgtgaagaaggggggcacccgggccgtgctggag

SEQ ID NO: 36094 - DNA, 122 bp, Homo sapiens
  chr16:23313400-23313522
  hyper
gtatcgctggtgtcccgaggtggggagggagaatgcggagcgcgtgcgtgcggggggcgtccagtgtccctgaacctggcgtgtgggggctggagcttattgggaggcgagggaggtggcca

SEQ ID NO: 36095 - DNA, 57 bp, Homo sapiens
  chr16:23313779-23313836
  hyper
cgcacccggtctcccgcgcgctgcccggagtccctgcgcgcgcgccttctcctgccc

SEQ ID NO: 36096 - DNA, 140 bp, Homo sapiens
  chr16:23706411-23706551
  hyper
cgcgatccaggtccgggttttctacgtactgagcagcagcaagggccaaagcatcactctccagcccggaccttcccactcaccctccctgaaccgcaatgcaactcacctcctgcaaggaggcccggcagagctccagg

SEQ ID NO: 36097 - DNA, 104 bp, Homo sapiens
  chr16:23765896-23766000
  hyper
tccccataggccacccgccttccagcagggcgtggtctctacagaggaggtcaggtctcccaggcttcctcagcgtcgacgccggggagcgccctggggttggg

SEQ ID NO: 36098 - DNA, 30 bp, Homo sapiens
  chr16:23766456-23766486
  hyper
cggctgcggaggggacggggcgaacccagg

SEQ ID NO: 36099 - DNA, 262 bp, Homo sapiens
  chr16:23846792-23847054
  hyper
cctacctctgcagaacgtgtgtgtgtatgtgtgtgtaagtgtgtgcggccacaagcctttccgaatgagtgacagcgggagcccatccctccaggagacgcgtgcagaatgaccaatgggatggatgggggtggatgggtaccagtctccgcagaggccggggtggaattcgctgcgccccaccccttccacccgctccccttcgccccgtaggtctttccactctcgctcctcccctgggcacatctcctgaacgcagccc

SEQ ID NO: 36100 - DNA, 15 bp, Homo sapiens
  chr16:23847310-23847325
  hyper
cggcagcagctgggc

SEQ ID NO: 36101 - DNA, 186 bp, Homo sapiens; identical to SEQ ID NO: 1261
  chr16:23847326-23847512
  hyper

SEQ ID NO: 36102 - DNA, 28 bp, Homo sapiens
  chr16:23847788-23847816
  hyper
ggactcccggctccggaccctgctgccc

SEQ ID NO: 36103 - DNA, 58 bp, Homo sapiens; identical to SEQ ID NO: 1263
  chr16:23847817-23847875
  hyper

SEQ ID NO: 36104 - DNA, 70 bp, Homo sapiens; identical to SEQ ID NO: 1264
  chr16:23847933-23848003
  hyper

SEQ ID NO: 36105 - DNA, 561 bp, Homo sapiens
  chr16:23848004-23848565
  hyper
cctcgggtgctctccgacccggggttccctatctctccgcctgcttccgggcgcgaggagccctcgccccccaccccttgtttccggggggggcggcgccctgggtgtccttctctatctccctgcgggcatgggacatcctttctcactcctctgtgcctccgggcagcgccctgtgttatctcccattgcccctccccgagggcctgggttcccctttccactcctcggtcacatcactgcgggcccctttcttccccagtccctccagtagtggggcatcctttcctccttcccagtccccctcccagaggacaccaccgccgcggggtcactctcgccctccctctgaatgcgtctttatctcttctcttttcccgagggtgctcggggcatctatgggtacatctgtcgcctgccttcagcccctaccccgacggaaacgctccccactatcccgccacctggtggtcgcagcctcctctcttctgcaggagtgaaggcagatgggggttacagccgagctcccacctacccccacaaaggcggaagactcttggg

SEQ ID NO: 36106 - DNA, 120 bp, Homo sapiens; identical to SEQ ID NO: 4336
  chr16:24267025-24267145
  hyper

SEQ ID NO: 36107 - DNA, 379 bp, Homo sapiens
  chr16:24267220-24267599
  hyper
cgagccggctggctgacccgggaaggaacgggggaagggcggggtgagggaagaaagaccctttagcaccccgggtttctagcccgggcggcggtgtgcagctgcatgagggagctgtcccttcggcaccacggaccttaaagcctaggcgttaagacgacggaggcggggcaacaggcggggagctgtcccttcagcaccacggaccttggcgcccccagggaaaccagccggcccccgccccaggactctgtcttttctccagtttgagcgggggtgtcgggagcaggcggagagctttcctgcgaggctgtggaagcagtgaacactcttctcagcggctcgcctcccagcagtgctattttttgccatccgccct

SEQ ID NO: 36108 - DNA, 153 bp, Homo sapiens
  chr16:24621912-24622065
  hyper
ggctctggggagctgcggctctcgggccctgccaaacagacgcagccttcctaaggagcagcgctgcgctggctctgctggggtggaaggagcttctccttcgctgtcctccctctcccttcccagcccatcttattccgagcctctcctctc

SEQ ID NO: 36109 - DNA, 1328 bp, Homo sapiens
  chr16:25702795-25704123
  hyper
agagaagatggggggcggggggcggtggctggaaagatggaagttgggatgggaaagcggttgtagaaaaggattcactcctggaccgaaggcaggaggatatcccgggcgagagaagggagggtcggggatgggctgagttggagtcccagaggaaaagcggaagcgagagcttcgtcacccgctgtcttccagctcccggtgcgcggcaccggaggcaggcgttgggctttacctctctaaaagtactggggcaaaggaatggagaacacggcgtcccgagctcccaagggaggggagtaaacgaggtggggtggggaacaccccaagtgcgtgcgtgctgggggctggggggcacgatctccgttctcccgggtgccccagccctagcgcacgcctccgctcccccgcccccttcgcaggcgcgcgcgaggcgcaccccccttccctcggcggcgccgggcgcgcgcccggccccctcctcctcccctccgcgcctctcctctctcccggcagaaagttagcagcggggaaggaactccgggctgcaacagcgcgcggcggcggcggcagaggctgaagcagaagccgcggcggagccggggaagcgggggcgctgcagacggagcaggtgccgccggcgggtccgcgcgcccccctcggtccccttgcctgaggctgaggggggggcggtggtgggggggccacccggactcggcgggcagcgtggggcggggggccatgcggccgggctcccccctggcgcagcgggacagcggccagggccgggggcgcagcggcgtcgcttcatgcagccggggcggctgggcagcggcggcggcggcggcggcggcggcggcggcgggggcggcggctgaaaccatgtccgggcagcgccgggggctgccgccgccgccgccgccgccgcgagccgggagccgcgatggcccggtggcccgcacctcctccgcctccgcctccgcctccacctctggccgcgccgccgccgcccggcgcctctgctaaggggccgccggcgcgcaagctgctttttatgtgcaccttgtccctgtctgtcacctacctgtgctacagcctcctgggcggctcgggctccctgcaattccctctggcgctgcaggagtcgccgggcgccgccgccgagcccccgccgagcccgccgccaccctctctgctgcctacccccgtgcgcctcggcgccccctcgcagccgcccgcgccgccgccgctggacaacgcgagccacggggagccgcccgagcccccagagcagccagccgcccccgggaccgacggctgggggctgc

SEQ ID NO: 36110 - DNA, 255 bp, Homo sapiens; identical to SEQ ID NO: 4339
  chr16:25704389-25704644
  hyper

SEQ ID NO: 36111 - DNA, 43 bp, Homo sapiens
  chr16:28073999-28074042
  hyper
gggcatctagtgccccgcgaaaggaagaggaggagggggcgag

SEQ ID NO: 36112 - DNA, 179 bp, Homo sapiens
  chr16:28074076-28074255
  hyper
cgcccctccgaccggcagcgggggtgggcgccttcccggggcgcgggagcgtccccaaagccgcggggcgtccgcagcgggtaggagctctgccttgcacctctccacggcggggcgtcccgcacgtccccccatgctggtccccggccccggaacggcgcgcgccccctgccccggaa

SEQ ID NO: 36113 - DNA, 520 bp, Homo sapiens
  chr16:28074417-28074937
  hyper
cgcacgagtaccagatgccggtgtggaaattcctgaagaggaagcggtcgtcgccggtctcccagctgtagagcgcgccgccaggggggccgttccccgaggcggtggcggcggcggcggcggcggcgggggcggcggtgccgttggccgtggcgttggcgcccgagttggggcagttggcgcgcccgccctggccgcagcccggcttggggacccgctgcgtgccctggcaccagtgcgtggtgaggaaagcggtggtggcgaacagcagcgccagcaggttcagggccacggccaggagcgctcggccgcggcggctagtcttcatgccgcccgcgccgccgggacgggactgcaccgccggggagctccgcgcgcgaagttggcagctggcgccccgcgtcagcggccgctgcccgccgcgccccggggctcgggtgcctgagatcggcggcggcggacgcggcgcgggcccatgccccccccaaccccggggtgggggcgcggcgcggggggcgtg

SEQ ID NO: 36114 - DNA, 432 bp, Homo sapiens
  chr16:28074955-28075387
  hyper
cgggcggcggtggaggagcggctacggcgcgcccggagcccggagcgcgagtgcacctcggctaggagccgctggcgcctggcagcggccacggcgcagggacgcgcgcccctccgtggggagacacctgcaggcggccggcgacactgttccggagcccgcccgcacggggagagggggccgccacgccgggcgcgggcgggggcctgggagtggagggacgcccccgaaagaaatccgagccagggtgagggtctgagacgcaaggagaatcccaggcaaggcgctcctgagaaaagatccccacggcggacgtggggcaacaaaacccgccgggagcgggcatctcatgagacccagagaggccctgccccaggagacaagggcagagcctgctggggctccccaagagggacacggaccagcaggacc

SEQ ID NO: 36115 - DNA, 120 bp, Homo sapiens
  chr16:28304473-28304593
  hyper
gctccaggacttgggcgactgagcccctggcggcaccgcttgcaccccggtccatggtcgtggcgccctgagcccccggggccgggcagacgaagaccgcgacggcgcccaggccccctg

SEQ ID NO: 36116 - DNA, 51 bp, Homo sapiens
  chr16:28891741-28891792
  hyper
tggcaacagctggggcggggcgcgcgcaggaggccccgtaaccctatcccc

SEQ ID NO: 36117 - DNA, 123 bp, Homo sapiens
  chr16:29888624-29888747
  hyper
ctggatttgggggcccgggcggtgcctgaaactgcagtgtgaggtcgggcccagaggagagaaggcggcggcgcggctgaggtccccgcagctgggccaagactcgggcgctgggaccgtccc

SEQ ID NO: 36118 - DNA, 30 bp, Homo sapiens
  chr16:30023074-30023104
  hyper
ccccctccctttggccgttcaggcctctct

SEQ ID NO: 36119 - DNA, 30 bp, Homo sapiens
  chr16:31022167-31022197
  hyper
gagcagggagagatgcggagagccaagcgg

SEQ ID NO: 36120 - DNA, 138 bp, Homo sapiens
  chr16:31226609-31226747
  hyper
ctgaggagcttaaggcggggctggcagaggaaagccgcgcagggatggagcctggcgataagggcgctgagcaaacgtaggtttcccggccttagtccctagaggaaactggagatgggcgggcggagccccagggcg

SEQ ID NO: 36121 - DNA, 47 bp, Homo sapiens
  chr16:31227038-31227085
  hyper
ctgcacttatgtgtgcgggcccagggtggcaccgagagccccgtcca

SEQ ID NO: 36122 - DNA, 4 bp, Homo sapiens
  chr16:31228309-31228313
  hyper
tctc

SEQ ID NO: 36123 - DNA, 93 bp, Homo sapiens
  chr16:31483566-31483659
  hyper
ccagagctgcctccccgccgtcgctctcccgcatctccccatccctgtcttcttacttctgcttttcgcctctgcccgcgcctcctttccaac

SEQ ID NO: 36124 - DNA, 156 bp, Homo sapiens
  chr16:31498557-31498713
  hyper
aaattcccacaaagacgccttattgctaaggccagcctgtaacataaacagctgggctgtcccctgaccccggcctgttgcaggagggctggccgcgctgatgtacacggacacggtacagaccttcgtcattctggggggcgcctgcatcctcat

SEQ ID NO: 36125 - DNA, 91 bp, Homo sapiens
  chr16:31499538-31499629
  hyper
cccgtcgcccagttccgtcaccctcctaagactcggcagtttgggcccggagtcccgcctccctccgggggtcgcacgcctcctctgctag

SEQ ID NO: 36126 - DNA, 249 bp, Homo sapiens
  chr16:31540812-31541061
  hyper
agagctttttaaaaacgaaatgaaggtgttagacccgcggcgcagtctccaggaaaagcctccacgcgcagaggggagggccctccgggggagggtgcgcggggcgggggcgcgcggggggagggggttcccggggtgctgagcgggggcgggggtgcgcggggcgggggcgcggctaggaggcgccgcacagcaatcagacgcggctcagggtgcgcgcggggagctggagggcgcagttctggacct

SEQ ID NO: 36127 - DNA, 259 bp, Homo sapiens; identical to SEQ ID NO: 4341
  chr16:31580480-31580739
  hyper

SEQ ID NO: 36128 - DNA, 992 bp, Homo sapiens
  chr16:47176772-47177764
  hyper
caaattagtaagaaccgaacaccagcggcggggaattctgagacctctggcggagcgcgaggagcgccgcgtcccgggaagcacccgagcagcagcgctccccgggggccgggacaagccgggtccgcggcgcccgcgcgccgcccccggagcccgcagtggtgccgcagcctccgtggccgcagcaggtgggacccggctggcccagcaggccccgttccccgccgcgaggtgcaggcgccgcggggctattcgaaaaccactgcacgacgtcacggccgcggcttttattgttctcgtggaattactttttgccatcacatctggagaaagagcggcctccgctccacgacaggaatctcacaactttgcaaagggatgcgcggaattctacggaagcggcgcgagggcgcagcccggagggccctgctgggcccaggggcctcctggccgccttcccgacccgatccctcttcccacacgcgccccgcgaacgtcggccggactcgcaggggtcggaagcggcgcgcccggagagccggcggagccgggcagggctcgcgccccgcggtccgctccgagtagccgcgagccccgccagacaaagaggcgcgtcgggtcccgggcgcgggtaagggacgcagaggcgcgggcagggcggcgcgccagcctcggcccgcagggggcgccgtccgtggccccagccccggtccttacctttgaggaccgagcagagccgctccagggccatgttcccgagctgcccggcgcttcgcgaagggctgaggtagcggcggcggtggctcggcgctcacggctcggcgcggcggcgacggccccactccgtccccatcgccggccagcagctgcctccccgctcccctgaggagagctcaggtcctgcggcccgccatgcccgagccccacagtgggctcccgcgcggcccgagcaccccgacgggcgccgcctcctgctccgcggcgccccgtcc

SEQ ID NO: 36129 - DNA, 31 bp, Homo sapiens
  chr16:47177824-47177855
  hyper
gcccgcggccccggcgcgggatccactgaag

SEQ ID NO: 36130 - DNA, 33 bp, Homo sapiens
  chr16:47178260-47178293
  hyper
gcagacagagaggggcgccggtccctagtcccc

SEQ ID NO: 36131 - DNA, 15 bp, Homo sapiens
  chr16:48845119-48845134
  hyper
cggggctctgccctc

SEQ ID NO: 36132 - DNA, 351 bp, Homo sapiens
  chr16:49309108-49309459
  hyper
tgttctcattaagagcggatgcgcccgggctctgagcattagcgctccagtgcagcttggaaggcatgctcccagctcggctaatggtggaagcggcggccgggcagcaagcgagctggggggcaggcgcggggcccagcgcaacccagcgctgctccgcagacagcagacaccacagtgatcaccctcggctcctcgcctgcgcggctcccggggcgcttagcgcggtgtggagaacccgggcggagaagccaggtctgggcttgttgggtcctagaagcctccctgagttcccctcacagtacctttaagcctggctgggtgccggaaacgctgcgcagaataggaaac

SEQ ID NO: 36133 - DNA, 545 bp, Homo sapiens
  chr16:49311445-49311990
  hyper
tatctctgtgggtcccggaggcacagggctgcaagggcgcccgctagagctgctccacggcttaccggattgcatgcggagaagaaacgggcccgggtttcaacagaggccccgtgctccgtgaatttctaactcgaaccagccgctgggataaatccgagaaacgttgtttattgtgctattattaactttcccttctccccacgcccctagaggaaataaaattcattcctgaatattgggccaggaaaacgtttctctgaaaggaaccacaactgcaggggaccacccggctgcagctcccagctcccggcccttcgccctaggctgcccactcgctccggctcccgacctccccgctgccgaagcaactgggtcagcctttcagacttaaaacgaagtcgtttatttcatttttgctttcacattatgttccgatacaatcaaaactcctggacgaacctcttgaataaagtcctgtgaatgagcggaatcataggtcctgggcgcccgagtatgcggcgggtggactccggattcagagg

SEQ ID NO: 36134 - DNA, 499 bp, Homo sapiens
  chr16:49312032-49312531
  hyper
cgcggtgggagacatccggggacagaaggcctgaggagtctgccgctccaggcagggtcgtttgggtcctcaaactgggactattcctgatgcatttggaatgcaaagaaaaaaatcaaacttcgctcctgggccggcggccgcgcctggcctagcaagatttcggccacatttcttacgtttccgccaaagctgtgaacacaggcgaatgcagtgctggtccccggcctggcgcaggaaggagcgcaaggccggctttgcaaggaagccctcgcgcccaggcctttctatggttgcgttcccccaagtctcctgcctttcggaacctcgccctttggcaccccagacccccaacctcgcagctggggaagatgcggattttagaaagctgtttcagaaaaataaaagtcccacttcgactttattagattaaagcaaaattaaaccttgactattcacacgtatgttacagaggaagaggaggcgtccggaagaagct

SEQ ID NO: 36135 - DNA, 1616 bp, Homo sapiens
  chr16:49313206-49314822
  hyper
taggaagtttcaagtcgtgctgctttctcgccctcttaatttcagcctctttctcactccccttcctgccttcgccctctccctgcctcccttccggctacgagccagtcagagaggaaacaccaggaatccggagaaggtcgagtacttccagccccccatcaagtttccccgctccagcttgaggtatgctcggtcgcctttctccatttggattaggactccgttgctggcggcctcccgggtcacgtcctggtcaccagcgaaggctgaaatcaccggccacccgtttagcatgaggctcacctgagaaagagaaaggcccgcttcagaggcgcaacctaggcaggcaccgaagccgcggtggagcgaacctcctccttgcttggctaacagcctgtaaggcctggaagcacggagaggtggggggtggggggggcgaatggaggaaaaggggctttgcagcttactgctgaggctccagtggggcgaaagaccacacatctgggtgacaggaagggcctgtccccaaaacgggagttgctcttattccagtttctcaaatgagcgcgccaagcgaatctcgactgtgctctgtgatccaatttaataaacccatgaggtggctctagcgccctgagacctttgacctctctcccgtttcccctcagcctcaaaaaacaaacaacaaacaaaaaaaacccagcaactcaggctccttctggcgctaccggaaaaacaaaaacgaacaaacaaaaagcccctgatccctcctggacccagctgccaggacacagtggagaagccactgtgatttgtgattagaagtctcgcaccgagcggcacaatgtatttcctccccaaaccacgggctcaattccctcccccatccagccgcgcccgccaccgcctggttttgcccctgtggtggcaccgtcagccaagggcctcgcgccctctccccagctgtgcgtcccacctctctcggcgcccaagggaaacctggacatctttggggacccggagagccggcgagtgattgctgggacacggctggagccgggagagagtagcactacgccccctccctccctcctctctctacccctcaccctccggggctaaatgctgctagctcaaaaacccacagtccgcacggggtggggattggggacaagtgggagaaaacgggggccccgtccgtggtgctgaagacaagcacgcaagccgcatcgcaggcttctgagccggggcaaggggtagggtgtactgtcgcggtgcttcctggggagtccgggaaggcttcccaagcggcagctgtctggggcgctaacaacagccgttacaaggaagtccctgaaatccagggaacccttcggagaggcccggaaggcagaagcagaaaattctgtctctcgggggatggggctggatcccaagagccagagacagggaaagcagaggacagttgaagccacagaactgagaggccccgctatctgtccctccaagcagcccgaagtacatgcagccgccacttctgcctaccacctccggacagcccgagcacccctgaggccagtaacccccctacggggccagggcccggcacgagg

SEQ ID NO: 36136 - DNA, 1244 bp, Homo sapiens
  chr16:49315072-49316316
  hyper
ccagcccaatctgcacgccgcgggaggaaggaacactcacctggtcgaagtagatgatcatggtgcgattactcatctcggacggctcgtggttggtgctcctgatggcagagaaagccaccttggcgctgccagagcgcacagagatgcccagggcagtgcccgtggggtcggacgtggggttggagtcgcacaccaccaggcacttgccctccagcacgatgggctccgtctcattctgcccgcgggccgggcccgccagccacgcagcccccagcagcagcagctccaggacgcccagcatcgcgccgccggcgcccaccccgccccccacccccagggctgctcgcgccagccgccccccccgtcccagtcccgctccgaagccccctcctcagctccgtgcgcagctccgccgccgccgctctggacactacacctcttcctcgcactccgggactagcgtcccctccgcgactagcgtcccctccgcgctgtgttcccggagcccctcccgggcctcaggggtgccgcggctgcccagccgcacttggatgcatagccgctgctgctcggtcccgctgctgccgccgcctcctgcccgcacccgccgctgccgccgccgccgccgctctgaattattgatgcagccggcgctgcagccggagcgggcggagagcgcgcgccgggcacaaaggcgcggacctcggcctggccccgcccccgccgcctcccggcccgcctccctccgaggccctgcccccgccccggccgaggccacgccccccagccaatcctgacgcgccgcgctccccaccgagccaatggcggcgctgtccgcgctcggccacctgaccccgggcgccgttgttattaggcgcggcgaggcgggtggcgcgcggcagcagggttgggctctcgccgtgagtcgacgaagggagcgcgggcgcgcgcccgcgtccgcgcactgagagtcgcctcggccgctcgctttctcgactcccgcctcgcgcctcgatcctgttccgcctccctcggccctcctgcccgcccccactcgtcggccctcaggtaggaggcggcgcgccccggggtcgggagtggaatcgctggaggctgcgagtcgcctgcccgcctgtgggcgcgcccgttgggaggggagcgccccccagcgggcgcgggcgcgagggcagccggcgcgctgggcgagcctggctcagggtcccggcggccggggtgcaggg

SEQ ID NO: 36137 - DNA, 115 bp, Homo sapiens
  chr16:49316508-49316623
  hyper
gactgctctgccggccgcggaggtcggatcgagcggtcattcattcatttgttaattcgttcacttattcaggggagatcattgaacccctacggagtaccgggtactgggccgg

SEQ ID NO: 36138 - DNA, 49 bp, Homo sapiens
  chr16:49317153-49317202
  hyper
cccacaggctcctggcgctccggtccccaccaggcgaccttgatcctgg

SEQ ID NO: 36139 - DNA, 35 bp, Homo sapiens; identical to SEQ ID NO: 12458
  chr16:49317700-49317735
  hyper

SEQ ID NO: 36140 - DNA, 30 bp, Homo sapiens
  chr16:50699376-50699406
  hyper
gcctggagaaagtttcggtttcccagctgt

SEQ ID NO: 36141 - DNA, 96 bp, Homo sapiens
  chr16:51167714-51167810
  hyper
atttcaataccaccacgaggcacctctagtgaggcgtagcggggcaagggtcggggagtaggtgaggagggggtgcgcgcccgtcagctgccttca

SEQ ID NO: 36142 - DNA, 45 bp, Homo sapiens; identical to SEQ ID NO: 12459
  chr16:51183963-51184008
  hyper

SEQ ID NO: 36143 - DNA, 100 bp, Homo sapiens; identical to SEQ ID NO: 4348
  chr16:51184324-51184424
  hyper

SEQ ID NO: 36144 - DNA, 263 bp, Homo sapiens
  chr16:51184695-51184958
  hyper
gcggtcaggccggggcgacctccacccgcacccacgcctcatggggctcccgggtcttggccgcggctgggatccccggaaaagcagggacggagaagccaggccggcatgcccgccctccttcccccgggaggacccaacaactccggaaagatcctgccgggagatgtgctcgctttccccggggcagcgggggaaagcccagcaaaggcacattgaaaattaaaaagaaaaaaaaaattacgccgagtggaagaagcaat

SEQ ID NO: 36145 - DNA, 238 bp, Homo sapiens; identical to SEQ ID NO: 4350
  chr16:51185054-51185292
  hyper

SEQ ID NO: 36146 - DNA, 423 bp, Homo sapiens; identical to SEQ ID NO: 4351
  chr16:51185542-51185965
  hyper

SEQ ID NO: 36147 - DNA, 304 bp, Homo sapiens
  chr16:51186025-51186329
  hyper
cgagttctccatcccctggatcccgggctcgcgggggcgcggagaagaggatccaggaaaggtttgggaacctgatgggtttgtggctggggggaggggcagttctcccgccaccccatcccctccccgccaggggcactgatcctccagcttcttgcttgctccctcgctccctttctctacctcggacattcccaggacaattagggctgaagttttcgggagaagcagccccgagcccgtgggataagggggcggcccggctccgcccaggacccctcccggacctcccccccggctgccc

SEQ ID NO: 36148 - DNA, 532 bp, Homo sapiens
  chr16:51186595-51187127
  hyper
gggacgaggtggcggcgcagagccggaaagcggggtggggggagggcggtggggaggtgttctgtccgaggctgcctggcggcgccgaagctcgcctccactttttgggcacttgccgagcgcggcgcccgaacttttcgctctatcaccatctccctcaagctgagatgcaacctccctaccctcgccccagagcccagagccaggagcccgatccctctgccgggctcaggcgcccgcgaacctgagactcggtacgcggctcagcctagctctttcccctcgcgcctcggggtctcctcgctccaaggttctcgaagtcttgcgcccgaaggactaaactaaactaaacttcggctgagtaatgggggaggaggggggtgcagatacacaatccctgccctatctcacgatcaggaaaggagagggctcataaggacgccccaattcgcgagcgcccttgagtctggccggtgccacggtcggttcgcgcgaagtgggcaccggtctcccgagccgacttcgtgtactc

SEQ ID NO: 36149 - DNA, 134 bp, Homo sapiens
  chr16:51187416-51187550
  hyper
tgataaaaagacaaacgaagctatcagtggggctgatgttgaagaatgaagataataatgtttccataggtggtgcttcaaatgccattatttctcactgaatatttaaagagatccctcggcaaagatggatc

SEQ ID NO: 36150 - DNA, 79 bp, Homo sapiens
  chr16:51189282-51189361
  hyper
cggcgccccgggggcgggggacgaggcacatcgatggtatcaacattattgatggggaaaagttcggggcaggagcccg

SEQ ID NO: 36151 - DNA, 82 bp, Homo sapiens
  chr16:51189956-51190038
  hyper
ctatctccagacgggcgccgggtgcagcgccgtgaccgggcgccctggcgccggctcgggcgcgaaattcagcggtggcaag

SEQ ID NO: 36152 - DNA, 94 bp, Homo sapiens
  chr16:51190121-51190215
  hyper
cgcttggagggctgttcctacaccggtattaagaaaccgacttcgctagcgactgcaagtgcttgcgattttgactttccgtccacagttgagc

SEQ ID NO: 36153 - DNA, 49 bp, Homo sapiens
  chr16:54317177-54317226
  hyper
accaccaaacagatccgtcgagggggcagacaggcgggttatagtcaaa

SEQ ID NO: 36154 - DNA, 80 bp, Homo sapiens
  chr16:54318670-54318750
  hyper
cggtggagacccccccgcgccgggaggcgagcggcgcgggttgtccgggcttgtggcagtctccgcgagggaccagatct

SEQ ID NO: 36155 - DNA, 33 bp, Homo sapiens
  chr16:54318955-54318988
  hyper
gtcgccatccctgcgcgccgccccagccaggga

SEQ ID NO: 36156 - DNA, 168 bp, Homo sapiens
  chr16:54319377-54319545
  hyper
tgctctccctggtggcgttcttgggacgggacgggtccccgaactggtactggccatacgggtagaaggcggggtgcgggtgcggaaacgcggcagccgcggccggatgctgcaccccggggctgtccttcagctcatactgcgcgccctgtacgcacatggagaagg

SEQ ID NO: 36157 - DNA, 47 bp, Homo sapiens
  chr16:54320739-54320786
  hyper
aaatctcgggtctgacgtcgcgccctcttattcgacttttccccgcg

SEQ ID NO: 36158 - DNA, 30 bp, Homo sapiens
  chr16:54321354-54321384
  hyper
ggagccgccacaaatcggtgaagcaggccc

SEQ ID NO: 36159 - DNA, 165 bp, Homo sapiens
  chr16:54321654-54321819
  hyper
gggcgcccaccttcacggattagggcgtgcagtcgatagcggcattgaaattcccagcattgccgcggctgggggctcagagctttaggccgcggcggcgacccacaagccggccaggcctgcagtgggcacgccccggagacaaaacgggggtggtgactctgc

SEQ ID NO: 36160 - DNA, 33 bp, Homo sapiens
  chr16:54325062-54325095
  hyper
gtggatctgcctccccggcgccccctcctcatt

SEQ ID NO: 36161 - DNA, 259 bp, Homo sapiens
  chr16:54628691-54628950
  hyper
gggagcagagttaatcgaataaactaatcttcgctgtggagattaactctcagtagctgcaggaaaccgggcaagggagaatgcaaatagcagagacctcaaggtgctggaggagttaggaatctcccctccctcactctaacgctgccgccgccgcaccccgccacctccccccctccccacccccgccgcccacccgccctcaggttttaaatttggaagatattgtggaaatggacaaactcgcctttgcctgctg

SEQ ID NO: 36162 - DNA, 34 bp, Homo sapiens
  chr16:54962651-54962685
  hyper
ccagagggcctggcccgggcgggggctcacctct

SEQ ID NO: 36163 - DNA, 33 bp, Homo sapiens
  chr16:54963623-54963656
  hyper
ttctaactgtgtggccgtcgtgggcaagggctc

SEQ ID NO: 36164 - DNA, 44 bp, Homo sapiens
  chr16:54964141-54964185
  hyper
ttcctgcgccctgggcgcgggccatccatcggctctcccagaga

SEQ ID NO: 36165 - DNA, 117 bp, Homo sapiens
  chr16:54965018-54965135
  hyper
cagaggccaggtgcccgcccgctcgccctcgcagggcgccgcccggctcgttggcggccgcggcgcggcgcgccccatgcccgtgtgtggccatgtcctatccgcagggctacttgt

SEQ ID NO: 36166 - DNA, 59 bp, Homo sapiens
  chr16:54966792-54966851
  hyper
cgaccccgagggccccgaagcaggttggtggacatgggaaagggcgtgttgggcgggag

SEQ ID NO: 36167 - DNA, 140 bp, Homo sapiens
  chr16:54967122-54967262
  hyper
ctgcagggccccccccgcaccggcgggccctccccggctgggccagcggcggcgcggctggcggaggacccggcccctcactaccccgccggagcgccggcgcccggcccgcatccagccgcgggcgaggtgcctccggg

SEQ ID NO: 36168 - DNA, 95 bp, Homo sapiens
  chr16:54971471-54971566
  hyper
cccctgggagccatgcgattcgaagggagggggacctagaggagacccccgctatccccccacccaccgtggggccttagctttgaactccggcc

SEQ ID NO: 36169 - DNA, 46 bp, Homo sapiens
  chr16:54972930-54972976
  hyper
gggaaagtgagaaggcgtggtgttggcattgcgcttgcaaataccc

SEQ ID NO: 36170 - DNA, 184 bp, Homo sapiens
  chr16:55090677-55090861
  hyper
ttcccgcgccccaagcgccgaagccccagaactgccgccggccgggcccatccccagcccaggctcgtaatcaaaaggcagatttccgcgccgggcacctgtttgcagggctgcgcctccttccgctgcggtgttttatctcggcgcggcggtgaataattcatggccccgggtctgctttgca

SEQ ID NO: 36171 - DNA, 129 bp, Homo sapiens
  chr16:55357444-55357573
  hyper
ctcccccacccctgccgccgcccacccatcagtgcccctttgaagacccctgggatggagtgagggggtggtcagaccgctgggcccagccgggcgtccaggaggagcgcagggaatgggccgccctcc

SEQ ID NO: 36172 - DNA, 330 bp, Homo sapiens
  chr16:55357611-55357941
  hyper
cggagcgcaggggctgcagcccggaccgggagccttcttcaggctccctggctgccccgcggccactgcgggaggcgcgcgcgcgaggcagccaagccttgccttcggaggagatgcccagggatcttagcaagcagcctgcggctgccagggatcggacctggcgagtttcccgacggaatctgagggatcccgaacctcggcctcgagggggcgctatccggcctactcgaggaccaggcagctgcagagaagctccaaggtcaaggccctgggccaggccagggcttggagagccggaatctagcccgagtcctggggaggctgagg

SEQ ID NO: 36173 - DNA, 360 bp, Homo sapiens; identical to SEQ ID NO: 12479
  chr16:55357991-55358351
  hyper

SEQ ID NO: 36174 - DNA, 110 bp, Homo sapiens
  chr16:55358566-55358676
  hyper
gcttggcacgcttggtggcccagggtcccggggcccggggtcccgtctggcggcccgggattaccgtgacgtcacattgagcctctggccaccttggactgggacacctc

SEQ ID NO: 36175 - DNA, 341 bp, Homo sapiens
  chr16:55358784-55359125
  hyper
cggaccccacgggccggaggggcgccttccggagcgcagggctcggcagccgggctgccctcggctctgcctccactggggccaaccaggcgaaggaaccggcgctgggcatccgcagcggtgtaaggaactgagacacctcactgctgggggcgcggaacagctgggctgagacgggaactcgacagggaagagagagacgggccagggacagccaccatgtccttcccacactttggacacccgtaccgcggcgcttcccaggtaagaggcgcctctatgggggataggggacagactgggtggagggagtgcctagtgcacggcgcctgcctctgatc

SEQ ID NO: 36176 - DNA, 274 bp, Homo sapiens
  chr16:55362982-55363256
  hyper
ggtgcacccccagcccggcctaggccacgaagtcctgagtgccgtatgattcctggacagcctcctgcctctgcccggcgactctcagtccccagagactccgcgtgcgacgagtcttcctgcatacccaaagcctttggaaaccccaagtttgccctgcagggactaccgctgaactgtgcgccgtgcccgcggaggagcgagcctgtagtgcagtgccagtacccgtctggagcagaaggtagtgggcccccagcggcgctgggagtatcta

SEQ ID NO: 36177 - DNA, 503 bp, Homo sapiens
  chr16:55364716-55365219
  hyper
ggcaaagatgcattgcggccagggattcttgcgacagcgcggcgtgggctgcatacctcagttcctttagtagctgggaaagaaactgacaaggtaacagacaaggccgtggcgcctgcagctcagcggactaaccgctgcgtaaccaatccgtggagccaagctgaccacctcgcgggtcctgcgcatgggaagtggtgggacttgtcaggatgtttatctggaaactgcatctgtttccgggttcgtatttgggttgtaagtttactgggggaggggtgacgaggaccgcgctcctccgatcgaactgaacctaatggggaggtcaggcagctttcagggtcggtgtgaggcgagagggggcattcttcccgttttatcaaaagtgtcagcaaacacttccggtacaggccaaccaatgggaactgacgggcagggaaggggtctttgtcccccttgctaggagtgtcgagcgaccgggttgggggtaagagatttaaaga

SEQ ID NO: 36178 - DNA, 27 bp, Homo sapiens
  chr16:55365434-55365461
  hyper
cgtttccaacgccgggtcccggccagg

SEQ ID NO: 36179 - DNA, 228 bp, Homo sapiens
  chr16:55404972-55405200
  hyper
tctttgagcatcaaacgtgtcctccttccctctacctacttcggctccggtttctctcccgaagcctaaataaagaaggtaacagacaacacctctattggcagaggcttctgccttttccgtcaggctggctgcagcacatccgtaatccttatgtcagcctgcactctagcgttgccggcccggtccagcatctgacagccgcgaatccaaagctgccggcctctc

SEQ ID NO: 36180 - DNA, 13 bp, Homo sapiens
  chr16:55405201-55405214
  hyper
tttctaagcagca

SEQ ID NO: 36181 - DNA, 19 bp, Homo sapiens
  chr16:55512935-55512954
  hyper
cggccggggaaaagaggtg

SEQ ID NO: 36182 - DNA, 138 bp, Homo sapiens; identical to SEQ ID NO: 12486
  chr16:55513226-55513364
  hyper

SEQ ID NO: 36183 - DNA, 57 bp, Homo sapiens
  chr16:55513482-55513539
  hyper
cgtcgcccatcatcaagttccccggcgatgtcgcccccaaaacggacaaagagttgg

SEQ ID NO: 36184 - DNA, 251 bp, Homo sapiens
  chr16:55514076-55514327
  hyper
ggagcttggtcaaagcggggcttggcaaatttctaggaaccttcggcacagatccggagagggacctttaaacaaacagctcgagggggccatttgggaagtgattggggcaggagggaagcagagagcgcatcttttttctcctggcttaatggacaaattggtcaagggctgggcctcggaaagtttcctcgaacttctccaaagggtcggagaaaagaaggagagagctggcccggcaggagggagga

SEQ ID NO: 36185 - DNA, 462 bp, Homo sapiens
  chr16:55689918-55690380
  hyper
ccgcgccctgccggccgccccgcgcctccagctcttccccggccccgcccgaacgccacacggcggagcccagccccagcccgcgccctagagcctgccaaggcgccgccggtcgggggccggcagggcgcaaggcaccagggatcccctcgccgccggacacgtgagtgcgccctgagcgcgggacagggctaggtctgcctgggaggcccgggccgagacgcgccagcagagggctagcgagtttgtagtgcagtgacgttaagtgtccgagaaggctcctgtggctgttgaagtgtcgcggacctgagctggggagggggtcggcacgctgccctcagcctcggtgagttcaatcccagccatttggggcaggcgagagtgggtgaacgaggaaaagtgctgcagggtcttcagccgcccccagagggctgtcagaagtctccaactcttgagttccgg

SEQ ID NO: 36186 - DNA, 124 bp, Homo sapiens; identical to SEQ ID NO: 12490
  chr16:55690453-55690577
  hyper

SEQ ID NO: 36187 - DNA, 25 bp, Homo sapiens
  chr16:55690761-55690786
  hyper
cgcgcagccccgggagacctggggc

SEQ ID NO: 36188 - DNA, 265 bp, Homo sapiens
  chr16:56224517-56224782
  hyper
cctgtccctccactccgggcaccctggcctccccagggtgggcacccctcctgcacggagagcggcggctgggatctcggagcagggtcggctatggccctggaggcagcggctcacagagaaaaagctctggcttttctccgcccgctgcgttcctcttcttacagcctcgggtgtcacatattaggtgctcaataaatgtggacataggaaacgaaaagtccgaatctgtccttacgcccccaaggcgaattctggggcgcgc

SEQ ID NO: 36189 - DNA, 10 bp, Homo sapiens
  chr16:56224783-56224793
  hyper
ggtttattcc

SEQ ID NO: 36190 - DNA, 39 bp, Homo sapiens; identical to SEQ ID NO: 4358
  chr16:56224794-56224833
  hyper

SEQ ID NO: 36191 - DNA, 113 bp, Homo sapiens
  chr16:56224880-56224993
  hyper
cgggcgacaagatggagagccggcccgagagggacagaggccgcgctggcagcgagctggggggcccacctgaccgtcctgcgggcagcccggccccgcgctcccattgacaa

SEQ ID NO: 36192 - DNA, 490 bp, Homo sapiens
  chr16:56225199-56225689
  hyper
gcctcccccgccccgcgccctccccgtcccgggggcccggcgcgcggccctgctgacgtcagctggcggcccgcggagccgggtgcgcagagccgctggcgcactcgcgcgctgcgctggcctcctccccgccccgggcccaggcgcgcgcgcgcttgttcgctctcccattttttttttcccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgcgccgccgccgccgcctcctccacctc

SEQ ID NO: 36193 - DNA, 45 bp, Homo sapiens
  chr16:56226280-56226325
  hyper
gctacccccatcccccgaccccggccactccgcaccccctgccac

SEQ ID NO: 36194 - DNA, 48 bp, Homo sapiens
  chr16:56228369-56228417
  hyper
ggatgaggtttcaggcgttgcaagtggtggacagcgcccagccgaggc

SEQ ID NO: 36195 - DNA, 14 bp, Homo sapiens
  chr16:56228577-56228591
  hyper
gggggaggggagtg

SEQ ID NO: 36196 - DNA, 215 bp, Homo sapiens
  chr16:56623169-56623384
  hyper
agtgggctggcagtgcgcgcacagcggcggcgagtgggtcgtgcacgcggatgcggggtgggagtgggggcgcacgcgcgggcgtgggcgagcgggccccggcagtgcacacacacggcaggggcgggcgacagatgcagtgcgtgcgccggagcccaagcgcacaaacggaaagagcgggcgcggtgcgcaggggcgggcgcccagcgggcttg

SEQ ID NO: 36197 - DNA, 202 bp, Homo sapiens
  chr16:56623667-56623869
  hyper
cgggcatgcctgtgtcgcggagaacagggagacttggcaccccatctcctcgtgacaggcgtggggacccgagttcgtccacattaacccttcctgtggcgtcgccctctctaggtggctcctgcacctgcgcggactcctgcaagtgcgagggatgcaaatgcacctcctgcaagaagagtgagtgcggggacccttcccc

SEQ ID NO: 36198 - DNA, 84 bp, Homo sapiens; identical to SEQ ID NO: 12499
  chr16:56651238-56651322
  hyper

SEQ ID NO: 36199 - DNA, 646 bp, Homo sapiens
  chr16:56659128-56659774
  hyper
ctatgtaaggaggtgcgggaccgaggaacctaggtgtggacagggacaggcaaggcgggggacgaagagaaatgaaagccacatcggtggcggatgttctgaacacaactcgctcgctaccgcacgttccccgctccgcactcagcggatcccgggacggcagcaggtgggctgcacacggactctgggacaagtcgagctgaaaaccgcggagctaggggtggggtggagacgcccgcgacgccaaggctggggtcccggaacacgctgggaggagggtggaaggcaacctcggggaaactgggaaaggcggcctggacttcgggaacaccgcgtacctgcgggggcacagccccacccgagcgaacgggctccaaaggggaggtcccgcggtgcccaccgcgcagagctcagggggtggtgcgcccggcccttctgcggcgcacagcccagcccaggaacgcgggcggtgcggactcagcgggccgggtgcaggcgcggagctgggcctctgcgcccggcccgacctccgtctataaatagagcagccagttgcagggctccattctgctttccaactgcctgactgcttgttcgtctcactggtgtgagctccagcatcccctttgctcgaaatggaccccaa

SEQ ID NO: 36200 - DNA, 549 bp, Homo sapiens
  chr16:56665957-56666506
  hyper
acgggagagagaggccgaccagtgttccccgtgttgctgtgtacggaggagccagtccgagggaccgcggtgtggacagggacaggcaaggcggggaaggaggagaaacgaaagccacattggtggcgggtgctctgcacacgactcgctccctaccacacgccccccgctccgcacacgaccgatccggggactggagcaggagggctgcaccgggactccgggacaggcccagttgaaaacggcggggcgagggggtggggtggagacgcccgcgacgccaaggctggggtcccggaaagcgcggggaggagggtggaaggcaaaggcaacttcggggaaactgggaaaggcggccgggacctcggggacactgcgtaccacccggcgcacagcccctcccgcgcaaacccgagccaaaggggcggtcgagcggcgcactcggagcggagctcaggggatggtgcgcccggcacttatgctgggctcagcccagcccagcccaggaccgctggcggtgcgaacccagccgggcgggtgcaagcgcgg

SEQ ID NO: 36201 - DNA, 15 bp, Homo sapiens
  chr16:56672158-56672173
  hyper
gctgcactcagactt

SEQ ID NO: 36202 - DNA, 165 bp, Homo sapiens
  chr16:56672221-56672386
  hyper
cgaaacgccaaggctgggttcccggaacgcgcggggactagggtggaaggcaacttcggggaaactgggaaaggcgaccgggacctcggggacgccccgtaccccgggcgtaaactcactcccgcgttagcggccccaaagcggggagggggtggtcccgtggtc

SEQ ID NO: 36203 - DNA, 61 bp, Homo sapiens
  chr16:56672513-56672574
  hyper
cgggtcctttgcgtccggccctctttcccctgaccataaaagcagccgctggctgctgggc

SEQ ID NO: 36204 - DNA, 374 bp, Homo sapiens
  chr16:56677138-56677512
  hyper
ggtcttatctggggacgtgagcactaggctggggtagcacatggactcccacagagccgaagctcacgtcactggtgcggggtgcgggggtggggataccgcgaccacctgaggctgggttcccggaccgcccaagggcaggaatggagtgcaatctccgggaaattcgggagggccgggattatagcagggacgccgcgtaccgccaggagcacagcccctccaaagcgagcgtgagccaaagggccgcccccagggtgcgcaacagccacgttaaggaggatcctgcgcccggcccgcctggtgcgcacagccccgccctgaaccctgggcagcgctgacactgagctgggctggtgcgagacctggggcgg

SEQ ID NO: 36205 - DNA, 52 bp, Homo sapiens
  chr16:56701956-56702008
  hyper
ggtgcacgtggaaggcggagtggagcccaacagccagcggctgtttttatag

SEQ ID NO: 36206 - DNA, 79 bp, Homo sapiens
  chr16:56709814-56709893
  hyper
cagcatagcccctcccgcacgagcgggccccaaaagggcggtccccgggagcccaccaggctgcactcaggggatggtg

SEQ ID NO: 36207 - DNA, 100 bp, Homo sapiens; identical to SEQ ID NO: 12506
  chr16:56709949-56710049
  hyper

SEQ ID NO: 36208 - DNA, 919 bp, Homo sapiens
  chr16:58018565-58019484
  hyper
tcgcaacaggtaccacgagggaaagctggcgcccatcgcgccaggcatcaaccgagtggactggccctgcttcacgcgcgccatcgaggactggtcccacttcgtgtcctcggccggggagttcaagctgccttgcctgaggaagcgaggtcagtctacgggccgctgaaggaactgccgggcaggtgggccgcggggctggagcagggaacgtggactgcggacgggaacgcaggcggcgggccaggcagaaacagggcggggccgctgagatgaagctgtggcacttgcggtgggtggagccgagacgtgcgcgcggatctggaggcaggactgcccttggggagggggcggagccaggcggagccttcgggccgggggctttgccctggtggggcagcggaggcgggacctgttctccgtacacgtgtgggtggggctggattgtgggcggggctggattgtgggcggggcttagatgaggaggcggggcttgtcctgggggggggcggatgagcgctcgagaggggctttctgttcgcagcggagggtctcagcggctacgcggtgcggtacttgaagcccgacgtgacccagacctggcgggtagggagcgctgcgcgcagacccgtccctgagcggggagcgggggtcctggtggggagcggcttaagccgggggttgaggggggaggagacccagagcagggcctcccagtcttcaggaccacggtctctagcaggaagccctgtgtggggcgtgggcagggcgtccgtgctcccccgactcaccgcgcccctatccctgctgcccgcctcagtactgcctcagccagaaccccagcctggaccgctacggacagaagcccctgcctttcgactccctgtaagtgacgccacgcgcccggggaccccatatc

SEQ ID NO: 36209 - DNA, 122 bp, Homo sapiens; identical to SEQ ID NO: 12509
  chr16:58497214-58497336
  hyper

SEQ ID NO: 36210 - DNA, 1116 bp, Homo sapiens
  chr16:58497469-58498585
  hyper
cgcggtccgtccgggactagccccaggcccggcaccgccccgcgggccgagcgcccacacccgccaaacccacgcgggcacgcccccgcggcgcaccgcccccagcccggcctccgcccctgcagccgcgggcacgcggaggggctcctggctgcccgcacctgcacccgcgcgtcggcggcgccgaagccccgctccccgcctgcgcgtctgtctcgtccgcatctccgcggtgagtcggcggcgccctcgcccctgagcccagggccagcttctctcgccgccgcggctgctgcgcgcgtccccgcccagcccagcccagccccgagcacgaccccagccccacgcacgaccctagccccgcgagtcccgcaccgactcgctcccgccccatttcgcctccgcgggggcggcgccccctcctccccgcggctcccgctctccttcctcgccttcccggccgcgctggggacccccagccgccgtccgcgaccccccaccgcgacgcccggaggcggcggggtctctttgttcgggcggcgggcacgggggaccacctcccacggtgtcaccgcacccaccccgcgcccttcctccgcctcctggagttcaccgggaccaggtggcggcgggtgcctttttgggggtgcgcggccatgcaattggtggatttttttaaaccgttttggaggggggagcgcggcgttgggggcgggagagcgctcctggctgtgagctgctcctgccgcttcgctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggtaccgcccgcctgccccgcagccggccgccactttccgagttggagcggactccgggcgcggcggccggggactggggcggctcgggtctgagcaggaaggggtgcggaccccaactaagtcctagttttgtgctacctgtttgtgtgcggagcccagccccgggagaggacttgaggttgtggcgagtccctggcgctggcgtccgggctgc

SEQ ID NO: 36211 - DNA, 64 bp, Homo sapiens; identical to SEQ ID NO: 12512
  chr16:58498586-58498650
  hyper

SEQ ID NO: 36212 - DNA, 30 bp, Homo sapiens
  chr16:58499185-58499215
  hyper
caggaccttaatgtccgatgagggagcaga

SEQ ID NO: 36213 - DNA, 85 bp, Homo sapiens
  chr16:62068463-62068548
  hyper
agaggacagtactctcgcttaccttccctagcgtcccctcgttcccattgtcagcccccagatatcatgacgccaggtgaaagaa

SEQ ID NO: 36214 - DNA, 75 bp, Homo sapiens
  chr16:62069009-62069084
  hyper
agcacgtttttttaccgtttcccagccttggctggatcctgggagaaccggagtaggtcccttatgaacctctta

SEQ ID NO: 36215 - DNA, 138 bp, Homo sapiens; identical to SEQ ID NO: 12513
  chr16:62069136-62069274
  hyper

SEQ ID NO: 36216 - DNA, 35 bp, Homo sapiens; identical to SEQ ID NO: 12514
  chr16:62069336-62069371
  hyper

SEQ ID NO: 36217 - DNA, 43 bp, Homo sapiens
  chr16:62070743-62070786
  hyper
agcgtctcagtgacccgcagctattttccgtaggaggaagagg

SEQ ID NO: 36218 - DNA, 232 bp, Homo sapiens
  chr16:65154985-65155217
  hyper
ggttctcaaagttaacgttgaccctggcagctttcgccaatcccaagccagaggcgagcccgagtctgggccgctcatggacctactcctgcgctggtgggagcttacaaacgggcgccagagctcccgcagagactcgggctggagggctgtagcgcaccgcagcctgctgccccagaaccacagtcggcggccccaaacccacgctattaaagtgcgggcaatctccttc

SEQ ID NO: 36219 - DNA, 925 bp, Homo sapiens
  chr16:65155737-65156662
  hyper
gaagccccaaccaggcgagaggaagggactggcggcgcacctcacctggggcccttgagggtggacgcaacctccgagccgccagtccctggcgcagggcaagcgctgcggtgtcagtcccggccccagtcccggtcccattcacaagtcagcggcggctgcgagcggcccccgcggcatctgctcctcggcccgcgacgctcccctcagctggcggcggccgcggaatgagccgccgagcgcgctagtggcaggaatgagaaaccggggggaggtggcgggcgggcaggcgggtgcggggcggggggggcgggaggagggaggctgccgctgtgagggaaggaaagggcgggggctgagagaagccgaggctgcgagaggcagcgagatgggcctcgcagaggctgcgggggccgaccccgtccgcgcccctccccccaggggcccagagatgctaacccctggattcgtggccgcccctcccgccccgtggcgcggcgctccgactccctcagggctcagatggagtctggagcgactgaagttgggctccagggacgcacagccaatcagggagggcggcggagggaagctggagaggggttgggagcccccattttcctccttcccccaaatccgctccagctggccaggctgggctctcgcctggcgggccgggatggtggttgggggaaggtatcgtccaagtgagggaagcaattgggaattcgggagcgcgttctattctttctcactccaccaccccaccttccaaaaatccctcaacgttggcggctcctgcccagcccccacccctctcaatctcccatcccttgcaaactcttctggtggctctggtggtgaagtcgggcggggagggagacttaggacttgggaagagcccagtctccgttctctctcagct

SEQ ID NO: 36220 - DNA, 23 bp, Homo sapiens
  chr16:65156872-65156895
  hyper
aagggcctaatggggcgcagcgc

SEQ ID NO: 36221 - DNA, 347 bp, Homo sapiens
  chr16:65156939-65157286
  hyper
cgctaccgtgagggttccccgggcctgcttcctgccctccctccccgagtcgccgggagaaagggctggcagggccggggcttaggaatcacgccaaggactgggcggggcgctcgcggtaccgggaacggcgtggggatccgcacacccagcagggaacaaccatgcctgtgtggggacccctggcttgaacaagtttgcagggtgggaggtggaggcaagagaggaggcggaggaaggtggagacgccagtgggtgaaggctaaaaaggaaccgcctagggggacggggatgaggctgggaaaggagaagagatggacccgcgaaaaagacggggaaggaggctg

SEQ ID NO: 36222 - DNA, 15 bp, Homo sapiens
  chr16:65157823-65157838
  hyper
gtaaccccccaacct

SEQ ID NO: 36223 - DNA, 15 bp, Homo sapiens
  chr16:65157863-65157878
  hyper
cgcgaggacattgac

SEQ ID NO: 36224 - DNA, 478 bp, Homo sapiens
  chr16:66461511-66461989
  hyper
cggagcgggatcccgggtctcccgcggaccctcgaccccgggctggccactgggatctgcgcgagccgaggctgaccctgatcgcgccctcgggcctcggggaaggggaggtatccaggttttctgcctgactcgagtccccgacgagcatcaaccgcatttggggaacccaagacagcctccccagcagcttgccctcggtttcggggacccctgaacaacccaaccaagaagggaaaactagggcgcactctcggtcggggtgggagaggaaaggggctggggcttcacggagtttggagtttgaacccacccgcacccctttgagctaggaagtttgacccttcgacgagcaggtcgcctggggtatgcccctgtctccgtgcctctgtctcagcaccgagcgtcggagagagagcgcgccctccgcaccttctcccactttgggacagactttcccttgcgctgtcagagggac

SEQ ID NO: 36225 - DNA, 362 bp, Homo sapiens
  chr16:66612734-66613096
  hyper
ccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaacacctgcttcctctcgttgccttgtgtgaaagtcgcgttgtattttcctgcgcttggc

SEQ ID NO: 36226 - DNA, 175 bp, Homo sapiens
  chr16:66638277-66638452
  hyper
tctttgctgtttagacgcctgggttcccggatcccagacacgcgcacgggcaggaagttagaccggagacagcgagtatagacagcccttctggataggggcagacgggtgggagctccgaaggggtgccggggcggtgatcgggaggtctccagcggcccgaaccagggtgaag

SEQ ID NO: 36227 - DNA, 85 bp, Homo sapiens
  chr16:66878235-66878320
  hyper
ctggggggtggggggcgggtcccccgggaactgctcctcccgccagccgctgctttaagaggctgctccgcggtagcgagcgggg

SEQ ID NO: 36228 - DNA, 106 bp, Homo sapiens; identical to SEQ ID NO: 12525
  chr16:66878819-66878925
  hyper

SEQ ID NO: 36229 - DNA, 39 bp, Homo sapiens
  chr16:66958838-66958877
  hyper
agctgagcgagtcctcggagtcctcgggccagtccagcc

SEQ ID NO: 36230 - DNA, 178 bp, Homo sapiens
  chr16:67184208-67184386
  hyper
gtcgggtaactggaacgcgcggggtccgggggtgggcctcggtgccgccctccctcgccctcgcggcgcgctcgccgtcggggccgcgccgtcgcgctgcgcatagagtaagaggcccagggaggcgccaaggagcagcgtgagcaatgcgtccctgcgtaggcgcagcctcctcctc

SEQ ID NO: 36231 - DNA, 68 bp, Homo sapiens
  chr16:67189168-67189236
  hyper
gccagttcttcatcccggagccggtcgggctaggggaatggaacgtgccgtcacgggggacttaaccg

SEQ ID NO: 36232 - DNA, 665 bp, Homo sapiens
  chr16:67197617-67198282
  hyper
ccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacgtaagcgctctgagagggaacggggggggtgtccaggcgcgccccgagtgctagtgccttcttttgggattgttgccccccgggtctttaccgagttgggaactgtgatggcatcgggaccagtcctgggcgccctgagaccactcgctgctctcaccctctgcagacgccccacccgctcggtcctggacacactgcccccctctcttgcctccacccctctgcggactctgcagctccgcggccccggcgcagggagagggagggcacgggcgcgggccgggcctcaagggtgagtgtgaaataaacaaatcctgcagtgtttctgcgtcctattaaaggcggggtcggatctgaaagggaaggacagggaacgcgcggggtaccggaggagccatcccggcagaggttgggtttcctcaagagcctctggacgacacagctgcggggggtcagggtcggggcactcacacccttggaatgactacgtcccggggttcggcgggagggggcgtgcttccctgccc

SEQ ID NO: 36233 - DNA, 400 bp, Homo sapiens
  chr16:67198557-67198957
  hyper
gtccgagccccgccccgcgggcttgcacgtggcccccgcctgacccggcgccccggggcggagtagggcggagcgggcggcaaacgcagcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccggtgagggccggggcccctcgattccccctgtggtcccggggtccctccacgtcagtgaacacccatgcccgcccaaccccctcctgagactgggccgtggatccccggatttggccattc

SEQ ID NO: 36234 - DNA, 146 bp, Homo sapiens
  chr16:67199375-67199521
  hyper
caccctcctggtctccgcccgcacggtgggcgggcggcgttcttggtagagcgggaccagtttcctcgtaagcgaccagagccgtttcgccaaggaagtgctgccccagtatttcaagcatagcaacatggcgagcttcgtgcgcc

SEQ ID NO: 36235 - DNA, 44 bp, Homo sapiens
  chr16:67360535-67360579
  hyper
aatccttggccacagcggcccccattcgccgctttggtgctttt

SEQ ID NO: 36236 - DNA, 30 bp, Homo sapiens
  chr16:67427344-67427374
  hyper
acgcgggagaccaggcggctccgcagctcc

SEQ ID NO: 36237 - DNA, 40 bp, Homo sapiens
  chr16:67433365-67433405
  hyper
ggagagggggcacagcgcgattggccggctcattccccgc

SEQ ID NO: 36238 - DNA, 30 bp, Homo sapiens
  chr16:67572408-67572438
  hyper
ccagtccttcgcaggcgtcctcggcagcca

SEQ ID NO: 36239 - DNA, 63 bp, Homo sapiens
  chr16:67679073-67679136
  hyper
caggcttcctgtgtgcgcgctcgtcctctgctgtttcccgccggagctcgttgggcctccccg

SEQ ID NO: 36240 - DNA, 103 bp, Homo sapiens
  chr16:67700928-67701031
  hyper
ggcagggacagctcacggaggagcccggcagcgctcagacctccgaggtgaccgtcaggctgtttaaccttcaaacacagggccgcagcgctctgagaggtgg

SEQ ID NO: 36241 - DNA, 99 bp, Homo sapiens
  chr16:67877035-67877134
  hyper
agtggagtttgcagccgcagagggcgcagccgctgcggccgccgcgtcggagttacaggctgctaccgcagggctggaggctgccgagtgccctatggg

SEQ ID NO: 36242 - DNA, 45 bp, Homo sapiens; identical to SEQ ID NO: 12529
  chr16:68118410-68118455
  hyper

SEQ ID NO: 36243 - DNA, 156 bp, Homo sapiens
  chr16:68118759-68118915
  hyper
ggtccctgccctctggagactcagccattaaagttgaggtggggggatgaggatgtgggcggcgtccaggtaactctgaggggccctgatgccttccctagagccagccatcaggagtaacacgatgcgcccccacatcaccgaacccagaacctc

SEQ ID NO: 36244 - DNA, 224 bp, Homo sapiens
  chr16:68504068-68504292
  hyper
gtaaaggaagcaacacggaacaaccacgtttttgttattcgaaatgcagctacacgtgtttacagtccttaaccatttcatctgacagcctggggagacagacttctaatttgtgttttgataaactgagagtgacagagcggttgttggccctgcttggaggtggagtgatggtgtggtcagaagggaagccggagggaagttacactcgtggggtgtgtgtt

SEQ ID NO: 36245 - DNA, 184 bp, Homo sapiens
  chr16:68544194-68544378
  hyper
cggcccggacacccacgggccaccgcgtcgaggcagcgcgagccccgggcgccccctgcaggttgtacgggcctcagctgcgcagcgcagacggaggagggcgctggcggttaagaactcctacttgtcaaccggaaaaacatcccccataaaaaaacggtcaaagggccgggacagaagcatt

SEQ ID NO: 36246 - DNA, 245 bp, Homo sapiens; identical to SEQ ID NO: 4365
  chr16:68676360-68676605
  hyper

SEQ ID NO: 36247 - DNA, 198 bp, Homo sapiens
  chr16:68676841-68677039
  hyper
cgtggtccacccccagcctcagtcccagccccagctgctgggctcacccgccggctaagggaatgctcccgagataccagatgccagttgctcgttgtaccctcagccatgaaattggaggattacaacgcttctcattctcttaattcaggggatgtggggatgctagaaagagagacggctcgccagacatctgag

SEQ ID NO: 36248 - DNA, 99 bp, Homo sapiens
  chr16:68679959-68680058
  hyper
cccagcagaggaatgcgccggccacattcttcccccaacccgcgcgcaggtgtggggatgagccgtgccccgggcagcccccttcgcccctctcgggcc

SEQ ID NO: 36249 - DNA, 66 bp, Homo sapiens
  chr16:68771258-68771324
  hyper
cagcccggcccgacccgaccgcacccggcgcctgccctcgctcggcgtccccggccagccatgggc

SEQ ID NO: 36250 - DNA, 133 bp, Homo sapiens
  chr16:71459956-71460089
  hyper
cgtgcttgccggttcttgccaccctccgccgcttgcaccggacccaggcgctcatcccccgcttcccccgcgccccagcccggtcacgcctcggagcttgtccccacctggccgtgctcagagtctgcctgcc

SEQ ID NO: 36251 - DNA, 247 bp, Homo sapiens
  chr16:71460270-71460517
  hyper
cgcacaagcccggggtgagaccagaagctgctgcctgcagagcccgaccttgcgtagatgactccgcgagtgcaaggggctgcaggcattttcttacaggaggtagcaagcttgtctaagcagaggccctcttagcgcagtgggcagcgcgtcagtctcataatctgaaggtcctgagttcgagcctcagagagggcagctgttttgttgtgctacgaatgcagcaaatgttcggatgtaacccagc

SEQ ID NO: 36252 - DNA, 28 bp, Homo sapiens
  chr16:73100271-73100299
  hyper
cggagccagcgtgcgcgtccctaatgcc

SEQ ID NO: 36253 - DNA, 7 bp, Homo sapiens
  chr16:73100575-73100582
  hyper
cgcccca

SEQ ID NO: 36254 - DNA, 107 bp, Homo sapiens
  chr16:75528762-75528869
  hyper
gctgtgccaccagcccggcccccagccgacccgagtgtggggacatcccccgcggagaatgaagaaccaacgtaccccaaagcttggcggctctgcccgagctgcag

SEQ ID NO: 36255 - DNA, 412 bp, Homo sapiens
  chr16:75528922-75529334
  hyper
cgtctcttccaaattccaccgcacagccagctctttctcttcactgggagggtccgcaggggctgacttgctccttaaggtcccaagactattaagcgacacccggtgaggccgggaaaggggctctaagaggcatggacgagagttggcggtgaccaagccactggaagctcctggagactcgaggtagaacgaatgtgggaacagggcaggagtcccagaatgggatgttgaggctgggggtgtcctggggctaccacagggaaggacccggcgcagagctccctctggaacccggcactgcggcccgcgccctctactccccgcgcgccggccggcaaccctcggcgctgcccggtgcagcccgcccgagcgcacacaatgaggcgctttcagacgtggctgcggtccc

SEQ ID NO: 36256 - DNA, 41 bp, Homo sapiens
  chr16:76311161-76311202
  hyper
cgcctctgggtgcagcggagctcgagcgctgttgtgtgttt

SEQ ID NO: 36257 - DNA, 65 bp, Homo sapiens
  chr16:77246006-77246071
  hyper
cctcctctttgtcctcgcagatgctggagcagcgactggcccgggagatccgtgccctggagaga

SEQ ID NO: 36258 - DNA, 623 bp, Homo sapiens
  chr16:77246307-77246930
  hyper
gggcggaggggaacccgcccaggtcccccgctccgcccccgactgccgcttccccggcctgtgcctccctcggcgtcgtcgggtctccgcgtctcggtggcttcctcctcgtcccctggactctcgctctcttcctcctgtctcctcggccccttctccgcaggctgaaggcggagctggagatattcggggagcaggtccggagcgcccccgaggtcggggccggcgagggagaggtagggagcccgaggaagggaggcggggcgggcagggaccgagtcaggagagagcgggcgggggtcctgggagcggcccccgagagtggggtctgtggggagcagggcggccccggggacagaggaagccgcggtggaggcctagggcagacgcgggcggacgcgaggagcgtaggaacctggtccgcagcctcacccagcccccggcaggccggacctgagctcccccgcgctcgcgacgaggaggatcccgagccgccggtggctgcccctgacgccctctaggccagcaggacccgcccgttcccgaccttccctcgagacccgccaagaaataaaggcgatgatttccgaccatgctcgcgttctccgcggagtctgtgctac

SEQ ID NO: 36259 - DNA, 37 bp, Homo sapiens
  chr16:77468421-77468458
  hyper
atcgcgcgtgaggggcgcggcggggctggcgtcgggc

SEQ ID NO: 36260 - DNA, 59 bp, Homo sapiens
  chr16:77469028-77469087
  hyper
gggctcgtccgagcccccgggctggtgcaagggcgtgggattcccggctccagctctga

SEQ ID NO: 36261 - DNA, 266 bp, Homo sapiens
  chr16:77822153-77822419
  hyper
cccagacattagtctcggtccatttcaaggcacccgagcctgtgccgtatataaccaagtactgggcccacaggaagggggatgacagggtggtctctctaggctcgttttagtcacagatcttcggcaaatttgggtttagggccgcgatcccgaccctaacttgggactatttcaggaactggagttgaggcttcgttgggacaggaaagaagggtggggcgggggtgaagcgcttagggcacggctcttgtgaggattacggc

SEQ ID NO: 36262 - DNA, 727 bp, Homo sapiens
  chr16:77822420-77823147
  hyper
gaggctgtggaccgcggcggcgctcgcagaggctgcagccattgcacagccgagcatcccacattcaacaggaggaacccgcgggagaggagccccactcccccagcgccgcagccaccgcagccaccgcagcccgtgcgccccgcgccctcgagcgccatggccaaggaaggcgtggagaaggcggaggagacggagcaaatgatcgagaaggaggcaggcaaggagccggcggagggcggcggcggcgacggctcgcaccgcctcggggacgcccaggagatgcgcgcggtggtgctggctggcttcggggggctcaacaagctgcggctcttcaggaaggccatgcccgagcctcaggacggcgagctcaagatccgcgtcaaagcctggtccagtatccgcgcctttctcgctttctctctttttgcgcgctgggcgctggggagggggtgggaaagctgcggctgggatgctgcccgggtagaaccgccgcgcgcaccccctccgcgccctcacccgggtctcagagcctccccgggccaaagctggggaggatgcagaggggcggcctccccaagccagatctaggggtgacgggaggagaatgtgagctcctgggcgcggggagaatgctggcgcccaggcaccccgggtctggaagattgcgctacgggagttctccgtctgagaggacaactcagctttcgcacgggagggttgatgc

SEQ ID NO: 36263 - DNA, 374 bp, Homo sapiens
  chr16:78079785-78080159
  hyper
ggggagcggctacagcgcgggatcctggggagatagctcaaggcaggccagggaaggacaggccgggcaatgggcgcggagacgaaggggccggacagcggcgaggcgctggctccggtcgcggcacccggctgctgagggcagtgctgctgcttgggacgttccaggcgaccaagtaccctcggcggccctggcagggcggtgcctggggtgggcgctgggcctccaggcctgcagccacgcttggcgctgtccgctagggccaggtgctgaagtgttggccgcgagcggagctgctgcagcgctggcttccccgggccgctgcgggtggacttggacaacataaagggctgattgagcggggccactttttc

SEQ ID NO: 36264 - DNA, 32 bp, Homo sapiens
  chr16:79623822-79623854
  hyper
ctccctgggcactgccgcgggtctgggactgc

SEQ ID NO: 36265 - DNA, 167 bp, Homo sapiens
  chr16:79632650-79632817
  hyper
gtggctagctggaatcgcgtgtcagactcacatgaaaaactcgggagaggacgggttgtcgctgctcgagccgttttctcggaagccgctgctcaccaacttctcgtatttctccttgtacgcgtccctctcgcgcaccagcctggagatctcctgcttgaggtggt

SEQ ID NO: 36266 - DNA, 95 bp, Homo sapiens
  chr16:79633073-79633168
  hyper
cgcccccgccgcgcccccgccgcctccgccgccgccgccgccgccgccgcccccagcgctggccgggccaccgccgcccgcgcccccagcgccac

SEQ ID NO: 36267 - DNA, 59 bp, Homo sapiens
  chr16:79633469-79633528
  hyper
ggggctgaagcccagcgcctcggggttcagctgctgcgggtagccggtcatccagtagt

SEQ ID NO: 36268 - DNA, 51 bp, Homo sapiens
  chr16:79633792-79633843
  hyper
atgccattctcctgccgccgccgccgccgccgccgccgctccgccagatgg

SEQ ID NO: 36269 - DNA, 30 bp, Homo sapiens
  chr16:79634970-79635000
  hyper
gacaggcctcccatccggagccccagctcg

SEQ ID NO: 36270 - DNA, 32 bp, Homo sapiens
  chr16:79635617-79635649
  hyper
tttatcagggtcaggcgcgccctttgcacttt

SEQ ID NO: 36271 - DNA, 58 bp, Homo sapiens
  chr16:79804242-79804300
  hyper
gacagaggcaagacacgcagcgagtgctctcgcgagagttcaccgagttgataaaatt

SEQ ID NO: 36272 - DNA, 369 bp, Homo sapiens
  chr16:80574670-80575039
  hyper
tggacaaacacaggccgggagcctgacccacttccctcttccctcccgggacccactgctccaggattgggcgaacctcaggtgagcgcctgctcccctcttccgcgaaccttcgcctacggcggccgggaggcatcaggagcgcggtcagggcgaaaaagccgactcgcgagcgcgcaggcgcagccctgacgcttccgtggggccacttccttttttgtctcctagcaacggcgggtagcgttgttgacatcccgggaggctgtgccgccggcctgagcccagagtttcgcggcctccgcgatggtaaatctggggtctccgtccacgccccgccgttccaagcacgccgaccgtcaaggaccttcg

SEQ ID NO: 36273 - DNA, 32 bp, Homo sapiens
  chr16:80966399-80966431
  hyper
ctctcgggaaggccccgcgggttcccaccagg

SEQ ID NO: 36274 - DNA, 30 bp, Homo sapiens
  chr16:81779906-81779936
  hyper
gagtgcttgagttttcgcccccagcacagg

SEQ ID NO: 36275 - DNA, 30 bp, Homo sapiens
  chr16:81813567-81813597
  hyper
atgcgtgtgtctgtgcgtgttgtgttttgt

SEQ ID NO: 36276 - DNA, 256 bp, Homo sapiens
  chr16:82660312-82660568
  hyper
tggccgccagtcccccgtgcaattccattctctggaaaagtggaatcagctggcattgcccagcgtgatttgtgaggctgagccccaacagtccaaagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgct

SEQ ID NO: 36277 - DNA, 124 bp, Homo sapiens
  chr16:82660780-82660904
  hyper
tttctgcattcggatcgcccggcacgggcagggtgagggggctttcggggggtcggggcctccggtcgcggcggcgaagacagatcggggctcggtagggaggtcattccgagcccagagatcc

SEQ ID NO: 36278 - DNA, 161 bp, Homo sapiens
  chr16:82661251-82661412
  hyper
ccccctggtacagcccggctgcccgctggaaggcgcctcggggcagcagagagcctcagcccggctgctgctgtcgctcaaaggcgccggcgccggccgcacccgcatcggggtccttttgctcccagaccccgggcccgaaagggccggagcgtgtcccc

SEQ ID NO: 36279 - DNA, 292 bp, Homo sapiens
  chr16:82661468-82661760
  hyper
cggccagatcccgggctgccgcctctgctgccttccctgagcgggagcggagcgcagagaaaagttcaagccttgcccacccgggctgcagctgcttgttaaccctcagagcgccacggcgcgagggaagggcacgccaaccaggagagggggcgagggagatgcggtccgcctgcagtcacctctgcacctcagagatttcgggaagtttgagtgcaggaaagcagcgctccgaggccaggcctggggtgctggccgctgcggggggcacgccctgcgctgctcaggggcc

SEQ ID NO: 36280 - DNA, 30 bp, Homo sapiens
  chr16:84001873-84001903
  hyper
gggggactttagaagcggggagagcaggag

SEQ ID NO: 36281 - DNA, 52 bp, Homo sapiens
  chr16:84402140-84402192
  hyper
cccaggaggcttgggcgcgcgcagccatcccgggcctcgccggggacctagg

SEQ ID NO: 36282 - DNA, 125 bp, Homo sapiens
  chr16:84633325-84633450
  hyper
actttacagagactccggagaggttatgcaaacacggctcaggaagggaaaaaacaacccacacaccaaaaagctgagctgtcagcttccaccgagggagctccctggagcgaggatgaaaggaa

SEQ ID NO: 36283 - DNA, 297 bp, Homo sapiens
  chr16:84853364-84853661
  hyper
ctccttgtccctagccggccctggaggccagcggccccgccttcctcgcccacccggcgcccgcgcctcagctgccccccgcctccttcagcccgctgagcctgcggggcggggccgggggcggggccggtgatgctcggtcctaccagcgccgccagcgatctgggggcgtggcctccgggctccggggagcctacaagaggcggtacgctgagccccggcacccactcgcatcccagggcgtctccggctgctcctattgagctgtctgctcgctgtgcccgctgtgcctgctgt

SEQ ID NO: 36284 - DNA, 183 bp, Homo sapiens
  chr16:85203399-85203582
  hyper
ccgctgcttcctgggcgagcagtgggccgccttcgagcgcgcccgcacgccggtggacaagcgcatgtactggctcaagcggccccaccagtgcgacgcgggcgcaggcggccgccgtggcggcgccggggccccccgcgagtggaacgtcgcctacgcgctgggcagcgccaccggcgacga

SEQ ID NO: 36285 - DNA, 360 bp, Homo sapiens
  chr16:85932306-85932666
  hyper
cagcgctcgtgaaggcggagaccggcggggcagctagtttctggctgtggattctgattaatgggccgcaggcgcacggtctgcaccgtccggctcgttgctagtggctcgctcgggagccgccgcactcccggggctgtccgcccgagccggcctggaaggcggaggacgcctccaggtcgctccgcggggcctccggaattcctgggaaagcccccctgcagcgccgcccctggaccccaggtgtgaggagcggggctcggccagcggctccagaagaggcccggaccccactgccgtggctgccgggggcgggaaagtgatttctcggaaagcagagcacttcgaagaaggcgggcc

SEQ ID NO: 36286 - DNA, 1 bp, Homo sapiens
  chr16:85932667-85932668
  hyper
c

SEQ ID NO: 36287 - DNA, 304 bp, Homo sapiens
  chr16:85932669-85932973
  hyper
cgagccaagctgacgctattggtcggtgtggccgtcgctctgcgcaccgcccgtcccccccacgaccctttttaaggccgcgcgaccgctggcgcatcgcctggagcgcggcagcaagcgtgggaacgcgggcggcgagacggcggcaggacggcggcaggtaggcacagtgggcgggtagggcgcccgtgtcccgcgcggtccggtcccgcggggtccccgacgccaggcggggcgtgggggtggaactacctaccgtaatgtccccgggcgcagctcagtggccacccgtgtccctctctgc

SEQ ID NO: 36288 - DNA, 30 bp, Homo sapiens
  chr16:86081925-86081955
  hyper
gctcgccactctgcccggaagggggagggg

SEQ ID NO: 36289 - DNA, 205 bp, Homo sapiens
  chr16:86320284-86320489
  hyper
gggctccagaaaccccgaccctcgcaggggagagccagccgaaccagacgtgtgggggcagcagccgccgcggcggtctgggacgcgggtgtcgccttccacgggacttgggtccagggacccaagacggggatctgggaggagggggatgcccttggggcctgagacccgggcggtttccgaagcgaagtagttacccagaacc

SEQ ID NO: 36290 - DNA, 569 bp, Homo sapiens
  chr16:86320490-86321059
  hyper
ctccctaccttctccccgcctccctgtctttctgcccctctgtcccctgcagctgctcggccctccctcctctgaaacccaccgcccgcccaaggctcactccttcctgctgttcccgcccgcgaagctgttgcagggacggtgcgcccttgggctgcactcaccaccgcccctcgcccgcgacgtcctggccccctaaccccagctttcccgccgccgctcactcccgcgctccgctgcagctcagcccggtctgcaactctccctctgttttctgccccgctcctcagttctgcgctctcctcttctccaggcttccctctcctcctccttctgcctctcccctgtccccgttccattctcctgcgcccctcgccagcgcgctcgcagcccatcggctcctgccggggcccctctggtgccagccgccttcaggctgtgggtccgtccgctggtggaggggaaggtcggggctggccccgggccccgcgctgctgggccccatggtcagtggagacgcctcctggtctcccttcagagctcctcgtcgtcgtcggagtcatcggagg

SEQ ID NO: 36291 - DNA, 46 bp, Homo sapiens; identical to SEQ ID NO: 4372
  chr16:86530947-86530993
  hyper

SEQ ID NO: 36292 - DNA, 273 bp, Homo sapiens; identical to SEQ ID NO: 4373
  chr16:86531016-86531289
  hyper

SEQ ID NO: 36293 - DNA, 107 bp, Homo sapiens; identical to SEQ ID NO: 4374
  chr16:86531374-86531481
  hyper

SEQ ID NO: 36294 - DNA, 98 bp, Homo sapiens
  chr16:86531527-86531625
  hyper
cgttccctggttcacaaccaccccacccccacgcgcctgtgcacatgtccctcccgccgcgcagggtctccgcgggcgcgccccgccccaaatagagc

SEQ ID NO: 36295 - DNA, 324 bp, Homo sapiens
  chr16:86539103-86539427
  hyper
cacaaatatccctcccgcgctcctccggcagccgtgaagtttcgtttcccccggccgggtcctccttccctcccttccgaagccccgaggacaggccgcttccctcccgcccagctcccgcgtcgggtcctggctggccgccctaccttgaggcgtcgtttgaacctcgcctcgcggggggttggagggagcgggggcgggcgaggagggcgcgggcccggcgttaatgcggagcgggggcggcggcggccggcggggcggctgccctcgcggtgggtggtcggcggccccctgccccgcccgcgcggccggcctgggctccct

SEQ ID NO: 36296 - DNA, 36 bp, Homo sapiens
  chr16:86539463-86539499
  hyper
cgctctcggcccgggcggcttcgcttaagcaattag

SEQ ID NO: 36297 - DNA, 226 bp, Homo sapiens
  chr16:86541633-86541859
  hyper
aagggtgtttgaggccgtgggcggtgcggagcgtgtctgtgtgcgcggaggctgagctggttgtgtgaagtggtagcgggtctgccagagagcgtttacctgcgtgaatgcacaaccacacactacgggtcacgtcccacactcattctttccctaggcgggccaggctgtctgcacgcggagacccagagaggccagcggaagggcagcgcgggaaggcggctct

SEQ ID NO: 36298 - DNA, 50 bp, Homo sapiens; identical to SEQ ID NO: 12561
  chr16:86542388-86542438
  hyper

SEQ ID NO: 36299 - DNA, 101 bp, Homo sapiens
  chr16:86543663-86543764
  hyper
gagtgaaggctgcctcgcccggaatctcggagccgagcgccgcgggcggcggggactcagggctgctcccggctggggcgcacggccgtaagacctggagg

SEQ ID NO: 36300 - DNA, 367 bp, Homo sapiens
  chr16:86544191-86544558
  hyper
agaagcagcagccaccgcacggcggcggcggcggcggcggcgggggaggcggcgcggccatggaccccgcgtcgtccggcccgtccaaggccaagaagaccaacgccggcatccggcgcccggagaagccgccctattcctacatcgcgctcatcgtcatggccatccagagttcacccaccaagcgcctgacgctgagcgagatctaccagttcctgcagagccgcttccccttcttccggggctcctaccagggctggaagaactccgtgcgccacaacctctcgctcaacgagtgcttcatcaagctacccaagggccttgggcggcccggcaagggccactactggaccatcgacccggccag

SEQ ID NO: 36301 - DNA, 163 bp, Homo sapiens
  chr16:86599222-86599385
  hyper
cacccagtcttcccacggagcgcgctccctaactcaccctacccacccaacaaaacaaaaaaaaggctgaaatatagaaaagcaacttggaggctcccagggggacgttgccaggagcaggaggcagggacagcgccctagggtcggtgttagcggccggcgc

SEQ ID NO: 36302 - DNA, 512 bp, Homo sapiens
  chr16:86599480-86599992
  hyper
cgggtttctcctcgcagggcccaggaactcggctctgcctggcccgggtgggtcgctgcattgtcccggtcttctgggagtgcggggtcagcttgttagagggaatttctacctgggaaaagggagacgagtttcgaagctgaagttggtaggctgcgagtgtccacgcgggagacgaaagggggaaatagcagagtcacttcacccttttccccaaaccccacaaaactgctcgcagcgacgcggatgatctaccgaattccccgcgaattcggaggattaagttgtcagtcagcacgttgctaccttcccctctatgcactccgctgcctggctcctcggcggggagcgagggaaactcagtttgtagggtttacctctaaaacctcgataggttatccttgacgaccccgagcctggaaactccctgttgatgattaattatttgattaaataagtataacatccaggagaggccctgccattccaatccagcgcgtttgctttgaatc

SEQ ID NO: 36303 - DNA, 648 bp, Homo sapiens
  chr16:86600315-86600963
  hyper
ctgcgctcctcgccccgattggcgccgactcctctcagctgccgggtgattggctcaaagttccgggagggggcgtggcccgaggaaagtaaaaactcgctttcagcaagaagacttttgaaacttttcccaatccctaaaagggacttggcctctttttctgggctcagcggggcagccgctcggaccccggcgcgctgaccctcggggctgccgattcgctgggggcttggagagcctcctgcgcccctcctcgcgcgggccgagggtccacctgggtccccaggccgcggcgtctccgctgggtccgcggccgcccgcctgcccgcgctgccgccgccgggtcctggagccagcgaggagcggggccggcgctgcgcttgcccggggcgcgccctccaggatgccgatccgcccggtccgctgaaagcgcgcgcccctgctcggcccgagcgccgccgcccgcgcaccctcgccccggaggctgccaggagcccggggccgcccctcccgctcccctcctctccccctctggctctctcgcgctctctcgctctcagggcccccctcgctcccccggccgcagtccgtgcgcgagggcgccggcgagccgtctcggaagcagcatgcaggcgcgctactccgtgt

SEQ ID NO: 36304 - DNA, 326 bp, Homo sapiens
  chr16:86601213-86601539
  hyper
gaagatcaccttgaacggcatctaccagttcatcatggaccgcttccccttctaccgggagaacaagcagggctggcagaacagcatccgccacaacctctcgctcaacgagtgcttcgtcaaggtgccccgcgacgacaagaagcccggcaagggcagttactggaccctggacccggactcctacaacatgttcgagaacggcagcttcctgcggcgccggcggcgcttcaaaaagaaggacgtgtccaaggagaaggaggagcgggcccacctcaaggagccgcccccggcggcgtccaagggcgccccggccaccccccacc

SEQ ID NO: 36305 - DNA, 464 bp, Homo sapiens
  chr16:86602037-86602501
  hyper
cgtcgcccctgagcgctctcaacctcgccgccggccaggagggcgcgctcgccgccacgggccaccaccaccagcaccacggccaccaccacccgcaggcgccgccgcccccgccggctccccagccccagccgacgccgcagcccggggccgccgcggcgcaggcggcctcctggtatctcaaccacagcggggacctgaaccacctccccggccacacgttcgcggcccagcagcaaactttccccaacgtgcgggagatgttcaactcccaccggctggggattgagaactcgaccctcggggagtcccaggtgagtggcaatgccagctgccagctgccctacagatccacgccgcctctctatcgccacgcagccccctactcctacgactgcacgaaatactgacgtgtcccgggacctcccctccccggcccgctccggcttcgcttcccagccccg

SEQ ID NO: 36306 - DNA, 84 bp, Homo sapiens; identical to SEQ ID NO: 12569
  chr16:86775022-86775106
  hyper

SEQ ID NO: 36307 - DNA, 30 bp, Homo sapiens
  chr16:87622644-87622674
  hyper
cactgcgaagggctccggccttttccagtg

SEQ ID NO: 36308 - DNA, 129 bp, Homo sapiens
  chr16:87635070-87635199
  hyper
cagtttctggctcaccgcgctgcggtcaccggcccacactcccaggagcgaggaccctgggcagcctccacacccccatcagcccactgcaccggtctgctgccatttcccgcacgcatttcaggaggg

SEQ ID NO: 36309 - DNA, 37 bp, Homo sapiens
  chr16:87635424-87635461
  hyper
agggcgcagggcgcacggaattcgggtgactttgctc

SEQ ID NO: 36310 - DNA, 294 bp, Homo sapiens
  chr16:87636197-87636491
  hyper
gccgccgccgccccgcgcccggcccgcggcccccaatatggtgcagccgccagcgccgccgcccgtgccgccgccgccgcccgcgggccccgccgccgccctcgggcgcccgcagcgcggcagccgcaggtggggggccgcggcccgggcctgagctgccccccgcccggcctcggcgcggcgccctccccgcggggctgccggcgaggggccctctcgccgctgaggtggagccgcgggccccgccgccgccgctcctgccccctccctccctcctcccctccccctcccctc

SEQ ID NO: 36311 - DNA, 156 bp, Homo sapiens; identical to SEQ ID NO: 12571
  chr16:87636626-87636782
  hyper

SEQ ID NO: 36312 - DNA, 537 bp, Homo sapiens
  chr16:87636783-87637320
  hyper
acggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggaggtaggtgccgcgggccgggccgggccggggcgggagggacgtgcttccgatcgcgccccttctgtggatctctggggaagttgagctgcgtcctccggttgggccgtgggcaccaggggcctttcccgggcttccctggaagccacggcggctcctggctacaggttgccccgctgcctggtgggg

SEQ ID NO: 36313 - DNA, 78 bp, Homo sapiens
  chr16:87637599-87637677
  hyper
cgaatctgcccaagccgagagaaagggagtgatggggagcgctaggggcgggggatgccaacccgaaccaaaacagcc

SEQ ID NO: 36314 - DNA, 120 bp, Homo sapiens
  chr16:88449303-88449423
  hyper
gctggggggagggtgcgggggcggcggagtctgtaacctaagccgccccagcctccggggggcagaccccgcggccgccggccggcgtccggccttcccagcacccggcccagggctgga

SEQ ID NO: 36315 - DNA, 302 bp, Homo sapiens
  chr16:88449693-88449995
  hyper
ggtgcctggggaccccgggctggaacgcggggcgggggtgtcaccgggctgcgcgggggtctccggcccggctcccgctcctgcgccctcgggggccgctccccggcggggccggaccctcccagcgctcgcggcgcccggcccggctcccccgacctcctcctcccgggcccggacgtgcggggcagcgagcgccggggcccggcgggggccgcagccttgcccggagcggagcgttggcagcgcggggtccggctccgtgggcagtttgggaagcgcccgggcaacgtactggcgagggc

SEQ ID NO: 36316 - DNA, 65 bp, Homo sapiens; identical to SEQ ID NO: 12576
  chr16:88450363-88450428
  hyper

SEQ ID NO: 36317 - DNA, 178 bp, Homo sapiens
  chr16:89006356-89006534
  hyper
tatccccggccgacccgtccgccgaggtggctgccctgggaacctcctgttcctcgtccaggagaggaaacgcacacccgggccggacgcacagaagccgcaccctggctggggccacaagcctgacagctaccgacaagcccccacccacaggagcacgcgacgtgctctcttttca

SEQ ID NO: 36318 - DNA, 30 bp, Homo sapiens
  chr16:89006819-89006849
  hyper
tcccacagcctggctcggggcctgcccaac

SEQ ID NO: 36319 - DNA, 271 bp, Homo sapiens
  chr16:89007509-89007780
  hyper
tggtccccgcctccacgactcaggggcggctgcgcgctgtcttctggcgccgcaccgggctcaggcgcgcggcggggctggggcgcgcggggcggccgcctgggccatgccggggactcggctccggccaccccgcgcgggaacaaagcgcgcaccccgcccggggcggtctccggcctccgcggcccgcgccgggtccagccgccgcgcctgtggctccaacgccgcgcgctcgcccgagagtctcacggggccccgcggcccccgcccc

SEQ ID NO: 36320 - DNA, 505 bp, Homo sapiens
  chr16:89267320-89267825
  hyper
gccagcccaaagccacggtctgctgaagacgctggtggtcctgaagcaaattccaggccctgctcccccaccggcgccttcggctccaatcctccagcgccccaggccgccccgcgcctggcagctcccaggcccagattcagcccccgcccggcccctctccgcgggtccggcccgtgcgcgcccgtctgcggcaccgtcgggccggcggccgccccggagcaggaagcccaggaggacggccggggggcccgggtcagaggcgccaggtaggatggagaaaggacacccagggcctcggcgggctgggggcggggagggctgcggggcagcagggacgggggcgcacctgggtgaccgggctttgcaggaggccggcgccgggcagcgcgtagagccagccgcgtgtgcagggccgggtgccgttgcgtgcgggcgcggggcgcgggcccggggcgggtgcagggcgcgggatcggggtagcgcaggagcaggcaggggctcg

SEQ ID NO: 36321 - DNA, 95 bp, Homo sapiens
  chr16:89268397-89268492
  hyper
tgcactcaggttgcccgggggcgcgcgggctccggccggcgtcccggggtggtccccgcgtggggccgggggcgtccgcgcgggcggggcgaggt

SEQ ID NO: 36322 - DNA, 30 bp, Homo sapiens
  chr16:89268813-89268843
  hyper
ctcgcgttaacaattcgaatgggcacgttt

SEQ ID NO: 36323 - DNA, 61 bp, Homo sapiens
  chr16:89778723-89778784
  hyper
cctgcctctgcaaagcggggagcccctcggccctgtaccccgaccccggaacctccgctcc

SEQ ID NO: 36324 - DNA, 83 bp, Homo sapiens
  chr16:89992890-89992973
  hyper
ggaccccaagcgctgcgcgaggtcagcaccaaggacagcgcccgggccgagcgcctggcctcgaacgccgggttctgctttgt

SEQ ID NO: 36325 - DNA, 208 bp, Homo sapiens
  chr17:1083533-1083741
  hyper
aggatcctggcgatccgcaaaccaggtgccgtggggggcccgggagcccacaggggtgacatcacctcccgcccgggatctccaagcgcggcttcgcgggcgggagcggcggccgggcccctccccagccagacccgctgcgggacccacggggtgaacgtcctgcgcgccgcgggacgcgcctctctcctcccgaaccttcccccgc

SEQ ID NO: 36326 - DNA, 89 bp, Homo sapiens
  chr17:1174273-1174362
  hyper
ggccgcgcgcggggacaccggggacacaggcgccagccccccgccgcctgcagggcccagcctcgcgcgcccagacgccgcccgcccct

SEQ ID NO: 36327 - DNA, 165 bp, Homo sapiens
  chr17:1174384-1174549
  hyper
cgcctcgtgccccccgcacgcgcccctggcacggcccagtgcggtggccgaggggccgggcctagcacaggcctccgggggaagctggcgccgctgtccgggggcttcctctgccgggccgcctccctggccgcggggctacctgcgatccgcccccgggatggg

SEQ ID NO: 36328 - DNA, 30 bp, Homo sapiens
  chr17:1811643-1811673
  hyper
tcgcccgggacttcccgtcctccaagcctg

SEQ ID NO: 36329 - DNA, 212 bp, Homo sapiens
  chr17:1901506-1901718
  hyper
ggcggggagggctgtcgcattgatccggagctgcagggcgagggcggtgcccagacccggcgccccaaggcctcccgcaggccgacccgagccgagcgcgccctttgggcaccggccccgcccgggagggtcttctcgctctagagccgggggcccgcgctgagagatcggggttaccgcgcggggagccgcggccgcgctgggatccgttc

SEQ ID NO: 36330 - DNA, 50 bp, Homo sapiens
  chr17:1901920-1901970
  hyper
tcctcctgggctcgccgggatgtggcctccgaggtcgccgcggcgctttc

SEQ ID NO: 36331 - DNA, 272 bp, Homo sapiens
  chr17:1927434-1927706
  hyper
gccgggctgctggggcgtctagctacggtggtcgcgaagccagctgtcctcaagttgagctgtgcaccggtcgcgcacactggcggcacggctttcgcgtccctccgctcccagcataatgaaagtttgaggaactggacatcaggcgctggccgctccccaccctcagccgctgggtgcccagagcccatccctagcgatcagagcagaactgcagagaagacgtccgcgtccgggccccgtctggggagctagggcgcgcggggagcgcc

SEQ ID NO: 36332 - DNA, 176 bp, Homo sapiens
  chr17:1927990-1928166
  hyper
ccagcagcagcccctcggcgggtgcgcccggcaaaacccaccagcccgccgggggctacttcccagaccgggagccccggcgccgggcggcgcccgggctcgcggctctttccggagcgcattcaacttcaacttgcccctgcggctccaactcacctttgcgaagcatgttggcc

SEQ ID NO: 36333 - DNA, 34 bp, Homo sapiens
  chr17:1957561-1957595
  hyper
ccctgttgtttccttcgggcgggtgggttggaga

SEQ ID NO: 36334 - DNA, 132 bp, Homo sapiens
  chr17:1959132-1959264
  hyper
gggggagaaggggccgggggagccgcggagggaggcgccgggcccgcgcgtgtagggcccaggccgaggccgggacgcgggtggggcgcaggcccgggtcagggccgcagccggctgtgcgccgtgcccgcc

SEQ ID NO: 36335 - DNA, 129 bp, Homo sapiens
  chr17:1959436-1959565
  hyper
gggccccgaccgagggttgacagcccccggccagggcggcgccagggcgggcaccgcgctcccctcctccgtatcacttcccccaactggggcaacttctcccgaggcgggaggcgctggttcctcggc

SEQ ID NO: 36336 - DNA, 49 bp, Homo sapiens
  chr17:2627535-2627584
  hyper
agtacaaaaggctggcggttcggggatttggggggagccggggccgcct

SEQ ID NO: 36337 - DNA, 517 bp, Homo sapiens
  chr17:2627798-2628315
  hyper
cgggcgctgggccgcagcggcctgcgtgcatagaggaagagcgcggggtcgggcatggggtcggcgtcgtcgagggcgccggccccgcggtcccaggcggcccagtcccggccggggcccttggcggcggcctcgtgggcagcaggcgggcggcgggctcgcagtgcgcggcggcgtggcctgggctcggcggtggcgccggggcccgggcgcggggcctgcagtctctggcgcgccgcgtgcagctggcaggagaggtaggcggccgcctcggtgtgcttctgcagctcggtgcccagcacggtggcgcggtggctgcggcggcgcagctcctccaggaagcggcgctcctcggtgcgcaggctgcagcgcagcgcggacaccagcgcctcgcgctgcgccacctcccgccgcagctccgcgttggccgcagcacgcgcctccagctgcgactccagcgcgcggcacttgctctccagctcccgggacgccgcctctggaacggggcagaggccag

SEQ ID NO: 36338 - DNA, 89 bp, Homo sapiens
  chr17:2652543-2652632
  hyper
cttctgccagcagcccgccgcgagtcctgtccgcctcccgcgcgctgcggtgcccagccccgcgccagccctcccgggggagctggagc

SEQ ID NO: 36339 - DNA, 61 bp, Homo sapiens
  chr17:2659604-2659665
  hyper
caggggaggggtccccgtgtagcggggcagtcgccctttccccctccgcagtcctggcccg

SEQ ID NO: 36340 - DNA, 294 bp, Homo sapiens
  chr17:2680204-2680498
  hyper
gggtccagaggcagccgcgcgccaggcggcgcagaaggtcagtggccccggggctgggattccgcagccagcctggatcgggacgtgagtcctggtgtgactgacggggaatcggagcgtgtgtggagtgtgaacgcgtgtgtttgcagacagacatcggcacgtatggacggcgcgagccggtactgcgttccggaggagccatccggcgtcacaggctgtgctggggaggtggggtgaccgtcctcagaaacccccgcgggcggggcgctgcacacacgtccacctataggg

SEQ ID NO: 36341 - DNA, 136 bp, Homo sapiens
  chr17:2756282-2756418
  hyper
tgggcgcggggagggcggagtggggggcgcccggcccgccaggaggaagcggggtcgccgtgaagttggttattgaacccatgtggagtcaaactcccagggccgggagagccagtgttcgcggggagccgacccc

SEQ ID NO: 36342 - DNA, 72 bp, Homo sapiens
  chr17:3438866-3438938
  hyper
cgaagtagaagccttcgtgttggtacttggggttgaagaaggcccccttggcgtgcgcgttgacgtcggcgc

SEQ ID NO: 36343 - DNA, 74 bp, Homo sapiens
  chr17:3599635-3599709
  hyper
gcagccccccggatgcgcaggaccgccctgtgctgttgcccagctgaaagcagcgatcgcggaggagaggaagt

SEQ ID NO: 36344 - DNA, 183 bp, Homo sapiens
  chr17:3866983-3867166
  hyper
ctgctagctgataagcggcaccttcctgggcgttttctggagccctcaggggagaccctggggccagctgggaggccgagcctgagtctccggccgtccctcgcccgccggtgtctgcgctgcacctgcaggatgccagcgggagcggcgcggcgttggggtggaatacggtccaggatgggg

SEQ ID NO: 36345 - DNA, 513 bp, Homo sapiens
  chr17:4544491-4545004
  hyper
agaaagcgagaggaccgacggcggctccagtgactgctgagtttccagacaagggagctttgtgcaatgaggggcgcacaggagcatgccctcaattccaaggagatcgggtagcggcaacatttattgagcgcttactgtgtgccaccgactgccctaaagccccccacccccgtggcctccgcgcgctttgagcccaatgcgcgggcccttggcaaagagaatcggccagaggccaacgggggcgcatgtcctccccggtatttgactgactcggagccaggggcgcagcccaccccgcccggctctggggagctcaccttgccccgtgcgggccacagtcgcttcccgagcgccgcctccccgtgctggccgaccagccacagctgcacctggttgttggaaccggcatagagcgaggccccagtggacacgcggatgcggtagagacccatcttgctcaaagatgtttcgctccttctggtggagaagggtggacgagctaaataaccc

SEQ ID NO: 36346 - DNA, 154 bp, Homo sapiens
  chr17:4981395-4981549
  hyper
gtccccgcgggaatgcgaagcggattctcgagttcttgagcctagagcaatgcttggggagcgacacgagggcgcagagcggcagatcgcggagcggaagttcatccccggagccgttctaggaaacccggaggactcaggtcgtcaatgattc

SEQ ID NO: 36347 - DNA, 34 bp, Homo sapiens
  chr17:4981951-4981985
  hyper
cgtttaggcccgttctgaccggggttcgctgtgt

SEQ ID NO: 36348 - DNA, 282 bp, Homo sapiens
  chr17:5000354-5000636
  hyper
cccagtgggaaggagcggggacgattctggcgatcacatgaggaagggagcagcctcagcagcgcaggtggacacagtcgtcaaccactcgctggccgcctgcgacgtgaagcacctgcgctgggcgcggcgggtaagcgccgacactagcgggcgcctgaacagtccagcggcgtcagcgctgcggagcaggaaagggtcccaaacgcagggcggccatgcagcgtggcgcccacctgtccctctcctcgaagcgctgagccagcacgatgcacataaggg

SEQ ID NO: 36349 - DNA, 57 bp, Homo sapiens
  chr17:5000879-5000936
  hyper
aaaagtccccaaatgcgctagaggccagccagcccggtatccgagaggtaagagccc

SEQ ID NO: 36350 - DNA, 58 bp, Homo sapiens
  chr17:5001149-5001207
  hyper
gggcgggctctggggcgtccgcggaggctcccgcgtgcgtgtgcggggtggggtcggg

SEQ ID NO: 36351 - DNA, 37 bp, Homo sapiens
  chr17:5973300-5973337
  hyper
gtgtcaggcagtgtgcggctgtcgctgtgagtctgca

SEQ ID NO: 36352 - DNA, 270 bp, Homo sapiens
  chr17:5973825-5974095
  hyper
cgtgggtccgcttgccgcgggcggccggagacgtgcgggcgccggggcttctgggctccgggcactgcggggggctgcgggctcggcgcccggggaaggcgggccatgggcgcgggtgcgggcgccccagccggccgcgatcgcggggtgagtcctgtctctcggcgctccagccggacccccgcgcgggctgcgagcagggtgttccccttgccgcgggcaaacaagtttgtgcagacgcggttgggagcgcggcggggctgcacctgc

SEQ ID NO: 36353 - DNA, 612 bp, Homo sapiens
  chr17:6616271-6616883
  hyper
gatctgtgctcacttcgaggtttccgtgcttgcctggacggctcttgcgccctgggatctgtaaaccccaagggtggtgcgccctggggtcgccatgcccctcagattctttacagggcacctcccatccggcacctggagctcctgagtgcgcgcgccccgggagagctgtgctccccgcgaaatccgtgcgctccagctcagggctcccgggatcggtgcccgttagtgggcacaggacgccgggtgtccgaagggctgcctggagatgcaactgaccttggcgggcatcagaatgacgagtggcagcagcaggagcggggtgacgaacaagatcacgaaggacttgaacttggagacatagctcagcgccgaggccatcgcgcgggagggagactggcgggcgagacgagtgaggggcagctagaggcgccgcgggcttaagaaggggccacagtccccggggattggggagggggcggtgacaactccgccccgcacgggggcgcctccccgcggccctggggcggggccacccctcggggtctgtgggacgcgcctgcccccaattctgccacccggcggcggtgggaggcgtctttggactccaac

SEQ ID NO: 36354 - DNA, 174 bp, Homo sapiens; identical to SEQ ID NO: 4380
  chr17:6616884-6617058
  hyper

SEQ ID NO: 36355 - DNA, 36 bp, Homo sapiens
  chr17:6679303-6679339
  hyper
gcgcagaagcaagggcgggggcgtgccatcctcacc

SEQ ID NO: 36356 - DNA, 214 bp, Homo sapiens
  chr17:6679581-6679795
  hyper
ggcggagcaggtaggcgcgctccagtccctgcagcccgagcggggttcagcgaacgggtaacgggagaatgcgggccggagcaggctggggtggcggtgggatgccccgaggcccgcggcggggaggcgggctgctctcatcaccccctctgggaagcatctttggctgcaggagttgccaggccaactccccctcccgcggtgggtaggacat

SEQ ID NO: 36357 - DNA, 30 bp, Homo sapiens
  chr17:6735130-6735160
  hyper
tggccaaaggcttagcgcaggcgcaaattc

SEQ ID NO: 36358 - DNA, 230 bp, Homo sapiens
  chr17:6926198-6926428
  hyper
cgaccaccccttgtttctgaggtcccgccctcgagacggagaccccgccctggactcgccatctggagagcgagggaggaaggaaggatacagacccaggcgttcaccccacctccacccccgcccccgacatcccggccagataaaggagccgaggccaagaggggagagagaccccgccccccttaagaagagaagccgcggcccctgcaggacgggggtaagaacaa

SEQ ID NO: 36359 - DNA, 36 bp, Homo sapiens
  chr17:7197656-7197692
  hyper
cagcggggcccgaggcggctccgcccccgccgcccg

SEQ ID NO: 36360 - DNA, 30 bp, Homo sapiens
  chr17:7348931-7348961
  hyper
gggtagggtgaaggacggacctgtgatcgg

SEQ ID NO: 36361 - DNA, 181 bp, Homo sapiens
  chr17:7554612-7554793
  hyper
tggggggcctaggatcggtgcatcttccgccgcgctgccagcaccccgcagcgcgtggtcgtgcaccccggaatctgcagcagctgcatatctgaggggggtctcctttgcccgcgccgccttcgctccccgtgcttttgggtgtgtggagggcttcagcgcgcggcgcccccgcttctcc

SEQ ID NO: 36362 - DNA, 30 bp, Homo sapiens
  chr17:7621433-7621463
  hyper
tactgctggcccctgcggtatttcctagta

SEQ ID NO: 36363 - DNA, 49 bp, Homo sapiens
  chr17:7976269-7976318
  hyper
tgcgggcagagagctcgacagctgggaccagggccggccagcaccccct

SEQ ID NO: 36364 - DNA, 589 bp, Homo sapiens
  chr17:8055166-8055755
  hyper
tgagcattttctgagcgccaggggaaaagggaaggttgtggccaacagcaggaaccagcgctgggaacgggatgttctagtccgaagtgggctgacatcacaggcggcgcagggccagggactggagaacagagacacggggagcgctgaaagcctaatagggtcctggtaccggggcaaacctggggcccctcgagtaacgagcaagaagaccggggcatgcccgctgagagtcggctgtggggccgggaaagctgggacggggaggtggggacaagctggaggtaagatgagtgggtcaggagtgcagactcccggtgcaagatttcgaggaggacttcggtccttgggggcagggagagggtgggtagcggtaaggacgacagtgtgccctctgcctgggccgaaagtagcccatcagattggaagtggcagcggtccggctcagggacggagatcggccccaggatggccgcagagatgcctacctggtcgcaggagtgtcctccgcacgcctgcccgccgccgctccagcccgcagccgagtggaagctccaccgggcgggcggggaggcgggttgcataatgc

SEQ ID NO: 36365 - DNA, 78 bp, Homo sapiens
  chr17:8230272-8230350
  hyper
gtcgtctccaagccacggtctcaccaccctccatcagcctcgggcgacaccaaggggaacagagcgctggagctcctc

SEQ ID NO: 36366 - DNA, 470 bp, Homo sapiens
  chr17:8230351-8230821
  hyper
aagtcctcccgaccttagcggggctccgttcatcctcccggacgtggccaggccccgctctggccccgcgcccgcccctcccgcggggctgcccctgtctctctgccggagacccggactcagtgagtgagcgcagcgcggccatagggcttcctgcagcggggtctcagcacgtcttctggctggactctggggtctcctggcctggctgtgtctcctggttctcagcgctcgcctcccacgcggggcggagtatgggagtgggctgctcccgcggaagaatcctggggaagttgaggcactggctcccgctgttcagaacactgcccgacgtccccagagctagccactcctccttcccacccacccgcagcactctcgaggtcgcaacggcagtcaccaggtcccggggcctgcgttcagctgcttgatccgactaggtttggcttcggacccgaatgggtcagctc

SEQ ID NO: 36367 - DNA, 38 bp, Homo sapiens
  chr17:8533161-8533199
  hyper
gctccacggagggcgcggcaggacgccctcctcccgcg

SEQ ID NO: 36368 - DNA, 86 bp, Homo sapiens
  chr17:8868582-8868668
  hyper
ccctacgacacagggcgtcctgtgtcagaggcaggaggctgaggacacagctgcgcagagccgcccagcagaggttacccggataa

SEQ ID NO: 36369 - DNA, 399 bp, Homo sapiens; identical to SEQ ID NO: 1275
  chr17:8868814-8869213
  hyper

SEQ ID NO: 36370 - DNA, 257 bp, Homo sapiens
  chr17:8869214-8869471
  hyper
gctctgacccgccagccctcggaagaagcagaccctggccggtccatggcagtggcccgaggggcaccagcgcggagcaccagcgacccccaaggagtaaggggaggttaggcccccgcgtcggaagcgcggctttggccccgcaggagggctgggcggagcaggggggcaggtctggggtaggggcttaggggaaagacgagaaagaggaagctccgacgagctgcttccttctctcactgcgacccacttcctct

SEQ ID NO: 36371 - DNA, 947 bp, Homo sapiens
  chr17:8906266-8907213
  hyper
ggctggtgttctgcccgcgatgggcaggggagccgggtggccgcggggcgaggagccgcgagggccgggccggcgtgacaccacctggcggagtctcggggaagagtcttaaaggcgcgcgctcctccgtgccccgcgcactcgaacgggagccgcggagagctcgcctcccgctgccgccggcgcctcggggaggtaagtgccacccgcggatcccgagtcgcggccgggtgggggcggcccgcggctgccccgcgctcgggaagctctggctggggctgcggtcggagggcggcgcccaagttttcttgaaggcctcggagggcagctggagcggcgtagagcctgcgcggggatggcgggggtggccgcgggccggggccgtctgggggcggccatcccgggcggtgcgtggaaaagtaggcactggtgcgcggcgaggggcgcacgccagagccccagccccgcgtcctgcgcacttggcgcgctctggccgcggtcccggcgagccccagcctgctccgggccgcgaccccggctccgcgccttcctgcccgcccgggtcctttgtagcccgctggccccgcggtcgcgcacggtcacgccggcaggtcgcgctcggcggccggccaagccagccccggccctgccgcgcccgcgccccgggccaccccgcccggccccctcggcgctgcacccctcgctttccccatctccagccgctcgctattttcacacctcccggtgccccggccccggcgcctgattcagtgcttagtaattaatttggcgtttcagaatggtcagcgggctggataatgggtgcattcatcccccgggctaatctgaacagaggtgggaagaaaggctttcacagacagaaaatgccattcgccgagcgctcaaaggggctgtcactcccagaataaatcgccgccgcgcccgcc

SEQ ID NO: 36372 - DNA, 514 bp, Homo sapiens
  chr17:8907214-8907728
  hyper
gctcctctggccatttccatacagctccggcccgcgccgcggacccgccggcctcggcctcggctcccgggaatcactcactcgagtgccttcgacgggaaagtcgggcgagagctggacccaggcgggggccgagggaaacggggaaactggagactcgggtgaaggccgcaggggacaaagagattgattagaaaatcaaacgcgcatctagaaggaggcgcaggcgactgctcaaggcgcggacggcggagctggggctcgggagcgtccgtccaaaacccccgaggttcgccaaagaggagggcccgcggcccagaccctccggagcgtgcccgaggcgacacggcaagcttctggggctcccaaattgtgaatggagttcaatgcacaagcatagatagtagaaacagggtcgacctgcacagactttttattccgagttccttgtgctatcagccccgtcgccctcgcggcctggaaggtgacacggtgtcttccccggcctcctgct

SEQ ID NO: 36373 - DNA, 22 bp, Homo sapiens
  chr17:8907776-8907798
  hyper
cgggtgacggaggctttatcct

SEQ ID NO: 36374 - DNA, 123 bp, Homo sapiens
  chr17:8925590-8925713
  hyper
ggcgggctggctgagcgcagctcccttctctccgcaggcgccttctgcggcaggcggacagatcctcggcgcggcagggccggggcaagctggacgcagcatgatgcgcgcagtgtgggaggc

SEQ ID NO: 36375 - DNA, 26 bp, Homo sapiens
  chr17:10101084-10101110
  hyper
tcaggctctagactccggggtggaga

SEQ ID NO: 36376 - DNA, 317 bp, Homo sapiens; identical to SEQ ID NO: 1280
  chr17:10101131-10101448
  hyper

SEQ ID NO: 36377 - DNA, 401 bp, Homo sapiens
  chr17:10102264-10102665
  hyper
cggagggctgcgcgctccctcgcagaggggcctgtcactggggagaggggctcccactcgcgcccccaccgccggggaccgcgggaatggaaacgcccctctgttctgtgcctgctttgtaggcctggcggcccgtggcgtgcgggcggcttcttcgaggtgtctgcgagggatcgtttgtggttgtcattgtagtggttgaacctggggttgaacttgtctcaccggaaactgaacaatgggtgaaagacaggtttgaagcctggcgcctgagcccagcagcctggtggcagcgtggcacgctggagggacggaatggagagaagacggggtcggagttgatagaattggaaacagtcgatggggataaatggaggaaaggcgaacggtgagaggaacag

SEQ ID NO: 36378 - DNA, 432 bp, Homo sapiens
  chr17:10632918-10633350
  hyper
tccgcgtctcttagacgggggagaaagtgggggctccccaagcagaaagcccaagtcccgtcctccccactaactgtgcgcccctgcgactctgcccgctagtcagttacacggcccgctaggccagggggcggagctgggagccgggcgggtccccctcccaccgcggccgcctgacctgcaccaaggccgccagcgcgaagaaggcggccatgagtccgttgcaggcccgccacagcgctggcgccatggctcggagaacacggcgcggggcggtgagtcctgccacgtgcggggcggtgagtcctgccacgtacggtccgccttcctccttgcgcggagggaccgagacccccgcctcggtttcggtgccttggggacactgccgtggccgtcgctccgcccgggggcggggagcgaagggcgtgggtg

SEQ ID NO: 36379 - DNA, 60 bp, Homo sapiens
  chr17:11145224-11145284
  hyper
gcccgagaacaagtacgacccggagaaggacaagaccaacttcaccgtctacatcacctg

SEQ ID NO: 36380 - DNA, 32 bp, Homo sapiens
  chr17:11501937-11501969
  hyper
cgcctgggagcgttgcgcggggagtgctgagg

SEQ ID NO: 36381 - DNA, 50 bp, Homo sapiens
  chr17:12568739-12568789
  hyper
ccgcgtgaactgtcccgcgggcgcgcacgccctttcgcgcagcctttgca

SEQ ID NO: 36382 - DNA, 33 bp, Homo sapiens
  chr17:12877698-12877731
  hyper
aggcctcttggatttcgtcgtttcccatgcccc

SEQ ID NO: 36383 - DNA, 103 bp, Homo sapiens
  chr17:13503842-13503945
  hyper
ctcaccggtaccaggcgaggcccttgtcgtagctgcggtcgaagaagtggggctcggcgcccacggcgcgcacgtcggggtgcacgcgcaggaactccagcag

SEQ ID NO: 36384 - DNA, 116 bp, Homo sapiens
  chr17:13504194-13504310
  hyper
cgccgccggccacaccgccagctccctcgggcctccggccaggacgccgccaccaggggcccccgcctcctcgccgccgccggacagccccacgacggggccggacagggtctggc

SEQ ID NO: 36385 - DNA, 213 bp, Homo sapiens
  chr17:13504557-13504770
  hyper
gtgcgcccctgtggccgtgcgaactgtcccgggaggcagcggccggggctccgcggggaaacggaatcccgggggccccgcgcaggatccctgcctccagtcgagggagcgggaaggggaacgcgggtccgtgcttaagaaaccatcgtcttagactcgcccaagtcctgagcttggggcagccttggcccctcggttccccgcaagagtcgc

SEQ ID NO: 36386 - DNA, 571 bp, Homo sapiens
  chr17:13505001-13505572
  hyper
cgcccgagttcaggttctctcagccaaggagcgaggtccccccgagtccctctgcccgagcgggagacaggaggcccgtgcagagccgtccacccctctccgtagcgccgggttgctccaaactgctcttggaccccacctgtgagccgcgtggctgggctgggctgggctgcgcgggacctgtcagcggcccccgccactctgctcgcaggcgctcaccggctgcctcctgggccgccgctggccgccgccacacgtgggacgccgagggcagcaaacttgctggtgacgtcaaaggcccgggccggaccagcccccggacgagcgcagcggggcgcggaccagcggccaggcggggccagacgggcggggtgggatggagaaaaggtggcgcgggctccgcagcagccgcccaatggcactggagagggcgggggcggcaggggcgacgccccttccccagtgtcccccattcctccccgcggcttcgcccccttccagtggatccggtgtctgcggcggctccggggttgcctgagtgacagctaaggccggccggatctctgggggc

SEQ ID NO: 36387 - DNA, 152 bp, Homo sapiens
  chr17:14200755-14200907
  hyper
gttcccttcccagtccgctggggagacaactggccgcggctgccctctgctccgctcccggctgtcccgcagctgcgaggccggggccagagcgctcccttccgggcgggcatcggagccgctgcggcgccgaccgcccttcgcgcccgggc

SEQ ID NO: 36388 - DNA, 278 bp, Homo sapiens
  chr17:14200930-14201208
  hyper
cgcagctgctaacccccgaggggccgcctcgctggcgaggggagcgggaggaaggtccggattccggtggcaggaactggggctctgggccaccggttcaggctgccccaggaaatgcctgctttgcggtgccgcagagggtatagaggagctcggccccagagggtggctgttggggaggcggagctggccgcaggctggagcagctgcggagcctcccatcccgagcctagaatcggagaaatttcaggcggaaaatactgcggggatggtttggc

SEQ ID NO: 36389 - DNA, 244 bp, Homo sapiens
  chr17:14203027-14203271
  hyper
ttctgtccccggaaccgcttgcagccaggagttggaggccctctggccccgcagaggctgggttgcaggcatcgaaaacttcctgaacacgaccagtaagaatttgatctcgagcttccgaactccaaacgcctgggcaagaattcagcaaagcgcagcaccgctcacccgcacttcccccagctagcggttgctgtttcttggaagacgcgtttatccgccccagtcccgggtgggtgggtca

SEQ ID NO: 36390 - DNA, 231 bp, Homo sapiens
  chr17:14204011-14204242
  hyper
catctgggcaactaccgccaaggctggcttctagggaacgagtgcggaaatgcgtgcgggtgtgggagcgcaccactcagtagggtaggacctctcccagcgctaggtcactgcagcattcttcccaccatctgctcctgtcaccagcccctaactccgcccctttgggcccgccccttgttccgaagccaatagcaacccctgaccgccctacaccgcccagaagccttt

SEQ ID NO: 36391 - DNA, 103 bp, Homo sapiens
  chr17:14204731-14204834
  hyper
cacccgggcgtccagcgtgccggggaaccctctctgcgctcactgcccggcgggacccacgccatgtgctgagccatgtccctggccgcgcccgcgggcagcg

SEQ ID NO: 36392 - DNA, 566 bp, Homo sapiens
  chr17:14205251-14205817
  hyper
ggccatcatcatcggcgtgaagaagggcggcacgcgggcgctgctggagtttctgcgcgtgcaccccgacgtgcgcgccgtgggcgccgagccccatttcttcgatcgcagctacgacaagggcctcgcttggtaccggtgagtttccctgccaggggcagggtctccatcgtcgattcagaccctgagctaagggagacatggcgtatgatagggaattggcagggttacagcttcggaccacccggggtagggcagggaaactacggcagattgcgcagcgcatcctgtccgggtgcggtgagggttgcgctccgcttggttctcgtcacaacccacagaaagttctcgcggagcactggtgcccttgaattcatcaggcgacctcgccgcaaagaagaagggcagcgactgagaccgccctcagcaaagcgagccaccctctaaccatgggggtatccgactcgaatcgtattttatgactcgttttaaattttttcctcccggagcccgagacgctgggaatgttctgagcccctttggtcggtctccgccctcaaggaact

SEQ ID NO: 36393 - DNA, 134 bp, Homo sapiens
  chr17:14206209-14206343
  hyper
ggagcaaagaatattcggggcccattgattgagaaatgagggttgcttcgaggtcgcggcttccggaaattctgttctcgagtcgggttgcgggtcaggttccaaagggacagtggccccggggtcacaatcac

SEQ ID NO: 36394 - DNA, 7 bp, Homo sapiens
  chr17:14212588-14212595
  hyper
cggagac

SEQ ID NO: 36395 - DNA, 30 bp, Homo sapiens; identical to SEQ ID NO: 12624
  chr17:15164652-15164682
  hyper

SEQ ID NO: 36396 - DNA, 786 bp, Homo sapiens
  chr17:15166015-15166801
  hyper
acttggccttaaatgcgcctcaagaaaaagtcggtccctgcaaaaccgcggcgacttttactcgaaaccagaggcggctgagctttctcacctcccacctcccttctcccctggccccgtggagacctagtgttgaccgagaaactggctcctcagcccactctgggaagacccagccaaatgtagctcagcggatgcccagggctgggcttctgggcccgccgacgccgaccgcgcccgcgcggggctgaggctggattcctttcccactaatagagggcagcgggcgcttgagcgctggaagaagtccctctcctctcgggtcctggagcccctgccctgtcctggcgtcttagccggacacacctgccccgcgccggtccccgctattactgtctgcacctacgaagcatgccagcttcctaggattggcggggattgatctagcgggctcctcttgggtgcgaattaggggaagaaaagtccggccgactactggatagcatggtctgggattgggctcctcctagcctaggcaaaaccagactaccaccgaataagctctaggcaaagtgttcctgcagcagtcgggcttggctgtcagccttggctggagtcctggccatggggtttggcgggcgggtgcgaggtggccatttgaggtggggttggagcagccaaggaaatcagctgattcatagcctcctaacgtggcccgcccagcgttacagggagagaggctagcccccttcagtctcggcttggcagaggcgcgcccaactgaga

SEQ ID NO: 36397 - DNA, 86 bp, Homo sapiens
  chr17:15244447-15244533
  hyper
tgaagcagagggggacgaggaacagcgtgcggggcggccagcaccgcagtggaaaggcacagcgctgctaacgggtaattattaga

SEQ ID NO: 36398 - DNA, 145 bp, Homo sapiens; identical to SEQ ID NO: 12627
  chr17:15244987-15245132
  hyper

SEQ ID NO: 36399 - DNA, 253 bp, Homo sapiens
  chr17:15820777-15821030
  hyper
cgcccatcctgggaccgcgcccctgcaccatgtggacggtgcaggctgggctggggtctgacgcccgaggaccccttccccctgcccagccctgcccccgcaggcactggagggctcccctaggcggggctccgggctagggaacagggatgcccagcaatctcgcgctcccggggccggactccagcggcaggggcctccccaggctgcggctccgcgccggtgacgggggctctgccgaagggctcctgcc

SEQ ID NO: 36400 - DNA, 84 bp, Homo sapiens
  chr17:15847883-15847967
  hyper
gggggctgcagcccccgagggctccttgcagtccggccccgcagcctggagacagctccggtggtgctgcgctgcccgagactg

SEQ ID NO: 36401 - DNA, 30 bp, Homo sapiens
  chr17:15849181-15849211
  hyper
aaaccccggggaaagcgtcacccccgggga

SEQ ID NO: 36402 - DNA, 25 bp, Homo sapiens
  chr17:16310306-16310331
  hyper
cgtcccaaggcgcctggctcaccgc

SEQ ID NO: 36403 - DNA, 393 bp, Homo sapiens
  chr17:16472011-16472404
  hyper
tgccttgcctcctgtcgcctccccttcccggccaagtccctctgcctcttactcctcttcagccgcagggtcgaggtcgagggcagcgggggagtcggggaccgtgcgacgcgcaacgctgggactgggcccacagcagcctccaccccgtctttgccctcccgcaagccacgagcacgggagcccgcgcgtggacgggctcgggctgtcactgatcgcgcggacactcgcgcgctgcgcccggacatcaatacctgtcgctgggacccggccgacgggcagccggagcggccctaaggccacaggcaacaatggcgacgctggcacaggcgcctgcgtggcgggctcagtcccgagcggcagcggatcctcgggctccgccacttcccttcc

SEQ ID NO: 36404 - DNA, 149 bp, Homo sapiens
  chr17:16472622-16472771
  hyper
acctcctccacccatcgctctgacttgcttgtcagcctgcgaggttccgaagggaacttcaaagtttccccgggcagacgcaggtctggtagacgtcttggaggccagggaggtgccagtagctggaggagcgccgggagttgaagccc

SEQ ID NO: 36405 - DNA, 39 bp, Homo sapiens
  chr17:16492416-16492455
  hyper
cgcccacccccttcccgccgtcagcgattcctcctcctc

SEQ ID NO: 36406 - DNA, 64 bp, Homo sapiens
  chr17:16570208-16570272
  hyper
cgtggagggagcgatgcccccgcccgggactcctggtgggtgatggcgccgggaggccttggct

SEQ ID NO: 36407 - DNA, 285 bp, Homo sapiens
  chr17:16570654-16570939
  hyper
ctgaggagctgaggggctgaggcggctgaggggctgaggctggtgaggggcttgaggggccgagcggataaggcggctgacgcggctgaagggactgaggggctgaggtggctcaggggctgacgcgggtgaggggctgaggggctgaaaggctgaagggcgggcagcgtgccgggtccctgcggctgggtccaccgcacgtcacgtggcagaatcccggggctgctttctctccggctgctcagccacttgttttctcactgtgaacctcgtgggctcctgctc

SEQ ID NO: 36408 - DNA, 30 bp, Homo sapiens
  chr17:17204181-17204211
  hyper
gcagttgccctgctgcggctctggcccagc

SEQ ID NO: 36409 - DNA, 63 bp, Homo sapiens
  chr17:17398606-17398669
  hyper
cttcttgttccgcagcgccttcttgtgcagcacgtcgcagtactgcaccgagaccttgcggtg

SEQ ID NO: 36410 - DNA, 74 bp, Homo sapiens; identical to SEQ ID NO: 12631
  chr17:17398902-17398976
  hyper

SEQ ID NO: 36411 - DNA, 30 bp, Homo sapiens
  chr17:18314944-18314974
  hyper
ttctcctctcccaatcgtcttctttcccag

SEQ ID NO: 36412 - DNA, 95 bp, Homo sapiens
  chr17:18538190-18538285
  hyper
tcagcccctcagccgcccacgcctctgctcgctcacccgcccggctgccttaggggtcggcgctgcccagcgggctccagcgcagcctcctaccc

SEQ ID NO: 36413 - DNA, 618 bp, Homo sapiens
  chr17:19436820-19437438
  hyper
ctctgggtccttccacgccaggtcattcagaacctgaaacccccagcggaggtggagagccggggtgagtcctggcgtccgagacgtggaggacccagcccccggagcgcgttccgttagtttacagagctttttcaaactttgccttccaagtgcaggagttccttggtctttgcaagacccgcaggcgtccgcagtggtgcagagagaggtgcaaggggcgcgcccaaggtcgcaggctgcctggctgcgcgctcagtcgggcccccgggcgccaggcgcggggcgggctctgggcgggcggccggggcggggactgcagagcaggctgcactgcgcggtacccactgccggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcggtgagtaaggtggcctcagtggcaggccggtaccggcgggctggggacctg

SEQ ID NO: 36414 - DNA, 222 bp, Homo sapiens
  chr17:19483136-19483358
  hyper
cgggacggggaggggcggggctgggtgggatcgggtcgcccccctcacccccacaccgcgctgcggtcccgcgcccgcgccgccgccagccgctcccagcctccgcatggaggcccctgcggccgccgacgccccggtccccgccgagctccccgccgccgccaaggaccggcccccatagcggctccgggccctcggatggcgtgacggcttgtggggcct

SEQ ID NO: 36415 - DNA, 34 bp, Homo sapiens
  chr17:20747407-20747441
  hyper
aggtgatcgacttctcgcacgggctggcgctcta

SEQ ID NO: 36416 - DNA, 121 bp, Homo sapiens
  chr17:20755828-20755949
  hyper
agtcctgttggttcacgccccgggtgcgaataccaaaagcaactcccgctggaaagcctgcaggaaactcgagacaaagacagaggcaaacgcaacgctgggaagagccaggggtgctgcc

SEQ ID NO: 36417 - DNA, 43 bp, Homo sapiens
  chr17:20755950-20755993
  hyper
tctgcaaaagcagagacgcgtctcccttcgggcaaagtgactg

SEQ ID NO: 36418 - DNA, 166 bp, Homo sapiens
  chr17:26120495-26120661
  hyper
aggaatcccacagagcgcacatccccgccctccgatttctcccagagagagatggggccccgcccgggctcggagcccaccgcttccctcccagggcggacttcggcccgcggggtacctggctctgcgcgggcagcagtcaggcttcggccggaggatcctgcag

SEQ ID NO: 36419 - DNA, 197 bp, Homo sapiens; identical to SEQ ID NO: 12637
  chr17:26554556-26554753
  hyper

SEQ ID NO: 36420 - DNA, 178 bp, Homo sapiens; identical to SEQ ID NO: 12638
  chr17:26554791-26554969
  hyper

SEQ ID NO: 36421 - DNA, 335 bp, Homo sapiens
  chr17:26578290-26578625
  hyper
gcacctgcagcccctcgcccagggcgccctccggcggcagcagcacccacacgaggccggccacgaccagagcgcatgagcagcgcagagcccgcgtctggagggggcagggcggacagagccgcgggcggtcacgtgaccccacggctggggtcggcgcgatccctgacggtagcttgcgggtgttccgcgccgtgggcagcctggcgtgcaggggcgctcagccgagggacgtggctatttctgggacacacaccagtgcacggacgccctaagggacatcctggtgcccaggggaatggtgcacacctggacatgcccggtgatgcacgcag

SEQ ID NO: 36422 - DNA, 202 bp, Homo sapiens
  chr17:27038906-27039108
  hyper
ggggcctccggcgcctcccaggcccctctttatctcagaccttaaccttacaggcccagctctcaccacccatctctggttccagcttgcagtccaaaccccagattttcaccctgcctccagatcgtagccccaattcttagtgttacaacgagccttgcccccagccccattcttagccccgccccggccattctctaaa

SEQ ID NO: 36423 - DNA, 2 bp, Homo sapiens
  chr17:27044880-27044882
  hyper
cg

SEQ ID NO: 36424 - DNA, 294 bp, Homo sapiens
  chr17:27332416-27332710
  hyper
ggggaagcgggaccacgggccgccagctggaccgtcccgactcactgccttgcgccccccggcacgcgccccagcaccctgagatgcctagagtgtggcgaggtagcgcgcgggtgagcgcgtgtgtgcggggagtgggtggcgtgatgaattgcatcagagaaatcccattagatctggggagatgattaaagacgaggtctcggccgggcgcgaatggcgggagccgcggcagcttcccgcccgcgaagcccgcgccccgcccggcttggccggcgccgggggcagcgcagc

SEQ ID NO: 36425 - DNA, 30 bp, Homo sapiens
  chr17:27466437-27466467
  hyper
cctctcccccacccccgggcatactgccca

SEQ ID NO: 36426 - DNA, 113 bp, Homo sapiens
  chr17:27940225-27940338
  hyper
aggtgggggccaggacgccgcgggactgaccgcctccactagagggtggtggccgcgggccgccctggagcctccacgccgtgtcccggccccggccggtgggtgggtgcgcc

SEQ ID NO: 36427 - DNA, 321 bp, Homo sapiens
  chr17:27940590-27940911
  hyper
cgagcagtagcgccccctgccgggaccctcgccagcgccacgcgcgccacgcccagggccaggagccagacaaaccccggcctgcgcgcctgcagagcggcggctggagactggagccaccgcctcgcgggtgcagcagcacagcaggcacggttcggggagggattcggcatggccgcggggtaccttcccaggccagggccctggaggcaactggcacggcctggtccccctgctttgctgtattctgattccccaacccgctcccctgggctcagatctgtcctgtcctagggcggagccaggcggtcctgaggggga

SEQ ID NO: 36428 - DNA, 671 bp, Homo sapiens
  chr17:27949457-27950128
  hyper
cccgagcctgaggcccggcctccctgcacccttcttcagcctgctgccctgacactgcgttcttgcgagacgaggtgtctgcgccctccgggagcgctggctgctgtccggccaaatatagacaccacgtcctccccgcccgaaaccgaatttggcggcgcggggggaggaggcgcagacctctgcccctcagggaccccgcccgctccgctggctgcggtgacggccgggtgtggggggctgggtacctggtcctgagcgggctgcggggcgctcacgctgcgaatcctctgcggaaggggcccgagtgcgtagggggccgaggaaggcttcagggcgaaggagccacctctccgggtgtctgtagtatctgggacccgggtgtccagctccgcactctggccgatcctgcggctctctagagcccggcgccgctgcagccccagctgccgctgccatcaacctaagagggcggggctagcataggggcggggccagagcccaagttgccccgccccctccagcggcgggaaagtcgagcgaccccgactcccctcccagcttccgccggcctcggagaaccatcgaaaataaatgtgcagctgtgtgctaggtgcgcacgctgcttccctccctccatgactcccgggtaggctggggaggctcgggtt

SEQ ID NO: 36429 - DNA, 36 bp, Homo sapiens
  chr17:28088606-28088642
  hyper
ggccccaagacactgctgcctcggtaagggagtgaa

SEQ ID NO: 36430 - DNA, 315 bp, Homo sapiens
  chr17:28562701-28563016
  hyper
gcggcgctggctgtgcggaggggcgccggcgcggccgtatttgtacccgcgggccctcacatggtctgatctctagatagccgccgccaaagagctcttgaagaatttttgcgtcactttgaggcgaataaacttaatgcttccccgcggccgcggctccgcgctcccgctggatggggttgcgctcgccagggaggggccgcgctacggggcggggtgcgcgcccgaccccagagccaggaggggagggacccccgacacacacacacgctcgcagggaggagcggagcgcggagcagccggcagggcagggcc

SEQ ID NO: 36431 - DNA, 61 bp, Homo sapiens
  chr17:28563999-28564060
  hyper
acaaccacgggcaagcgagggcagctcccagcgggtggagtccgcgcgggattctggtgcc

SEQ ID NO: 36432 - DNA, 175 bp, Homo sapiens
  chr17:28705281-28705456
  hyper
aaagggagcctactacgtagcacatttccgctaggcataaaagagacacctttccagaaagcaactctaaaaatgaatgcaccgcctagtgaggtgcgagccttcctccccacgaggcgtcccgtgcaaccgcacgcggacagcggggctccagcggaggcggggtggatgcgga

SEQ ID NO: 36433 - DNA, 127 bp, Homo sapiens
  chr17:29020895-29021022
  hyper
actttcccgcaagctcgcagagagcatcctccgcccacccggcaagcaccacttcatcacgccaccgccagggtgtcaggcggggctgagcggttgtcatttctctctaacccgtcagaactctgca

SEQ ID NO: 36434 - DNA, 482 bp, Homo sapiens
  chr17:29249457-29249939
  hyper
cgcccgagtccgggctctcgatgtctgcgcacccaggcgcgccccacgccctcggactcagacatcccagccagggctaaacgtcgggcccaggccgccgacagtcctgtgccccctgcccgctcccagacgccccccgaaggcctccccagcgccccacctcggggacgccgagggccccctaactcagcctccccacctgcagctccgcgccgagccccgcggtgcgccccccgcgccctcctctcggttccttctgagtcccttcacttccacgtcgcgcagcctcagactctctccccgggccctgaactgcctccaggatcttcaccccggtcgccgcgcagcggccggtgggctaaccagaaggtgccaggctggccgcttagttcgccttaggtgggagaaggggcgccccacctgccccagtgccccgagcccagccctggtttcttcaccgcgctttccgctcagctcctctc

SEQ ID NO: 36435 - DNA, 30 bp, Homo sapiens
  chr17:29335681-29335711
  hyper
ggcctcagcccctgacgctgtggtgactcc

SEQ ID NO: 36436 - DNA, 398 bp, Homo sapiens
  chr17:29718142-29718540
  hyper
ctccagagatggcagcgaatcccggccctgcctcttgccagctgtgtggcctagagtgagtccgacctctctgggcctcagcttcctccgggatgaatgcagtcacggaacgcgccaatgcaggaggcccccaggacatcctgagcgctcgggagacgccaggcgcggcagcgggcacggatagcggaaaggggcgcgaccccgcggaatcctccggcagggcagggcctttgggtggctccgggtgtccagaggaaggggtgggctcggggacgcggagggaaactggggacgcggagggaaactgaggtcgcggaggacgcggccgttggcagctcgctgcgcctgccggccccgcgtgggccgccccactcgggaggacgcgggctccttttgtc

SEQ ID NO: 36437 - DNA, 464 bp, Homo sapiens
  chr17:29718778-29719242
  hyper
ggcggccccggagggcgcgcggcgatggcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtaagctggcccgaccccagtcccggcccggggaccccagcccagccccgccgcccctcccccagctcccccgccgggtcacccgcgtggcccgaggcggtggcctccctcccaatcccctccctccgccggagcccaggacctcggccccccccgggtatccctggcccagccgggccctcgctttccgccccccggcgcccgtgccccgag

SEQ ID NO: 36438 - DNA, 243 bp, Homo sapiens
  chr17:29886485-29886728
  hyper
tcggggcgcgggccccggctagcggctatggcccccgtgcccaggcagcggtgcgggctcggccttgcgggagggtgcggcctgctgcgagaggtcggccacggctcctgccccgcgccccgcgcccctcgcccgccgagctgagcgcaggtaaccgaggcagagcggagctgggcctcgcaggcgcggcgtgggagcgtggcgaagtttctcggcgcataactcttgcgccccactcgggag

SEQ ID NO: 36439 - DNA, 76 bp, Homo sapiens
  chr17:30846530-30846606
  hyper
cggtcgccaaggcaacgccggccccagcgcccgcggctgaaacgaagccgctgcccgagcccgagcgccagcgcac

SEQ ID NO: 36440 - DNA, 118 bp, Homo sapiens; identical to SEQ ID NO: 1281
  chr17:31618291-31618409
  hyper

SEQ ID NO: 36441 - DNA, 987 bp, Homo sapiens
  chr17:31618410-31619397
  hyper
cggagggcaactcacggaggagaagttgtgcggcccgcagagctcgccgcggtacttgcaggagagcagcatgtcctccagctggtggcccaggcggtccatgaaggcggcgctgattccctcgaagtggcgcggaggcaggaagaggcggaagtccgccagcttgcggaaccactggcggcgcggctcgtcgccccgcagcagctcgctgacaagcgggcgcgcggtgcggttgggcagcagcagcccgagccagtggccggcatagtagaggtcccccttggagaggcgcgggaagcgcagcgggttgttgttgcacacagtgacggcggggaagggtaactggcggctccactcgcggtgcacccgcgtgtgtgacgggaagctgagccagtagagcaagcggttcgaggaccaggacagcagcaagccgaaggatgtacagaaggccagcacccacagcgcccgccgctggaaggagcccccagccgccgtgcgcccggcacacatgtgccgcagcccgtgcagtttagcgcggctcagcgatggccgccccctgcgggcgacccctggcccctgcagcgcccgctcgccgcctctgccgcccccgggctgcccggcagccgccaacgccgcgggcgccggctcctcgcgggccatgcggaagcgtcccgggccggtgagcgcggctgcgggcagcccggctccgccaatccggctcattcattcagcccgcggctggcggcagcggcggcggccccggccgggcggagccgccatgggagtccgcagcagcagtggaagcagcagcagcggcagccgcgcgcagcccgcgccagggaagcgtgcgcccgaaaggagctccggtggcgcggcatgcccgcccggcgccgccgctgccgcctccgcgggcgcccgcccggggctgagcgccgcctcagcccgcagcccctggcagtggcctctcccgagcgcctcccaggcttt

SEQ ID NO: 36442 - DNA, 760 bp, Homo sapiens
  chr17:31619687-31620447
  hyper
gagcgcccccagaggcgcaccgcggctcctggctgggcgggcggggtgggtgtgtacgggggtgagtggtcgccttgccggctgccgccttctttcccttcccctccaggacccttccttgttactgctccctgggctgcgctcggcagagacctgcttaggcttccccaagtcctgcgcctaagtcctgccaggcgcccgctctcgcctggggctgagagcttctcagggcgtcctgcgggaggctgttcgccgccggggtccttcaaggatgctagccgcagggaagtgtcgcttctcgcctcggctctcccaggtgcctcgcgtctccagaaaagcccagccttgctgtctctcgcgtcttctctctgcccccgcggcgacaagagctggggactgcggggacccgccaacacctcccgggggtgacccggactcgctgctccgcgcgcccttctcctctcgagactccgagctcgcggtggccgtgacgccggctaagctccttccccggttgcccgggagaaccctctttgggccccaggcgaacttgggcagcggccgcgcgacgctggcgcggctgggctccgagcacctgctcctcagctcgctggccccgcggctccgggcgggcggggcggcggcggccgtgagcgccgtgcgctcctggagacgcggtgctgacgcgcccggctcctcctcgctgcattttaattcctggccactgtggccgctgcacaccgagcgggaagcctcttgc

SEQ ID NO: 36443 - DNA, 127 bp, Homo sapiens
  chr17:32483992-32484119
  hyper
tgggggatgtcagggcggccacgctgatgcactgcggtcgggcgcagcggcacagccttcagagccgccgccgctcggttccttttcccatgatgttttggactccgaatgccgtttctcgccgccg

SEQ ID NO: 36444 - DNA, 57 bp, Homo sapiens; identical to SEQ ID NO: 12653
  chr17:32906021-32906078
  hyper

SEQ ID NO: 36445 - DNA, 244 bp, Homo sapiens
  chr17:32906312-32906556
  hyper
gcggaatcgcgaggtcggcccttggcccgagtctcattaaggagccgcgcgcgccgccaggctaggaatgcggaatggacacgtggacagaggagggggagctaggagtcggggagtctccgtggcgcgcgagctgtgggccgcgcgctcgggggccacgtgaccacggggaatctgggaggggtgggagtgagcgcgccaagctcggcgcccgcttctgcccgggtgggcgctgaatcccgga

SEQ ID NO: 36446 - DNA, 216 bp, Homo sapiens
  chr17:32906598-32906814
  hyper
cgagtcatttacggcggagcagccggcgcgagcgccgaggaggcggcgacggcggcggcggctgcttcgtgcaactgtggcttcccccacctcctcttcctttttgctcctcgattcttcttcttcccccacacacgtccatggggagccggctcccctgccagcacctcctctcctctcggccccgtaggcaccagctgccgcttccctggccgc

SEQ ID NO: 36447 - DNA, 153 bp, Homo sapiens; identical to SEQ ID NO: 12654
  chr17:32907265-32907418
  hyper

SEQ ID NO: 36448 - DNA, 85 bp, Homo sapiens; identical to SEQ ID NO: 4393
  chr17:32907620-32907705
  hyper

SEQ ID NO: 36449 - DNA, 99 bp, Homo sapiens; identical to SEQ ID NO: 4394
  chr17:32907706-32907805
  hyper

SEQ ID NO: 36450 - DNA, 274 bp, Homo sapiens; identical to SEQ ID NO: 4395
  chr17:32907873-32908147
  hyper

SEQ ID NO: 36451 - DNA, 761 bp, Homo sapiens
  chr17:32908170-32908931
  hyper
cgcggcgcggactgggggtgaggatgcggcaggcgccactggagggggtacggggaagactggggagaggagcacccacaccccctggactcgcagccgccactccgggtttggcgtctctggctgcagctcgagttaccgccagcccccgagccctccggcgagctcagctgaggggaccgagcccggcgccagaaaagggtggggggagggtgtcgctccagtcctctcctggttataaagaagggttcgaacccgaaggtctggggtcgtgtccgcccacggaaatctagagggatccgagggatcctccggatcgcgtccaggccgccccccgcccccgtctctccctgcagccggccgggctgggggctgttgggatccgccgggatcgcgtctttcctcgccccgggcgcgcaggccggtgcggggccgcgccgcccgtcgcctcgcttcctgcggcggtcctcgggaagggaagtggactgactccgggccggggagccgccgcggctcgcacgcccgcggtcctgtgagctgcatctaaatggccggcttaggcgagcccggagggcgggggtctgggcacccgcacaggccggggcggtgggccgcgggccgcgcgcggagggagcgggctccgcgctctcgcattctgcaatctgttgcgtctgctccccaggctcgccccgggctccgcggtaaagggggtgggagaaggagggattgaggttggcgcgctttggcggtgggacagcggg

SEQ ID NO: 36452 - DNA, 32 bp, Homo sapiens
  chr17:33672862-33672894
  hyper
gagaaaaaaaaaagacgcggaactgtcttcag

SEQ ID NO: 36453 - DNA, 164 bp, Homo sapiens
  chr17:33673326-33673490
  hyper
gctagttcctgtttcaaaaaagaaaaaattcctcaaatgttaattatgaaatatttcagaagtacgaaaaagtgtaccaccaccggcgctaccacttccaccttggcaagtgaagccccactacaatggaagcgtcgggcgtatcctcccgggcctctttccct

SEQ ID NO: 36454 - DNA, 301 bp, Homo sapiens; identical to SEQ ID NO: 12660
  chr17:33700472-33700773
  hyper

SEQ ID NO: 36455 - DNA, 402 bp, Homo sapiens; identical to SEQ ID NO: 12661
  chr17:33700974-33701376
  hyper

SEQ ID NO: 36456 - DNA, 117 bp, Homo sapiens
  chr17:33775327-33775444
  hyper
tctgcctgtttgttccgcccccgcggaaaccgctgctcgctgggcaggggctttctgttttgcagccggaacaggaacacagatagcccgccaagccgccggcgacaccttccaacc

SEQ ID NO: 36457 - DNA, 399 bp, Homo sapiens
  chr17:35014243-35014642
  hyper
aggggagggaagggacgcggggcggaggacgcagcgggcggcctgcggaggcggcctggctcggggtgggggctcggccggagttcccgcggctgctcggcggcggccggctcgggagcaaccttgagcgcggtcgcggaggcagtgatttaggtgccggcaccggagcgtgaaggtaaatggccacatttcaccgtcgggaggtgagccggaggcgcccgccctggcccttcccccaaggccccgggccggtgggggcgggagttttgcttcccctctctgacccgctccgaggcccgcctgggagggcggcgcccccacggtgcaggacaggagggctgcgccgggctgcggggtgagcaagacccctagagctgcctttcccgaccccttcctatt

SEQ ID NO: 36458 - DNA, 362 bp, Homo sapiens
  chr17:35060253-35060615
  hyper
aggggaggcacaaaccgttcagctcagctgggaagaaatcggctcaagcccatcagagtgacagatacccggggaggctgggcgtgccaagctggaccggtccggccaggctggaagcccagctgcccgctttttctcagtgcctggagaccgcccgccttttcagcaccacggtcagcggccttttcgcaggcgcgcgccccagccccgccccgggttgggctggcatccagcctcccggcccttctgcgtgtccctcggcccaccggcatcccgggctggaggtgtgggtggggcaggcgaccggggtatgagaggcggtggggtgcctcctccgcgcgtctctgcgagtatctgtctcc

SEQ ID NO: 36459 - DNA, 372 bp, Homo sapiens
  chr17:35078532-35078904
  hyper
gggggaggtcagggacggaaataaacaggcggtttggtcttctctttcttccctggcagccttaattgctacttaagcgtgggccctgcacttaacatccggggggcaggcccggtgcgtggtgcacgccgggcgcgctgtgcacagtctccggaggccgccagtgcgaccccgccccacccgcgcacccccgcccggagggccccagcgcgcatgcgctcgccgcagggcggcctgcggggctgtggacgcgaggccagctcgtagggggctgggcggtcagcggggtcaagggacagccacgctgggacggaggacggggacaggggagcccctgcggcgccacttcttcctctccgagtcctgtctgcc

SEQ ID NO: 36460 - DNA, 30 bp, Homo sapiens
  chr17:35165346-35165376
  hyper
cccgcatttccaccccgctcccactgctgg

SEQ ID NO: 36461 - DNA, 251 bp, Homo sapiens
  chr17:35165593-35165844
  hyper
cttcaattttatcagcggccggggagccgggcgggagataggaggccggccctgacacgaattagcccggagattgtccgatacgccttggccagggcgccggcgccgcgcgctcgcctccctcgcctctcctttgtgtccgcctcgcctcgcctctcggcctcgccgcgctccattcccgcggcgctggcccgggccgagcgaactgctttgcctttggccacgttgagcgcgccgaggcagccgggggc

SEQ ID NO: 36462 - DNA, 188 bp, Homo sapiens
  chr17:35165845-35166033
  hyper
cggggctccaggacccgtctgctcctggtgcccccagctcctcagggtccggccgggtcacctgggccgatccaggcgggcaggggcctcgctgctcctcccccgcagcccctctcgccctcccggggaccgtgtgcggggagcagctgggagctgcgtctggaggggctgtccgactggggaacttg

SEQ ID NO: 36463 - DNA, 30 bp, Homo sapiens
  chr17:35242096-35242126
  hyper
gagaaggcaagggggcgggagcgggagggg

SEQ ID NO: 36464 - DNA, 358 bp, Homo sapiens; identical to SEQ ID NO: 12667
  chr17:35285437-35285795
  hyper

SEQ ID NO: 36465 - DNA, 290 bp, Homo sapiens
  chr17:35289328-35289618
  hyper
aattactgtgaggcacgagccccgtttgtcttccttactgggtgttcagacagaggaacacgggcacgcacccaaatacacattgttgtcacgccgtcttagacgttttatttatttgttggattcctgcccagagccgcttttccacgggcgcagagtctcccaccaaacacgctgcctctttctctcagcacgcactcgcctgtcccaaagccgcacacccccagacccgcgggacgccccctccgtgcctgcagggccctcggctccgcgcccgtccccgcggcctt

SEQ ID NO: 36466 - DNA, 550 bp, Homo sapiens
  chr17:35290388-35290938
  hyper
aaggcaatttgagtccggagagaactagacgggaaggagaggcgggagaccttggcgctcagatccgagcgaccttatccacgcagttccctgcgtggcattactgcggcctcaccgagtctgggcggagtttgcgtggcctctgggaccggcagagtccaggggtgctccgggctggctatttcctccctcctccgggatgggtgtagcagggtgtgtactccgcatggggtaacctcctagagccggctacgccccaggcgcctcctttcacggccttgtcactcttttctgctccttgggctgttctggaaccgaagagagaggagggaaatggctaggggcggccatcatcctcgggatcaatagcagccgagagtgactgggcaggctctgtccatgggccgagcgtcattctggaacctggagggggcgggggcgggggaaggaagggaagtggaagtttgagaggggcaccttcaggctccccaaactgcatggcagctggagagggctgacagaaccctctccaacccgggttctgaccagg

SEQ ID NO: 36467 - DNA, 359 bp, Homo sapiens
  chr17:35291540-35291899
  hyper
atctggacaccaggacgagcggagcctgacgccctagagcgagcgtcctgtcctcatcctcaactctcctgcctcgctggtccgtctgtggggaggggccttctttcccctatacctaggtcccaaggttcttacacccctaaatggatggagcaacctcctcctgcccaccagagggaggtgacaggccctgggttggggaagggccgacagctaggtccagctgtcgtccggtaggtcccactgaccgccccacactccaccgtgacccctctgctttgcatgagaaggagcccagctgggacgggggcggaggcaagccacccgggactggggccactatagattccagaaagggg

SEQ ID NO: 36468 - DNA, 735 bp, Homo sapiens
  chr17:35291920-35292655
  hyper
cggcgagaaccgggacagctgcggggaggggaggagtgtgaggacagcagggctggactggccccctccccgcaggcctcacgcagcgcagcaggctgggaggcgcctgggggtccgggtggaagaagtggggaccccatgccacacggcttttggcgcttgcgggggtgccagaagcctaccgagtaccggtcgtcttccgccgggaagtgccgggtccgcaggaggagcgcgaagccgagtccgagcccgcggagcccgccccctagatcgcagaaccgccttctccatcctctgccctgccccgcgtcggggtctgggagcgaccggcggaggccggcggcgcgccggagctgactagtcccctacgctcctccggcccgcagcggggagcccacatgtgtatgtgcaagaaggtgtggagaaggcgttagggtcccggcacccacgggtcagggcagaacgccaacgagtcgcactgcgggtctccgcggcttcggtttccatgacatggtgacgccggcggcaaggcggggggctgcctgtgggccttgaggttgctgggcggtgcgggcggagtcagcaaaggggcgttggcaaagccctaaaaccccacggttccacggagcgcaagccagattctctgaagcagcttccccgttcgtccgaagagggtattccatctgcacagcgggattccctgccagcccaggttcactgcgactccgcttcccc

SEQ ID NO: 36469 - DNA, 35 bp, Homo sapiens
  chr17:35292896-35292931
  hyper
cagaacaggtgtggtcgaaacggaatttagggttt

SEQ ID NO: 36470 - DNA, 475 bp, Homo sapiens; identical to SEQ ID NO: 4398
  chr17:35294006-35294481
  hyper

SEQ ID NO: 36471 - DNA, 9 bp, Homo sapiens
  chr17:35294482-35294491
  hyper
gggctgtgc

SEQ ID NO: 36472 - DNA, 1133 bp, Homo sapiens; identical to SEQ ID NO: 4400
  chr17:35294492-35295625
  hyper

SEQ ID NO: 36473 - DNA, 1130 bp, Homo sapiens
  chr17:35296016-35297146
  hyper
cattctccaggccttcggggttgtttgccctccaggcagagcccaggctccctcccggccactaccttttccgaccccgagcggtcttggcggtaagctccgagccttttgcgtagagtgtctgggccaactgccctgtcagcggcaggaaagaactcggccttaaagccgatcctgcacgcccgggggtcttccccaaacccggacatgcctccgagtgcagacctggacaaactgctgcactgtagcctgcgaagtgcccggagctttttcctgcttccctggctgccgaagttgtctggtggttcggcttcagccccaggtgactccgactcccacgggctccgctcagtagtcctcctaggaaactgccagccacagccagcaacctccttgatgaaacctgggggaaagccgagacctccagcttgctggtggggagacttctccctaccccccttattcgtttagcattttaattatattatcgtacactcacaattttgccgctccattcacacaaacacacaagtcaacagagaagaacgggcacaaatgcgaattgtaattccaccctacggatgtgaaatatcgcaatttactcggctgacttggtctctgcttttctgagtttgtggtcatagttcaaaccagggagcaggaggaagagggattcaaagccactcagagggccaagacgcgctgtccccagtgccgctccaggactcgtggctggggttgggttgcgtggaaccatgaagcaaagctccgtgctcgctggtatttcgggagaacgcgcaggctgagcctctgagcctccgcgggctgcccggttttcctcaaggactggatcatagcgggagggtggcaaaccgtactcgtacccgctgccagtgggtccctgagcctggcttccacaacccgcggcagagcgcccagagccagctcccgcagctcccgcttttgccaacctgtcccgctttaggcaagagcgtggcggcggccccgctaaggctacggaggggggctctccgcggctatgtttgtttaccaacagcggggctagacatcgccaaccccatgcctatgtgcgggtccttttgcgatgaaggagagaaaagcggcgctcc

SEQ ID NO: 36474 - DNA, 460 bp, Homo sapiens
  chr17:35297147-35297607
  hyper
cgcacgtttatatagagttctaattgtaattcgacttttctgaatctaatcggaaaataagtgccccgttccccccgcccacacaggtcactgccttgccaccttctttagacgatgcatctttcctctgggataacgctgggagtgaggctggggcttggcgggtagcttgggcccctggctctaaccgcgtgtatcccctccctaactcttccctggtgccgcgctctctctcctgctgcctcctcacctgcttaaccggaattctgcctctctttatctctctcttcccttctttctgtgctccattcctcctctcctacttcctccactttttacatcttccctctttctcgctgtcatctttctctccgcctgtctccccttgcccctggctgacccatccccgcccccgccccccacccccacccccccgcaggtgtttcggtaccaaatgcgc

SEQ ID NO: 36475 - DNA, 314 bp, Homo sapiens
  chr17:35297897-35298211
  hyper
ccctcttagccaccacgggcagtgaccccagtttgtctccggattcccaagacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcctcaacatgcgcgtcattcaggtcaggccccggcgcgcctctccatcc

SEQ ID NO: 36476 - DNA, 259 bp, Homo sapiens; identical to SEQ ID NO: 1284
  chr17:35299185-35299444
  hyper

SEQ ID NO: 36477 - DNA, 366 bp, Homo sapiens
  chr17:35299600-35299966
  hyper
gctggtggaccgcctggagccgggcgagctcatccccaatggtcccttctccttctacggaggtgggtgcgcgccgaatggcggggcacggccaggtcggggcgggcttcgttggaagcgggtggcagcgcgggggggcacgcctcgctctctgtaagccactggagagttggggcgagtagggagaaggctgggagtaaatcaaggggaggcggcgagaccgaggacccaattcacggccctgaataacgggggtagctggtaaggggcagctcccgggcttgcgcccagcctcctccctgcacccaggcccgcgagggctccccgcgatccgcgagttccccgcgtggccttcctcagcccgcc

SEQ ID NO: 36478 - DNA, 453 bp, Homo sapiens; identical to SEQ ID NO: 1287
  chr17:35300260-35300713
  hyper

SEQ ID NO: 36479 - DNA, 42 bp, Homo sapiens
  chr17:35300812-35300854
  hyper
cgtggggagggaggccgtgagcacagccgggtgaaggaagtg

SEQ ID NO: 36480 - DNA, 30 bp, Homo sapiens
  chr17:35301109-35301139
  hyper
atacacacatacacacgtacacggacacac

SEQ ID NO: 36481 - DNA, 237 bp, Homo sapiens
  chr17:35303314-35303551
  hyper
cgattcttctaacaacgtggttgtggcgcagtctctcccctcgtcgcgggattcagaatcctggcgaaaacccgaacaggtggcaacgctcagcagtcaaatttggagccgaaggccccaaggaggaggcctggaaatgtcagggcctgttctccttcccatcagtgctgtgccgcccacctctggccccgaggtgcggggacgtgcggcaccatacctaggcggagctcccgcagg

SEQ ID NO: 36482 - DNA, 885 bp, Homo sapiens
  chr17:36102404-36103289
  hyper
tttctctttgcttttcgtcttaagggaacacggtgggcaaaagaagggagtgcgtgtgcccgaggcttgggagccccctgtgcagtgacctaggaaccgctagcgatttcttgaaaaattactttaatcaagtccggcgctcccgggagcgggggaggaaaggcagcacccgctcgggacgggagaaaaaagcctccaggtctgtcccgcgtctccaactcggcgagggtctccggctccccagtccctctccctgccctgctggggcctggggctttggggagggaagagcggggctggggtctaaggaccctgggccgggcctggctctccgccggccgggcctgcgggtgtcggcgacccgggggctccgcgggcggctcgggcgctcacagagcccgcgtcccgcgccagagcggtgaggccgcggggccgcacggggcgcctggctgggtgcgcgctgggagcggcgagcagccccgcgcccgcgttttgatctccttcccccctctaagccgcgtttacaacttcaccaatgaataacccgcctctcttttcaacctaatcacggctctttgtgtatctttctgttgatgatttatagaaataaattaataacaccccaactccacgtgctgcagtttatgttacgtctcagctgcggccagcccggcgcggggctgggtgcggaggggcgccccaggtccttccagcgccgcgctagaaagcgggcgcctgcggccgggtgggagggcctaggccctgtggcccccggtggccggcggtgggagcctggttcatccgccaggtcctgagcgacctccccggcagccctggcgccccagccgctcctaggggccactctctcgacccctcttagcctcc

SEQ ID NO: 36483 - DNA, 36 bp, Homo sapiens; identical to SEQ ID NO: 12690
  chr17:36103290-36103326
  hyper

SEQ ID NO: 36484 - DNA, 495 bp, Homo sapiens
  chr17:36103540-36104035
  hyper
gccaaggctcagccccgaaatcgcggcgcttcagtgtccgaagccacgcgatgggctctgtcctaaagcggagtggcccgggagcgacgtgctgtctcagggaaccgctcggctccttagataattagtaaccagctgtcaaagtctagggcggtcggggaggacccacaaacgatcccggccctggggatacactgccagccggcctgaactcccggggagaggccgggggtgggcagcgaggtctggaaacgccctcctttctcagactgagaccagatcctctgcgaactgaggtctgagacgcgttcgcccccacaccaccgcgcttcgtttctttggccccgcgcgtgtccacccggaccctgcatggaacatgccctttgcaaatctaaacccgcgttggggatcccggataattccgggccttgcatgggcgcggctaacaagagtgcccaccagggaactcgcctcccagatcccggctccggatgc

SEQ ID NO: 36485 - DNA, 334 bp, Homo sapiens; identical to SEQ ID NO: 4411
  chr17:36104217-36104551
  hyper

SEQ ID NO: 36486 - DNA, 707 bp, Homo sapiens
  chr17:36104643-36105350
  hyper
cgtcgccggacaagcggcccttggcgtggccgttggtgagagtatggaagaccggcttggtgtcgggctcggccccgctgccaggggacaggggcagcgtctccagcttcaccccgaagttcggggatggcagcaactcctccaaggcctgaaccagcacctccttggtgaccccggagctcagcagggcgctcaggagttcttgctggagcgacgtgagcttggacaccattttccaaggacggaaaaagaagggggtgagggggtgggtgggtgcgagagaggagggtggaggggagtttcacaagcaaaccccaaatccaggaacccctccacccttcagcctccagacacctgttactccccggggtcccggaggctcctccgaaaggagtcagaaaacttctaacttgccatgatcgccaccattaggccatataagatatgcaaattagtgggaagggcccagctttcggctggatgcaaatgatggtggggagggggaaacccggagagagggagagccggaggggcagacctggagagcagaagacctgggccgggagcggggctttgccagggtccattgtactcacgctggggggctagagaccttcttttactggttctgcttatcagccaaacttcacctaacctttggacttgttaagccagtgccttgcagcctaggcgcggggcttttccac

SEQ ID NO: 36487 - DNA, 270 bp, Homo sapiens
  chr17:36105458-36105728
  hyper
cgaagagtagagaccctggatgcgtcccggccgacgcaggtggtgggccaggagagcccgcagggcggaagagaaactgaccacttaggaaggggcgccgaggccacgggggaggtgaggcagcgttaggtgtggtgagcatgccctggagggactccatttatttctacctcggttactacctccaggccccagaacctccctggcctggtctggcggtttgggtttgcagaactgcccgccagagagcgtaggcgagggtgaaggagt

SEQ ID NO: 36488 - DNA, 75 bp, Homo sapiens
  chr17:36715017-36715092
  hyper
ggttgggaatatttgcgggacagggtgtagccctatgtaggtccctgccgacagtgcggccgcatggctatggct

SEQ ID NO: 36489 - DNA, 136 bp, Homo sapiens
  chr17:36729051-36729187
  hyper
ccctttgctgcaatgcgagagccgccgcggccgccgccgtgccggcccgggccccagtcgccccggtaaccgcgactccacctggcgcggcgctgcgcgccgccgtgcacatcccctctcgcggccccctccctcg

SEQ ID NO: 36490 - DNA, 46 bp, Homo sapiens
  chr17:36829977-36830023
  hyper
gtaacaccaaagtttcgaccggcggatcagacgatcgaaatgttcc

SEQ ID NO: 36491 - DNA, 40 bp, Homo sapiens
  chr17:36905467-36905507
  hyper
ttttctcctgcctggcgctgattcccgcatttttcgctcg

SEQ ID NO: 36492 - DNA, 422 bp, Homo sapiens
  chr17:37321203-37321625
  hyper
gcccaatcgctcctccggactacagaggagcccgggaacccagggaagagctccagtgattggtccccctgcctgtcagtctggtgggaggcccagctctctaccctccccgcccgagagtcacttacaaccggtagagaatggtggtctttccttcattgtccagtcccacgatgatgaccgtgtgctctggaagcgtcggaggaagggcagcgtcagggccaaacccgaagaccaagggactgtgtgcccccaccagacctcccaggaaggagatagcgctccccgcaggctggggacctctgcccaccgtaccgcgtctgcttcccacccagctccgacacctgccccactccgggacggtggaaaagacagctgagcccccacctcccttcacattccagaaaagtgtctgaaaggcc

SEQ ID NO: 36493 - DNA, 88 bp, Homo sapiens
  chr17:37321787-37321875
  hyper
cgccgggacccaagaggagcaggcagggacgggggcaggggaggccgcggggcagtcgaggagcgcccatatacgaccctcggagccc

SEQ ID NO: 36494 - DNA, 512 bp, Homo sapiens
  chr17:37366040-37366552
  hyper
cccccactctgcatccgggcagcgccagcagtgccccagcacccccgcagcccgcctctccttggcgccccgctcccctccgcctataaatagcacaggacgtgctcgccgtggcgatgacgcggctgggcaggcggaggggaaggaggcagctctgccagagcggtgggcggcgagcgcggcggcgggaggggtgcggcccctccatgctgggctccgatgacaggggcgactgagtcatcccggggacccacgggccacgactgtccccgccgccagcgtttctgtctccggcttgggggactgcggggacgaggctgacctcggatgggtactgagccctcccagacccccggcacgcccggtctcggagggcacctctgggtgggcaagatcggcctcgacggccctggcgcgcaggagcatgtccgcccctgcgcgactcaggtgcacatggaggcggaaagtgaccgcagccccaagccgtttccctccagcgtccccagacctcc

SEQ ID NO: 36495 - DNA, 423 bp, Homo sapiens; identical to SEQ ID NO: 1290
  chr17:37381007-37381430
  hyper

SEQ ID NO: 36496 - DNA, 157 bp, Homo sapiens; identical to SEQ ID NO: 1291
  chr17:37381570-37381727
  hyper

SEQ ID NO: 36497 - DNA, 409 bp, Homo sapiens
  chr17:37381825-37382234
  hyper
cgggcgtctccgggactctgaagccgttctccagaggctgcccccagttagcccccggcacggcagcccccaacccgcgggagcgggcagagaaagttgccggggtggcgggcgaggggaggccaccacgctgagccgcaggagcgggacgaccccgggcgcgaggaccgagggtctgcagaggatgctgctcgcagcgcggggaggagggaagtggggccgcggggatgagccgagggagggagccaaggagctgtccgtgtccagccggctccgccgtccgctgcgcccgccccccatcccctcccctcccccgccggccccagcccggcacccggcggcccctccgcccagtcctcgccgcccaactttgatttaggaggtcgcctggtcccgccccctgccctac

SEQ ID NO: 36498 - DNA, 52 bp, Homo sapiens
  chr17:37388387-37388439
  hyper
ctcccttggggttaacgcctggggagagatcctgtggcgggggagtctagac

SEQ ID NO: 36499 - DNA, 131 bp, Homo sapiens
  chr17:37752808-37752939
  hyper
aatccatcagtggggcggcagctcccgcgcccccaccccctgcccctgctggatcccgcggttgacgccctcctctcctcctccccgcactggccgcgtaggtggcctcgggtgcggaggtcccggcctgg

SEQ ID NO: 36500 - DNA, 361 bp, Homo sapiens
  chr17:37753021-37753382
  hyper
cggaattttagatgtgctctccgcccctcctcgcaataactccccccaccacccccgcagctggcaccggctgtggcgtggcgccctcctcctcccccaactcccaatagcaaaaccgggtgatggatccgggagcacggctggaggcttgggccaggaggcccgggaggcccgcggcgtggcagtggcggctcccagcgcggagggaaccattgggcgctgttcggacctcttcccttgtgtccttccttcccttctcccgcatccactcactcccatctctccactgtctatgtccttctcgacctctgccccaccctacagcccatcccagccaccgcgtctacgaagatcctctaca

SEQ ID NO: 36501 - DNA, 144 bp, Homo sapiens
  chr17:37755368-37755512
  hyper
gccgcgccccagcctcggcctgggagcccggccgagcgcgagttcgctgcaagcgggatccgctctgagcccggccggccggcagcctccgcggtattcccggcgcgggcccctccaggggctcccctgcggctcctgggggca

SEQ ID NO: 36502 - DNA, 117 bp, Homo sapiens
  chr17:37756218-37756335
  hyper
ctccctgggcatggccggcgcctagaggttccctcttctcctcccctcggagcgccccagcttcccttccctgccctagggaactaaggtgactccgctcctcgcatctccctcctg

SEQ ID NO: 36503 - DNA, 30 bp, Homo sapiens
  chr17:37760128-37760158
  hyper
aggaaggtaaaattgcgtgtgtgtgggtga

SEQ ID NO: 36504 - DNA, 292 bp, Homo sapiens
  chr17:37760367-37760659
  hyper
ccaggtggcacccaccgaggcacagtccgggcaggggtggggctgcccccaggtctccatccccacccctcaccccaggaggggacagaatggccgcggggaggaggagccggcgagctcacctccttctgccccccggacgccggcgccgggcctgcttgtgcgtgcggtgtggtgtgcgtgtgtctttcatgcaaaccctccctccccaaaccgaccccccaacagtttgccattccatacaaatttggaaacaggtttttaaaaaacagcatgacgcacaacggggacg

SEQ ID NO: 36505 - DNA, 1545 bp, Homo sapiens
  chr17:37761235-37762780
  hyper
tcaagaaagagggagcgcctggctcctttttgcctcggcagctgggtgtctgtttttaaaataataatgagagggggaaacgcgttccattgctcagctgcccccttaccaacgccttgggcctgcagggaggagggggaggaggaaacctcagcgaagatattgggaatgggggaggggtgcctccagggagcccccggagagaggtccctggagaagcactccttgggagagaggaggagggaaccccttggggagagagaaggcgagtcccctgggggaagcgaggcccctgggacaggccacccacaggtaacaggactgcgctgccccaggagagcggcaggaccggtggcccgctccccgcgcccggcgccggggtaggatgggggtgtccctgcgctctgggggctggggacaggggggcgggcaaaggcaaaagaaaaagaagggagccggcgcgaagtctcagttatgaaaaaacgcattgagctcctcgtacatggggccccggtcgtggtgaaggtgcatatcgtaagacaagagattctccgagtggacgcccccgcgcacagccgacgagccgaagactagcccgtggcccgtgggccgcgaaccgggcagcgccgagtagtgcatagagtagtggtagcttttctcgtggtcgggcgaggagtcctgcttgagtgagaagttgccattgagacagagcggggggctgagcgggccctcgtactcggagctgttgtagtccgggctcgcgccgccaccgcctgccgccgcatacagcgtctcgtaggcggcgcagtagccgtgggtccgcagggcgtgcgccgcgccgccgcccaggccgccggccgcctggcactgtgcgcccgccaggcgcgagcacgggtacgggtaggggtgcatggcgaacgggccgcccgagccgtggaagcggccggcaccgtcggcgccttgctccgtgaggaagttgcgagagttgagctgcagacagccggccaccagattggtggtgggctgcgacagacccttgcacagagtctgcacgtaggacactaggtctggccgcttgccggagcgcaggatctccgagagcgcccagatatagttcttggctaggcgcagcgtctcgatcttggacagcttctgcgtcttggagtagcagggcaccaccttgcgcaggttgtccagggctgcgttcaggtcgtgcatgcggttgcgctcccgcgcgttcgccttctgccgccgaagcttggagcgctccaagcgcgccttggtcatcttgcgcttcttgggcccgcgcttcttgggccgctcgccctccgcctcgtccagtccttcttcctcctcctcttcctcctcctcctctccccccagctcgccttcctccttgacctcggccaacgtggcctccgtcccctcttctccacggagagggactggcttggccgcccgggctggccccggagcccctggcccgggcgcaggcggtggcggtggcggcgcgtcgcccttgtcgctcctcggctcgtcgtcttc

SEQ ID NO: 36506 - DNA, 45 bp, Homo sapiens
  chr17:37763928-37763973
  hyper
gcccctcctcccaaccggcgggtcagatctcgctccctttcggac

SEQ ID NO: 36507 - DNA, 186 bp, Homo sapiens
  chr17:37783470-37783656
  hyper
ccctcctcccgctcccgcgccctcccctcggcgggcacggtatttttatccgtgcgcgaacagccctcctcctcctctcgccgcacagcccgccgcctgcgcgggggagcccagcacagaccgccgccgggaccccgagtcgcgcaccccagccccaccgcccaccccgcgcgccatggaccccaa

SEQ ID NO: 36508 - DNA, 30 bp, Homo sapiens
  chr17:37794096-37794126
  hyper
tgtcgcccaacccctcgctctgtacactga

SEQ ID NO: 36509 - DNA, 269 bp, Homo sapiens
  chr17:37856457-37856726
  hyper
ccggagccatggggccggagccgcagtgagcaccatggagctggcggccttgtgccgctgggggctcctcctcgccctcttgccccccggagccgcgagcacccaaggtgggtctggtgtggggaggggacggagcagcggcgggaccctgccctgtggatgccccgccgaggtcccgcggccggcggggccagaggggcccggacgagctctcctatcccgaagttgtggacagtcgagacgctcagggcagccgggccctggggccc

SEQ ID NO: 36510 - DNA, 94 bp, Homo sapiens
  chr17:37857113-37857207
  hyper
tgtcccaaccagagccggggaggaaagggtggcccggagggtggcctcttgctggggtctgggttgggggcgggggagacgtttgctttgaaca

SEQ ID NO: 36511 - DNA, 306 bp, Homo sapiens
  chr17:38264389-38264695
  hyper
agaagcaggataaagcgcaaggagacaagaagggagccccgcgcgctttccctccttcctcatcttgcctcctgtttctctggcccacggaggaaggggcccagtgtgtttgtgccggctcgaggctcacgcgggctgccggggtcacatggcccgggcatgtgcagcctgctccatttctaccacaacaactcgctcataaacagcccggctgctgcggcggtggcggtggagacatgtgcaagcgagggggtggggcacgtggccctgcccgagccaagggaaggcgctcgctcagcactgcct

SEQ ID NO: 36512 - DNA, 142 bp, Homo sapiens
  chr17:38347474-38347616
  hyper
cctttcgctcctcatcgccttgcactgccatcttcccacccactcccctcaccccctggcgccctggccgcccctccgctgccgtgggtgcagctggagttcgtggactacgtgttccacggggagcgcggccgccgggaga

SEQ ID NO: 36513 - DNA, 25 bp, Homo sapiens
  chr17:38347753-38347778
  hyper
cggccgtcggcgggatggggggccg

SEQ ID NO: 36514 - DNA, 114 bp, Homo sapiens
  chr17:38478719-38478833
  hyper
tgtgtcactgtaccccgcaggcagtgtcaccgtgacccactcgctgtgtgtctgtgtgtacacacctaccttggagtggctttatcccggccctccccccggagcctctgtccc

SEQ ID NO: 36515 - DNA, 30 bp, Homo sapiens
  chr17:39683809-39683839
  hyper
ctccaaccttgcccccgccacctccagagg

SEQ ID NO: 36516 - DNA, 235 bp, Homo sapiens
  chr17:40332839-40333074
  hyper
acttgccccccagctcgaacctcaagccccgacctccgtcccactcacgcgttccgtcaaaacgggtggcgatggtgtccaggaaggtgttttgcggggccagcaaccccttcatgaccggcatggccccggggcgtgggttcaaggcgcggcgctggggagctttcagcgcggccgggccggagggggcgcgctgtcggaggggccggggcgccccatgcgccctcctgcctcc

SEQ ID NO: 36517 - DNA, 30 bp, Homo sapiens
  chr17:40400826-40400856
  hyper
ccaaacagaaagcagcgaattcttgccaac

SEQ ID NO: 36518 - DNA, 197 bp, Homo sapiens
  chr17:40464190-40464387
  hyper
aaaaagcaggggactcgaggtttggggaaatgatggagatgggcgcgggtgggcagaactctgacccaggcttctccttagcagctgctgctcccagcagcctcgaagctggcggctgagggcccggcgccaagatgcttctcaaccctcggggccaggggcagtcccagagccgcaacaaccgtcccatcctcctc

SEQ ID NO: 36519 - DNA, 36 bp, Homo sapiens
  chr17:40573790-40573826
  hyper
gctgcgcctggcccccgcccccgcaggcatgcgggg

SEQ ID NO: 36520 - DNA, 30 bp, Homo sapiens
  chr17:40669662-40669692
  hyper
caaaatgcggctgtgcgtccaggatgcctg

SEQ ID NO: 36521 - DNA, 106 bp, Homo sapiens
  chr17:40912947-40913053
  hyper
ctggagagtcctgggcgccacgcagccgagcccccgaaatagatcccggttccggggttccgggagctgtccagcctcgcggggtgagctacgagagggtgggcca

SEQ ID NO: 36522 - DNA, 261 bp, Homo sapiens
  chr17:40932562-40932823
  hyper
gccgcggggcggcgacgggggcggggccaggccgagctgggggctggggccgcagccgctcagccggagcgcagcgcacccagcgagtccgtctgtcaggccgcctcctctccggccgtctgattttctacccttcggcgccctgctcttcctcatgttggcatccccggccacggagaccaccgtcctcatgtcccagactgaggccgacctggccctgcggcccccgcctcctcttggcaccgcggggcagccccgcct

SEQ ID NO: 36523 - DNA, 59 bp, Homo sapiens; identical to SEQ ID NO: 12713
  chr17:40932843-40932902
  hyper

SEQ ID NO: 36524 - DNA, 30 bp, Homo sapiens
  chr17:40933234-40933264
  hyper
cctcaagtttgacatcgagattggacgtgg

SEQ ID NO: 36525 - DNA, 80 bp, Homo sapiens
  chr17:41723454-41723534
  hyper
ccgatccgggttggccgcccgcggggcgcgcccggggagcagggcagggggccgagttcctggcgcgggctgcctgcccg

SEQ ID NO: 36526 - DNA, 56 bp, Homo sapiens
  chr17:41723778-41723834
  hyper
gacgacgggcgcggtcggggactggtttcccaatcttctcccgtcccgaggcttag

SEQ ID NO: 36527 - DNA, 32 bp, Homo sapiens
  chr17:41832619-41832651
  hyper
taaacaatcaaaccacgcgcagaggacagaaa

SEQ ID NO: 36528 - DNA, 217 bp, Homo sapiens
  chr17:41983831-41984048
  hyper
atcacccatagtgtccgcaggcgagcggaccagcagtgaaagggagaggtttcttccaacctcccacccatccctccatccatacacatacaaagaggtgcggagaagaaaggtctgacaaaggcgctttggagagcgagaggtcgcggggaggtctggacagaactgagggccagaggatggggtcgaaaggccaggcggacgtgcatgcttggac

SEQ ID NO: 36529 - DNA, 81 bp, Homo sapiens
  chr17:41984266-41984347
  hyper
cttcgcttctggcaccggtcccctcccaagtctccagaccctaaccctggctcccgacccgccccgctacagcttgggaag

SEQ ID NO: 36530 - DNA, 209 bp, Homo sapiens
  chr17:41984363-41984572
  hyper
cgcccttctgcggaccccctcccagggaagattgtggtgttagctgcctagggggaccagggggccaccgggacccagcgcaacctctgtctcgctccccaacccccggaagcgctaacagcacggttcttacgtaatgccgggcttctaagtacccccaacccgcacagcccccggggaggccgcgcagataccggggcccctcacag

SEQ ID NO: 36531 - DNA, 422 bp, Homo sapiens
  chr17:42030329-42030751
  hyper
caggtctgggccctccgacctgcggaagcgaaggggaaggaattggatctggggaggcgagcctgggagacgtcgttaagtgatgttgccagggtagggccaggccgcgctctcggatgcaggatgtgtggtaacgggcgcttttaccgcgacctgacggggcggtcctcgccgtcggggaagaacgttttggaaagaagcgtgtccgggccgtctcttttcccatacctgggggcggggaagggaagagcgtggtcagatctggccacgcccccaggtggagcggggccgcagggtgagagccccaggggtcccgctccgcgcctgcgctcaccgctgccgggtgaccaggttgaggtagtggcgcagggaggcgtagtagcggttcagctcctccggcgaggcgtcttcgcggggagcct

SEQ ID NO: 36532 - DNA, 163 bp, Homo sapiens
  chr17:42061257-42061420
  hyper
ccgggctgagtgttccgaggcgagcggctgctgtttgcgcagctaagtggcgtctgtgtacccagcggggcgcagcggtcgcgcgcttatctcccgcaaacaccgcgcccggatccgccggaaccacggccgcgccgccccatttgcacgccccggccgccgg

SEQ ID NO: 36533 - DNA, 88 bp, Homo sapiens
  chr17:42082176-42082264
  hyper
tcagcaccgcctggtcgcagccccagcccccgcccgaggagtacgcgggcgcggacgacgtctcccagtcgcccgtcgccgaggagcc

SEQ ID NO: 36534 - DNA, 88 bp, Homo sapiens
  chr17:42082469-42082557
  hyper
cggcgtgggccgtgacgcagcgaggggatggggttgtgcggccacctgtcctcaggcatggcaggatacgctgcgggctctgcgcagc

SEQ ID NO: 36535 - DNA, 138 bp, Homo sapiens
  chr17:42082805-42082943
  hyper
cgggaggtaccccagcgtgagacaagggagtggcaagacccaacggggcaaagggcggagcaggtgggcactggtggccagaactgggtcctgacagcttctggaagggtagggtcaccgagacggccctgcaggcca

SEQ ID NO: 36536 - DNA, 160 bp, Homo sapiens
  chr17:42083143-42083303
  hyper
tctgggaggccaaggcgcagctggccaagagctgcaaggtgctggtagacgcgcttcgacacaacgccgccgctgctgtgccattttttggcggcgggtctgtgctacgcgctgccgagccggctccccatgccaggtgagtgcccgccctgcccgccca

SEQ ID NO: 36537 - DNA, 98 bp, Homo sapiens
  chr17:42083525-42083623
  hyper
cgtcgctggccaaggcgctgcggcccaccaaaatcatcttcctcaataacacaggcggcctgcgcgacagcagtcataaggtgcggccctttctttca

SEQ ID NO: 36538 - DNA, 30 bp, Homo sapiens
  chr17:42091732-42091762
  hyper
agtccccgtagtggacgtagcccccgatgt

SEQ ID NO: 36539 - DNA, 97 bp, Homo sapiens
  chr17:42393478-42393575
  hyper
actatcctccactgacgtccccatcaccccagctgaccccaacaacactgcaccattccctccaactcccaatatttgtgcacgaatccctgtcacc

SEQ ID NO: 36540 - DNA, 236 bp, Homo sapiens
  chr17:42393870-42394106
  hyper
aactccaagctctaccggaggtaagccccagccaggtggggcttgggcctgagagcgggtcgtcctggggaagaagggcttcctctaccggcgcaccagctctcgctctgccgcagacacagcttcatgagcacggagccgctgtcagctgaagccagtctgagctcggactcccagcgcctgggagagggcacgcgggacgaggagccctggggtcccatcggtgagctccccca

SEQ ID NO: 36541 - DNA, 487 bp, Homo sapiens
  chr17:42635273-42635760
  hyper
tgcaccagttctatccgctggtgaaggtgcagtgctcgcccgaactgcgcttcttcctgtgctccatgtacgcacccgtgtgcaccgtgctggaacaggccatcccgccgtgccgctctatctgtgagcgcgcgcgccagggctgcgaagccctcatgaacaagttcggttttcagtggcccgagcgcctgcgctgcgagcacttcccgcgccacggcgccgagcagatctgcgtcggccagaaccactccgaggacggagctcccgcgctactcaccaccgcgccgccgccgggactgcagccgggtgccgggggcaccccgggtggcccgggcggcggcggcgctcccccgcgctacgccacgctggagcaccccttccactgcccgcgcgtcctcaaggtgccatcctatctcagctacaagtttctgggcgagcgtgattgtgctgcgccctgcgaacctgcgcggcccgatggttccatgtt

SEQ ID NO: 36542 - DNA, 380 bp, Homo sapiens
  chr17:42733526-42733906
  hyper
cggtgcctgccagtccgggccaatcccgaacacatttactttgagcgggaaaagctcagaagcggcgagagagcgtggtccgctaaccgccccttcctctccttgtctctggggggtaacggagcctggagtggtcgcccattggatgggcatcggaccaatggcgggctgcgaaacgggaggggcgggcctcacagcggggcggggcgcgcctgtgccgtgtcgcgtgccgagccgcgagccccaggcaggccaggtaacggcctctgcccccgcccctccctccccgctcggacttcccttacccgcacactggctccaggcagcgcccgggcggcggaggcggctgcggagacggcggggtgcgggctgagggagcc

SEQ ID NO: 36543 - DNA, 66 bp, Homo sapiens
  chr17:42906582-42906648
  hyper
tcccaatcagacaatcgcaaaaaaaagaacaaaatctaaaccatacattcacgtacatcttttcaa

SEQ ID NO: 36544 - DNA, 182 bp, Homo sapiens
  chr17:42907014-42907196
  hyper
ggggcggcccggctccgccctgcgcccctaaccgcccgggtagttgtcggcaccgccggggcgccgccgagtgcgcgccgcttctgtccgggctccccgaccgtcgcccgacacctccgcggcccaggacacccccgagccgtttccctcccgatttgggagccgcgcgcctggggacaaag

SEQ ID NO: 36545 - DNA, 416 bp, Homo sapiens; identical to SEQ ID NO: 12728
  chr17:42907735-42908151
  hyper

SEQ ID NO: 36546 - DNA, 80 bp, Homo sapiens; identical to SEQ ID NO: 12729
  chr17:42988684-42988764
  hyper

SEQ ID NO: 36547 - DNA, 299 bp, Homo sapiens
  chr17:43044508-43044807
  hyper
ccccaagggcaagtccgtgcacctgggagccctgcgctctgactagttgggttcatttcccgcatttccagtagcgttccagacggtgcccagcagcgtctgtcttggagcgggaacccaggaactgaggatcggcgatgtccgctggctccgaccatccccacacgtgatgaccaagcggggccgctgtggggtgggatctccacctgcgtccgcctggcgcccccgccaactccgatcaggtacccatttgccccgggctccctgggtgccctgggcccagcccagccccatgcccc

SEQ ID NO: 36548 - DNA, 6 bp, Homo sapiens
  chr17:43044863-43044869
  hyper
cgccgc

SEQ ID NO: 36549 - DNA, 228 bp, Homo sapiens; identical to SEQ ID NO: 12730
  chr17:43045038-43045266
  hyper

SEQ ID NO: 36550 - DNA, 141 bp, Homo sapiens
  chr17:43045371-43045512
  hyper
cgagctcaccagcacggggatgagcaccaccagcaccagcagcatcaccacacccgcggcggccgctagcagcgtctttcggcccgcgcggagcctggggagcgccgggccgcccggccgcgccgtcggggcaatggtgcc

SEQ ID NO: 36551 - DNA, 233 bp, Homo sapiens
  chr17:43047752-43047985
  hyper
cgcagagccctccgggcacaccgcggctggccgcccggggccaaggatggggcgggagcgcccacccacccccgcgccggccggggcatccaagaggcgcgctcgcagccacacggcgccccgcctcccgctccgaaaaagctcctgctcccctggcgcggtgtggcgtctccgtcagcccagccggattctccccgcttcgctggagtggaaaataacggcttcaaactttg

SEQ ID NO: 36552 - DNA, 224 bp, Homo sapiens
  chr17:43339109-43339333
  hyper
gtccctactccaaggcgcgcatgcgtgtccgtgagagcacatgggtgtgcaccgcgcaggggctgaggctgggagccgtagtcaggggcaccgggtgggctttggcggcgggtcgacctgcctttcaggtgccgggggtttgggagcaggggaacgggccctgggcggattcctgaccgcccccttcgcgcccctccccctctcactttcgctttccccgcctg

SEQ ID NO: 36553 - DNA, 296 bp, Homo sapiens
  chr17:43339641-43339937
  hyper
cctctccgaagacctcgggggtggggctcgcgcttccgcagcgggcctagagcgagaggcaggcggcaggtaagcctggctgtgctggacaggacttgcacccgctctgcacgccagcggctcagggctgccgcccttttcgtggtcccagggcccttccaagaaccggctaaaccaacccaagccgcgcgcacacacacttgtgcacacagggagtgtggagccagattcgataaggcaccccgtgtgccccagctccatgaccaaggaactcagcaccccgtgtgccccagctc

SEQ ID NO: 36554 - DNA, 169 bp, Homo sapiens
  chr17:43974231-43974400
  hyper
gtgatgaacctggtacgcacggttttctggttaattctatcgctgaaaactggtgcggggggcgcacttctgagacggaagagcatctaggagctgaatcctccacgcgggtcgcccaggttgatctgaatttctggggaatggcttggctgcccgcccgggaccaggc

SEQ ID NO: 36555 - DNA, 102 bp, Homo sapiens
  chr17:44919159-44919261
  hyper
gaccttgagcaaccacgtcctcctctgagctccgcgtttgccgtgtgcaaagtgaaggggtaggccgaccccgcagggcccttcttgcgctcctctgcggtg

SEQ ID NO: 36556 - DNA, 88 bp, Homo sapiens
  chr17:44928630-44928718
  hyper
aatctcctccgtccccgcctcgtaccctcctccccgcctctccaggcccggggggcttcacgttcagccaccgcgaccccgggcgggc

SEQ ID NO: 36557 - DNA, 101 bp, Homo sapiens
  chr17:44929256-44929357
  hyper
ggtctccagcttccccggctccgaatccatcgccctgttcagtgtccgagtctctggtcgccccccagccgccgctctcctcatcccgccgggtctcggac

SEQ ID NO: 36558 - DNA, 130 bp, Homo sapiens
  chr17:44929573-44929703
  hyper
ggctgttcccggtctcggggcagaggatcgtgcgcgtccagggagaatgggggaaacctcggacggtgagagcgccagctggagacgcaggaaggaaccgtgcgctggggaaatgcgaccacatctcaga

SEQ ID NO: 36559 - DNA, 34 bp, Homo sapiens; identical to SEQ ID NO: 12740
  chr17:45055871-45055905
  hyper

SEQ ID NO: 36560 - DNA, 117 bp, Homo sapiens
  chr17:45056144-45056261
  hyper
acagcacgcagagcacggcgatctgcgccacccgcgacacccacaggctgcgctcgtcgggcgccagccccgcggggaccccgtcgctggcggccagcggtgcgccccctggacagc

SEQ ID NO: 36561 - DNA, 37 bp, Homo sapiens
  chr17:45056814-45056851
  hyper
ccccctcctggcacccgctgtccgttcttggctagaa

SEQ ID NO: 36562 - DNA, 30 bp, Homo sapiens
  chr17:45331645-45331675
  hyper
tggtcgggccaaggacgactggcccaggag

SEQ ID NO: 36563 - DNA, 873 bp, Homo sapiens
  chr17:45810546-45811419
  hyper
ggagtgggggggagccggagagcttcataaagccacagcaaagcgctgcgactctagtgacagcggcccgctggagaggaagcccgagagctgccgcgcgcctgccggacgagggcgtagaagccaggcgtcagagcccgggctccggtggggtcccccacccggccctcgggtcccccgccccctgctccctgcccatcccagcccacgcgaccctctcgcgcgcggaggggcgggtcctcgacggctacgggaaggtgccagcccgccccggatgggcatcgtggagccgggttgcggagacatgctgacgggcaccgagccgatgccggggagcgacgagggccgggcgcctggcgccgacccgcagcaccgctacttctacccggagccgggcgcgcaggacgcggacgagcgtcgcgggggcggcagcctggggtctccctacccggggggcgccttggtgcccgccccgccgagccgcttccttggagcctacgcctacccgccgcgaccccaggcggccggcttccccggcgcgggcgagtccttcccgccgcccgcggacgccgagggctaccagccgggcgagggctacgccgccccggacccgcgcgccgggctctacccggggccgcgtgaggactacgcgctacccgcgggactggaggtgtcggggaaactgagggtcgcgctcaacaaccacctgttgtggtccaagtttaatcagcaccagacagagatgatcatcaccaagcagggacggtgagtgcggcgcgccggcccttggggcctctgtgcccgcgccggaacaagaacgtctcgtctgtttttctggctcgacaatgcttctgactccgtgtccctcactgc

SEQ ID NO: 36564 - DNA, 457 bp, Homo sapiens
  chr17:45867027-45867484
  hyper
acttgtactttcaaccacgtcccccactccaaaattctgcgcctccctcaagccagttcctcctctgcttcctcctcgcagcagccggcgcgtctttgttccgtccaggcatcttcaacgcgtccctccctctggacgctgccgaggaaatactgaagtggtagaggatgtggggaggccgtccaagagtggaggtgtcccgggcctgctctctccaggaggaggagtgcaggctggggtccacctccccggtccagcagtgctggggaggggaccccgcacgtgtgcccggagcgcggacacggtgatgcggctgcccctcgccccggccccaggctcgctgcgccctccctccccggtcgcctctgcgtttctcccgccagcaggagaccgagtctgagcgcagccgccgaccctgcgccttccctgtgcactcaaagaccgccagctctggggg

SEQ ID NO: 36565 - DNA, 156 bp, Homo sapiens
  chr17:46089946-46090102
  hyper
cccgcgcatccctgacggtgcccaggaaggcagagtgggggagagacgacccgcactcagcctgtgtttagggaggactggacccagtgcggttcgcaagaggttctgtgtccccaggccatctttggtgacattgaaccccgggagtccagctcc

SEQ ID NO: 36566 - DNA, 30 bp, Homo sapiens
  chr17:46507708-46507738
  hyper
cacgccggagccccacggtagaaggattgg

SEQ ID NO: 36567 - DNA, 36 bp, Homo sapiens
  chr17:46619087-46619123
  hyper
cgcaggggcgggggcagatcccggctgggccggcgc

SEQ ID NO: 36568 - DNA, 882 bp, Homo sapiens
  chr17:46620552-46621434
  hyper
gagacaggagtcggccgcgaagaagttgaggtcgggaaggaaaggtgaatcctggcgccccgagaagacgtcttctggcaatggcccgggctccagcccgccggccccgcgcagcgcgcagccgggactcgacgcgcctgcgccctctaagcgaacggctaaaggccgggggtccgcgcttaaggcccccggcaccacctccggcgggtgacagcaggcttcccacgccgcccgcgaggcggaggggccgcccgggctggccgcgggttcctcggcagggtcgcagatgtcctccagggctcccgggcaggcaggctccccatccggcggctctcggtgctgcgtctgccgcttgtgcttcatgcgccggttctgaaaccagactttgacctgcctttcggtgaggtccagcaaggccgcgatctcgacgcggcgtggccggcacaggtacttattaaagtggaattccttctccagttccagcagctgcgtgttggtgtaagccgtgcgcagcctgcgcgccccgccgccaccagcctccggcagtcccaggccatctgcagggaaaacaggctcggcgtcatagcgggccgtgtactcagcccaacctcagttcggactaccccatcctccaaaaccagtatcacctctccccttcctcgccaccccacccccgcccccaccccaaagccgctcgctttactgcttttgggttttcttctctccctctctagtctacagccccggcccgggtcagggcaaagcattcagagccgcccacgggccacgcagggggcggagagcggctcccttcggcgccggaacctcagatccccctcccaagccctcccagtggacccctcaattcggaactttccaact

SEQ ID NO: 36569 - DNA, 232 bp, Homo sapiens
  chr17:46621779-46622011
  hyper
gaaccccaacaggctcgccaccattttttttaaacctccttccactgctttttctccccctcttctagctgcccctcaccccacccccaccacgcttaccgacctgcaggcgatccgaccccggaggccggaacggcggaggcggccggagaaggagacgtggcggattggctgggtttcttggcggatttcttctctttcatccaagggaactcgggggccgggggggcag

SEQ ID NO: 36570 - DNA, 324 bp, Homo sapiens; identical to SEQ ID NO: 1295
  chr17:46655070-46655394
  hyper

SEQ ID NO: 36571 - DNA, 24 bp, Homo sapiens
  chr17:46655395-46655419
  hyper
gcgcaggagcccgaggggacagac

SEQ ID NO: 36572 - DNA, 111 bp, Homo sapiens; identical to SEQ ID NO: 1297
  chr17:46655450-46655561
  hyper

SEQ ID NO: 36573 - DNA, 437 bp, Homo sapiens; identical to SEQ ID NO: 1298
  chr17:46655562-46655999
  hyper

SEQ ID NO: 36574 - DNA, 350 bp, Homo sapiens
  chr17:46656057-46656407
  hyper
cgcaaaccctagatcccttaagaagttggggctcccggtgtagccctcctgttctgcctcacctctgcccagcattctgtaccttccaaaggccccagtctcctcccctcggcgggagggagcgctagcaccctgcgtctctatggggagttaggttactggcgggttgggggctccgtctcgaaaggggaacccatacgggggccagagcacagagcttggggcttttctctgcagctggatggggaagggtaggggtgagagaggaggcgtccagagctagagggcgggtgcgcagagggacttgtcagagatgaatggaaccgcgggcggatcgataggaaattcat

SEQ ID NO: 36575 - DNA, 480 bp, Homo sapiens; identical to SEQ ID NO: 4434
  chr17:46659429-46659909
  hyper

SEQ ID NO: 36576 - DNA, 237 bp, Homo sapiens
  chr17:46663552-46663789
  hyper
agacaagagaggagacgcctaaatcactgagaaaaggaataagaagagagggaagagaaacgttaaaacttggggacaaggtgctttttgggatccgacaggttcccgaattgcccgaagtccaatactctccaggctcccaaatttcccctcttcctcttggagcctgcaatcagtaaattcgccaaaagaaagaacgaaagatccgcctaaacctgccggcgtgcccccaccccc

SEQ ID NO: 36577 - DNA, 553 bp, Homo sapiens
  chr17:46670978-46671531
  hyper
tagcaactgatagtccgggccatttggataacgccccgagaaggagtttacaaagtacgagctcatttgggtgattttggagggcttgatttgtggatcgtggtcgttataaccctgtgcttcacgatttatgatgtattaatgaattatagcgatgcactgtacttcgttttgctatgtatgcggccaaatatggggggggggttggaaggggggtggggggcgttagggaatcacgtgcttttgttgaccagtcgtaaattctcgctgatgacctcaagaggtaattcatgctctatggttacaaataatgacgatccgagaatcgttagggccgattcaatgcgagcctccgagagagggggaaaaaaggagaagggggagaaacagagagaaggttggctttggcctctgagcagagcgcgccacctcccggcgaccgacgggagcgcgggcgtgagaccgccatggcggcgggcggctgcctccctgctggctccctgcaggctccctgcagtcgccgggagagaaagaaacccggccaaggctcagc

SEQ ID NO: 36578 - DNA, 835 bp, Homo sapiens
  chr17:46674922-46675757
  hyper
taataggggacacagcgagagacccccggccggcgcccaatcttcttctatctcctaactgagatgcccacccagcaccctgtgggagattggggcagggggcgctcactagttctgtgtcccggggtgggcgcccaggggagccggggcgacggcgacgggaagtctcactcactgttgcacgaattcatccgctgcatccacgggtagaccggagtggagcacttctgctcttctgtctcgccgaacacgctcttgtcctgcgcgcagtccgacttccgcggctcggggtggaacgggggctgctcgtcggcgccggagagtgcgcaggccgactctttctcgcggtagaaggccggcgccggcccgtagtcgcagggcgccgctcggccgtagccaccgcccgccggcgggtaataggaggaagtggcaaagcccttgtcctggcccggccctggcccgtagggcgcggggtaatgtctcagcgggtccgcatagcccgacgaatagagcggtagctggcccaggaaggactcctgcccgctggccagagtgacggggaaggtggagttcacgaaataggaactcattgggaggggaggcgcgcgcggccgctgctgctccgccgggtttatgatttgttgtgttttatagtccgagcgccgcgcctattagtagtatatccgagattgggttttagctgaggggggatggcgaggtgccagtgagggccagaaggaaatacaaccatctgatccaacactgaccaatggcagaggcaggaattgtcaaatagcacccaggaggagcgcagcccgcacgagggacccgcgca

SEQ ID NO: 36579 - DNA, 1002 bp, Homo sapiens
  chr17:46687804-46688806
  hyper
cagccgggaaggaggcgccttcagggtaatgtgccccggcccctggggctcaggacagctcggtgcgcggcgttacctgagcttcgcatccaggggtagatccggaagttactctcggccgccaagtccgagtccctctgctccttggcgcccgccgccttggcggagtcgccgggacacaccccggagaggttctgctcaaagggcgcgcagtgcatgttgaaggaactcggctcgagcccatagccggccgcgtagacgccggccgcgctctggcccgccatgccccccccgccggggtacaagccctgcatcgaggcggcgaaggaagcgcccgaacccgctccatagcccgggcgctgggggttggaagcaaacgcacaagaagtttgttctgggaaggctccggtagcgaaaaccgaacttgaggctggatatttagaaaataaagtattcgcataatacaatgaactcataatttggccggatgatttgtaggcagggacgttttagtgtcggttttacgagattccttgatatattacagaattagagtccagatttacaccaaaaaggaccccctttttcctctccggaccacgtgaccccgcccacgtgacgtcccctccgccaatggccgggccgtctccccacggctcccggtaatgtggaaaaaattgtgtggcgttggatttataaaatatgatcaataatgaatgggaaagccgagccctgtggattggggctgggggctcaagggccgctgccgactcccgcgggctggaggccgcttgcaggcgagatttggggaggaagagattgagtggaagggaaaataaataacctcggggcgatccgtgtcaccctccacccatcctcttcagcccgttaccgagcgagagacaaacgcagggattgaatgcacgcaactgggtgggtgggtgcttggggcaggtctgttctttattaaaccaggccaattctgcacggcaaggccttttg

SEQ ID NO: 36580 - DNA, 378 bp, Homo sapiens
  chr17:46689986-46690364
  hyper
cagagagaaagccagcgagctggggggttgcagaggggagagaggattgggaggggaaatgaggacgcagcgagagagagcgagagcgagagcgagcgagcgagagagagagagagaagggagacagaaagaattacggcgtgaataggcagtttcatgttgttgggagaacttagcagaaatcggtaccttggtcattacaaagaagcacgttcaaaggaaaaaaaagacaattgcacaaggaggctttttacacggggaggggaggggcatggggggctcagccgggcctttgccgctcgccctcacagggcgagggagcctttgcttaaatccttttctttccccccggcccccaagagaagggaaggagatcca

SEQ ID NO: 36581 - DNA, 276 bp, Homo sapiens
  chr17:46690429-46690705
  hyper
cgctgcggtgggaggcccggctcctggccccgctagcggggccagagctctctcgggcaggggcgcgcggcggcggcgcggccgggacccgcggacgtgcgggcggccgcggccctggcagtcccagctgaagcctacttcttgtcgcccttctgcgcgtcgccctcgtccgccgcctctggggcccgctccagcttctgtttctccagctcctcctgctcgcatttgctgctggggaacttgtctttgttgttctcttttttccacttcatcctc

SEQ ID NO: 36582 - DNA, 53 bp, Homo sapiens
  chr17:46690852-46690905
  hyper
cgcctgcgtccggcggctgctgggaatgggggaaagggcgagacagaggggag

SEQ ID NO: 36583 - DNA, 377 bp, Homo sapiens
  chr17:46691442-46691819
  hyper
ggaaatgtttctaagcgacccccttcaagggaaagaaaaaagaaagaagaaagaaagataagaaagaaaggggaaaagcggcaggcgatcggaacggagccggcaagtcttccagaagctggaggaaatgcgccccggcctgccaggccttgggcccttccggccccctcctgcccttgtcggccccgaggcgagctcaccttgcgggcgcatccaggggaagagctgtgtgggcgacgggctctgctcggagccctcggcctcctcgcccaggccgctggcggcggcaagcttgcagtctgcgtactgcaccaggtctggatcctgcgcaccgaataggctctggcgttgcagcgggtcgtagccgtagaaattgc

SEQ ID NO: 36584 - DNA, 378 bp, Homo sapiens; identical to SEQ ID NO: 4440
  chr17:46691987-46692365
  hyper

SEQ ID NO: 36585 - DNA, 141 bp, Homo sapiens
  chr17:46702566-46702707
  hyper
ctaggaacaatcctccgccaagctgttgcatcgcaaataaaatcctaatgagctccctcccccttccccttggccggcttttacggtctgcgcgtggcgcggggagctctgccagccgcacggccccgggcagcccagtgc

SEQ ID NO: 36586 - DNA, 50 bp, Homo sapiens
  chr17:46710940-46710990
  hyper
gtccaggctccctcccgccctcgcccagaagcgagggtccgagtggccac

SEQ ID NO: 36587 - DNA, 181 bp, Homo sapiens
  chr17:46713949-46714130
  hyper
tctgtggtctcccggcgggtgaggccgagacagagaccaacctctaggcggcgccctggcgttgagtccgcgctgaacaagattctctcgcagctctgcgtcccgcgccgggtgaaggggcgtgttcctgcaggcgctcggggctcggcctggagctggcggccggcacgtcgcctttggc

SEQ ID NO: 36588 - DNA, 154 bp, Homo sapiens; identical to SEQ ID NO: 12768
  chr17:46714131-46714285
  hyper

SEQ ID NO: 36589 - DNA, 301 bp, Homo sapiens
  chr17:46723899-46724200
  hyper
gagaggggcctttcacgccgcagtccccagctgcgagaggaagggctgcgcccgcctcctcacctacctctcggaaccacgccgtcccccgcgcgtcttcgtagactgcaggagtccagggcgtctggggactgtgacggcgcccaaggcgggggatgtggcggctctgggtcgccgccttctgcccccgcctctgtgaggcctctcgaggcagtgtctgtgtctggggcagcgacgccgacggcgctgggggcgcgaaggggctcacgctcctgcgttcccctggcgccggtgagtggcg

SEQ ID NO: 36590 - DNA, 43 bp, Homo sapiens
  chr17:46755656-46755699
  hyper
ctcaagtctcaaacacggtgcggggctgcgcggcaaggagaaa

SEQ ID NO: 36591 - DNA, 938 bp, Homo sapiens; identical to SEQ ID NO: 1300
  chr17:46795436-46796374
  hyper

SEQ ID NO: 36592 - DNA, 55 bp, Homo sapiens; identical to SEQ ID NO: 1301
  chr17:46796498-46796553
  hyper

SEQ ID NO: 36593 - DNA, 25 bp, Homo sapiens
  chr17:46796613-46796638
  hyper
cagcactactaccgtctgagcaggc

SEQ ID NO: 36594 - DNA, 365 bp, Homo sapiens
  chr17:46796849-46797214
  hyper
cgggcgacagccccccggataaccccgccgagggaggggcgcttgtaaaaccgagcggcgacggcctcgttacgaccgactcgaacattctctaataaatcatcggccttagctagtattcgtttgtgtacgcatctgtttatcctgattattaaaataaattaaggattagactgcctagaataaggtaaacgaacatgaaatgccaaggaggaaaacagaaaaagttacaccatgtcgatcccgaccaaaacattggcctgacttgccggatggcctcaagaatccggcttttagctgcaggcccggcgggtgttccccggaaggcaaggattggaagctctttgataaagccgcgcgaggcc

SEQ ID NO: 36595 - DNA, 455 bp, Homo sapiens
  chr17:46797274-46797729
  hyper
cgtctcggcctggctccggaggggtgaaggaatgtttatagcctgactcaagttcaatgacaaaaacctgcctggaatgggaggtgcggcgagcttcagccatcaacatgacaaaggctggacgcaggtctcgggcgggggcgacgggctgggcccacctagagatggggagctgagggcccacaggatgggtacggaccccgcagaccaagagctgcctctctgccctcagcctggggtctgcggagtttggcgagtagtgcgggtgtgtgcccgcctggatgagggtaaggcgatcagcctctgagtgggcaaggggacgtctgattactgcccaggcttcgcctgggggtccaggaccctgtgagatgcccctgctctctgcctggccagctctagctcacccggagtaaggatccgcaccgtccttctatccaccgcgacctgcattttct

SEQ ID NO: 36596 - DNA, 172 bp, Homo sapiens
  chr17:46799288-46799460
  hyper
tttaaataataataacgttatcaatattaattttgcttatgccaggactccatcccattggagacaaacattaagtcttatggcagaccttacagcgggtgctagttcccactcccaagcctctcccccgcctaggtcctgcaggtcccgcgtgctgcgaaacattttcttt

SEQ ID NO: 36597 - DNA, 95 bp, Homo sapiens
  chr17:46799801-46799896
  hyper
cttgcaagcaagcatcggcctaaaggtttcagcctcccagtggcgctctgtttgcacgccttaggctaggagaggaaggacgggagcacagcact

SEQ ID NO: 36598 - DNA, 30 bp, Homo sapiens
  chr17:46800233-46800263
  hyper
tccccccaggctgggcgccagcattattct

SEQ ID NO: 36599 - DNA, 559 bp, Homo sapiens
  chr17:46800489-46801048
  hyper
gcctggggggaggggcggggtgtcctgcttttgggctagaggcccggggccgctcccgagctttctcccctcttccctggagagcgactgttcgggagggtgagaatggtataaatttcaaaaacaacgaaaccttcttttgccccctccgcagcagtcgcctccgggctttattgcaagtttacggtaacgagttcatctatttaattcgcggttgcagctcggggatttctattagacaggacgggttggggccggggggcacagggtctcccctgaaggaaacccaattagagtgcagcacttagcaccttcaatataactttaatgaagggggggaggggagctgcagggaagagaagtttgctctaggttggggaaggaaagctggagctgctcccgagaactggggggcctggatgaggctttttcctgcttcgagggctttccagcttccggcccgggaactactatttggagtagggatcgcctgcagggaaggcggggcggattctcggctggcggcggcctcgcagggttcccggaagcgctagccagc

SEQ ID NO: 36600 - DNA, 188 bp, Homo sapiens
  chr17:46801108-46801296
  hyper
cgagattcaaaaagagcttccggaggtagtttctacgcattgcgccactactcccttattcggcttctggaggcctaataaaatccacttgctttggagttagaaattatttcgggcctggagcccgcgtagacgcgaccctgtgatcccatttcgtagcttgctgagagattcgctgcgggagtttg

SEQ ID NO: 36601 - DNA, 30 bp, Homo sapiens
  chr17:46801636-46801666
  hyper
gattcccaatgaaagcgtttaatacaaaac

SEQ ID NO: 36602 - DNA, 655 bp, Homo sapiens
  chr17:46802257-46802912
  hyper
catctccgttagtggcggtggcagcccctcttgtggcctttttcctctctccaaggggtcaccccgcaccatgccgctccccctcatctatcttgccccctccccacaggcccatctgcgctgaactctcgccagttccgaagtcggcgagggagggggtttacttgcccgatcgttggtgggtttgagcttatagaggcagaggagtaagaacctgcgatattgaaagctacccacatggggcttccttgaaggaggacgtggaaggcagaaagtgacctgctctgagcggcgcatgtaaccgaggaccttaagctggaccacggggcttggacgattttttaaatcaggaaatcgacctcatcttcctcctcctcgtcctcttcccctgaacccccagtccgcatgcactcacactctttggccttttccctcagtcccgggctcctctttggtaaatagatttgtaggtgtctaagtcacgtcccaccctcactccttcccaggagaggagacagggctaggatcccacccgaccgcgggccataaacacttggctgcggcggccgccgcggggtttctaggagagctggctccgggagggaaatgtcctcgaggtagtggcggccgcggcccaccaccaactgctcgccac

SEQ ID NO: 36603 - DNA, 192 bp, Homo sapiens
  chr17:46802993-46803185
  hyper
cgtggagaatgcgccggcaggccccccacccccagcctaaggtgcaggaaggaccagcacgaacccgctggctttgctgcgcggccaggagatgagtcccaccgggcactgagcccaggtacaggacatcagagaatgaacacagaggcagaggccctcatgtccctctcagagtcccggctctgcaaagag

SEQ ID NO: 36604 - DNA, 30 bp, Homo sapiens
  chr17:46803786-46803816
  hyper
ctcaattcatgaaagcggtttctaaagtgc

SEQ ID NO: 36605 - DNA, 321 bp, Homo sapiens
  chr17:46804107-46804428
  hyper
ggacacccccactttcgctcctcccacccaggcaaggagatctcttaaggggtagcgctgttcttcaccttggcgagaaccttcttctctttgacccggcggttctgaaaccagatggtaatctggcgctccgagaggctggtggctgccgagatcttgcgcctcttgtccttggtgatgaacttgttagccgcatactcccgctccagctcccgcaactgccccttgctgtacggaatgcgtttcttgcggccgcgacgaaaggcgcaggcgtcaggagggtgctgcccgctggagtctgcgcggcgtgaaagggaggga

SEQ ID NO: 36606 - DNA, 352 bp, Homo sapiens
  chr17:46805572-46805924
  hyper
gcaaactcagtggggcggctggggtactcttccccggccgtgggagtctccgcggggtacgcggccagggtggctgcctgggcacagggtttcagcgagctccgggacactcggcaggagtagtacccgcctccaaagtaaccataaggcacgggagctggggacgtcccctggggcaccccagggcatgggtggcattgctttggcggctccgccgagcctggcagatccaagggggcatagttgacagcaggcatcagcgtaggcgccgctgggtggctggtcagaggggagtgggcgaccagattccgcccccctcccgctcccagcaagccttcgatatccttggctc

SEQ ID NO: 36607 - DNA, 107 bp, Homo sapiens
  chr17:46806788-46806895
  hyper
tggaatgagctgctccgggccccagggaggtgccctggacgccccttacccagggactcgctactgcccagaatgctctggaggccctgattcgggtgaggctgagg

SEQ ID NO: 36608 - DNA, 823 bp, Homo sapiens
  chr17:46810273-46811096
  hyper
cctgcacaacccaggcgtcctgatcttccagactgactgggctgagcctggccttcccctaaccccacagatgcctttgtgtcctgctgggagcctcctggcagaccctccgggagcccggagcctcccccagctttctttactgacccagccaaaagcgctgaaagcctcagcgtgctcctttacatacccgccagacacctccaggaaggtaaaggccaagttgaaagttaagagtctgtttacctccaggagcccattcagctcggccccacagacagcctgtgacctttacagcccggcctttgagcgcggccgccgcgcccccgggggttccggcaacggggacttggcacctcggtgtcagctcccgcccccacccaggctagggacccgccaacgaggggtgggggcgggaggcgcccacccgtcgcactagtgggcatttgctaaactacgttttatttttttgtaaagtgagcgcccgctgccttcgttctcccaactggagcaaactctgtggcggcgacgatggcggccgtcaggtcggtggtgatgaatagagaggatttctctgcagcgcgacgctcccctctcccgaaaggttggctccacggtcccgccggccgcgcaggtctggctgaactgcttggggtcgcccggctcctctcgattttatgaaaatggcctaattgaggtgtgctcttttctttccttcctcttttcatcttttccttccgtctgcattttctctcctctgtcttaggcttggtatcttcttttctttttatatttgtgtttttctcaccgcctttgcttcctt

SEQ ID NO: 36609 - DNA, 146 bp, Homo sapiens; identical to SEQ ID NO: 12785
  chr17:46811354-46811500
  hyper

SEQ ID NO: 36610 - DNA, 30 bp, Homo sapiens
  chr17:46812585-46812615
  hyper
tgtctagtgcaggcacggttattagtgctt

SEQ ID NO: 36611 - DNA, 71 bp, Homo sapiens
  chr17:46815930-46816001
  hyper
aggccaagctttggacgagggaaagcacagactgacgccgaccagcccatcctccccggccttgcactgcc

SEQ ID NO: 36612 - DNA, 454 bp, Homo sapiens
  chr17:46816270-46816724
  hyper
gggtcaggtctttaacggtccagccagcgcagcaagagagctggggagtcttcttgcagtcccttcctcctactcacgcaaagatctcctctatgctggtaggtgcacctgccctccaccgatcctcaccctgagcgcaggtcgtacctcaaggcgaaaacccgcttagtgcgttggcgggtggagagctgccgccttcttgatccgggactgagaagctgcactccctgacgccactgtggccagcacctcgggccgcgcagacccctacatctctaatcccatagccctccaggggtccttggggcagtccctttggaaagtcttcgaagtgcagggtactttaagtaccctgtagacgccttttatttaatccgcacaacaaaagaacggggcaggagtggggggaaattgttacttccgttttgtagataagagaactgagccgggacgg

SEQ ID NO: 36613 - DNA, 417 bp, Homo sapiens
  chr17:46824498-46824915
  hyper
gcctgttccccatcacgattgatcctccagggtcgccaaggctcctgctgactacaaaaacatccccaagattcccttcttgacccggttcaggcatatctctttatacttccatgtctccgtttctctatatttttactgtggaggactcagaagagagctgaggctattgtccggggaggaaaggaattcgggcaaatttgtgggtaggggcccagacccaagacccgtgtttctcctgcgtgggttggagtctgtctcaggtcgctccagggacatcaagagcccgcgccgccgagagcccgcgccgccgtccagcgggaagcagcggacccacaggggcctccagccgcctccccgctcccgccccgtgtttctcctgggcctccagctccgtggagagagctgagagttctc

SEQ ID NO: 36614 - DNA, 469 bp, Homo sapiens; identical to SEQ ID NO: 1307
  chr17:46824916-46825385
  hyper

SEQ ID NO: 36615 - DNA, 63 bp, Homo sapiens; identical to SEQ ID NO: 4456
  chr17:46826997-46827060
  hyper

SEQ ID NO: 36616 - DNA, 172 bp, Homo sapiens
  chr17:46827330-46827502
  hyper
tccttggaggacaggcggctgcttaggagtgggacagtaaggactaggctgggtctggagggctggcggggcaggagttgggggccaggtaggaaagccaggggtcgaagggatcgattctaggggccgcagaggctactctcgtgctctggagaagcaccgcatctttctc

SEQ ID NO: 36617 - DNA, 68 bp, Homo sapiens
  chr17:46827625-46827693
  hyper
cgccagcattttgccggggtttatgcctcaatcccgcattccagccacttccacgaattacttggaag

SEQ ID NO: 36618 - DNA, 157 bp, Homo sapiens; identical to SEQ ID NO: 4459
  chr17:46829979-46830136
  hyper

SEQ ID NO: 36619 - DNA, 64 bp, Homo sapiens
  chr17:46830189-46830253
  hyper
cggtagggatgcctgggagtctagggagtggcgggggtgtttcttggcccggcagggtggggtt

SEQ ID NO: 36620 - DNA, 40 bp, Homo sapiens
  chr17:46830483-46830523
  hyper
gggcggtcttccaagcgggcagccacgttgcctacttgag

SEQ ID NO: 36621 - DNA, 547 bp, Homo sapiens
  chr17:46831779-46832326
  hyper
taatgggaacagtgacggaatgaaagtgaccacgctggaacccgaagcgctgttcccctccgtggcttcacactgatctccacactagaattccgtgtctgcagttcaagttcaaactactgtggtcggggaagggctacagagatctcgcttggccgtggagtcaccggccccgtccagtcttgcttgggacacatactggtttacactctctcgggttcagtttcctcatctgtaaatggggctcgtatccccctcataaagtggtttgggggataataaagcttgtaaaagcgctttgccccagtgcttggcacataatacgcgctacgttaacaatgtcgcgtacacgcccgaaccggaggaaccccattccacgctccttctggaaccgaattcacctctgaggctttggggcttcagagccggagccgcttgggcaaaaccagcagaacagcgagagggaacgggctggtctagccctgccctgagcatttctactgagacccccggtcctgcttcttccagcctctgctggatttctctc

SEQ ID NO: 36622 - DNA, 304 bp, Homo sapiens
  chr17:46832489-46832793
  hyper
cgtcgacccggggtctttttccgccaaggagctcggggctcaagaactcgggactgggctgtgggcggggcatggttttcctctctgggcgtcctaatctccaatttcaggcaaattcgctaggaagaaccttcccgagcgcgccttctccaacaggacctccaagccagcctcacgcacgcaggcctggctctctcctgcagaatccccacctgccctataactacccacttcagatatgggggaatggaggagatattccaatcacgccatctacctacagtttccacggccccttctgttg

SEQ ID NO: 36623 - DNA, 61 bp, Homo sapiens
  chr17:46918852-46918913
  hyper
ttgtcagaaaattctcgtagcataggaagttgtgactgagatggctcgaagtgaaacagaa

SEQ ID NO: 36624 - DNA, 353 bp, Homo sapiens
  chr17:47072676-47073029
  hyper
acaaaaacaaaaatccgacaaacacgtggctgggtagaacaaaacgctcattggggagggtgggctctaaggtggtggaggatatagagaaaccgagttggaagccctcccccgcccctaagtcccagccccatttcttttcagcgcgccgggaaaacggggagggggacaaaggtgctgcgtgctgtctttcaactcccgactttttgaatggcatacaatcgtccggccgcagagcggtgagccaaagtcggagtcagctcagactctgcaaacgaaaaataataacaataaaaaaaattcaaggcattcatatcggtgtagtcaacacgtgttgcggagtcggcccgggc

SEQ ID NO: 36625 - DNA, 225 bp, Homo sapiens; identical to SEQ ID NO: 12797
  chr17:47073103-47073328
  hyper

SEQ ID NO: 36626 - DNA, 172 bp, Homo sapiens
  chr17:47073388-47073560
  hyper
cgaaacgcgcggcgagcagccccctcccccaccgcccagacggggtgcgaccgcccacgtgtcgccccttgcccagtcgggtccttccctcgggctccgggagccggaggatccggaatgagttggtcaaagccgagggaagggacccaggcggatccgcttccccctcccc

SEQ ID NO: 36627 - DNA, 456 bp, Homo sapiens
  chr17:47073953-47074409
  hyper
ttccttgtctcccaccgttcctgtctcctggagtcatctccggccagttccgcgtgttcccctcaggaccccgaaacgttatcatttaacagccggaccccgggtgcgaaccaccctttctcccgtggggatctcaaaacattatttcctgcggcttcctcgttctccactgggataccccgttcccagctttccagtcccgcgctcgcagggtcccccggtcctgcatccccggaggcgggggagtttcgtggggctggcgtggggaaggcggagaccccccccatttaaacatctagggaaaaggttcctttctttttaaatcaccagctcgtgcgaccctctcctgaagaccccagagtcttcggcttctctttgtctgtctcggccgtcccccgcctgtcagtcgctagcagttaaccggggaggggtgagcaaccccgccccccaaaacga

SEQ ID NO: 36628 - DNA, 685 bp, Homo sapiens
  chr17:47074731-47075416
  hyper
ttttttttttttttccgctccattttttttcaagtcgattttatttagaggcggcgccagggcggccgcggagaaacgtgacacaccagccctctcggaggggtttcggaccgaagggaagaagctgcgccgtgtcgtccgtctccctgcgcgccgcgggcacttctcctgggctctccccgaactctcccgcgacctctgcgcgccctcaggccgccttccccgccctgggctcgggacaacttctggggtggggtgcaaagaaagtttgcggctcctgccgccggcctctccgcctcttggcctaggaggctcgccgcccgcgcccgctcgttcggccttgcccgggaccgcgtcctgccccgagaccgccaccatgaacaagctttacatcggcaacctcaacgagagcgtgacccccgcggacttggagaaagtgtttgcggagcacaagatctcctacagcggccagttcttggtcaaatccggctacgccttcgtggactgcccggacgagcactgggcgatgaaggccatcgaaactttctccggtaagaacacagccacctcccggaaaagccacaacgagagccccgaacaacggagacccgcaccttccggttcctctcccgccaactcctctcttcccgggcctgcggggtttggcctccgtacccaccctcga

SEQ ID NO: 36629 - DNA, 101 bp, Homo sapiens
  chr17:47075634-47075735
  hyper
cagcccctccctatccgccggtggacgcccccccagctggaaaaccccggctcccgttcctcagtcttaggcctttccaggcgtggaaggggtacccggac

SEQ ID NO: 36630 - DNA, 254 bp, Homo sapiens
  chr17:47075879-47076133
  hyper
cggcgccgggtcgccatgctgcttcccgagacgccgaggctgggccgagaggcgcgcgcggtggcagtgagggaccctccccgccaggccccgctccgctcccccaggtccaccccttcccaaaccagccccgacaggtgaccgctccgtggcccaaagcccgtcttcctggccaacagagaaaaataaagtttcattctgcacactgcctcccgccccgcgccccactttctgaggaacggggagccctttct

SEQ ID NO: 36631 - DNA, 262 bp, Homo sapiens
  chr17:47081179-47081441
  hyper
gttgggtggatttcccgcttcccttttaaaggggagcggctggagtctcacagtgttacccacgggagaggggtcggagacgggtggtagactcagctcagggcaaggctatatttgcttttggagttgccggccttcccttcccctttcaaaaaagagagagagtagagagagagaaagtggcggcggcgctgcaggctcttcctggagcgctcgccccggcccggcggccctaaccttccccgcccgcccccgcgccagt

SEQ ID NO: 36632 - DNA, 442 bp, Homo sapiens
  chr17:47210040-47210482
  hyper
tgcacctgccctactcgccgagaatttgcccgggtcggtgccagggcggggcagtcggcggcctggctgctaggctccgtgacatccggcagtctgagggcggcgggattcgggatgacttcgggcgggtgagtgtccccggggcagagcagagcgagaggtgaaacttcgggagcagggagcgccgcgggtcctttctggcgtctgcagagcgggcaggtgctggggacgcagacgccggagccagggagcgggcggttggagtcttaagtccaaccggttccccgcataggtggctgcagaggcgaggtgacggcgcgtgcggaacgaactctgcacccccaggaatggggagcgctggcttttccgtgggaaaattccacgtggaagtggcctctcgcggccgggaatgtgtctcggggacgcccgagtgtgggaatcg

SEQ ID NO: 36633 - DNA, 36 bp, Homo sapiens
  chr17:47307637-47307673
  hyper
tggctttgtcagagtcggggacggagggatacccca

SEQ ID NO: 36634 - DNA, 142 bp, Homo sapiens
  chr17:47308577-47308719
  hyper
ggttactgaggattgcgggggttggcgggaggaatgactccctacccccacccccgcccgtaaagttggtggagcgggtggtgacagacagtttgccccttttgcagatggccctataaataaaaaacgcactttctcccct

SEQ ID NO: 36635 - DNA, 95 bp, Homo sapiens
  chr17:47547802-47547897
  hyper
tgggggaggggacgccgacacggagctgccatcggatgcgacggaccccaccgagcaccccagccacggagcggcttccgcgggcagcctggggc

SEQ ID NO: 36636 - DNA, 1560 bp, Homo sapiens
  chr17:47573694-47575254
  hyper
ggggagtgcccacttcgccggggcgaacccgctcccggggttcccccacggccggcgggctcctccgacgcgcgtgttctcacggcttgaagcagcgcagcggatcgcgagggacggagcgggtgtgcccctacccgggctggcggtggctacgtctcggggtgcagagcgccggggcgcactaggcggggacccttcctggccgcgcgcagctctggctacgcaggcgggaggcggcaggcagggggcgctgcggggcgaggcaagtgcagtccgccgctgcctgcctgcgagtctggggctgcgcgccgctccccacctagctgcgcgacccgagcgccgcgcccaccgcgctccgtgggctcccgcgcctcgaagggtcgggatccggtctgagcctctcctggctctcggtgcaagccgctgggcacctaacgagacgggggcgcccggacgcctcggattctgtagcgcggtatcccgggccaccgactcggcaaaggtcggcgggtcctccgggtggtccgacgagattgtcagatgtggcctgctttatggccatgaaccgaatgccctggaaggtctggcaacggaggaggcgtcttcactctccccgccagcatctttcatcagagcactgcgccccaaattccggctttacagatacggagactgaggctctgagagtttaaacgacttggccaagatctcacagcaagttgggccagagtcgtggctagactccccgacctgattcccagctcggtactcccccaccttttcagggggcagccgctgtcccagctcggggtcacggctgcgtttcccagcagggcggggggggttgacactgtccccagagtccgtcggcggtagagcctgcgggtgaggtgggcagagattctgtccgggtgcgggccccagcccgaaagctcagccccagttccctggagctgtcaggacctgtggctgcgtccggggatttgggagcgaccgcgggcacgtctgctgactaacgccgctggttagagacgctgctcagacgcgggtgggcgagcgtagaccaggagagcggggaggagggaccggatcccagaggggcaacgacttgggctccgggtctgggcaagagcgagggtccccgcgcgaagacccaaggaaggaggggagctgggcgtggaggacctgggcgcttgggaaggtgtaccccgacaggaacctgccgtctgcagcccctgcggctcccgcctccgcctcggcgcgcggctgctcggtctgggatggctgtgcgcggtccgagtttcttcctgggccgcggtgagagagagagggctgaaaccagagcgcgtcccggcgggtcggctggcgggccgcgccggtaatggaggcactttgtcattcagacgtctgtaaccagagccgccgggctggctaatgcgcctaatagggatggaacgagggcagcaaatgggcgtgcgtgagcggccgggctgagctgggtggatggtggatggggaggcagctccgcgggggacgggcccctaccgcactgttccagcc

SEQ ID NO: 36637 - DNA, 295 bp, Homo sapiens
  chr17:47928151-47928446
  hyper
ccctgacacacagcacgcgctcagttaaccctaacttaattgttgtgatgatgaggaggatgatgattttattccttcgaaggagcgctggtctcctggccccctctcagtctcccgacctcgccagcgccagagccatcctgcatggtcccgacctcgtcagcgccagagccgtcctgcatgaggcaggatgtggtgggcgcacagcagggacgaggcggggggcacggggcagaaaggagagggcgacgggaagaaggcagagaaaacccaaaaggtccggaaggctgggagg

SEQ ID NO: 36638 - DNA, 103 bp, Homo sapiens
  chr17:47967958-47968061
  hyper
ctccgggcccgacgccggcccagcccagcagtgccgggcgccgggcccaagccgaccccctgttttggctctgccgcctgatttctaccgcaggcagatatct

SEQ ID NO: 36639 - DNA, 589 bp, Homo sapiens; identical to SEQ ID NO: 4464
  chr17:47987525-47988114
  hyper

SEQ ID NO: 36640 - DNA, 85 bp, Homo sapiens
  chr17:48040403-48040488
  hyper
atgcaccaccccctccgtaaaccgctgagagtgggtccacgaccctcctctcggccaaccactcccgccccgcccccatagctga

SEQ ID NO: 36641 - DNA, 625 bp, Homo sapiens
  chr17:48041152-48041777
  hyper
gtgtgtctgtgtgtgcgcgcgcgcgctctgtgttgtattgtgtgcgctagtgcacgcattgtcttcgatgttgccgctagaggaaccttccaactcccactactcccacctccggctttcaccctgcacccggcgatgaagacgtcggcgaaacgcctactttccatgcctaggtctgggaaggtctgaagatcccggcggagctgccttcgttcggggccgggcaaattcgttgcagccgggttggcctcagggcctctcgccggctcgctatgtttccccggggcgccctggcaggccagccggcggtctgtcagtccagctcctggtgcgggcgcctcgttttggtccaccgggtccggggctgggacaccgagggaaaacttcagagctccgggccaccgagcctggaagttacgcgtcccccagcccacgcgtccccaatcccggggtatttcctgctccctcatccagcgaagttcagcgtcgcgtgtctccccagcggcgcagcctgcctccaagacaccctcaaaaccgcctcattttttgttaaccgttttctctctctctctctctctgtctctctctctcttcctccgtccccccaccccgtgtcccaagaatt

SEQ ID NO: 36642 - DNA, 102 bp, Homo sapiens; identical to SEQ ID NO: 12812
  chr17:48042039-48042141
  hyper

SEQ ID NO: 36643 - DNA, 239 bp, Homo sapiens; identical to SEQ ID NO: 1311
  chr17:48042409-48042648
  hyper

SEQ ID NO: 36644 - DNA, 206 bp, Homo sapiens; identical to SEQ ID NO: 1312
  chr17:48042750-48042956
  hyper

SEQ ID NO: 36645 - DNA, 1762 bp, Homo sapiens
  chr17:48048808-48050570
  hyper
agccgtagggagcagcgggcctggagggaggccttggggctccatgatcgcgacccgggcagatctcgtaacttgctggaactggggtagggaaaggcagctgtccgggaaggaacttggagggggtctgctgggagagttggggcgcggagggctatgcgaattcagcaaccgggtcggcctcagagactctgcgtccccgctcgaattgcgcagtccacgcagccagagaggcgcgggtgggctctgggctgccagcccagagctgccagcagtggggtcgaggcaggggaggcaggacaggcgcgggcgggagcggaaacccaacggtttttctgggaattggttgaggcagggtcgaggagggaggatctcagaagcccgcagcgcccgaggccacgggtgagggatgcgggggaggtgacggcagctggtgaccgcggctggccgagggcgggtacactgacgtgtggagggtgagcccgactaggggaagaaggtggggggacgcgggcggacagaagccgctctctctcggctcaggtcggctggacagacccgcagggaatgcggcgaacgctgccctaagcgcccgggcattgcggctgctccatccgccctactcctcccattgcctgggacctctgcagcgtccccgtagagccgcgcaggttagggtggctggcttggaagaacagaaacccctcggcccaaccctcccctgtccctcagcattctagggctgggctgtcccgcggccgagattcctggagagctaggcgggccagagctgaccagatcccccgcggcggcaccgcagcgcgatccaggagtggccccgccgggctacgctgcgcgctcttggaacccgggtcaccttccctgccgccggaaccgctctgtgcgcgctgcccaacgaaggaaggggctgccccacgcagacccggcttctgggggtccctggaaacccaggcggccacggtgtggcgggggagacatggtcacttttcctgcagggtgcgcctgagcagaggggcagcccgttacagtaggcgaggccagggcaaacccggggtcactatcagcgctgcgagactggtattcaaggtcctctcagccgggcctctcacccaccccgctggccgcagccggaggctgccacgcggacaccgtctcaagcctctgagcattgctctgagcctctgcctgcaatgtccttcctctgtcatctctaggcctcggctcagccctggacctagcctttctgccccgccctaccccaagctggcgccaccgcccgtggctgaactccgacctcccaccgcaggcgccgcggtaccctggctgtggccctcggcgctttcttcctagggtcacaggacccatacgagtgggagctccctgggagcagaactgcgtcttgtatcacctggcgcggtgaacgtgggggttgaaacgctccacgcggaaggtagagggcaggggccaagggggcgatcctggtggctgcgctttttgctatttgctgccgacggcatgcagacgagatgcaaataagcttatgaaactgtccgtcctaccccctcgctccctcctcgccccctacaccgtgttgtgctgcccaccagactcggagaagccgcggctgtccccggaaccctccgagcggcgccctcaggcccccgccaaaaagctccgcaagccgaggaccatctactccagcctgcagctgcagcacctaaaccagcgtttccagcacacg

SEQ ID NO: 36646 - DNA, 222 bp, Homo sapiens; identical to SEQ ID NO: 12817
  chr17:48070683-48070905
  hyper

SEQ ID NO: 36647 - DNA, 72 bp, Homo sapiens
  chr17:48071121-48071193
  hyper
agagccagaactggccgcggcccacaacgcggcgctcccagctccgcgcccggccgccgcagcactgtcccc

SEQ ID NO: 36648 - DNA, 122 bp, Homo sapiens
  chr17:48071583-48071705
  hyper
ctttcccgcaacttccgtgggtccttctcattgccccctcacgactcctagtctccccatcccttatccaaaggagggcccctagagtttccagcccctgccgcctacccccaagccctctg

SEQ ID NO: 36649 - DNA, 53 bp, Homo sapiens; identical to SEQ ID NO: 4468
  chr17:48071806-48071859
  hyper

SEQ ID NO: 36650 - DNA, 70 bp, Homo sapiens
  chr17:48585866-48585936
  hyper
aggaggtttccaagccgtctccgcccaagttgatcggtggatgcgcgcccccgcgcggggcaccggttgc

SEQ ID NO: 36651 - DNA, 75 bp, Homo sapiens
  chr17:48619216-48619291
  hyper
cgtcccccaccaacccgttcggcgcgggcgagccgggcaggccgacgctaaaccagatgcgcaccggctcgccgg

SEQ ID NO: 36652 - DNA, 390 bp, Homo sapiens
  chr17:48619346-48619736
  hyper
cgcctctctgcccctcccgctcagcagcgtgccagctggcttgaccctccccgcctcggttagcgtcttcccgcaggccggagccttcgcaccgcagccgctgctgcccacgccgagctcagccgggccgcggcccccgcccccgcagaccggcaccaaccccttcctctgagccccgccccgtcccataccggcctgcgcctgcgccggacgctccgcggccccgcctccggacccggggctgggcggggcgccggtgctagtggaacgccgagccagtggcggctggtatcccgcggcggctctggaagctggacgcggaccacggcccgggagctagaaactgaacgcccgcataataaagactggaaccctcgttctcagctctca

SEQ ID NO: 36653 - DNA, 812 bp, Homo sapiens
  chr17:48636435-48637247
  hyper
atcccctccccccatcggccggggcgggaactgagacgaccccaaccctctgcggtggcgggaggtgcgcgggggctgcgtgggtggtgcagccttaggagagtgaacaacgcccaggggtgatggcctcagcaaagtgaggggtggtgatggaggtcatccgacccatcccgccgcctctccgcagtggcgcaagcgccccaaaatctccggagagggaactgactgacccactaggttccgccgtgtctacctctcgcagatgttggggaagtgcttcccggcgtctaatcctcgctgttcccccctccaccggcgcccagcacacccgcggcgctccgctcccgggtacccacagctttctggagtggcgccggcggcaggagagagctagagccgactgagccccagaactcggggaggtaggcggggcaagggccggggtctgcgcgtgcgtgtgcacgcgtggaaagcacaaacccacgagggcccgctgccggtagggttaaggtgagtgagtgaaggcggcagacccgcgaagttccagttccgcggacactctttccctaagccacatagggacttaagagaaactgaggcacgaagttggggggtggcggtggtggggactttgaaggtcgagtcgataaagcccagctctgtgcttccgccccctcccacacactcgagacccccacaggttccttcttaggggtcctcgctctgctccgcagcccctcctggggatccgggctctgcggtccagcgcgacctgcctggggccacgtgttcaagcacgaagcccctgcgtg

SEQ ID NO: 36654 - DNA, 54 bp, Homo sapiens
  chr17:48637706-48637760
  hyper
gatgcctggggcctgcggccctacgccaggaccccgcgccgaatactctgattc

SEQ ID NO: 36655 - DNA, 30 bp, Homo sapiens
  chr17:48712444-48712474
  hyper
acggagcccctgagacggcctgggcgcccg

SEQ ID NO: 36656 - DNA, 611 bp, Homo sapiens
  chr17:50235868-50236479
  hyper
ctctcagccgggttccggcagtgcgtccagggcgccgaggggaagggctgggccccggggactggggcgcggtgggggcacacagactctccaggtcgcgcgcgcccttcctgctcctctgctattttcctgaactccccagaacccccagttgcctggcttccatcgcccgcaactagcgccgctgtcgagattttccgcaatacaactgcaggggtcgttatttcctcgcctacggatccctacgcttcccaactcagagaggaggaggacaggtgggggcgggagggggaggaggagaaggaggcttggccaggtgagcgtcctcgccgccgccgggcgtcccagcgtcagctccgcagcccggcacccgggggcggaggcaggaggcccgggcggggaggtgaggctgagcgcggccatgaggaggaggaggaggaggctgggtgtcacagcttcaggccaccttggccgccgcctcggccccagtccctggcagccgcctccgcactccgccccgccctggctgcctctgttaccctccaggattttcgagtttctcttcttaaaaagaacttcgtgctgcgggttcggcgcgggagacccaggca

SEQ ID NO: 36657 - DNA, 60 bp, Homo sapiens
  chr17:50236690-50236750
  hyper
ctgcctccctcctcccgaaaagggggaacaccgcctttccaagtccgggtgccagcagcg

SEQ ID NO: 36658 - DNA, 30 bp, Homo sapiens
  chr17:50237251-50237281
  hyper
tgcagtggtggtttgcgaaagctcaaacct

SEQ ID NO: 36659 - DNA, 255 bp, Homo sapiens
  chr17:53341227-53341482
  hyper
cgtcccactgaaaaacggttttctttcatttgtgcccattcgttcttgcagccccttccccagatcgaagactagggtcttagtaaggagaggtaaggagggaggggaagaacctgcctggccccccgcggagctctgcagggggcgtcgcggctgcacgccagcgcccgcaccaccccaggcgggaagggagttatcacacagggggtcgcacgcagatctcggggaccgtgggtgccacgaggtcaaactggc

SEQ ID NO: 36660 - DNA, 87 bp, Homo sapiens
  chr17:53342183-53342270
  hyper
gtgctgcaaggtccccgaaaatcggcgcgagcggcgacgctaaacacgcggcggcggggcgagcgggccaggcgggcggtgccgcgc

SEQ ID NO: 36661 - DNA, 201 bp, Homo sapiens
  chr17:53342828-53343029
  hyper
aatttgagtgcatcgcgatggagaaaatgtcccgaccgctccccctgaatcccacctttatcccgcctccctacggcgtgctcaggtccctgctggagaacccgctgaagctcccccttcaccacgaagacggtgagcgctgccgcggccccgctccgggaagggacgacgctccgggggtccccctccgcggccgggcac

SEQ ID NO: 36662 - DNA, 617 bp, Homo sapiens
  chr17:53343030-53343647
  hyper
cccgctggagcatcccccaaccccgctcccgccctgtcccgcggcgccccggccccgcgctgatgaaattgaggagctcacccagcacccttcctccccttcctcctcctccatgaaaggggagggacccctcctgagctacatttaaaagagcttcgggcacccggcctccctgggtcccgctcctgcggcgcgggtgggaggtgtaacttgacaggtcaggatcgttccctagaacgaggcacacccgcacgcagagcgagcccgcctgcggagggcagagcctcccgggctggggaggagaaaccctggggcctggttctgtgcggggcagggggcgggggtcggcttgagggagggggtttcactgcgtagcctgggttttggggttgtgttacagcttctgttactggttagtatttggaactcacgaggtgtgagagaagactcgttttcttctggtgaagggtagctgagaaagcggggtgggggctggggccggtggggggagtggtctctcggcgggaagccgtgcacgcctccagcgttgacactttcccggtgcactttttctggtgggaggggagagcggagcaggctcacgtgtaaccgcgcag

SEQ ID NO: 36663 - DNA, 357 bp, Homo sapiens
  chr17:53922649-53923006
  hyper
gtctttcaagataaacggaacgtccctaataattaatgttttggttatgtgcccacttgagaagagataccacttcagcctcttccgtctccgtggtgcagccaggccctagcgtctctccatccccgttccccgcgggctcccaggacggcgtccgcgggcctcagcgactctgcggagggtttccgcgggatgctcaagggggcagtgtggtcctgccgaagagggccgcctcgcctcgaggaacgccttggccattttcacaggaaaatgtttaccctggaaattaaattatatttgggattttgggtttcccctcccccaccccgccgtgggaggtttcggaaagttactgtg

SEQ ID NO: 36664 - DNA, 30 bp, Homo sapiens
  chr17:54671575-54671605
  hyper
gccagaggcatggagcgctgccccagccta

SEQ ID NO: 36665 - DNA, 343 bp, Homo sapiens
  chr17:54671992-54672335
  hyper
ctaagcaagaagctgcggaggaagttacagatgtggctgtggtcgcagacattctgccccgtgctgtacgcgtggaacgacctgggcagccgcttttggccgcgctacgtgaaggtgggcagctgcttcagtaagcgctcgtgctccgtgcccgagggcatggtgtgcaagccgtccaagtccgtgcacctcacggtgctgcggtggcgctgtcagcggcgcgggggccagcgctgcggctggattcccatccagtaccccatcatttccgagtgcaagtgctcgtgctagaactcgggggccccctgcccgcacccggacacttgatcgatccccaccgacg

SEQ ID NO: 36666 - DNA, 155 bp, Homo sapiens
  chr17:54673918-54674073
  hyper
ccaactccttgggaccgacgcctgactctcgcatgcgtccctccgcctcagtccccagtggcgcccgtcctcacagctccacgtgggccagcctcctgacactgctcagcgctctctttatttatcttggactccaaagtcgctctcctttgctc

SEQ ID NO: 36667 - DNA, 399 bp, Homo sapiens
  chr17:54674738-54675137
  hyper
aaactttctgtgccccgggccaatatttttttagacagagtttcacttgcgaggggcggaggtggtggggagtggggaagaggaggggtcttatgcgaggggggcgaaagcaagaattttcatgcctggtaaacacgcgaattatgcgaagagagttattcccagctgggcgggcagccaaaactcggagagcgcgccgaggccagcgcccccacccccacgttggcaatgtcattggattacaatgcgaggtcttcccctccgcgacgccccctcctccctccgcgggcccgcccgcccgcgcccctcctccccacccctgcccacttggaaaacccgcccgcagccggcgagcttctcggctttcagagcaggagccggtgtgagctgggaggacgc

SEQ ID NO: 36668 - DNA, 171 bp, Homo sapiens
  chr17:54675138-54675309
  hyper
ggttgcagacgtgaccggcgacagacagaccaccggatgcacagaaccagagagcaggcccgaagccgctgcggccgcgggagaggacccagcgggacccaggcagtcccagaagctaacgaaggaagtgctggtcctggaacattgtgcctaatgcgcagctggttacct

SEQ ID NO: 36669 - DNA, 37 bp, Homo sapiens
  chr17:54755949-54755986
  hyper
taaccccccaggaagcgctccacgtgctgctggtgcg

SEQ ID NO: 36670 - DNA, 33 bp, Homo sapiens
  chr17:54756362-54756395
  hyper
cgctcaccccgtttacgacggagccctttgttt

SEQ ID NO: 36671 - DNA, 569 bp, Homo sapiens
  chr17:56234271-56234840
  hyper
tttagaaagttatctcgccctccctcctcccccacaaaaaaagtttgagtcgccgctgcgggttgctagcggagtcgcgcgtcgggagctacgtagggcagggaaggcatggcttctgttttcgtccaatgagaaggggccagcggtggcggtcgggccaggtccggggcctggggacgccgaggcggccgcggaggagcgccgcgtcaaggtctccagcctgccctacagtgtggatgcgctcgtgtcggacaagaagccgcccaaggaggcatccccagtgccggccaaaagcgcctcttccggggccaccctgcggctactgctgctgccggggcacggcgctcgggaagcgcacagccccgggccgctgatcaagcccttcgagaccgcctcggtcaagtgggaaaactccctaagacggagcggcgtggatgcaggaaccctgctgataattcgccgccgccaagacacgtgagccctaccacctgcaccctgagaaaacacaagaccaatccgaagccgcgcacagcctttaccacgtcccagctcctcgctctggagggcaa

SEQ ID NO: 36672 - DNA, 141 bp, Homo sapiens
  chr17:56326821-56326962
  hyper
gcgtcccctccgcctcgagcagaggctccttcccccatggggtcctgggctttggagccccggagccggcctgccgaagctcagcgaggatcgtgctggtttcaggaggaagcctgcgctgggcgccgccaacagggctct

SEQ ID NO: 36673 - DNA, 53 bp, Homo sapiens
  chr17:56327222-56327275
  hyper
cccggagcccggccacgtggcggtcacgttctggccgccgcaggccagatacc

SEQ ID NO: 36674 - DNA, 611 bp, Homo sapiens
  chr17:56832946-56833557
  hyper
ttcagagttggagagcgggcgagtggagtgtcctttagactccgcggactcgacgggagggaccctgcaatgcttaattagaaccggttgccatggcgacagtctctaggcagcgtgggctgagctctccgtaggaataaagggtgggccgccgctggaccctgcgcgcgcccgccaccaactttccctccagatccgagaggggcggcgcgctccgcccccgggccgcgcacgtcggtgctcggcggcgcgcacgcctgcgggagccctctccaggcaacctagtgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagctattcctgggcgagtttcgcggaccgtgcggcggcggcgagccggagccggaacccgaacccgaacccgaacccgaacccgagtccgagcccgagcccgaacctgaactggtagaagctgaggcggccgaggcttcggtagaggaacccg

SEQ ID NO: 36675 - DNA, 76 bp, Homo sapiens
  chr17:56833915-56833991
  hyper
tctgctcctctcccccgcacccgcgcctgccgccgctgaaagcgcccccgctgctcggacccgggcggtcggctga

SEQ ID NO: 36676 - DNA, 65 bp, Homo sapiens
  chr17:56834247-56834312
  hyper
cagtctgtcttttcccgggctgagtgccttgttgtttggcggcagagacgcgactcctttctaga

SEQ ID NO: 36677 - DNA, 718 bp, Homo sapiens
  chr17:58212587-58213305
  hyper
tctctaagcacagggcggtggcgaaagggaagggctgcagggtggagtccggcaccaagacctcccggcccggcttctagcagcacacggacgcttgagatgatttcttctgaaaacgggcagtggttgaaaaccactgcttcaaaacacagactggaggagtggtaaatactaacgaggagttttagcaatggactctgttaacagagtctggtcgcctgagaagggcctcggaggactggccaggttggagaacgatttcaactgcgtactggacgacacacagaagactgcggggagccttagcccctacccggcctgcagtgctctctggggcacacggcagccccacgacgcctttgggtttcttcgagcgctactcgcacgcaccagcgcccacacagctgcaacgccaaacgcccgccagcaccttagggccgcgggagtcccttccccaggcccgccccacacgccggccttttctgccgcttcccaagccggagccaatcagcgctcagcagcgaccggcagggacgaccaatcgacttatcctgcgttgtgctaaagacctagaaatcgagcgtggtacattcgatcgacggaacgtctgggccctagtgctaagttgggtgactgttcggtggttgtctcggggggttgcaggaagatcctgtttccttggcgtagaaggagaggttgaccccgaagagttaagatt

SEQ ID NO: 36678 - DNA, 272 bp, Homo sapiens
  chr17:58216565-58216837
  hyper
cgaggactagcagcagatctggtgtgcagaaccctggattcgagtcccggcttcagagaccctcggctgtgtgacgtggaggcgtcggccgccctctgagagccttcgtggatgacagctgatgcttgggcctaccttcctcggctgctgagaggctcagaagggaccgcgtgtaaaacgccttggaatcttaaatctacttaattccatttacctgcttcccagaaacggtccatggcttccgtcccggtcatagcgctgcgcagcgggac

SEQ ID NO: 36679 - DNA, 434 bp, Homo sapiens
  chr17:58216865-58217299
  hyper
cgtccgcgctccattgcccctccaggtgccgttattttgccttttaacctggggcgggaggttttagacgaggctgcaagtctgggccagcggggacctgagggtcccttgcaaccagcacccgcgacggtgtctacactggaattccaaggaaaagagggctccaggggcgcgaccaaggtttggtcttctgctgagcgctgctggatgaatcgccagccttcgcccgcggccccctcctcctcatccctgaccccaactcgacaagatcccccgagcgcaggcccaaactccgcacagcttgtgggccgtgaggtccgggtctcgaagctcggtcccgctggggctgtccctccgcctctacttccagggtaaagaccgcggaaccaggcgggggtctggggagcctggctgcgacctcggctgcaggcttc

SEQ ID NO: 36680 - DNA, 268 bp, Homo sapiens
  chr17:58217356-58217624
  hyper
cgccacctaccggaagccgcgtccgcgctacagcctccactcaggattcgacccgaactccaagacgcgtccgcactggtccaacaaccctcatggatcgtcgcctgcctcaactgtttagaccaccgcgggtttcacccggaagcaccggggaggtcggagcttgcctgagaggctcagcgaaggtccatgccttgttcagtcccaggcagtgcgggacaggtgggcgaagctcgaaccccatgctctgtcccggcactggcaggaa

SEQ ID NO: 36681 - DNA, 409 bp, Homo sapiens
  chr17:58218648-58219057
  hyper
aggccaaggctggcccgcttagggaccgcgctcgggctggacgtcgcgctcagcgcgcagggcccccatggacgtcgcgccgctgacctagctgtcagacatcgccacgaggagttggcaggctcgggaggccgaaacgctgtgctcacctcgagcactgccaggctgctggagaggctttccggggcacagaagctgcagcggcgcggggcggtgggctgtgagcgagcatatgtaggggagcgtttcccgcgagaaagcagaacctgcgccagccgagggccctagggctgctggtaggaggactgttctctatcgtccagctgctcccgacctcttctctgaactggccctgctctggggaacagcgccctgcttctttgtgcgacgatcacgcttgactcattgg

SEQ ID NO: 36682 - DNA, 294 bp, Homo sapiens; identical to SEQ ID NO: 12837
  chr17:58227104-58227398
  hyper

SEQ ID NO: 36683 - DNA, 210 bp, Homo sapiens
  chr17:58228164-58228374
  hyper
cggccagagcaagggcggtctggcagggtcctggaagccgcgcttcccacacgggttccttgcccctgagggtcgcaagctcccctggcctccctaacctccagcgctgaattgggagcctggcgggggcggggggtgggggacccggagccccaaggcctctgcggagccggtctttccggacagggtgattttcgtttaaagattaat

SEQ ID NO: 36684 - DNA, 221 bp, Homo sapiens
  chr17:58498756-58498977
  hyper
tgtgcccgaggtggccgctgggtggcaggggaggcccgggccgacggcggtcccaccgcactgtcgcgaaggcaggcgaagaacagggccacactgagtggggacaactgggcccgggcccagaggacacgaaggaaggtccgggagaaggaattcctagtttcagggaagaaaaggtggctcgagtgaggaaactgcgggggcaacggtctctcgtcgcc

SEQ ID NO: 36685 - DNA, 367 bp, Homo sapiens
  chr17:58498978-58499345
  hyper
ggaccccgccgtgtgccgcccagggacgcgagggggcgctgctgccgcgccaggggcgagggtcccggggcctcctgagcacctcccggccctgcccggccaactcagactacacccggactctgcccaccgcgtttccgccctcggcctcgggtccctggagggctcgcgggtaggaagagtcggggtggcgggactttcgccgacacccggctccccgcctggtggctgcgcacacgaggccggcgacgggacttgcccgcgtctcagcgcctcctgtgtgaagcgggaccgctgcggtacctgccccagggaaggccgcggggagggttacagagcccgtaggcactggcggggatctttatac

SEQ ID NO: 36686 - DNA, 91 bp, Homo sapiens
  chr17:59467463-59467554
  hyper
tggccctgctgtcagcgccccctagtgccgggccggccgcgcatgagggcggtgggacagatcgcccacaactcctcggcttgcttttggg

SEQ ID NO: 36687 - DNA, 90 bp, Homo sapiens
  chr17:59474157-59474247
  hyper
ctgcagcccgcgccccgtcactcggacgcaagtccgtcgtccgctctgccacgcggccgcacagcccgagcttcctgctgcccactgccc

SEQ ID NO: 36688 - DNA, 403 bp, Homo sapiens; identical to SEQ ID NO: 4476
  chr17:59474741-59475144
  hyper

SEQ ID NO: 36689 - DNA, 53 bp, Homo sapiens
  chr17:59475357-59475410
  hyper
atctggtcacctcaccggctgcgcaaacgtgtccacaacgggtccctccccga

SEQ ID NO: 36690 - DNA, 330 bp, Homo sapiens
  chr17:59475678-59476008
  hyper
tgcttccgccggtcccgaatccgcactgccaggagagatccggccttcaaacgctgctcccaacgttcaacaacgaagtgccctgcgaccggtgtgcgcagtgggcgggcgcctgcatgggtcaatgttggatgtacgcgcccaccacgcggttgtacgggtgggaatgtcacccgtggctagtgcatgctctgtcttttccttcagaaaacgaccttcaggaatcagcctgagtgttcgcgcccgagcccgattggaagcaggtgcgtggtcgcttcactctccccgtgcacaccttgagttatagctctcgctgcgcacagagggcac

SEQ ID NO: 36691 - DNA, 2610 bp, Homo sapiens
  chr17:59476068-59478678
  hyper
atcacttcatgggggggaaactgaggctgccggaagacagaaaacgaagactgatcacagaagagggggcttcaatcacaggtgctcgcagacaccccaactccctcacgcgttactcagcactccttaacttaggagacgtgcgcttccgagagatgagaagaaactaaaaaagtggttggcagggcgaagagaggaagccggtatttcggaagaaggagactttcgtctccggtaccggatagggcgaaaattcgttgggtcgcgggtggagaatccggggtccgcccgcgcggtgccgccctgtgctcagcgaaaggtgcgctcaccttcctggccccgaggatccgctcctcccggccgctggaaagctcagggcggggcccgggcctgcggagaactccaggttccttccgagtcttccggtgaaggcgggcgcgggtagggggtccccgcgtttccccagcgcaaggccgcgtcccgctcccgcccgcgccggccccagcagggctcggccatggctccactcaccagctcccgccacctgggatccgctcccggacctcggccgcccgagcctcccgactcgcccgcccaccggcctcgctttccagtgcctgctgtctctttccggggcgcagggacccccaggcggcgccacgacccggagctgggtcggaggccaggctggggctcgggccagagcggccgggcctctgggcgcgggagaaggagggcgccccctctccgctcggggtcgtgtcaatgctttgcacttggggccggcgtgcggctgcgggtccttccccaaggccccgggacccgggctcccctcgcctcaggccctttcggcgggtcaggtcggccctccgcgctctccagtccggcgcaggcagccgcaggcgcgggcgggcggtgggggccggggcaggaggaggggtctcggggcccggcggcccgtcattggttaatattttattctgttgacatgttttcttactgctgaggcttccgacaccttctcccaggccccccctcccggccggagcttggcctgagctgtcaaaaccccgcccccggagacccacaattggtccaaaaagcgtaaaatcagcaatcaaggggggcctggctcgttagcgcaggggatccgagctgggcaggacatgtgagatagtcacagttttccagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggtagggctgccggccggctggaaggcgcgcgggcgggcgggcgggctggggcacgggactgcacggatcagagcagagctggggactcccggctcccggctcccggctccaggttctggccctgacgccacgcttcgctcccacggacaaccaagttgacttttctcgtttggcaccggagcgatttttttttaaaacaaaaacgctaaaatcctccgaatgaaataaaacgaaaacatactgctaaagaatagccccaaccgttctgagtcccagcgcagaggaggccccgcggcttggccctggcggtctcctccgccccgcgctctcgctcttctgcgtccgggtccgtctccgagctcgggggaaattcagcctctctcagactctgctccgaccccgaagcccctagtgggacctgggcccagctaaccccacgctggttgctcggttcctggcagcgagccccgggtcagccgagccctccgcctcaccgggctgggagccctttctccaccgcgggcatccgagccctggacgcatccgccgccccaggccttaaagcctgaagaaagccacagccccggcccctccacccttcgactcagccaccgagaatccaggcctcgggttcaccctcttcccccgaactgcacggccaggatgtcttatcaggctctgtagcccagttcccaatacaaacaccctccagatttatttctgggagcttccgtcccaagtgggta

SEQ ID NO: 36692 - DNA, 200 bp, Homo sapiens
  chr17:59488224-59488424
  hyper
atactcctagaggagcggcgcgtttgcgtcccgcggcttctcactttcagcaggacattaggagggagacgagagtcggctgcgcgcccgcggcggcctacgtacagggctgcggacaccagggggcagcaccgacttagggtcgcgggaggggtgcgggtgcgggcatgggcgcgggggaggcgggtgcctgcgaaggc

SEQ ID NO: 36693 - DNA, 368 bp, Homo sapiens
  chr17:59488634-59489002
  hyper
cggctgggccttgtcccagacaaaggctaggccactcccatgtccaattaagccaccctcctccccggcctcccagccctcattgtccccggggtcgccaattagcctaggcgcccggcgtacccgccgctccggtgccgcaaggcctccttaacccttcagggcctggcccggggtccttggacggcagagccgccggcacacgcgtggcaggagggccagtgctgggacgatggcgatacctgctggcggcctagcctgtcgcctcgggctctcgcgtgtggggcgtgtgaggtctaagagggaattgtgcgtgtcggtgtggggtggcgcgtgcgattcccggaggaactcggagatggagggtg

SEQ ID NO: 36694 - DNA, 72 bp, Homo sapiens
  chr17:59490147-59490219
  hyper
gcagcgccagctcggcgaccttccaggctgctgcagaccccagcttgtcctcttctgcgcgcccgcggggct

SEQ ID NO: 36695 - DNA, 275 bp, Homo sapiens; identical to SEQ ID NO: 1315
  chr17:59528876-59529151
  hyper

SEQ ID NO: 36696 - DNA, 12 bp, Homo sapiens
  chr17:59529253-59529265
  hyper
cgacctcgggac

SEQ ID NO: 36697 - DNA, 509 bp, Homo sapiens
  chr17:59529843-59530352
  hyper
cggagtcggagccccggccgtcccgcgctcctcggacccgaacctgcaggggacctcgggccgctggcgcctccgcatgcggcaccgcaattagggtgagtgtgggttccagccgagtggggacgagctgggcgtgcggggctggggccacaggggctcagggttaggctgcggggacggacaggaggatgagctggaaaggggtgagtcacgcgacccggggaagaacttcaggggcggtcaaagttgcaggaaggcggcgcgaagtgccttgggtcgggccgccgcctcggcccgacacccagtagttggggcacgagccctcctctctgagtaacgcgatgaattgggtctagagatccaagagcatagaaatatcgacagcgccagcaccctaagaacaaggccgtgacaggcggagcggtggcctggaaattggtgtttgcagaatatgcaaggccaaggaagagggccccggtactggagcgaaaatccgtgtagatatgtga

SEQ ID NO: 36698 - DNA, 351 bp, Homo sapiens
  chr17:59531667-59532018
  hyper
aaagagaaatgctgtcgtctttggaaaacgaggcagctgaaagcaacagaccccatcgcaaaggcagcggaggttgcgggccgcacccgcggaggagtggatgtgaaggacgagagcggaccgctatgcggtgctgagtgcgggaccccgcggtgctggcggcggccgagcgcgcccaagctcgaggtccgagaggaccgcgaggacggccgccccgggccagccgggcgtggaaaaaaggaaattgctgggaagggggcaagctgtcccgaggtctggatgtggcttcgtggcggagagaaaaggaagaggcaaaccctgagcccgggagggagagcactgagcaggcct

SEQ ID NO: 36699 - DNA, 170 bp, Homo sapiens; identical to SEQ ID NO: 1318
  chr17:59533874-59534044
  hyper

SEQ ID NO: 36700 - DNA, 66 bp, Homo sapiens; identical to SEQ ID NO: 1319
  chr17:59534340-59534406
  hyper

SEQ ID NO: 36701 - DNA, 225 bp, Homo sapiens; identical to SEQ ID NO: 1320
  chr17:59534556-59534781
  hyper

SEQ ID NO: 36702 - DNA, 171 bp, Homo sapiens
  chr17:59535096-59535267
  hyper
gcctctctgcctcctcgggcgtcagtgccacctcccttcgcagcttgggactgggccgccaaagcccgcagggggccaccgcagccgcgcgggccttgcgggaaagaccgaggggaggggcagcgctatgcaaatgaatccaaacagggatcgcgacgctcaaaagtccca

SEQ ID NO: 36703 - DNA, 496 bp, Homo sapiens
  chr17:59539215-59539711
  hyper
gtccccagggacctccgagaaagtcggggctgcagcggggttggggcttgggggaccctccaggtggagagaatctaggggtatcccctagtctctgtccctttccccaggaaaggggctgagagtaagcgccttgaatttggccaccgctttggccggggagctcccgcggctctcgcagcgcagctagaacttgcgtgttccctcagcagtgagttcgcagttacgggtttgttgccagaattaaaaaagccccaaacccttgccccgcgccccgcgcgcctccaacaccgagaaacgtccgaggaagcttatcttagcagttcattctaaagccatttccgagtatgaatagataaaggctccagctccgcaccctttcagagcctgtttcatgatcagaggagaagccccgggctttcatctcctcccgggccggcgagcaggcggcttgtttattcccctggcggagccgtttccgcgtgtgccgtgggga

SEQ ID NO: 36704 - DNA, 301 bp, Homo sapiens
  chr17:60705635-60705936
  hyper
cctgcagggcgcgcccggggagccagggctctctgtccgggagttcccgggcccagtctcctcgctctgccccaggactgatgcgttaggacggctttccaactatccgcgagggttcgtttcccccaccttccccccgccccctgcatctcgtgggcgttgatattttcttttccacacttagtcttcaaggaggcttgtggcgcgcggcatccgccccgcgtgagctcggcagccctgtgaggaggctcctgccactgggacgcagcaacaggctgggcgccgccgtgctgtgatgttg

SEQ ID NO: 36705 - DNA, 90 bp, Homo sapiens
  chr17:61600708-61600798
  hyper
gaggacagacggagacgccgggagccagtggcgcctgtggctccgggcaggggccgcggccgaaagatgccggtccgcaggggccacgtc

SEQ ID NO: 36706 - DNA, 165 bp, Homo sapiens
  chr17:61777909-61778074
  hyper
ggccattcactgcctcggtttcccccggttggcctcgcgcgtaggcgccggcgcccccatccccgcccagagctgtggggccgcagagacccagccggggcgaccccggagcctggcccggggtccctcgggcggccgagtcctcccgccgccaggggccgcccc

SEQ ID NO: 36707 - DNA, 15 bp, Homo sapiens
  chr17:61778234-61778249
  hyper
ggtatgcgtggttcc

SEQ ID NO: 36708 - DNA, 180 bp, Homo sapiens
  chr17:61926145-61926325
  hyper
aaaaaaacaagactttttgcaaattatccattgtcaaaactccgccaaatacatctcccagcccgccagggagcagccagcagaggccgcaagctcggccaagcgagccgggatgtccaaggcgggaacgtggcttcgcgcgcaactctctgagacgcgggccggctcacgtgtccgggc

SEQ ID NO: 36709 - DNA, 118 bp, Homo sapiens
  chr17:61926507-61926625
  hyper
cgcgctcccctcccgtcgttgtagcttcctgctcgcccctctcatctcagccaaccctgctgagctttcgcgtgggcgtcacgagtttctaggcagatcaggaaaaccgctctccggc

SEQ ID NO: 36710 - DNA, 54 bp, Homo sapiens
  chr17:62776217-62776271
  hyper
caagggccaggagaccgcggcttgccgaggctgagggaccgaaggagcagggtc

SEQ ID NO: 36711 - DNA, 275 bp, Homo sapiens
  chr17:62776523-62776798
  hyper
gaccatcgccctgggcggggcttccgaggtggtgccggagaggtttcgcggaatcggagctggcaacggcagcgaatagggacagcgacgctcaggagtgctgtcacccatacccaaagaagctgcgtctgggcggggcgaggaggaacctgaatgcctctgctggggaccttggggggcattgggacgaggaccggagcagaaagccggggtccggagccaggaaggctgcgtctgaaggggcgctggctggtcgctagcggagcccaaggagg

SEQ ID NO: 36712 - DNA, 270 bp, Homo sapiens
  chr17:62777021-62777291
  hyper
caacagggcctttcccggagcaacccggccgggcctggaaaaactccgagagggattcccagcgcagggacgcccaccggagcgcagtgtctcgggctggataagaaggggacccggccacagctccttcgccaacctgcgggaacacagagaaggggagggattggtgggggccgagaggatccctggagcgcgagagcgcacccgtcgccaggaggtcccctgcgtccactgcccaggcgacgcaagctacagcggcgtcaacgcctg

SEQ ID NO: 36713 - DNA, 141 bp, Homo sapiens
  chr17:64825634-64825775
  hyper
tagcccatgtgaatccgtgctgacatccgcacagatgaacggatcagatgagatttaatctccctgaggcccatgggcacgagtcactggagttttatggggtccagtaaagagcaaggaaaagtccgggtcttacaaggc

SEQ ID NO: 36714 - DNA, 229 bp, Homo sapiens
  chr17:64831214-64831443
  hyper
cggcggcggcggccacggtcattggcgccgagcggttccggctgactggacggggcgggcgtcccgggcagcctagcgcggtacctcccgccccgcgcgcccagccggcgagggacattggaccagggtcgggggtcgcggccgctccagcgaggtaagagccgggaagaccgggagagaccacctcttccatcctgggggggtccctgggggacggtctcccaccggt

SEQ ID NO: 36715 - DNA, 60 bp, Homo sapiens
  chr17:64961565-64961625
  hyper
cacgcgcgcgtagcccgggacccgagcgatccccaggggccgcgccggcacccccggggg

SEQ ID NO: 36716 - DNA, 45 bp, Homo sapiens; identical to SEQ ID NO: 12865
  chr17:64961987-64962032
  hyper

SEQ ID NO: 36717 - DNA, 1213 bp, Homo sapiens
  chr17:66596302-66597515
  hyper
gctgcagccctgggccgggggcgtcaggaaactcgagactggggcgcggggaggccccggccagagcgcccgctctcccgcgtcccgggcggggtcctcacctgttccagcgggccaccttcctccggtaataccgcagcgcctcctggctggccaggagcgagtcctcggctcccaggagaggcggctcctccgggacgttgtacagcgggtgggcgaagagggcctgcaacttggagctcgacccgctgtggctgccgccagccggttcagtccggggctcggttcgggaaaagttgtgcacgatcgtgccggggtccgaggcagctgcggccgagtcccgcgccagggaggaggcgcggccggtgcacgggcacccccgcgggcgctcccgaggccgcagctggcgctgtacttggggccagaggtggaagtagaggtcggcggagagcagcgcgcccagcagcagcagagtcagtaggcggtcccggcgcagccccggcatggcgtgctggccaagggggacgccgggggcaggccggctgtctccggggtcccgggaggggtcgcggggtgcgggcagaagaggtgcctggagtcccgcgggtgggccggggtcagtgagaccggaatgctccccgcgcgggctagtcccctgtggaggggtgtcgctcctcaacttggggaccaggtgcacggagcaccggggctctcggagtcagcgggcgtcgcttctccgcgccgagtgagccgagggaatggggttcccggggtgcccgcttcttgcgccttttctcccgtgcgcccgcccgcccggacgctcgcggcaggtgaagggccccggggcgccggcgccggctgccaccgcgggcggacgggcgacggggcggggggcgaccgcggagggcggacggaggccgccggctgcaaagcccggggcgtctctcctgaggatgctgtcgctcggcggcggctgctagtgctcccgcgactcctcctgcgggcggcggagacgccagtgccggcggctggcacgggcggcgcgagtggggagttggcgaagcaggagcggctccggggagcttgtctgtgcgcctggactcctagaggcagaggtagcgcggggcctccccgagcctggcctggcgccggcacccccacccactctccgctggcacctgcctctggcgcagctgacggccaactcccgatc

SEQ ID NO: 36718 - DNA, 749 bp, Homo sapiens
  chr17:68165237-68165986
  hyper
gcaaaggtctctacccggcgctggcacctcgcaggcccctcgaggagcacgcagggcaagcggcccaagagcgggggaaccgggaagtgtgtggggctccagacggagtaggaagctttgcccaaggccaggctgcaatcaggcagccgcaacagccgggcgcggagcttcccacctgctgctgtcccagctgggccgcaacttcctcctccccggcccgggcccgactccccggccgggctccgagggtggagggggacgaggcggcggcaggttccctccgctggcaacgcctcgcagcatcctcccctccccgccgcggttcccggggccggccgcgcggccaggcgcgctgcgattggccggcagcggccgggggcggggccaggagagccggtgtcgcacggaccgcctcaaaagagcccaggatattgcagagcgcactggagccctggccagcgcgcagccttcccggcgccggcgggctgggtcttgggaattctggtttgctttggctcactcgctttttacaaaccactggatcttacatgcctctgtaccccccacttccactccatgtccccatgctcctgcgccagcaacaggtaagggctgctgtgttttcttccttttcgctcgctgccggtgtgtcctggggaatggactctggccgccgtcccctaccctaccctgccccgctgctccagaggtgcccagctgtcacactgctgtagcgctcacccacactc

SEQ ID NO: 36719 - DNA, 78 bp, Homo sapiens
  chr17:70026589-70026667
  hyper
tgttaatctgcaacacgccacagcctctagatcgctgccgttcagagtcggatgtcatgggggcgactggcaggggtt

SEQ ID NO: 36720 - DNA, 30 bp, Homo sapiens
  chr17:70026970-70027000
  hyper
aaggagttggagctccgtgatggtgagctt

SEQ ID NO: 36721 - DNA, 751 bp, Homo sapiens
  chr17:70112816-70113567
  hyper
aaattttccgcagggcgttctagggatgagttgagggaagccgcatgacgcgcggctccccggtgccacagctaaggacagatattttcgcaaaacccagaatgaaaaaagagcacgctccctttgggagcgctgtccctttgggactggggccttccactcccacccctcctttttccctgatcggctccgcagctccacgacaagccagctggtctggtctctgacttgggctccggtccgtacccccggggcgccctgctgtgttacagccgcccgacgcccccagacccggccaggtcaccagggcagattggaggttcgcgccccctcacccgacacctcccgtccacctcatctttctttttttcgaaaacaggaaagggaagaaaactgaaacgggcctcttggtctgcagttttagcggagtcgggattccacagccctgagtggcacatgccggtcaacttcccaaagtcgggctcccgtgtggggagaaatacacacgcaggaatgcacaagcatcgcgtgttcgcaactgtcgctgggaggtctggcggctgtgatgggacatgcactcactcgggcaacacgtccacaggtgacatctattcgatcagtcaacagatatttattgcgcacctacgacgctatctggtactttccttttccccttagctgttgctgtccagcccagcgccagtccagagacgggcttaccggccgctcccttccacaagaaactcgtgtc

SEQ ID NO: 36722 - DNA, 372 bp, Homo sapiens; identical to SEQ ID NO: 1322
  chr17:70113647-70114019
  hyper

SEQ ID NO: 36723 - DNA, 365 bp, Homo sapiens; identical to SEQ ID NO: 1323
  chr17:70114152-70114517
  hyper

SEQ ID NO: 36724 - DNA, 30 bp, Homo sapiens
  chr17:70115315-70115345
  hyper
caatgcccttctacccgggacacagaaata

SEQ ID NO: 36725 - DNA, 640 bp, Homo sapiens; identical to SEQ ID NO: 1324
  chr17:70215667-70216307
  hyper

SEQ ID NO: 36726 - DNA, 76 bp, Homo sapiens
  chr17:70216392-70216468
  hyper
cgtcaaagccgggtccagggaaggggggcatgccatgggcgtattgttggcctgcgagttccgtcaatgggaaaag

SEQ ID NO: 36727 - DNA, 59 bp, Homo sapiens
  chr17:70588893-70588952
  hyper
tcctctggataccagcgccgcaccgcgcacccgcgccgcctgcgcgccctgcagtcggc

SEQ ID NO: 36728 - DNA, 30 bp, Homo sapiens
  chr17:71160848-71160878
  hyper
tgggtggaagggaatcgactctgtgaaatc

SEQ ID NO: 36729 - DNA, 256 bp, Homo sapiens
  chr17:71161183-71161439
  hyper
cgcaagaccaccagcgcccagagccccagtctgaggcttggcgccgggggtctgcgggcgaggggagctctctacgtgcgaggggctagcgggagccggcacaagagggtcgaggagccaggaaccccaaacgtccggcgccaggcgctagccaagctgctgcgcgccccggcgcccagctggctcggggacagccgctgggtgtcggagaccggagctagcggattgcagcggaaaagcaaaggtgaggggtgtg

SEQ ID NO: 36730 - DNA, 917 bp, Homo sapiens
  chr17:71161499-71162416
  hyper
agcgcacttgggcacctgtgtgcatctgcgctgatggtggtgtgcccatccgagtgcctgagcttaggtcccggtgcgtgattctccgctcttgtgccttttggggtgattgtagtaggaatgaacgacaacgggtacccttgcctgagtaagggggctgtgggtagagtgtgctggaacggacgtgtcctcgcagcctcatgcccgtgtgcgtggcgtgtgccctttagcccgagatttcaggtagctgcgacgggtgacaacttctctcccagccccctacaaaagagacctggcgcgaggggagcgaggccgtgagatgccagctggggctcctgcgggagcgcacccggagatccgagcctgccagaggcaggcggcgggcgcagagcggagaaagaggggcttctctccctagacgctgaacgatctaggatccgtccccgtcccccacctcgggacagaaaggacagtttgtctaggtttggagagaaaaaaccactgcataggccgtgcccaaaagccgctggccaagtcccccaagcgactgtcttctgcgccccgatgtctctgtcctcagcgccccccccccacacccggcacccctgctgtgcgtttcgatactgggcgtgctggcgccacaatctccgctcttgcctcgtcttcctggaaatggcacagagttctttgggaaacccttgctctgaggatcagcgagttggatggccaggaggaggactttctgtgccagccgggagcaaccggctccgcggtcctgacactcgcccctccatttctcaaccccgtaggccagcaccgccccggcttttcccaggcgctcacgcgccgcggtggccctcaggggcttttgtcaccctgccagtgggggctctcgctctagccgcacagagaccaag

SEQ ID NO: 36731 - DNA, 61 bp, Homo sapiens
  chr17:71639405-71639466
  hyper
cacaggtcacagcagcgagcggctgcacagactatcgagcgaacagcggaggctggaggca

SEQ ID NO: 36732 - DNA, 62 bp, Homo sapiens
  chr17:71639789-71639851
  hyper
gtctgggaagctcagcgtagccgagcgtggagcccggcacggaatgtcgctcccctcccaag

SEQ ID NO: 36733 - DNA, 30 bp, Homo sapiens
  chr17:71640237-71640267
  hyper
ctggagaggggtcctcggggtctcccttcc

SEQ ID NO: 36734 - DNA, 265 bp, Homo sapiens
  chr17:71640832-71641097
  hyper
gcaggcagcatctggcggggccgaaccaccccctctgggctccaccgccctcgcgccgaatcgggagacgccgggtctcctccgggggcgctggggccgggcgcgccctcggctccgcgcccagccggctagcaaactttgcgggtcccggagccgggcgcgcagccctgagcgcccatgtccgcgccagccgcggggcggcgggggagggtgctgggcttcgcgacgcgggctgtcgccggcgcccgggcgcagagcctcctgc

SEQ ID NO: 36735 - DNA, 318 bp, Homo sapiens
  chr17:71641365-71641683
  hyper
gggggcagcgtgagccggggacgagcgcggcggaggcggagacgcggagaggggggccgagcgctaccccgtggccgcgactggagagcagcctgcgcgccgggaggggcggcggcggcggcggcggccccgagccaggcccgggagcgagccccgcagaaatacaatccgactgcgcggccgcgggcgcccagcggctctgggacccgcaggggggcagcagtgccaaccttctgccgcgccgggagagatgcgcgcgagcccctccgctctctgcccagcctttccttccagcctcgctcgcgcccctgtctcaaa

SEQ ID NO: 36736 - DNA, 62 bp, Homo sapiens
  chr17:71897979-71898041
  hyper
attcgcacctgattacgctgcgcggacacaacagaggcgcccggacccgcagccctgccttc

SEQ ID NO: 36737 - DNA, 70 bp, Homo sapiens
  chr17:71898345-71898415
  hyper
cctccctccccgccccgctccgccctgctggtcccgcctgccgtccgcaattaggcggcagatgcttgcc

SEQ ID NO: 36738 - DNA, 597 bp, Homo sapiens
  chr17:71948390-71948987
  hyper
actccattcatctcccggttcctcgcattcatcccccaccgaacccacccacaaaatgctgaatcggtgggtgagatccccatagcaacggctccgatgccagaacccaggattacgacaccggatcagccagagacgcgctggaggggcccaggaggggctgcagcgcgccgcaaatcccccggggcttacgggagccgctctttaggagacagcgctggacgaaccgggcggggtggggatggataatcttcaggcgccaacgcaaaacggccgcaagacgtggccaggccaggaggctcctgggtcccgggcccgcgatgtggcccttgcgcggggacaaagacgaggccatcgccctcacgtgttcccaaagacgcccaacctcatcaggaggccgccccatccgccacctgggagcgtcccacacgcccgggcccttgaggatgtcccctcggcgatgtgcctgaccgggcgctccccgcccgccaacctccaacctccaacctccgccctccaccctccaccctccttgctctgtccgcgtggacgcagcccccggttcagacactagcgggtgcgcggggccgcccagga

SEQ ID NO: 36739 - DNA, 109 bp, Homo sapiens
  chr17:71949194-71949303
  hyper
tcctgtcacccaccacgggagttcacacgctccagtccatcggcctcccccggcccgaccgccctggctcaggcaaatcccagcctgcacttcccgaaggaagtcccct

SEQ ID NO: 36740 - DNA, 251 bp, Homo sapiens
  chr17:72208417-72208668
  hyper
agggcctttgagcaccgggtgactggggccccactccccagcagccatatgtgtttgcgagcgttttcagtcggtccgcatccacccggtcccttcagccagaaccctaggagccccgccccgtcctcccggggctcctttctcacccgcgtccctgccgcggtggatacgcacccctcaggctggctgcccagcgcggtttccacgcccaatctgccgcgaccccatcactccaccgcacctacccctga

SEQ ID NO: 36741 - DNA, 97 bp, Homo sapiens
  chr17:72209140-72209237
  hyper
ttgtcctcactcaggcgtcctgcaggcggcttcagcgagttgttggggcagatgcgccgggagctcccgagggcagggacggcgtcttatttctctt

SEQ ID NO: 36742 - DNA, 284 bp, Homo sapiens
  chr17:72270174-72270458
  hyper
gtaggcttggataagcgccttggcaacgcccctacaaatattcatgatcattattagtatgttaccaacctattggttaattcttctcctaactcaggagacctccaaaaagaagagggatggcctgcgcttccgacgtggcaggaaaggagtcacgtgctccggggtccttccgcgtcgccccgcgcgtccggagccaggccggggttgccaagcaaccggtaaacgccgccgtttgaggagcaccggagccgcgaccgtggattgaacgcttccccagagac

SEQ ID NO: 36743 - DNA, 42 bp, Homo sapiens
  chr17:72321933-72321975
  hyper
cacaggcacctgctgcgatgcacgcggcgcccacggaaaccc

SEQ ID NO: 36744 - DNA, 248 bp, Homo sapiens
  chr17:72322310-72322558
  hyper
ccccctgccccgcctcgggtcggcgtccttagccgctggcgcgttgttggtttcgggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtgagacccttttagaccctcctccccaccc

SEQ ID NO: 36745 - DNA, 15 bp, Homo sapiens
  chr17:72322611-72322626
  hyper
cgccaccccactgag

SEQ ID NO: 36746 - DNA, 96 bp, Homo sapiens
  chr17:72427312-72427408
  hyper
agccccgggggaaggcggccggaaaatctcttgtttatcgggctggataagtaccagcctggattcgcttcccaatttctgcggtccagcttcagc

SEQ ID NO: 36747 - DNA, 64 bp, Homo sapiens
  chr17:72428340-72428404
  hyper
ctggagcgcggcgggcgcccgattagcgccctgaatggaggtgatgtaacggtgatgcaggctc

SEQ ID NO: 36748 - DNA, 182 bp, Homo sapiens
  chr17:72667300-72667482
  hyper
gtgagctcctgggaccgcaatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccggg

SEQ ID NO: 36749 - DNA, 181 bp, Homo sapiens
  chr17:72838924-72839105
  hyper
caagcgcctgcaggccgagtggccgtcggggcgggcgcaggcggggccggtgcacccagcgggcagcgagctgggccgagcgaaggcctcggccacggagctgggcagggaagcgtgacgcgggcgcgagccccgggcccaggccgcgtgcagcagggcctcccgccgggccagctgctcc

SEQ ID NO: 36750 - DNA, 30 bp, Homo sapiens
  chr17:72848653-72848683
  hyper
cgaaggcgctccagtcgtactcttccagca

SEQ ID NO: 36751 - DNA, 190 bp, Homo sapiens
  chr17:72856276-72856466
  hyper
tacctgcccctggcacgctcttattcttcgggagtttagaaacaggctcaaagtcactagcaccgccaagacctggacgggctctgaaatacagccagcggaatggtaccctccccaaataagtgtctttcctcgattttcctgtggcccggggtcagggactgaactaagataacgccaccatccgagg

SEQ ID NO: 36752 - DNA, 743 bp, Homo sapiens
  chr17:72856941-72857684
  hyper
tggaaggggaagaagcgggactcgcggcgggggaaggggtctgggcgccgaggcgagtgcgcagcaggtgcccagcagacctagggaaactggggcactgggctggggagccgcacagccccctttcaccttctcgactcctttccaacccctcgctctggtggatcccagccccggcccccactcccggccctgttccccgctctccgccccggcggcttccagcagcaacagtttgggtccgcggcagcccagactcccctggtcccgcggtgctgccgcgccaagcgaaggaggaggagggctcggcgaccctggggacgaacgtcttggacgcttcgcccgcgtccttctctcgcgtccgccgcgcgcctgtctgctcggcctcttcttcgccttctctccggccgcccgggtcaaaacccaaggccaggttcttgagggtccgggtcctccagccgccccctccttgagccccgagagtcctgcgtgggtccaaccccccgggtgtcccgcctctgtctccgccgtccttgctcgcgcgccgcgggaacccagccccaagttggcggcgaagttggtgcccctcgcccgccgctcgccacttaccgaggggaaggggcgctgcgcccgcgacgagagcccgcgccggccgcctccctcgcggtgtctgtcccagagcctcggccccggagggctggcgcgctcagtctcagctccgcgggcgccggagcccgggcgcg

SEQ ID NO: 36753 - DNA, 67 bp, Homo sapiens
  chr17:72857958-72858025
  hyper
tcccctctccggaaccgcgtccccagacctgacactcggggcaagtgcgcctcggaggacacaccag

SEQ ID NO: 36754 - DNA, 23 bp, Homo sapiens
  chr17:72889334-72889357
  hyper
ctccatccttgggtgcggggccc

SEQ ID NO: 36755 - DNA, 380 bp, Homo sapiens
  chr17:72889430-72889810
  hyper
cgcgccgccacctccgccgcaccccgcccccacccgcagcccggccgggacgccgggtccccgcgttcctcacctgccggcaaggcgaagaggctgagcgcgaggatggcgcagtccacgccgtggcgctcccaccaggagctcgtcctcaccacgtcctgcaccagcacctccagctcccgcagcagcgcctcgcccccacggtgcgcgctccgcgccggttccatgggctccgtaggttccatgggctccgtgggttccatggactctgtgggctcgggcccgacgcgcacggaggactggaggactggggcgtgtgtctgcggtgcaggcgaggcggggcgggccggggcggagtcacgcgccgcctggggacaccc

SEQ ID NO: 36756 - DNA, 40 bp, Homo sapiens
  chr17:72890033-72890073
  hyper
gacaccccccacccccgccccgccccgagggccttccctg

SEQ ID NO: 36757 - DNA, 30 bp, Homo sapiens
  chr17:72920550-72920580
  hyper
cttcccctttcccagcgcttcctccagcac

SEQ ID NO: 36758 - DNA, 219 bp, Homo sapiens
  chr17:72920855-72921074
  hyper
ctgcacgctcatcagcggcggagccttcaacaaggtggccgtgtacgacaccgacgtgttcgcgctgctcactgcgatgatgctgctggcaacgctctggatcctcttctacctcctccgaaccgtgcgctgcccctgcgcggtaccctaccgggacgcgcacgctggccccatctggctccgaggtgccaggggaggtgggggcgaggtagggtgggc

SEQ ID NO: 36759 - DNA, 75 bp, Homo sapiens
  chr17:72932011-72932086
  hyper
cggcgatgcctctcccggcctcaggtaagcccggagcgccggcggaactttcccagcttgcgcaccccagacact

SEQ ID NO: 36760 - DNA, 258 bp, Homo sapiens
  chr17:72932356-72932614
  hyper
gcccggtctggggcacgcaggaagcggctgccccggccccgcagtccctaaaatggctcggaaggaaatcccgagggcgcccgcactcagcagcctcctcggagccggccctgcgctgctgggccgggcgccgggcccgacggctccgcggctttcatcgccaatccagccgagacccacaaaccagtccagtgtcccggccctcccttggactggcgtcgcgcccaggggcgtgccagggggcggcagagtactgct

SEQ ID NO: 36761 - DNA, 235 bp, Homo sapiens
  chr17:73073449-73073684
  hyper
ggcctgtccgagggccgccactaggacgggaggtggaggtgtccaactcgtgggtgtgcctgggcgtcacctacccccgcagctccccgctcggcggccgcccgagccgcagcgtggtctacctgctgggccgcaaccccttctcgtggtgcctggagtgggacgacaacgcgcagaccgtgctgcacggcgcctaccaccgcacgctgggcgtggcgctcgactgcgacgccgg

SEQ ID NO: 36762 - DNA, 1 bp, Homo sapiens
  chr17:73584937-73584938
  hyper
g

SEQ ID NO: 36763 - DNA, 100 bp, Homo sapiens
  chr17:74070380-74070480
  hyper
agccagactccggggcccctcatccgcctccgccccgcgtttcctccccccgatctcccaggggtcctcttttgagggcaccccagcccctcgacggtcc

SEQ ID NO: 36764 - DNA, 712 bp, Homo sapiens
  chr17:74071017-74071729
  hyper
gggaggctggcaccccgaggcggtcatcgtgcccctgctcttcgcgctcatcttcctcgtgggcaccgtgggcaacacgctggtgctggcggtgctgctgcgcggcggccaggcggtcagcactaccaacctgttcatccttaacctgggcgtggccgacctgtgtttcatcctgtgctgcgtgcccttccaggccaccatctacaccctggacggctgggtgttcggctcgctgctgtgcaaggcggtgcacttcctcatcttcctcaccatgcacgccagcagcttcacgctggccgccgtctccctggacaggtgagccagcgccttggcctccctgggagatgggcatccacgcgggggatggagcgggaggcgggactggggaccaagaagggacgcgcagagtgggacaggacactaagaaggcagtggaagacaagcgggcgcggaggaggaaaaagaggaataagaatgggggaccgtggtgtccctcggttagatgcgtcctggggcctggaagcctggagaatgtggctctccagcgccgcccgtgcctgacaacgcgcagcgtttcccagtacgacgcgtttgtgcgcgttcatctcgcttgagcttaatgccctccgtgagggtgggataggacaaagtgcccaatatacagaagagttgagttcctaagtaactcgctcagagtcgccagccagggatc

SEQ ID NO: 36765 - DNA, 103 bp, Homo sapiens
  chr17:74072477-74072580
  hyper
cacctttcctgctgccgggcccgccccatttccaggctccgctgagtgtctgggacacgctgggaggcccccacctccgccctcacgccgagcctcaccccca

SEQ ID NO: 36766 - DNA, 456 bp, Homo sapiens
  chr17:74072998-74073454
  hyper
cgtcgacccggtggccgcgggctcgggtgcccggcgcgccaagcgcaaggtgacacgcatgatcctcatcgtggccgcgctcttctgcctctgctggatgccccaccacgcgctcatcctctgcgtgtggttcggccagttcccgctcacgcgcgccacttatgcgcttcgcatcctctcgcacctggtctcctacgccaactcctgcgtcaaccccatcgtttacgcgctggtctccaagcacttccgcaaaggcttccgcacgatctgcgcgggcctgctgggccgtgccccaggccgagcctcgggccgtgtgtgcgctgccgcgcggggcacccacagtggcagcgtgttggagcgcgagtccagcgacctgttgcacatgagcgaggcggcgggggcccttcgtccctgccccggcgcttcccagccatgcatcctcgagccctgtcctgg

SEQ ID NO: 36767 - DNA, 63 bp, Homo sapiens
  chr17:74117965-74118028
  hyper
tcctctgaaccagtccggaaggggggttcggctggcaagccgcggtggcgtcagcctctggca

SEQ ID NO: 36768 - DNA, 146 bp, Homo sapiens
  chr17:74136296-74136442
  hyper
gtgggggtcggtgccccccgggggcagggcgggggccttggcgttgagaatggagaattcctgcagccactgcaggctggtcaggctgtcatccagggcgtcgggctcctccaggccgccctccggcccggcctcctccgccggcc

SEQ ID NO: 36769 - DNA, 149 bp, Homo sapiens
  chr17:74136570-74136719
  hyper
cgttacacggcctcccggacgcgcgcttccatctcgcgaccccgggggcgcctcctccgaataagtatgtggtgcctgcgaggaccacggtgggagctgagcactaccccacccccgaggggacagtgtgtgtacggggacgccctctc

SEQ ID NO: 36770 - DNA, 30 bp, Homo sapiens
  chr17:74378928-74378958
  hyper
acagcctccgattcgcgttttctaggcacc

SEQ ID NO: 36771 - DNA, 15 bp, Homo sapiens
  chr17:74533543-74533558
  hyper
caccgccttcctctc

SEQ ID NO: 36772 - DNA, 143 bp, Homo sapiens
  chr17:74533674-74533817
  hyper
cgcggggcgcggggcgcggggcgccgggagccggggccggctgcgtgcgcggcgggcgggcgaggggtagagcgcggagggagggagcgtgtgtctgtgcgcgccgggtgtgtgtgtgtgtgtgcgtgcgtgtgtgcagggta

SEQ ID NO: 36773 - DNA, 144 bp, Homo sapiens; identical to SEQ ID NO: 4498
  chr17:74534219-74534363
  hyper

SEQ ID NO: 36774 - DNA, 46 bp, Homo sapiens
  chr17:74534387-74534433
  hyper
cgcccaggctctggggggttagcacgggggtcgtccccctgcccgc

SEQ ID NO: 36775 - DNA, 327 bp, Homo sapiens
  chr17:74581216-74581543
  hyper
gggcttatccagacacggcgagcggaagccggggagaagggagcgggcgcggggcggacagagaccgcagcgggcgggaaaggcgactggccgcggcccgacggagggtccccgcgaagttggaaaccggagacttgggcccctgcccaaaaagcagaatctgacgttaccgagggagagttcccgacaaaaaaggaagtttttatctgcttcggggacccagccagatttcgacaatagaaagtgtacttatcaggccggggaggacttcaccaacaaggggcaccggggcgggtcgccagtgcacaggggcgaggtcttccttgg

SEQ ID NO: 36776 - DNA, 399 bp, Homo sapiens
  chr17:74864669-74865068
  hyper
ggaggcgctggggaccggggcgcgggcccggggccgcctttagccggcaccgagggcgcggggccggggatgagggcgcccgccgcggggagcccgtctgcgcgccgcggcaccttcccgcccagcgagcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgc

SEQ ID NO: 36777 - DNA, 186 bp, Homo sapiens
  chr17:74865069-74865255
  hyper
tccggcctcgcccgcggctgctcgcaccaacaagtttgaacaatgatcaccgtcaaccccgatgggaagataatggtcagaagatgcctggtcaccctgagaccctttcggtaaagttccctcctggttggttttttccccaggggggcgccgggtggaggtgggcgaggtcggttcctgcgaacg

SEQ ID NO: 36778 - DNA, 748 bp, Homo sapiens
  chr17:74865553-74866301
  hyper
aaagttagtgtgcggcgccttggagctccccctccggtccctcccgtcccgcccgtctgcccctaggtcggctaccccccaacccctccgcctgtgccaccctctccccagcctttggtggcactgctctcctccccgcggggctcgggcctggctccgacgagagggtcccgagattagagcgaggactcgctcatcccaggattcgcccccgatcgcaggcgtcggagaggcgggggcaggggcggcgctgcagggctacggggcggctggagccgaggctgcggcggagcgtggtgggcgggcggtggcgaaggcgacacgcttcgggcggccaacacctgggggcccaggccaggcagggctggggccgcgcgggactcactggacccagccaggggcccccagggcccagcggtgccggggcagccccctctcctcccaggcatccgcggaaccggcccgcagcggggtggggagggggcgctgcccagtggacgcccggcggggcccgagtgtcaccccgtgggtagctgggcagcgaggaagctgggggagtgaccgccccggcgcgggggccggactcgggacgtggccacaggtgggctccgggcgcgggaaggagcccgagaaggcggagcttgcaggggccctgaactcttgccctccaggtctcggcccagccccactgtggtccccctgccggctccagacggggatgggggcggggagacggtggctcacctgg

SEQ ID NO: 36779 - DNA, 30 bp, Homo sapiens
  chr17:74965579-74965609
  hyper
tgcagtgagactcatcggtgaggggggcac

SEQ ID NO: 36780 - DNA, 187 bp, Homo sapiens
  chr17:75368715-75368902
  hyper
gccgtgttccatccccgccctgtgccccttctcccggacagtgccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgc

SEQ ID NO: 36781 - DNA, 188 bp, Homo sapiens; identical to SEQ ID NO: 12903
  chr17:75368903-75369091
  hyper

SEQ ID NO: 36782 - DNA, 366 bp, Homo sapiens
  chr17:75369092-75369458
  hyper
ccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccgg

SEQ ID NO: 36783 - DNA, 368 bp, Homo sapiens
  chr17:75369492-75369860
  hyper
cgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcg

SEQ ID NO: 36784 - DNA, 74 bp, Homo sapiens
  chr17:75370268-75370342
  hyper
ggggatatcctcatccgcctcccagaatcgggccgtgggggacagaaggggcctgcgtgcgggcagggagagta

SEQ ID NO: 36785 - DNA, 30 bp, Homo sapiens
  chr17:75370646-75370676
  hyper
agccctctggtgggccgggagggggaaagg

SEQ ID NO: 36786 - DNA, 88 bp, Homo sapiens
  chr17:75447639-75447727
  hyper
cttgcaccactggctcgggggctctcaggtggcgcggccgcgaggcggaccctgatggccatggtggcggtgccgggagccacgctgt

SEQ ID NO: 36787 - DNA, 413 bp, Homo sapiens
  chr17:75524591-75525004
  hyper
accccctctcgtggtcgccagggtaggggtgggaggaatctggaagccacgtgcgatgctcggagctgcgtcctctgtcctggggcgtgggtccgcgagcgccgcgcagcctcccggaccgccctgagctgctgcgcccggcgctgctcctccttccccagctccgcgccttcccctcgcgatccccctcctgcctcttcggtcctggaagcgtcccaagatggggtgggggcatggagggagagaggggaggagggagctgcccgggggcagtgccgccaggaagtgggacggggactctggcgcccctccaggctgctgcgcgcgggctggggaccgtgcaccgctttgcgcgccagacgatgcatcttctggaacggcagctgaggcaatgcggggtgtgaagtggcggc

SEQ ID NO: 36788 - DNA, 103 bp, Homo sapiens
  chr17:75525005-75525108
  hyper
ggcagaggggctcgcaggggctgggatccgcgtgcccctctctgcctcggtgcggagcacgatgtgcccgggcgggggcgaggacgtccgggaggggctgggc

SEQ ID NO: 36789 - DNA, 98 bp, Homo sapiens
  chr17:75953838-75953936
  hyper
tcgaattgcacattgcgcctgaccttacctaccactaatgaataatggatatcgaggagccgtggaatggaggatcacggcggcgtacggagcaccgg

SEQ ID NO: 36790 - DNA, 389 bp, Homo sapiens; identical to SEQ ID NO: 4503
  chr17:76227773-76228162
  hyper

SEQ ID NO: 36791 - DNA, 144 bp, Homo sapiens
  chr17:76228213-76228357
  hyper
cggacgccggcaatggcagcgcctggcccgggcgcgcagagctgctctcctcgcactcggggctctggcgcatctgcgaaggtaaccggccaccgcgccggccctcctccctccgcgacctcgtccctccgacacccccttaac

SEQ ID NO: 36792 - DNA, 18 bp, Homo sapiens
  chr17:76254836-76254854
  hyper
cgccggggaggctgctgc

SEQ ID NO: 36793 - DNA, 146 bp, Homo sapiens
  chr17:77178726-77178872
  hyper
cacccaaccccaactcgccagccggagcttcctgcgcagcccccaagattgcaaaagtctggccccagccccctccccggccagagctcctggggcctccctcgccaggcgggtggcccacctcccccgcctccccggaggcccgg

SEQ ID NO: 36794 - DNA, 102 bp, Homo sapiens; identical to SEQ ID NO: 4505
  chr17:77178962-77179064
  hyper

SEQ ID NO: 36795 - DNA, 249 bp, Homo sapiens; identical to SEQ ID NO: 4506
  chr17:77179081-77179330
  hyper

SEQ ID NO: 36796 - DNA, 75 bp, Homo sapiens; identical to SEQ ID NO: 4507
  chr17:77179380-77179455
  hyper

SEQ ID NO: 36797 - DNA, 27 bp, Homo sapiens
  chr17:77179456-77179483
  hyper
gcaggggggcgcccggcggcggctctg

SEQ ID NO: 36798 - DNA, 92 bp, Homo sapiens; identical to SEQ ID NO: 4509
  chr17:77179617-77179709
  hyper

SEQ ID NO: 36799 - DNA, 67 bp, Homo sapiens
  chr17:77179710-77179777
  hyper
ggcgagcgggcgagagcaggagtcagtcactttggagcctccggagccctgtctgcaaagagtggtg

SEQ ID NO: 36800 - DNA, 429 bp, Homo sapiens
  chr17:77179799-77180228
  hyper
cgtgtgcgcgcgtgtgtagcggtgggagggggagtccctggcgtactccaacatcaaacggagccccgcgcggagggaagagaatccggagcgacggcacaacagctgatcccacacttaacccctcgcccgccggcaccggggcagccctccctcgcgccctcccacgctcgggcccctgcgcgcccctcctcccccccgttgccagcacttgctcctggcctggggggtctggaatctccctttgcccccgctccgttctccggccgctgcggagaggaggagccgctccgccggctctgcggccgaccgaccggaaggcgcctcgtcctgtttcgcgttcagagaagcgcctttcctaagggaggccggctcagtggcggggatgtcggtgatgtaatccgagggcatctacgcagaggcttccgc

SEQ ID NO: 36801 - DNA, 114 bp, Homo sapiens
  chr17:77188779-77188893
  hyper
gccagaccctggagccgccgtggctgcctacacctctgtctccctgggcccaaacaagcacgggtgtcagtgaactctctgttttgcaggggtggccagcggctagccctgctg

SEQ ID NO: 36802 - DNA, 34 bp, Homo sapiens
  chr17:77216439-77216473
  hyper
ctcctctctgcctcccgctcgctcctgctcactc

SEQ ID NO: 36803 - DNA, 129 bp, Homo sapiens
  chr17:77290796-77290925
  hyper
ccggactgggggccacgtggaggaggccttggttcagctctgccccatgcctcacgggacacacatttatcacctggaaacagcggccagtgctcaggaaggctcatgccattgcggatctgccttcat

SEQ ID NO: 36804 - DNA, 233 bp, Homo sapiens
  chr17:77772557-77772790
  hyper
ctgtccaaagtgaggcgcgcgcaggcggcggcagccgcgaggtcctcgacccgccgggcaagcggggcgcttcgcccatcttccctcccagtcgtgccccagcctctggaaacacgggtttcaggttttggccttgttcctaaacttcacaaggtggccgcttgtcgaacagtcccatctctccggccgttctgtctgaacgaacagcgcgtcgaggacgctcagatctccca

SEQ ID NO: 36805 - DNA, 16 bp, Homo sapiens
  chr17:77776550-77776566
  hyper
ggaccggttgggccac

SEQ ID NO: 36806 - DNA, 317 bp, Homo sapiens
  chr17:77776679-77776996
  hyper
gccgcgggccggccccatttccgccccccccccacgcgcccccccatcacacgcacacccaatccccggactgctcgctggtgctgcttgtgagacccattcctaggagccccaggcgcccttggggagcagaaagaggcggtccagagttgggccggacaaccgcaacctggaaggagtccgggagtccttgggtctgggcgctcagttctcacggtctggggagaaggggctcagacgggacggactaggcacagccaggggcggggactgcgagaggcgaggggaggccggcagggtgtggcggcagagcagcc

SEQ ID NO: 36807 - DNA, 223 bp, Homo sapiens
  chr17:77777052-77777275
  hyper
cgttatcagaaacctccagccccaacccctgcctggagatgcccggggcgcgctgactctgttctcgcatcaccccgggccctggctcaacgcgtgagcagcctgtggttccagataccccgagtggagagtttgaccccagattctgcctgcactgacaggcttggcctggcggttacgagccacggttgatgagcgcccctcctcccgtgacccagctcat

SEQ ID NO: 36808 - DNA, 147 bp, Homo sapiens
  chr17:77777502-77777649
  hyper
gctccagggactcctcggactccgcctggcgcttcccgttttttcatttcctaccccacccccatgcagaaggaattgaagtgacttttttgctgggacgtcgggacctcaagtcagttccaaagtgggagtctctcagccggtgcc

SEQ ID NO: 36809 - DNA, 254 bp, Homo sapiens; identical to SEQ ID NO: 4512
  chr17:77777650-77777904
  hyper

SEQ ID NO: 36810 - DNA, 52 bp, Homo sapiens
  chr17:77777943-77777995
  hyper
cgacgcctttcctcgcagccccggtacagggcttcctcggtgcacccctagc

SEQ ID NO: 36811 - DNA, 373 bp, Homo sapiens
  chr17:77778673-77779046
  hyper
gaaatgtgatgttcacgctgagtttctgtatttttctagtttcaacctcagagcttactttttggccaaacggatgaaggggtaagccaccgtggaagtcccagcagatacccccaccatcgccccatccatcctgggaggttcggtggccctcgaggcagagacatggactgtggctggggtattgggggcagatgttcaatgtgttggggtgtggagagggtagattggcagcctactgaggattaaaggggtgtcctgcaaaccagctccggggtctgggtccggaccttccagggactcagttccgcaccctttgaacagatcaagacagagcacttccttgctctgggatggtcgcctcagccaccga

SEQ ID NO: 36812 - DNA, 304 bp, Homo sapiens
  chr17:77786467-77786771
  hyper
tcccctgccctggtgcgcccccgggccctgccctgagcccatgccccaggccgggtgtccagttcaccctgagctccccttggcgcccggagaagggtgctcgggcccgggtgctggggagcggcggggtggccgccggcgcctcttcggcgcggatggctctcggcggggccgaggagggggtcgcagagcggctccccgccgagaggagggtgggcgctcggcacctgctgagctacggtggtggctgcggtttatggcgcccgaggatccacccggatcttctccgcggagttccgggctt

SEQ ID NO: 36813 - DNA, 7 bp, Homo sapiens
  chr17:77789473-77789480
  hyper
cgtccag

SEQ ID NO: 36814 - DNA, 112 bp, Homo sapiens
  chr17:77814794-77814906
  hyper
ggagaagctcgaagacggtctggtgttgaacgcacacgtggactccatttcattaccaccttgcagctcttgcgccacggaggctgctgctgcccggcggctgctacccacc

SEQ ID NO: 36815 - DNA, 30 bp, Homo sapiens
  chr17:77815150-77815180
  hyper
atatttttctcctgccgtgtttggcttttt

SEQ ID NO: 36816 - DNA, 133 bp, Homo sapiens
  chr17:77815455-77815588
  hyper
ccaggtctgggctgccgggggaggccgagcggctgctgcagcctccctgctgccaggggcgtcggactccgcttcgctcactacgcccaggcccctcaggggcccacgctcaggacttcggggccacacagca

SEQ ID NO: 36817 - DNA, 30 bp, Homo sapiens
  chr17:77815905-77815935
  hyper
gcccctacctaacctcggtggctggtccct

SEQ ID NO: 36818 - DNA, 176 bp, Homo sapiens
  chr17:77904151-77904327
  hyper
cggctcggtggggttcgcggcgcacggaccccgcccccaaggcctcaggtgggccgggggctccgggaggcctccgccgccctccgtcccaggagagcagttcccggtgagaagcccgggctctgcagacaccccacagcagttctgcgtctcggaaaacgcggcgccttcatcag

SEQ ID NO: 36819 - DNA, 159 bp, Homo sapiens
  chr17:78045491-78045650
  hyper
ttatcaaacaggcttcgtgtgagatgattttgcccacctgtaggctcatgggagtgtcctgagcacgtttgagggaggctgggctgagccggggtgcctggcaggaaatctgcaggaagtgcattttgggtttttcagctttttttttttttttttttt

SEQ ID NO: 36820 - DNA, 30 bp, Homo sapiens
  chr17:78449436-78449466
  hyper
gcctctccagctcatcgatcttgctctgca

SEQ ID NO: 36821 - DNA, 30 bp, Homo sapiens
  chr17:78449720-78449750
  hyper
tggccgggtagggaacggggtgggggaggg

SEQ ID NO: 36822 - DNA, 880 bp, Homo sapiens
  chr17:78449963-78450843
  hyper
gcgtgctctggctctcgcagcggcccagcttggcggtcagctcgcggatggtctccttctggctcaggatggtctccttctgctgcagcaccgtctcgcggagctgcagcacgctgctccggagctcctcggcgccgccggcggccacggacgcggcgcacatgtcggcgtccacgggcaccgaggtgcagatgaagcgcgtcggcccgaaatcctgggccccggcgcccaggaggcagagggcgagcagcgcacaggtgcgcgcggcgcggccggccggcatggctgcgggcaccgggcgctccgggcccggctcggctcggctggggctcggctccggctgggacccggctcgggctgtggctccgcgagcggcccgcgctctgggcgccgcgctcttcggccgcgcggtccacaccgccgcgctatcaggcccccactgccgcctgcgctgcggagcccgcgccttttatgccgccgcgggaggggcctcgagccgccgacgtcagcgggggaggaatcccgctttaattgtccgcggcccgggcccgcggcgcggcgggggtctcacgagcgcgccaccggggctgcctccgctcgcgtcccccccgcccttctgggagctgccgcggccccctcctcccccgcccccgcctgggccggcgctgctgccccgaaggctccgagagctcagggggaaggaagtcgggctccggccccggactcgaggatggaccacctgcgtggtgtccccgaacctccgacggggctccaggcgggcgggaaaccaccgcgtccgggagatagaattcggttcggccctcctggctgcactgaacacccttgggccggggtcgtttggagccgggctgggtgccca

SEQ ID NO: 36823 - DNA, 477 bp, Homo sapiens
  chr17:78451477-78451954
  hyper
gcggggctcggctcccgagatcgcggtccgggttccggcgccgggctgggggctcaggaccagggctggcgcagccgccccgccccgccccgccccggggctatcagagcggtcaaagcctcggaaatccctccgtccacgctcccgtggtacagagaaggaaactgaggctccgagactgcggggccgggctacagccgtggccccccgacccctccccgccgcccccggcttctctggtctctgcgttctgcagcctttccctgcgcgcagccgggggctgggggtccccagccagcagggacccacgggcagtcccgggtgccgggatcgggcgtccgcccctcgggcgggagcagaggccggctcgatggagacctttttgagaaatggcggcctctacccgccccccagcccccgagcgcccgccgtctgcgttcagcatctcagcttttaagcctccctgagccggggctg

SEQ ID NO: 36824 - DNA, 232 bp, Homo sapiens; identical to SEQ ID NO: 12930
  chr17:78452108-78452340
  hyper

SEQ ID NO: 36825 - DNA, 397 bp, Homo sapiens
  chr17:78452549-78452946
  hyper
agcggcctggcacctcggcacagaggagcgtgtcccccttccgcagaggaagggagtggacggcgtcagaaagggaggggagcctggggcggtgtctggggctagcgggacctctgggcactgtggggccccaggagaggagaccctcgggtccagcctgcaactgttgtgcaggaggcgctgggcgggacacctgcaggcgctgcacacacacgcgagggccaccatgccgcgtttctccttcacaagaccctgggcaagcggagggtcgtatttaggattccctcggcctccccagtgttctgaaagtatctgagagggagggagcaggaaaacgaagggccgccctgcccaaactcatcggggtgtctggttactaggtcggaagaggggggat

SEQ ID NO: 36826 - DNA, 45 bp, Homo sapiens
  chr17:78978134-78978179
  hyper
ggctgcggctggacccggctgcgcggggcgcgaggctgcctttcc

SEQ ID NO: 36827 - DNA, 81 bp, Homo sapiens
  chr17:78978379-78978460
  hyper
cgccccaggatggggcgcggggagcgcgctgagctgtcctttcccgcagcggccccgcggttgaagcgtgggcttgggttt

SEQ ID NO: 36828 - DNA, 66 bp, Homo sapiens
  chr17:79316947-79317013
  hyper
tcaccagggactctccgttctcgctcccgaagaggggacttgcgcggacggcgaggaggatcgatg

SEQ ID NO: 36829 - DNA, 57 bp, Homo sapiens
  chr17:79317833-79317890
  hyper
tggctttggtgcaggcgggtgtgcgctccgagcgtctttcggcgggggggagggggg

SEQ ID NO: 36830 - DNA, 15 bp, Homo sapiens
  chr17:79615121-79615136
  hyper
cgaacctggctgcct

SEQ ID NO: 36831 - DNA, 121 bp, Homo sapiens; identical to SEQ ID NO: 12933
  chr17:79761692-79761813
  hyper

SEQ ID NO: 36832 - DNA, 376 bp, Homo sapiens
  chr17:79761833-79762209
  hyper
cgagtctgcgtatggccggggtacgaggcgctccctgcgcagggtgggcaggaccgaagctcgccgggaggctgcgcggagggcgggcggggaccctcggctgccgctcccacccccgcggggccgcccccgagcccgccctccgccgccgccctcgccctgcgtcgccgccggaaagtttgcaccgaccccgatctggcagcgccgcgaagacgagcggtcaccggcgcccgacccgagcgcgcccagaggacggcggggagccaagccgacccccgagcagcgccgcgcggtgagcacctgggccgcggccccgaggggacgttggggagtcgacccggtggggacagagaccgcggggcgggcgcggcggggc

SEQ ID NO: 36833 - DNA, 164 bp, Homo sapiens
  chr17:79762474-79762638
  hyper
cgccgccctggggagcgcacaaagcgccgcggacgcgtccccgaggcgcggggtctcaccagcgctgtctcccctcggtgggctcctgccccgaggactgcccggtggcaccggcgcggcccaggatggggtgaggggtgtctgcgccccgcctggccgctcct

SEQ ID NO: 36834 - DNA, 86 bp, Homo sapiens
  chr17:79859940-79860026
  hyper
cttgcgcgcctccagcgctcgcccgcgcggctggttcctttgggatgcggaggtgcgacggctcctccgcgcgcgcccgctgcacc

SEQ ID NO: 36835 - DNA, 185 bp, Homo sapiens
  chr17:79860488-79860673
  hyper
cccccaggctgtgtgcgtccaggacgtcgccccaaacctgcagaggtgcgagcggctccccgacggccgcgggacctaccagtgcaaggcgaacgtcttcctgtccctgcgcgcagccgactgcctcgccgcctgagcccggacctctcctggcaccgctgggggccccccgcccccaccgtccc

SEQ ID NO: 36836 - DNA, 34 bp, Homo sapiens
  chr17:79918595-79918629
  hyper
ccatgttaccctccacggccgtgaagtccagcgg

SEQ ID NO: 36837 - DNA, 41 bp, Homo sapiens
  chr17:79988475-79988516
  hyper
gccctgcagtgatggcgagcgaccaccgagaggcgctgctg

SEQ ID NO: 36838 - DNA, 82 bp, Homo sapiens
  chr17:80188720-80188802
  hyper
gccacgccgggcagccgcacgcaacggaaccgaaccgccgggctcctgctccgagacccgcagttcacgagtcgacgccccc

SEQ ID NO: 36839 - DNA, 718 bp, Homo sapiens
  chr17:80329283-80330001
  hyper
cctgccccccacctgcgcgcgggcgggtccagggcttggtggacacggagaatcccaggctccgtgccctgcaaacacgggcgtgaggggcgcaggggtgaacgctggaggcggagaacccaagaggggctgcggggtcagccttggggcagccgggctggaggcagcttcgctccgcagacgcagacgcgagacccgcctgggaccctccgccgaccccgctgcggccccgcgacccccgcgtcttcccggcgccgcgcggtcagcgccgccccctagacacccggcgccgtcccctccgcgcgcctgctgcccgctggggttattttaataccgggccctggcgcggggcgcggcgcattcccagctggcggcgggcaggtggcggcggcgcagagacccggcgcggggcggggggcgcggctttggtggcgggactggcgggcgcccctgccgtgtgctctggaagccgaggccaccgcggagcccctcgcgccccctctgcgctgggacaggggagcgcgcctcggaaagttccccgcggccccgctgcgcgaggagtttggagccgcgagcggctgcccccacgcgcgaccccaggctcggcgggcaggtctggccgctcagtgaccggaggcaggtgggtcctcggtgggtgaccgggagcgcgcggggactgccgggtctgtgcccttcggggccctccgcagggctgggc

SEQ ID NO: 36840 - DNA, 45 bp, Homo sapiens
  chr17:80330164-80330209
  hyper
cgcgcacaactggggagcccggtgcaccctcggcttctgcgccgt

SEQ ID NO: 36841 - DNA, 177 bp, Homo sapiens
  chr17:80333064-80333241
  hyper
gcgccgcggacggcgcgcatcgtcaactacctgaccacctgcctcacctacggcaacagctgcgccaaccccttcctctacacgctgctcaccaggaactaccgcgaccacctgcgcggccgcgtgcggggcccgggcagcgggggaggccgggggcccgttccctccctgcagccc

SEQ ID NO: 36842 - DNA, 1221 bp, Homo sapiens
  chr18:500042-501263
  hyper
cccggagaaaacacccggccgccagcgcggggaccgctcgggccgggaaacggctagaggcgggaggagagaggactgggcgagcgtggggagcgctgcggcgtggaaaagcgaccgggagggatggcgatgcctccactctcctcggcaggttttttcaattaaaaagttggaaacgggaatccgtaaacaacgacttagggcttcaaactacttgcaaagacgcgatggggaggggaatacttgcgcgcttcaaaaccccaacctcgaggtctccagccgcgcctgacccgggagccgggtgcgcccccagtgtccgcgcacgaacccggcgccctggcagccccgactccccgggcccgcagcccaagggaaggttcgcgcgggaggcacctccgtggcctcccgcgcgccccgaagcccgttccccccgcccagagccccgcggagctgccgccgccctacctttcatggtgaccgtggggacgcaccgccggccggggagctccgcgcgagcgccgcgcagccgaggaagtcgtcccgagcggctgctcaccgcacgcccatggtagccgcgccgcgcgccggccgtctgcgcccccgtcctccctcgccgccgccggcccgcgctccccgcgctcccggctccgcgctctgctgcctcggggctgccgcgcgcgccgctctcgctctcccagcgcccctccccctggcccgacccggccgagcgagcggccgcgcccacgcccctctcgcgccctcccgcgcccgccccgccctcggcccgcgcctgccctcgccgggcactttctcgcccgccctctcctgcgcgccctggccccactcgcgcgggctctctctttttcccgttgcaccagcgtcgggatgaagtcgggagcaaagcccttcccggggcggtccagcgttcaccttcggcgagcacctaaggtgccgctgctgctggggtcgcttctacaccccaaactacctagcaagtgttgggcgagaggatggggagctgctgtgccccgggggtggcggggggtaaggtgggcccttccccaaacggctctggggcatggagaggtacagaacgtcctccgggttcagagtttccaagtgcgtgcgctggttgacgcctgaaggagaccaagcagcagggaacactctctctgtcacccagggagagcccgagtggccagaatccgaagtcaccattag

SEQ ID NO: 36843 - DNA, 96 bp, Homo sapiens
  chr18:903748-903844
  hyper
ggtggcaattttcaacgtttgtagcatctgttaccctacacttcagcacccggagtctggacagctccgcaggccgcgctccggaggcagcatgag

SEQ ID NO: 36844 - DNA, 358 bp, Homo sapiens
  chr18:904374-904732
  hyper
ttcatgaataaaaatcggagcgcaacagtgcaacaaaatattctgtacttaaaggcaacaggcaggcagatgttgacaaagagggctctccaaaaaccatgttcggatagatttttgcgaactgcacagataaataggagcagaaggccggtcacctctgtaaccagcggtagcagcagcagaagccgcagcttcagaggcagccggagagacctcggagcagagaaggcgccgccgaccctcgcggctgcctggcccgcggctcctacaaaggcgggctagccgcccgccctctcccttgccttcctccccttcttttctgactttccctctttcccttaatcgcctgcttcttcct

SEQ ID NO: 36845 - DNA, 115 bp, Homo sapiens
  chr18:904991-905106
  hyper
aggaacttgaagaagcgctttgcccgccgtcctacctggcagctctcctggcagcgggaggagttgaagggtaagggagggaaaatcttaccaaagcgaccggctcactcgactg

SEQ ID NO: 36846 - DNA, 177 bp, Homo sapiens
  chr18:905713-905890
  hyper
ggcagctcagggtcccgggtagagccagtgagcttctggccgctggagaaccccccctcccccaacccggcccacaggatgggggcagggcacggcccctagcttggtttcttttacctattcttgggacgagttaggagaacttcagctctggagcctggccgggggttgagcgtg

SEQ ID NO: 36847 - DNA, 699 bp, Homo sapiens
  chr18:906208-906907
  hyper
cagccctgcctggcccgggatggaggaaccttggcttttttcttaaccccgggtttctaaccggcaggcgcggcccaggttcccggaggcagccccagagtcgcggaccgatgtgccaggctgtggatgagccctgggtaggggagggttcgtaccagcggcgcctggggcagcgaggagcgcgcgttctgcctgcgaagctgccttctccgagccccgcccaggaacattagctctggggggccgctgatcattgatttggacggagagatgggttctgggttctgtattaggattccagcatctgggctcgaggcagggcaatatccagaaagaccccagggttcggggtacccgggccagggctgaggcgcatcgccgagcaaaggctgggtgcgaggcgtgcggaatgatgcgcttgccttgcccgggcctctccaaggatggagaaaaggcgagtgaagcagcgaagtacgactccaaccccgcccagagagtgctactagcgctggctgcacgccaagtctctccaggggtccaaagcgagagggatttgttttaacccatctctacccgtcctgtgtcaagaacggaggctgtagagggcgactgcgaagtcgccaggcactcgctggatctcggtccccctcctcgtgctctggggttgagatggggcaccgccatcgataacagatcagc

SEQ ID NO: 36848 - DNA, 380 bp, Homo sapiens
  chr18:907314-907694
  hyper
ggctcgggagccaggcggggaggggggcggtccttttccgtagacaggtgtgcgcgatcggcggagacgcctcggtttcccagcgcttgttgaggccgtggcccgcaggacgaccctttacccgcgaagggggggtgggcgggccgcccggcggggtaggagtggttgggtgtcgttgcctcctccttacctctgctcccacccccagtcctgggagaagagacaattctcagcggaggacttttatcacctgtgaaaatccgcgcgagccccttactttggatcctcgccgagctggggaggaacttgcactgaccacaccttctgtccccggccaccccgcaggccagaggaagaggcgtacggcgaggacggaaacc

SEQ ID NO: 36849 - DNA, 256 bp, Homo sapiens
  chr18:907721-907977
  hyper
cgccgggcgcagggagccccgcctccgcgccgcgcgccgccgccgcctggtaccgcccggccgggagaaggtgagattcgcgcggcctcgcgcacacccgcggctgggagctcgggactgcggtgacgggaggggcagtgtggtgacccacccaggatttttttttttttcccgtgaaagtcctcaagcctgtcctctccctggcccgatcctattgcagcgacagaaaatcagcagcgggcgggtctgtgtggac

SEQ ID NO: 36850 - DNA, 87 bp, Homo sapiens; identical to SEQ ID NO: 12948
  chr18:908432-908519
  hyper

SEQ ID NO: 36851 - DNA, 15 bp, Homo sapiens
  chr18:909070-909085
  hyper
actttctctgtatgt

SEQ ID NO: 36852 - DNA, 106 bp, Homo sapiens; identical to SEQ ID NO: 12949
  chr18:909183-909289
  hyper

SEQ ID NO: 36853 - DNA, 414 bp, Homo sapiens; identical to SEQ ID NO: 12950
  chr18:909318-909732
  hyper

SEQ ID NO: 36854 - DNA, 221 bp, Homo sapiens
  chr18:961763-961984
  hyper
catcggaactgtcaccggcataatttcgttgtttttaacttttcagttaaaaaacttttaacttttcagttaaaaaagaaagcaagcgttctttggctgtctctgtgccggatgcagagggcacaactgctctgtggcacagccctctgtgatcggccgcgtgagggtcctgtcatcttgtctttcccttgtttcttccttcagggcgctagggacaccac

SEQ ID NO: 36855 - DNA, 372 bp, Homo sapiens
  chr18:2846451-2846823
  hyper
ccccccgcgtggcctcggaaactgtcagatggtgcctaaggcagagttgggcaaagaaagaaccagcgttcgtttcctcctggactctctaggtccatggagctggtgggggaacggccctgtcttgcccgaggaggaaattcgagtcgagcccccactcctctccccgcgggactgataaacatgtccctcattcgccccgggaggctggcacccaggcacgacgcgaggacggccagactcgccgacggcggccgcgtcccggggggccgggagcgagcctgtcggaaggtgggaggcggagtcgctcggcatctgggaagagaccaaaggaatgagtcattggaaatgctgtaacgtagacccttatcc

SEQ ID NO: 36856 - DNA, 190 bp, Homo sapiens
  chr18:2847026-2847216
  hyper
gccggagggggcggccgcggagcactggttggagcgccgcgaagcgcccgagcctcttgccttcgcgggcggcgccctggccgccggcagccttgtggccggtgccccgatccgccgcgctccggacccgggcaggcggggcgcgcccgctgcgcgcgggatgtggcagcccagacggccctggccccgc

SEQ ID NO: 36857 - DNA, 601 bp, Homo sapiens
  chr18:2847537-2848138
  hyper
cgggcgatccgaaaacgactcccaggaattccatgagcccctgggaccatgggtgcttttctttcccgtcttggtcgggtccaggcgcgcgctctccagaggcgcacccgggcaccctccggcgtctgctcggtgaagctcccgcctccgcagagggcgacgggcccccccgaccctcgctcggtctggtgccgcagtcccctctcccctggcctcattgttctccgggtttaccccgtgcccctctccctctctctcctgcaccccaggaactggtgcgcctacatcgtgaacaagaatgtgagctgctccgtgctggagggaagtgagagttttattcaggctcagtacaactgtgcctggaaccagatgccctgtccgtcggcgctggtgtaagtcctggagccggggagcgggcggggcgcgcccgggccggggcggtgggggtggggtggggttgctgcgctgggctccagtccctccggtaaatcccttccagatccggtgaaaagcccgcagcggaaaagcgctccgagcgctcgcggggcaccggccacgctgggctatttagggagtgggtgctgcccgagtgagtggggag

SEQ ID NO: 36858 - DNA, 89 bp, Homo sapiens
  chr18:2906054-2906143
  hyper
cggcggggatggcgtttcttggcgagcgggtccctcagccaggcccgggtattgtcaggcgtcccgtggacggtcgggaggggcttcct

SEQ ID NO: 36859 - DNA, 30 bp, Homo sapiens
  chr18:2906366-2906396
  hyper
gaggccgtggggccccggcaggagtgtggt

SEQ ID NO: 36860 - DNA, 310 bp, Homo sapiens
  chr18:3499061-3499371
  hyper
gacagtggaagtcaccgagctcgggagcggacgggctcggagggggagaggcagccggcagaggagcggccgggggaggaggggacagatgcttggcggcggcggccgggctgcggggcgctcagagccgggtctgcgcctcggggatgtagatctcgatgctctcggcgctctcggtggccgagttctggcggacggacgcggcgcgcttggcggccatcaggcgcttgcgggcctcctggcgctgcgagctctccagcgagcgctcccggatcagcggcgcggggcccttcgccggcttctttggcac

SEQ ID NO: 36861 - DNA, 42 bp, Homo sapiens
  chr18:4453666-4453708
  hyper
tatcctcaccttctacgaagccattcacgaagaccacaaaag

SEQ ID NO: 36862 - DNA, 306 bp, Homo sapiens
  chr18:4453922-4454228
  hyper
taaccccttgccctccgcacatcctccccttctctagcagaaaattccgcagcgctacggtcgggctggaggcaagccctgcagccgggggcgagcgcggcactcggacacaggcactcagtgtctccggcgccggcagccgagccacgggccaccccttcccacggcctcccggtgccacccagcgaggccgggacagcgcgccttccgcaaaaagcgcagcagccgaagtcctgaaagcagggtcttcatcgccgcgggccctccgaaggtgcctctcccagctgcagccgcccctcaatgaaa

SEQ ID NO: 36863 - DNA, 24 bp, Homo sapiens
  chr18:5196235-5196259
  hyper
agagacagcgtcggacgttcacaa

SEQ ID NO: 36864 - DNA, 373 bp, Homo sapiens
  chr18:5196575-5196948
  hyper
cgcctccttctcctcgggaggccaggaggacccgggtcactttgccaattctgcggagggggaagtagcagtgagggagattcccacgcaagtagcccgaagcccactactctttgccccacctctccactctcttgcccgtgtaggtgccggtgctgctggcgaaagtcccagttcttaaggctcctgagctcggaaggggtgtggaggagccagatgggaagagaagcagcgggacgagggcgaggaagggctggagattgttagaggacagatggggcgggactggggagaggggcgaaggcgacgcgccgaggcactcctccgccccatgagcacagacagtaactccgaaacgcgcagatgggccgta

SEQ ID NO: 36865 - DNA, 70 bp, Homo sapiens; identical to SEQ ID NO: 12958
  chr18:5197202-5197272
  hyper

SEQ ID NO: 36866 - DNA, 430 bp, Homo sapiens; identical to SEQ ID NO: 12959
  chr18:5197329-5197759
  hyper

SEQ ID NO: 36867 - DNA, 175 bp, Homo sapiens
  chr18:5542983-5543158
  hyper
cctccccacccccaccgcggcagagccgccttcgcagacacctcccgaggagaatcgcggccccgagggcgccaggtgagtcgcgccgccccgagcccccgggccacggcaggccgacccaggcgcccccggcccgcccgtgctcccgcgcccgggtgccagaggcgaggggccc

SEQ ID NO: 36868 - DNA, 270 bp, Homo sapiens
  chr18:5543899-5544169
  hyper
cggaaaagttacctgggatcagcagggagcccgggcgcgccgcggcgtggggactaggctcgggcgcgcgtcctcggcggcggtgcgcaggagactcgggcgtggggaggaagccgcagcccagggctgctcgccgctgttccccccgccccctgttgcaggagacaccgaggctccgcggagctgcggcgggggcccacgcccagagaccgtgcgaggaaagccaacctcgtcctgcctgccctcccagccgcgggggagggggccacc

SEQ ID NO: 36869 - DNA, 77 bp, Homo sapiens
  chr18:5544170-5544247
  hyper
cagtacttcaggacagttacatgggcacagcctcctccgtcctggcgcagggtcaggctccgcggacgacgcctgga

SEQ ID NO: 36870 - DNA, 259 bp, Homo sapiens
  chr18:5628082-5628341
  hyper
cactggagcccaccccgctcctacgccgcaaagcagcacaattacagcctgggaggggcaagtcttgcggggcccgtcggtaactgccattatttgaatgcgatataggagatcccacatagaccctgctctaccgggttagaatctgtttctaatcacgtggaatttagatttaaaccacagttagatttgggatttaccatcgtttctactttcattcatttagtggcttccagccctctcgcggcccagtcttaat

SEQ ID NO: 36871 - DNA, 579 bp, Homo sapiens
  chr18:5628792-5629371
  hyper
cggctcaacttccagcgccactcgggtgccccgagcccgccgcagctcccggcgcgccctccagccgcggcacgcagcccctgacgcgcccggggcgccctcccgcagcaccagccaggccaccccacctcccgcgccgcgcttccccgccagccgccggccaggagctccccggcttctgagcaggacgcgccaaagggagttgggaggctcagcagcccccagcgtcgccttctcgggtgacgtgacgctctctctggagcgcgggcccgcctccgccaagcctccaccgcaggtccttacagccgagccacgggaagatgcaacgccgggcgaggggcgcctcccggattttgaaaaacagcctcattcgcctcgggaacgcctcgatcccccacccgcaccctttggccagatgattttaatcctgggattccgcgttggtcgtgggggtaccgggagctggagctggaggagaggagccggcagcgcggagttgccggggtgcagctgcgcgcagctggcggcgaggggaggcggtccctgcggctccgccgggctgggggaactggctcctgc

SEQ ID NO: 36872 - DNA, 112 bp, Homo sapiens
  chr18:5629372-5629484
  hyper
cctctgcctcccggaggatcgcactcgctcatccttacacaccacacacacacacacacacacacacacacacacactgccgctagcgccccccacgccacaagccggaatg

SEQ ID NO: 36873 - DNA, 257 bp, Homo sapiens
  chr18:5629569-5629826
  hyper
cgaggttcgcaccttcccggaaggcccccccctcccccgcgtttccccagggcgagcaaggtctagcttctgagactccgctctctgggctagcggttcgagctgcaggggggcggggacggattcggagggagcactagagagagagcccgcgctcactcctgccctcctcgcaaagaactggccagccccactcgcgtccagcccacaactaggctgccgggaccggggagccagaccccaggtcgctccaactc

SEQ ID NO: 36874 - DNA, 399 bp, Homo sapiens
  chr18:5630256-5630655
  hyper
cgctttctcccccatcgacctcgagccaagggcaggcggcccgcacccgcgcccctgcccacggggctaggcggcgctcccggcctacgcccggctgccaagaagagaaaggcgctcacctgagtcaccgaagccttcctttggggcccctcccggagcttgttcgcagcccgcaggcacaaccttccttggagaaaaaaagtagcgcaagggcagagagaggtagggctgctcacaggtccctccgcaggggctctttccttcgaattctccggggtccagtctcgggctcggcggcgggaaagagctcctggaggctggaaggggccgccagacccgggctcctcccgcagctgcggtggcggcacctccaagttgccacctgcagcgcgcttcggg

SEQ ID NO: 36875 - DNA, 105 bp, Homo sapiens
  chr18:5630693-5630798
  hyper
cgccctccccgtccgctcgttggctgcgcccggtgcccgggcggtccccgcgctctgccccgccctgagcccgcctcccagccgcgcgctcgcaaagtatgggtc

SEQ ID NO: 36876 - DNA, 85 bp, Homo sapiens
  chr18:5891336-5891421
  hyper
ggggggcgccgcggcgggggcagacgacgacgaagaggcggcggcggccgcggcggcggccgcggcggccgccaggtctttggcg

SEQ ID NO: 36877 - DNA, 32 bp, Homo sapiens
  chr18:5891443-5891475
  hyper
cggtggagtagaggtcccgcaggttgatgatt

SEQ ID NO: 36878 - DNA, 88 bp, Homo sapiens
  chr18:5894858-5894946
  hyper
ctgggcagcgcatcccgtgtagccagcccgggaaaaagcctctcaccgaacaccagcccggggcgcggggactcggggacccgagggg

SEQ ID NO: 36879 - DNA, 510 bp, Homo sapiens
  chr18:5895017-5895527
  hyper
cgctcacttacccagggagaccgagggaggtcggggccggcgaacgggcgctcgggcgacacaaaggaaccatggagaaactttttcagcccgagccgacggcggagcgcagggacagcgccccggggccccgcatccgagcgcgactcagcagccccgcgggggcgagcgcccgccccaggctcgcagtccccgccggcgctgtggcgggagccatttccaagagtttccaagaagtgtcaggtcctccgcatcccgcatcccgcatcccgcctcggagccctcctctccgccgctcatcctccagctcccggcgtcccctagcgcggcgctcccgggcgggcccctgcggccgcgccgccggccctcgcgcctcttttgtgtggctgcggcgcgccgggctccgccgggtggagttgagcccgcggcggcggctcggggcggccggactggcggctgttgctaagagaccggagccatgacacagggaaattgcggcagggtggcggt

SEQ ID NO: 36880 - DNA, 297 bp, Homo sapiens
  chr18:5895739-5896036
  hyper
ccgcggggcagggggcgcggggtgcctcctcggcctcggctctccccgccccggggcgccccgagaccgccgcctgcctccgcgggcagctttgttcttctttcctccaactacctgtctgagccgcgggccccagaggccccaaagagaggcccggagggtctccccagcagcatccgaggggcgctctcggggagctaggggccagagtccgcggtccctccgtgcctgcctccctcccctcgtgcctcggtcttttgttgcctctactcctcggcacggcgcagcctgggctct

SEQ ID NO: 36881 - DNA, 173 bp, Homo sapiens
  chr18:6414507-6414680
  hyper
cgaggcgccgggctctgcggcggccgcgcccgtccaaagtaggcgacaagtgaggcagcgcctctcgcggggagcccggcgcgcgccccggcggcgaaagagaaagagaaagagcctgggccgggaccggggctatccccaaccgccaccgcccccaccggcccggccctcgc

SEQ ID NO: 36882 - DNA, 130 bp, Homo sapiens
  chr18:6730009-6730139
  hyper
cgccttgtgcctgagcgcacgaccgccgtcactggatgttgtttcaagttttggtggactagatgagtgagcctggggttctttgcattgtctttgactggaggtgggaaacgctcgaaggctccaccag

SEQ ID NO: 36883 - DNA, 32 bp, Homo sapiens
  chr18:7116490-7116522
  hyper
aatgaatgagatggtcgcgtttctgcagagct

SEQ ID NO: 36884 - DNA, 170 bp, Homo sapiens
  chr18:7117059-7117229
  hyper
cgcctgcgggtccccctgcccgggacggctggctaggggcgcccttctcgccgcgtctctccccactagcccgcttggctgccaggggccccgaggaatccgccctttcccggccgccgcgacccagcttgcgcagccggacaatgagggcgactcgggagagctctttc

SEQ ID NO: 36885 - DNA, 21 bp, Homo sapiens
  chr18:7117615-7117636
  hyper
cgcctgcgggggacagggacc

SEQ ID NO: 36886 - DNA, 224 bp, Homo sapiens
  chr18:7117867-7118091
  hyper
ggctgcgccccgccccgccccgtcccgccccggcttggccccgccacccagacccctcccccgggggcgcccagcttggcctctgggtcccggcgcacgcggaccccaagtcggggaggccgggctgaccgcggccgcctccccggctccgggtaggaggtgggcagagaaggtgggctgaggggaggagaaactgggctgcgggggtccgggagggtggattc

SEQ ID NO: 36887 - DNA, 46 bp, Homo sapiens; identical to SEQ ID NO: 12973
  chr18:7118131-7118177
  hyper

SEQ ID NO: 36888 - DNA, 174 bp, Homo sapiens
  chr18:7566582-7566756
  hyper
cgcttcgggcccacacgggacaccgaggcatgatgaggacgcagaacagcagaagcgcgccctgcttcccgggcgccagtgctcggggccagcggcgtgtacccggcgggcccggccgggagcgggctggcgatcgcggggctcggcgctcccggctcccgcgccatctcccgg

SEQ ID NO: 36889 - DNA, 263 bp, Homo sapiens
  chr18:7567072-7567335
  hyper
aagacgcggccggggcgaggaggtgggcggggggagcccggtggccgctcctccccgcgcggctgacgcccgcttcggcggcggtagtggctgtggccgcggggccgcccccagccgagctcccggaggcgctcgggcgcgggccggcggggcacgggcgctcacgccctctagcgggccgcggcggcgccgggcggccgtgacgtgagcgctcccttcagccggcctgcggggcaccgccagtcagtcggggagcaagagcc

SEQ ID NO: 36890 - DNA, 446 bp, Homo sapiens
  chr18:7567754-7568200
  hyper
ccctccgccctcgcgcgcccacccaccgccgccggggagcggcccggcccgcactcagcaccatgaggggacttgggacttgcctggcgactttggccggacttttgctaactgcggcgggcgagacgttctcaggtaagcgggaccgcctctgccgcccccgaggcgcgcgggccggcgcgggacgcccgggacgccgacagctccctggtggtagagccctaaggctggcgtcggggccgggcggggggcgcggcgggccggacaccgcttctgcctgtgagccgggcgctgggcgaggggccgtggggctggcaggcacccagtcctcgggcgggcggagcggacggaccccgagggcgagctccccagccgggactgccagctcggccgccgtccttccgcggcctgggctagtgctcaaggttgggcggcttgcactcttg

SEQ ID NO: 36891 - DNA, 139 bp, Homo sapiens
  chr18:7568400-7568539
  hyper
ccctgccctccctgtcgccccctgcccggcgcggctggcgaccccgggaggtccccgcggtcgtgcagcgtctgcggagaggctggggggagttcctcgccggtcccagcggtagggcttggcggccgcggagggaagc

SEQ ID NO: 36892 - DNA, 96 bp, Homo sapiens
  chr18:7568540-7568636
  hyper
ggcaggtccccaggccctggccacggccctgcgccccgctgggctccccctccccaccctcgtccccctagcggagcgccgcggccagctgcaact

SEQ ID NO: 36893 - DNA, 90 bp, Homo sapiens
  chr18:8608748-8608838
  hyper
aaaaataactgatttcgcgcgtttccgtgcaaaatgggagacagacgtgacggagagagaccgagcagtgccacggcccggtagagggtg

SEQ ID NO: 36894 - DNA, 81 bp, Homo sapiens
  chr18:8608901-8608982
  hyper
cggcccggcggcgcggcctcaggtcggggcctttccagcgttccagctacaccgagcgcgcgggggcgaaaacatgtgcat

SEQ ID NO: 36895 - DNA, 101 bp, Homo sapiens
  chr18:9708380-9708481
  hyper
ggcactgcctggctgcgagcacatgatggcgatacgggagctcaaagtgtgccttctcggggtgagtcctggccgccacccgccggcggaccccggcccgc

SEQ ID NO: 36896 - DNA, 549 bp, Homo sapiens
  chr18:9708821-9709370
  hyper
gggacggggcagtggcggcgagtctggggccccgagggctttctcctccgcttttgatagtttccttccggcagaaagtttaagttgctcagccaagtcgctgagtgctcttttgcctcctgggggcaattgatttactcacgtaaaacagaaaaataaaaccaaaagcgaacccagccaagggggtgaaagccgagggcgcggccggggtggaaggtgaggcagtgacctgtgcggagcgcgccctgcaaacttccctgctgcgggtgaaagaagctgcctgggaaagtcctccccaccatcactcccctaaagtggggttttctccgcccgaagaagccttaaagcagccagaaacaaaaaagcagtcaatccgtgcggcccggggactgcagacaggggacccggcgaggacgcagggagccgctggcgaaccgcccctgggaattcagataaacgtagggtcgcttcctttcgggggcccactccgcattccagaattccttcttctaaaagaagagccggttctaagggcgttttcagcagcca

SEQ ID NO: 36897 - DNA, 30 bp, Homo sapiens; identical to SEQ ID NO: 12980
  chr18:9771739-9771769
  hyper

SEQ ID NO: 36898 - DNA, 456 bp, Homo sapiens
  chr18:10454714-10455170
  hyper
cgggcgcggagaagtcggggcgggcggcagagaggccgggacgcggaccgggccggggcgcccacagccgcccgacggcgcccagagagcgcgcgccccgcagccccgcgcctagcccgccgggcatggggcgcgcggcagccgcctgaagccccggcctggcccggccgcacccggccggaggcggagggcagagcgcgcgcccagttgcccgggcaccaaatcggagcgcggcgtgcgggaggccccagagcaggactggaaatgtcctggccgcgccgcctcctgctcagatacctgttcccggccctcctgcttcacggtgagttcccgagggccactcgagcgctcccagccggcggaggcagcccgggcgccgcggagcccgcggaggcgtcgggtctggatcgcggcacggcctacactgtccccttggcggggcgggtccgaggggag

SEQ ID NO: 36899 - DNA, 353 bp, Homo sapiens
  chr18:11148741-11149094
  hyper
cgagggcacgctcccggggctcttggccgcccctcgcccaccgggctctgggtagcccctcaccaggctcttggcggccacctagcccggcgcccggccccctgcggccggcccatttagtgtgaatcctggatccggcagcggcggcggcttcttcaggggtagctgatgccggggccttggagagggacgctttgggagggtcctgggaggcggcgcggcgagcaaagggggcaagaagggcgtgctgtgctcccgcctggctcccggggcgtcgtttgggggcggccggggagttttctacttggaagcccctctgaagccaccgcgtctcctttgcccggcctcgtctc

SEQ ID NO: 36900 - DNA, 141 bp, Homo sapiens
  chr18:11149115-11149256
  hyper
cgctctggcctcggccccggctctcggagctgcccggcgggctccgggtctcgccctccagcccccaggcggcccgcggcggatccccgagaggcagcgcagctcagcccctgcgccccccagcttcgggccggagagacc

SEQ ID NO: 36901 - DNA, 199 bp, Homo sapiens; identical to SEQ ID NO: 4519
  chr18:11149561-11149760
  hyper

SEQ ID NO: 36902 - DNA, 213 bp, Homo sapiens
  chr18:11149779-11149992
  hyper
cgcgggcactcctgccccactggctcccgcagccccgcggctctgcgtggttctgtcattccggtggtgcaccctggcatccagtccacccggccgggccctgagcttgcccaaacccagggaaccgtttaaggtccgagggaaacgcacaggcccggcaggagagaagccaggggcttggagagtcctgtgcgaccccgacttctgctgggt

SEQ ID NO: 36903 - DNA, 63 bp, Homo sapiens; identical to SEQ ID NO: 12986
  chr18:11751569-11751632
  hyper

SEQ ID NO: 36904 - DNA, 478 bp, Homo sapiens
  chr18:11752127-11752605
  hyper
ggcgccctcgccccccgtctccgttcattgtgctgtattcatccagcagattttgaaacaattctcgtgtaaaaaggcattttactccgcgcgtcttccttacagccatttagttgggagtttgcggtgggcagggggagggagaagaaacgcctgctctgaatcggaaaacaccgaagagaccagaccatctctttcagcagcaggaaagagaggagccgtcgcaggagccgcacacgtctccaactctctattgctttttgcgcacattcctaacttcctgacgtccatcccagcgggcaggcatggggtgtttgggcggcaacagcaagacgacggaagaccagggcgtcgatgaaaaagaacgacgcgaggccaacaaaaagatcgagaagcagttgcagaaagagcgcctggcttacaaggctacccaccgcctgctgctcctgggtaaggccgaggggcgcgcggcggctcc

SEQ ID NO: 36905 - DNA, 129 bp, Homo sapiens
  chr18:11752640-11752769
  hyper
cgccaggctgggcgggcagggccgggcgagggtcgcgcgcacctctgggccgcggagcccagacggcggccggggcgagctcctccagccaggaacccgcgtgtaggaaatccccgtgctgggggagga

SEQ ID NO: 36906 - DNA, 142 bp, Homo sapiens
  chr18:11947249-11947391
  hyper
ggaggaaccacaaaccgcgtagactcaggccagccgctgggcctgggcctgtgtgtccctcaggcggcgacctttggcccacttcaggccggccgtatttaccagcttagaggcgccgcggcgttggcgagtcctttttcac

SEQ ID NO: 36907 - DNA, 35 bp, Homo sapiens; identical to SEQ ID NO: 12991
  chr18:12253812-12253847
  hyper

SEQ ID NO: 36908 - DNA, 43 bp, Homo sapiens; identical to SEQ ID NO: 12992
  chr18:12254104-12254147
  hyper

SEQ ID NO: 36909 - DNA, 290 bp, Homo sapiens
  chr18:12254304-12254594
  hyper
cgggcgggggcggggccgccgcactttaagaggctgtgcaggcagacagacctccaggcccgctaggggatccgcgccatggaggccgcccgggactatgcaggagccctcatcaggcgagtgccccgcgtccccctgattgccgtgcgcttccaatcgccttgcgttcggtggcctcatattcccctgtgcgcctctagtaccgtaccccgctcccttcagccccctgctccccgcattctcttgcgctccgcgaccccgcgcacacacccatccgccccactggtgcc

SEQ ID NO: 36910 - DNA, 159 bp, Homo sapiens
  chr18:12287804-12287963
  hyper
caacgtggttcctcccgttgaatcaggttctgaccgagtccgctgcagctgcaggcgggggcgccctgccgagcagatacccagcggagctccggggccccgtttctactgtaagcagctgggggccaaatgtgcgcccgggcacgtctcttggcctct

SEQ ID NO: 36911 - DNA, 486 bp, Homo sapiens
  chr18:12307602-12308088
  hyper
cgcgaggagtaggctgcatagacccggcgcaggaggtgttcattttcggatccagccctgtagtcactttagctaaacccggttccaaaggggtgggagtcgtcggagaggaatggcctctgtatctccggagacggaaacaccaggacgaagaggccctaagaacgtgtgcccggggtgcgaccggggggtggggggcagggggcagagaccctgaaaagctccaccgccgaaccccagggcagtgtcccggcttggctggactgggcgcgggcggctgcaatgctcccgggcgcggcgctgggaccccgcgggccacgtcggctccgctgccccgacgccagggcccgactcgcgtctccctctggcggggcaccacaaggggcagcgaaacggtggtgggggcgggcgccgcgctccttcccgtctcctccccgccagctccgggcccgtccttttccgcccggctcccggcaagggtccccc

SEQ ID NO: 36912 - DNA, 30 bp, Homo sapiens
  chr18:12308897-12308927
  hyper
gtgtagcaggatgcccggccactcccttcg

SEQ ID NO: 36913 - DNA, 105 bp, Homo sapiens
  chr18:12911116-12911221
  hyper
gggcgcgagcgggagcggaagcgggcccgggccgcactgctgccgcgtctagccgcctcccaggctgcctgcgccgcgtggctcgcccccgggacttgccagcag

SEQ ID NO: 36914 - DNA, 350 bp, Homo sapiens; identical to SEQ ID NO: 1330
  chr18:13868570-13868920
  hyper

SEQ ID NO: 36915 - DNA, 307 bp, Homo sapiens
  chr18:13868946-13869253
  hyper
cgagcgcagggcacccggcccatcagctcttccttcacctgaactgccccggcctcgctgagacgcggattttaaaaccgccctgcacctatgtgctggcagccaggccctgggaacttcctccaaacactcccatgagttcgggatgactagcatcagttttcagctggagagcagacggcaactgaacgctgcgaagtcccacgatggggatgagaggaccagagccccgaggccagtcgcccccctcccgcccatccgcccgcccgcccgccacgcagggctgctctagcgcctgcctcttcct

SEQ ID NO: 36916 - DNA, 58 bp, Homo sapiens
  chr18:14450734-14450792
  hyper
cgggccagcatggagcggaagagcccgactgctttctggtactcgctcgcgcggaagg

SEQ ID NO: 36917 - DNA, 91 bp, Homo sapiens
  chr18:15198009-15198100
  hyper
agaagccgcggcggccgtggaaaaagtcgcggcggcaaaaagccgcagagtagggggcgaaaagacgcaaaaagccgcggcggcaaaaagc

SEQ ID NO: 36918 - DNA, 30 bp, Homo sapiens
  chr18:15198160-15198190
  hyper
aaaaagcagcggtggcgctgacaaaaagcc

SEQ ID NO: 36919 - DNA, 100 bp, Homo sapiens
  chr18:18821813-18821913
  hyper
agaagaccccccccccgcacgaccccctgtacacccccgcggggctgcgcgttcgtctgtgcggcggggtttgggaatggaggcgtgaggaccgcgcatc

SEQ ID NO: 36920 - DNA, 1030 bp, Homo sapiens
  chr18:18821914-18822944
  hyper
agggctccacaggctgggcggggggcgtcgttggaggggggtaggggagaaatgcgcgcccaccaccctcacagagggcgagggacccccaaaagccactcgcggacgccgaggcagcgggaaggcgcgaggcggggcggggggagggggcgcgggggtccccgctgcggaggccagggcgggcgggaggggcagcacctgaggaatccgcctccggctgcggcggccgccgcctcgctccgccccggggaactgagcgcgcggaccgcgcgcctgccagagagacgccagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgagcggccgcggggactccggggcgcgggcaggaggtgagaggtcgcgaaccgggcgcgggagctcgcctgtgaccggcaggagctgccctttggcgggctggacgccctggccgcgcggggaagcgccgcagcggacttttccggagggatgggaagctcagcgggggtgtgagcggagcgcgtgcgggtggcgagggagcgccagtgccaacctgggagccgtgcctgccttccctgccgcctcgcgtcgcccaccgaagggacccggccgtgctgtccgcgcccagaggccgaaggcctgtcaccgggctctactcgctgcctttgtggcgggagcgagacggcccgggggtgggacgagggagctgcggcgcgccgagtagcgcggggtcccccggcggaggcggcgagggggcacctggttcgtctccccgagcccaggggcagtgagggggtgccgggcaggcgggcgggcgacaggtagggcgccgcggaggtggcggggagaggatggatggagttcagcctgggaaagttgagaacgtccagaggtggctgggcgctcgctcggcgtctgtgggttttt

SEQ ID NO: 36921 - DNA, 259 bp, Homo sapiens
  chr18:18823227-18823486
  hyper
catgagtccaaggaacgtccccgaacgcgactcgtttgcccggaactgccgctgcctctaaccgaggctgcgggtcctggagaaactcctcagtcttgcccctttctccggtgaacgtgacggttccaaggtccttatcctccccacccactcctctggccccggctgagaggatagaaaccacattttaatttctgcttttcacaccgtaaggtgtttttttccgcctccccccgcctcgaggcgggaatccctgctt

SEQ ID NO: 36922 - DNA, 88 bp, Homo sapiens
  chr18:19748288-19748376
  hyper
tcctaaagtctccctcggcagccttctggggtcacgtctgtcggaagaaatcctttctgtaagcgaaagggagcgagacatatatcac

SEQ ID NO: 36923 - DNA, 60 bp, Homo sapiens
  chr18:19749864-19749924
  hyper
gcgcagccttatctccgagttatctcggcgcaaaggggcgggagccggtagttaggcagg

SEQ ID NO: 36924 - DNA, 78 bp, Homo sapiens
  chr18:20716572-20716650
  hyper
tgagtatccgggatgcgacgcgcacccaaccctgcgtcccgcccggcgctcccagcctccccgcggtctctgggctac

SEQ ID NO: 36925 - DNA, 88 bp, Homo sapiens
  chr18:21977137-21977225
  hyper
tctcccttggatattcgttcatgcttgtagaaccgaccacgcggtacattgggaaacggtcacatgaacaatgcgtgacttccattgt

SEQ ID NO: 36926 - DNA, 131 bp, Homo sapiens
  chr18:22928965-22929096
  hyper
aatgctcagaagctgcgagtgaacaaaactgccaatcgtgcaaactttaataaacttttttttttttgaaaagaaaaatccctcccaaattccttcacggggtttcagaagcttcttggagccctttccac

SEQ ID NO: 36927 - DNA, 533 bp, Homo sapiens
  chr18:22929186-22929719
  hyper
cgttactttcaagaaagccggggtctcgggcaagtctcgccggcgcgagcctggtccaccgttaccctgacacccgcgcacgcccgtggcgtttcttttttcactgtcgacacttggatctttcaggccctgggtctaggtttcccccagaaaaatgaggggcccatgtgacggaaaccaccagacacactgtgtggagacacatgccaatgattcacctcgttcccgaactaaaacttctgcgctttaggaaaaaagcaagcgttccaatctgcgaggccctcccccaccccgtcccttcccaggagaagaaagaaagggctttgtgtgtgcggtgagggctccgttcatcgagttcaaaaatgcacagcggccgggggccgggaggcgtggggcgccgggccctgcccaccccttttccccgggccggcggcgagtcgggaagctggtgcgggaaccggggccacggggcgccgcggcccggcagccaggaggaagaggatgctgcgccgccggggaccagagggcggggc

SEQ ID NO: 36928 - DNA, 357 bp, Homo sapiens; identical to SEQ ID NO: 4528
  chr18:22929926-22930283
  hyper

SEQ ID NO: 36929 - DNA, 894 bp, Homo sapiens
  chr18:22930284-22931178
  hyper
gtgcccgcggccggcggccggggtctgtttactccggcgacgtgcggagaggacccaagcaggacgcgggcgggcgggaggcggcggccgggaccccgggccacgtttgtcacgagcgggggctgctccccacctccgagatgacttttttcttcttccaaagaaaaggaaaaaagaagcaccgcacggttttgcatatttattctttgcgaaaacacacaacagaaactttttcctccagcccagatgtagatctcagacgggatatttttttttcctccctctccggataatttcgtttctttctctctctctctctttttttttttcggttgttgttgtcttttctcgcccactttctaccgccgccccattcggggatcctcctcccgtcttcgtctccccccaccccgacacctcaccctcactccacctaggggctcagcggggaggggagcgcgcgcgcccccgcactcacactcacactcacgcgcgcacacgcctcgcagccacgcagccctcgctccgctacccacagtgacactcgcggatgggggaaagcggggagcagggggttcctccttacctttgagggatctcggtttcgcttgcttgcggcgagacatcctaaaagcaaacagctgaagttgtttcaattcagccctgaaagaaactatacttcctcgtggccgcgcgcccctcgggccgcggcgcctcgcgccctccgctcggcctccctcgcgccctcgctccgcgctccgctcctcgctccggctccggctcgcgctcgcgcgcggggctcgcggctgcccgagctccgcgctctgcacgacggcggcggcggcggcggcggctgctgcaccaaactttcccagccttcgacccccaccccca

SEQ ID NO: 36930 - DNA, 187 bp, Homo sapiens
  chr18:24127943-24128130
  hyper
tactcccggaagatgcgcacggcgtagcgggtggccagccgggtgttctcgctcagccgggcccgctcggggcgctgcagcacgtcggggtccagctcggagccgtccccgggcggcccaccgcgggcccggggcgccagcagtcgcggcggcgcctcgggctccagcgcggcgctctggtccatat

SEQ ID NO: 36931 - DNA, 138 bp, Homo sapiens; identical to SEQ ID NO: 13008
  chr18:24130809-24130947
  hyper

SEQ ID NO: 36932 - DNA, 89 bp, Homo sapiens
  chr18:24131098-24131187
  hyper
cgcagtttgccggaggcggtgtgctgggttggacgctccgggaaacaaagcaacccaaaacagctcccagttgacgtcaacttatttcc

SEQ ID NO: 36933 - DNA, 479 bp, Homo sapiens
  chr18:24764644-24765123
  hyper
acaccctggaggacccgacagactggcagcagaaactaaagactgttcctgccgtcctctttccaacctctgcatgccccaagaggggtctgaccccggaatcctggagtccagggtgccccgccggggcgcaggaaggaaactcaggtagctgacaagttcaggcggccgtccttctccagcgccccctcaaagtcaggatcccctcctgctcccgccccccacctcccgccatgcgtccactgaagtgaagggaagtgggttggaatactggaggtaggggagatagaaaaaggaagaagcctcccgcatctccagcggcgaagcacctggaaaggtgagggcgcacgtccccgcccaccagagcccgctcccggcgcgggtacccagcagcgcgccatcatctctgcccctccagtgccccccagccccaaccccagccccagcgcggttacctcgcgggccgctgccgggcgctt

SEQ ID NO: 36934 - DNA, 37 bp, Homo sapiens
  chr18:24765383-24765420
  hyper
tctctccctcgcccccgctgcccgccctgccttctcc

SEQ ID NO: 36935 - DNA, 53 bp, Homo sapiens; identical to SEQ ID NO: 13011
  chr18:25755399-25755452
  hyper

SEQ ID NO: 36936 - DNA, 345 bp, Homo sapiens
  chr18:25756641-25756986
  hyper
gagcttgctcggccccgaagaaggagcagaggggacccgcaatccagcccctagagccccgccaggaaaggcgcgagagacctactggccccggcaaccctgccccggcgcccggacggagcccgatgcctgcgcagctaccggccgcgcggcgcggcgcggcgcggcgtggcacctcccttcccgggtgcgcagcccggccccgcagcggcgcggggaacaaagggacccggcgccgcccgccccaccccgcccgtggcccggcccgcggggaccgccgcgtacctgaagcagggccgccagcagcggcagcagggtccgcagcgctcccgctatccggcacat

SEQ ID NO: 36937 - DNA, 185 bp, Homo sapiens
  chr18:25757253-25757438
  hyper
gagctggggagggggcgggggaacagggagggagagcgtgtgagcgtctgcgagtgtgtggaggcggctgctgtggcagcgcaggcggctcggctccggcccggagcgcagcggaagccgcgagggatgcagcggcggggaccttggccggtggaggatgtggaggtggaagtggagcggatggc

SEQ ID NO: 36938 - DNA, 533 bp, Homo sapiens; identical to SEQ ID NO: 13014
  chr18:25757439-25757972
  hyper

SEQ ID NO: 36939 - DNA, 359 bp, Homo sapiens
  chr18:25758128-25758487
  hyper
cggggggtcgccggagggaagcctagagtgcgccgagcaccgccccggcaggtggaggggctgcgggaaataaaataacttgggcaggaacttgattggtagcaggttcatctttggtccgcggtagggaatctaatggagatgaagaatggtggggaagggggggcggtgtctccttgggagcctaacgtacgcttctttattttgtcattctttggagatgggtaatctttcctggcaggggcagacacagcaaactaaggacgcaggccaagctcatcctagctattgttgtctgaggcgctcgccgggagccacctgcgggcgggggagggcggaggccgcggctcctctctgga

SEQ ID NO: 36940 - DNA, 125 bp, Homo sapiens; identical to SEQ ID NO: 4530
  chr18:28620831-28620956
  hyper

SEQ ID NO: 36941 - DNA, 135 bp, Homo sapiens; identical to SEQ ID NO: 4531
  chr18:28621033-28621168
  hyper

SEQ ID NO: 36942 - DNA, 550 bp, Homo sapiens
  chr18:28621474-28622024
  hyper
gaagcagtaagaatccgcgagaccagactcggctcactgccgacgcgggtatagacctcgctcccatcggaccccatgcgcatccatggatgcgggtaagtcgcgggtccgcggctcctttctgggcgtgcggaatgaaactctgttgaagcctgaagcttcgcgtgtaaccgcgccgccagagttccgaacacttcaagtctcccgtgttctcagagcatcgtctctaacttcctctcctagaggatttcgtcctgggcggcaggtttccgtagactcgaaaccccaggctgtgctccggccgcgcagtcctccccggagccggagtaagtacgacgcaaccccaccgcatccatcatcccccaccactgtcaccctctacccgcctccacacctcggcagcatccccaaaacacaacacgaccccaacccccattctggcccggtcttcccacactttcgcgcccccggcacatcccgcccccagctgggtggctggcgggggtggaccgcttgggtgagcttctgaataccctttaggggagatacc

SEQ ID NO: 36943 - DNA, 93 bp, Homo sapiens
  chr18:28622025-28622118
  hyper
agaaacccacttctcaggggcagccccaccaagggacccagggacacagccccggctccactcactaacgaaccaatccgggtcaactgcgac

SEQ ID NO: 36944 - DNA, 364 bp, Homo sapiens
  chr18:28622419-28622783
  hyper
ggctgctaccagacccgcagcattgatctgagccgcggttgtcacgtttcggcccgctttgtccccagctccgtgcagcgtccagggcggatccacccccgtccccaccccagccctatccggcgagatctggcttaccacgagggtcagcagcagatgcaggcagacggctccgcgcacggagcgccggggcccagcggcggccatcgggatgccgggcagggccaggagaacgcgggcgccgggagggtgccgagagcgagacctgccgaggtgcagggcgcgggaggtgcttttctcgccgctgcttgtttttaagtgtatttggcctctctcaggcttgcctgcccgggagcaacttcac

SEQ ID NO: 36945 - DNA, 66 bp, Homo sapiens
  chr18:29078189-29078255
  hyper
ggcgggaggcggaggcgagggtgcgatggcgcggagcccgggacgcgcgtacgccctgctgcttct

SEQ ID NO: 36946 - DNA, 81 bp, Homo sapiens
  chr18:29599743-29599824
  hyper
tacctgctttacgcacggtctctccaaaccggcggaaattacagagtaaaataactttctcaaaaccgcatagtacttagc

SEQ ID NO: 36947 - DNA, 30 bp, Homo sapiens; identical to SEQ ID NO: 13021
  chr18:30349740-30349770
  hyper

SEQ ID NO: 36948 - DNA, 324 bp, Homo sapiens
  chr18:30350080-30350404
  hyper
cagcacctcctccaccgtgtccagggacagggtcacgttggccgtgtagaggtactcgagcaccaggcgcagcccgatggacgagcagccctgcagcaccaggttgttgatggcccgggggctggtcagcagcttgtcgtcgggggaggaagaaggagtcccgggctcctcctgcggcggcggctgctgctgctgtgacggctgctgctgcggcggctgctgctggtccttgggggcccccaggccgtcctggccgccgacccctcccccgagaggggggtggctggagaagagcgatcggaagtactgcgagcaggaggccag

SEQ ID NO: 36949 - DNA, 319 bp, Homo sapiens
  chr18:30350720-30351039
  hyper
ttgactccctcctggcgcgctccggaccccgaccctaggaggaaagtccgaagacgctggatccgtgagcgccaccagaagggccctgtctggggtcccggcgccggttctgcgccctgcggctcctctcgccacctcccacacacttcgtccctcactttcctaaaaccaaccacctcagctcggctgttggcagcaacagcagtggcagcagcgacggcaaagtggcggctgaggccgaggcacctcgtgggctcgtgtccatgccgggccagatgaagggaaaggccgggaagtggggagccgggggtgccctgaa

SEQ ID NO: 36950 - DNA, 30 bp, Homo sapiens
  chr18:30352193-30352223
  hyper
gcttcctatttataccggactgggctcctt

SEQ ID NO: 36951 - DNA, 113 bp, Homo sapiens
  chr18:31020398-31020511
  hyper
ggaattgttttcaaacgcgcggggcaaggactccccaccgcctctggaaggggtgaagaactagtcgactctaactccctcagggtggccagggaattgcatttggttctccc

SEQ ID NO: 36952 - DNA, 36 bp, Homo sapiens
  chr18:31158511-31158547
  hyper
ctgggtcattgtctccgcgcccgaaccccgagcacc

SEQ ID NO: 36953 - DNA, 568 bp, Homo sapiens
  chr18:31739074-31739642
  hyper
gtgaggttgccctggcggtgtccatagcaacgctggagggggtggcagggagaaaggcgccctccaccctgtcagcctcctcctcgcctcccccgacctgcaggcgcgctaagcgctccgggcgccgcgctccgcgagggggagcagtgctcccaacccgcgaccctccgcctcagacatcacagttgccgcggcaacggccggaggaggaaggccaaggcttttctcccgctgacgtcccccgccaccagtacccagagtgctggggcctggatgagatctgcgtccgcttcacccgagcatgagcttgggtctctcggaggagcaggagacgcgggctcgaagccgcgggcctgaccctgatccgtggatgccgccgccgccttctcctcccctgggtggtgggggacagggcctgggaggcacggtcacgccgagtttgagcacgtgaccttccaagagcttgagagtcccctagagagcaggccccaccccaatccatcccgcctcgccggaggggtccctctggctttagtccttctcttctaattccctgtatgtcccgacc

SEQ ID NO: 36954 - DNA, 329 bp, Homo sapiens
  chr18:31802052-31802381
  hyper
tcttgtgaagaaaatcgacgctgctgcggctccccagccccactggcttctgcagcgtgaggctgagatgcattgggctctcaatgccagtgcctcgcggcgcctgggctagagctttgtggccatgagactagagccaccccagaaaaaggaacaaatacacacaccattcgatagcgcctaaacccatctttctttgttgttcatcttctagctgcggctttatttgtggaagagggaagtgaggaagggaatgggggggcggggaggaggaatctccaggaccttatctacaatctcaacagtcgcggcaacgatctctgggagtg

SEQ ID NO: 36955 - DNA, 413 bp, Homo sapiens
  chr18:31802675-31803088
  hyper
ggaagctcctgcagccggtccgggaacccgaggcggggagggaggccagctctggaggtgcgctgccgctttaaaataaaggaccacaaagactgtacagtggggaaaacgcgcctggctaatgcgagtggggacgacttggggagggggttgaggaaggtagggggcacacgagccaacggcggctcacggctccccctctctcccgcctctctccttcctccctccccgccgggctgctccggcagacaaataacagaggaaggcgagtcactcaccgtggtcttgacaggcacgtagagcacttgcttggcgccgccgcctcccccgcggacctcgtccggctggcccagctggaagcccttcgatttgacccagaatttaaatttggcgttgtccgtggagctcgactc

SEQ ID NO: 36956 - DNA, 186 bp, Homo sapiens
  chr18:31803310-31803496
  hyper
agggatgcgaggtcccggccgcagcgggagcctgctttgggtgggggaagggatgggaagaggggaggagggtccggttgggcaccagcaatcaatgccccgtgctaccaagtctggtccattcgtaattgcaacggctgtctcggacgtttttcctgttcccttagcggtcggtctctttaatat

SEQ ID NO: 36957 - DNA, 35 bp, Homo sapiens
  chr18:31804992-31805027
  hyper
acggctgggcgctgacgtcacgggcagaattgtcc

SEQ ID NO: 36958 - DNA, 30 bp, Homo sapiens
  chr18:31902793-31902823
  hyper
ttcttgaaaagaaaacgctagcgatttcac

SEQ ID NO: 36959 - DNA, 381 bp, Homo sapiens
  chr18:32073450-32073831
  hyper
agtgactgaagcgcccgtccattccaaggtgtgtgcacggcgttttcttctttgacagctccggagtgggggagggcgcgggggtggagggggtccgtgtgccgggcgaggagtgggcgcgaggccgggctgccgcgctgcccccggccgcccggtgcagaggagcccgccgcggggcgggaggtgcacatgacgcgcagccccggctgcgcagggaccgcagccgcccacggcgccggggcgcggacacaggcggctcggcgctggagcaagggcaggcgccgcgcaccgagcaaagtcaagagtggaagcgggcggagagcgccggcgggggcagggattcgcctcaacgcccactcacggggttcccacctgtgcgcc

SEQ ID NO: 36960 - DNA, 159 bp, Homo sapiens
  chr18:32073907-32074066
  hyper
cgggcggcgcctcaggcccgcggggcggcggtagcggctgctgcaggatgtccggcccgggggcgcggggccgcgcaggtaaatctcccccgccctcgaaggccttcgcagcgccgcagcccctgctgctgccgcggcgccgctcggggggtggctatg

SEQ ID NO: 36961 - DNA, 132 bp, Homo sapiens
  chr18:33878418-33878550
  hyper
tcaggcctctggggccgctgcgggcggccacgcgaccctcgcgacaaagcacgcttcccggcgacaccgcctcctccttcccccgggggcgccgccggggacgccggccgcacactgcgatagcgctcaggg

SEQ ID NO: 36962 - DNA, 15 bp, Homo sapiens
  chr18:34833539-34833554
  hyper
caggcccatttctgc

SEQ ID NO: 36963 - DNA, 572 bp, Homo sapiens
  chr18:34833958-34834530
  hyper
cggcggggaggggtcgggggacaggggggcggggcgggcctgaggctctccccctcgggccccgcccccggccccgccccggtgcccgcccctctccagcccgcgcgcgcgtgctaggcccctccgggggcaggcgctggcggggacccggctcgctgacctgcgcctagtctctggccgcgtcactcgcccggcgcccgctccccaagtggggcccgcggccgggcggcgctgggagaggcgcccgccccccacccccgccggccccggcacctcagccctcgcctcggcgggagagggcggacacacctgcgggtggaggagtttattggacactgtcctccctgacaggagggggcctggcagcgcgcgggcacagggtgccggcctggggagagagacgagtgcgaggggccgggagggaggcgccgccgagaaacttctccaccgccggcccggccgcccccctcgccaccgcaggtgcccggctgtcggaggaggcccagaggctgagccctcgcgggccctccgcccccactcccggcctctgcccgccccgccaggctccgggt

SEQ ID NO: 36964 - DNA, 30 bp, Homo sapiens
  chr18:34973974-34974004
  hyper
aaattgccagcttgtcgggggccgcagggc

SEQ ID NO: 36965 - DNA, 264 bp, Homo sapiens
  chr18:35064882-35065146
  hyper
acccacaggagagaccgcgcagacccttgacccgaagaatacttcttattttatggtgatgaactagcctcgataatagccatggctgatatcacacccagttaggggggccataaataattctcttctcccccgcacagaagctataaaccagggccgaggcgcgatagtttatcaaagacgagggctggctccttaaataaaccgcggtgatctcacttgcggcgccccctcccacgccggccccctcctcccccactagag

SEQ ID NO: 36966 - DNA, 171 bp, Homo sapiens
  chr18:35065516-35065687
  hyper
cgctctgggccttcagcgctgactcacgctcgcagtaggtgaggaaggcgcagcctggggaggaaagcaagcgccaagaagggtcagtggggcgcccccgggcccgccgacgcgccctgccgcccgccctccaggctcccgcccctccctgccgctcggtccctgtcccca

SEQ ID NO: 36967 - DNA, 61 bp, Homo sapiens
  chr18:35067550-35067611
  hyper
cgtccctcgtgctgccgcctgcttctcccgggggcgtctttcctcccgtccccttgttggc

SEQ ID NO: 36968 - DNA, 29 bp, Homo sapiens
  chr18:35104522-35104551
  hyper
aggtaaattttcggccggcggggcagccc

SEQ ID NO: 36969 - DNA, 44 bp, Homo sapiens; identical to SEQ ID NO: 13033
  chr18:35104934-35104978
  hyper

SEQ ID NO: 36970 - DNA, 117 bp, Homo sapiens; identical to SEQ ID NO: 13034
  chr18:35144820-35144937
  hyper

SEQ ID NO: 36971 - DNA, 630 bp, Homo sapiens
  chr18:35144968-35145598
  hyper
cgtcctgggctcgaccggtgcagccttccccatccccatctttcaggtcgctgtacccaaaaatccaagccccgtctcctcgatcccctctctctttctcttcatcggcgcccgctgctctctccatggcatcgttcctatcagcacctcgcccaaaacccagtcttgccccagcgaacagctccccacgcaccccagctctggtctccgctgcccgagcgcctccctccaccgcgcccgcccgaggcttcctctcgcttagtccgccgctcgtcagtcgccggccggccggtcggcccgccagcccgctcctgctccccggcaaagttgggagggaaaggtgtactcacctttgtgcatgcctgtgaacctgtccttcagaaccgtaagctcgtagattttgccaaactcctcgaagaggggcttgaggtccttctcatccaggttgcgggggatctgcccaatgaacagcttgatggcatcgtggtccttcatgggaatggtcgacgggttccccgggctgtggcttaatccgttcatgtgcccggcactgcccgggctgctgccgagcccgttggtactgaggcttgcgttgtcagcctgtccgtttgctaacgtggccatctttat

SEQ ID NO: 36972 - DNA, 89 bp, Homo sapiens
  chr18:35146102-35146191
  hyper
acggcgggcggcggccgggggcagggcggcgtggggcggcggccaccgcgcctcccccgtcggcggccccgcgccgtggcgatggtaca

SEQ ID NO: 36973 - DNA, 55 bp, Homo sapiens; identical to SEQ ID NO: 13038
  chr18:35146710-35146765
  hyper

SEQ ID NO: 36974 - DNA, 195 bp, Homo sapiens
  chr18:35146895-35147090
  hyper
cggaaggtgggggtccccgtcccgggcggcctcccccgccccggagagcgcggctggtcccccggtggctggcgggaggaaggtaggagtcgggcgcccctgcccgctcgcccgccggagggggaggaaggcgctgggcgcggtggccggtgagccagcgcgggggatggcttgatttgccctcgtctgctttac

SEQ ID NO: 36975 - DNA, 78 bp, Homo sapiens
  chr18:35147091-35147169
  hyper
ggttcaaatagaatatatttttttaatcaccatcaaaagaataaagcccctgaatcgctatctgggttgccgccggac

SEQ ID NO: 36976 - DNA, 317 bp, Homo sapiens
  chr18:35147487-35147804
  hyper
tcagggcagcctcttcgcttcagaagcctggcaaattgaaataacgcgcccgctcccccgcgggctgcggggctggggagctggggcggcggggctgagcggctggcctaacccccgccggccctcggctagccactttcgggtttcagggtttctcttttcttgccctcggattacattacgttactagaggatatgtctgcaattttaattaaagaaatgagaccccagctgcctgcaaacccaggccaaccccatttggtacaagcacaatacggagctctccagcgccggaggaggcccggaggcccgaggtt

SEQ ID NO: 36977 - DNA, 15 bp, Homo sapiens
  chr18:35147834-35147849
  hyper
cgcctctctctgagg

SEQ ID NO: 36978 - DNA, 30 bp, Homo sapiens
  chr18:40857392-40857422
  hyper
agagggaggtccactcgccctcgcacagtg

SEQ ID NO: 36979 - DNA, 189 bp, Homo sapiens
  chr18:43913431-43913620
  hyper
aatgcgttcttggcacgcgtcctgcgttaacaaggcgtttggtgtgtgcatgtctgtgtgacagtgcctgggtcctgtttgcggctgcttgttcgcattccagcttcccttgtgcccgcagtcaggctctacacgtgcgccagcctccgagcgcacgtccccgagtgacccgtgcgcggtgtgcaggga

SEQ ID NO: 36980 - DNA, 71 bp, Homo sapiens
  chr18:43914155-43914226
  hyper
gccgcccgcgcccgcgccccggagccgcgccacaaagggcccgcgcgcagccgccgccgccgccgccgcgc

SEQ ID NO: 36981 - DNA, 399 bp, Homo sapiens
  chr18:43914227-43914626
  hyper
aggagccaggatggtcctggtccacgtcggctatctcgtgcttccagtgtttggctctgtgcgaaacagaggtatcgctttttcctttcggggtctgcttcggagcgtggatcgccgcaggcaccggggcgggggcgggcgccgcgggcggccgggggctcagggcacacccgcgaggacgcagggcgagcggtggcttccccccaccccattttagggggacccccgagggtgggggcggccgccctcgtgggagcttttgtagtgaagttagggtttggcgaatttgggtcccttcctccccagccccattttttattttttgcggcggacgtggttcccccaaatcacagccccttcccctaatacctagccctgtatgatcgaaaggagaaagat

SEQ ID NO: 36982 - DNA, 140 bp, Homo sapiens
  chr18:43914882-43915022
  hyper
atcccatccttttttcgtctttaaccctttttgtgcatcgcccttgtgctattgccctgctcaccccgccccccgcaactgtctttgtatgacagttgcatacacgggttcaagatgcttgggcgcgtgtgtgtgtgtgt

SEQ ID NO: 36983 - DNA, 282 bp, Homo sapiens
  chr18:44336168-44336450
  hyper
ggatgctcttggaaacgcggtggcccaagcctaagcggccatgctcggggctaggagcggaccccacggccactcaccccggggcgctgcgaccgaagctgccgcggccactgccacccgggggctcgccggccggctccgcgcatcccgccctctcaatggactttcttacctcttaatgtagttcctgccatacaggatctgttgcagcaaggtcaccaaggcaaaggcgcagatgaagatgaagagcaaagttcggctccccaacaaatcccggttggc

SEQ ID NO: 36984 - DNA, 139 bp, Homo sapiens
  chr18:44337012-44337151
  hyper
cgatagggacggggggagggggcgtacaaaacacccgcgcagtctggctaatgataggcgggccgtggggagggggaggggcggagcgcaaaacgccgggtttgaatcttggaattaaaaagagggcaggggctgggcg

SEQ ID NO: 36985 - DNA, 167 bp, Homo sapiens
  chr18:44337451-44337618
  hyper
agagggcaggaagaggaaacaacagttgcggagctggacttgatggaagggagcatttgcgtgcggcgcgcagggcactgagtcaccatcgtggccgcgtcctcgcgctctcctagcgatttctccggagaaagcggagcaaggtcagccgggcagcccttcaagga

SEQ ID NO: 36986 - DNA, 193 bp, Homo sapiens; identical to SEQ ID NO: 1335
  chr18:44337649-44337842
  hyper

SEQ ID NO: 36987 - DNA, 140 bp, Homo sapiens; identical to SEQ ID NO: 1336
  chr18:44772977-44773117
  hyper

SEQ ID NO: 36988 - DNA, 501 bp, Homo sapiens; identical to SEQ ID NO: 1337
  chr18:44773466-44773967
  hyper

SEQ ID NO: 36989 - DNA, 315 bp, Homo sapiens
  chr18:44774387-44774702
  hyper
gcccttgctgggcaccgggatgactgggtagctgcgcgggcctttggcccctgccccggcacccgcccccgcgcccgcgcccacgcccacgccggccacacagccacccccagcgccgcccccaccagtccccgcgccgcccgaagcagcagccacagagaggctggcggctgcggccgagaggctggcggcggccactacggcggcctcctgcaaggagtcgtcgtcgtcgtcgaagcgcggccgcttgtgatgggcgtgcggggcaccagccagctctgccaagggcggcggtggcggcggcggcggcggggg

SEQ ID NO: 36990 - DNA, 151 bp, Homo sapiens
  chr18:44775439-44775590
  hyper
tgggtttgaggttggcgtgccctggccgcggctggctcagcgtgtcgggctggaaggcgctcgacggcgacgccagcaggatgtcgttgggccctggcagcggactggaagccatctccgccgcagaaccccgggccgagccctacaggtc

SEQ ID NO: 36991 - DNA, 30 bp, Homo sapiens
  chr18:44776834-44776864
  hyper
cagctacatctcaagcgcattggccaaggc

SEQ ID NO: 36992 - DNA, 49 bp, Homo sapiens
  chr18:44777301-44777350
  hyper
gataattccaactctcgctccccagcaaggcgcgcggctggccagccgg

SEQ ID NO: 36993 - DNA, 196 bp, Homo sapiens
  chr18:44777596-44777792
  hyper
ccaacttagttctcccgactcccaaaccagtcaccacggaagcccaccgctgcccctcaacctaacgcggaaaatcctaccgctggggatctcaaataggtgcccagcaagctgtgtgccggattggggcggccggttccggcaatacctggtaacctctgggtgtctttaggcgtgtggctgccggcccatcttc

SEQ ID NO: 36994 - DNA, 464 bp, Homo sapiens
  chr18:44777862-44778326
  hyper
cgcgaagatccgggctctggcccgagcgaatggcgctcaaaccccggcctggggagaatgacggcctgaattgcggcggggcgtcccctccaccgcagaaagtgtgggtacgcagaaacccgcggcaggagagccccaagtggagcgcagtctgacagcgtctgtctctgaactcgtgtcggaccgaggggacgccacccagcgggcagggtgacgtcaccgtctccctgacactccacattaaagggctggcatgttacagggagggagggggagagcgaaagccagcgcgagcaacagagagatcctttctcagcaggcacgaaagctaccaacctaaccaactcgcaattgacaacaacctcctcagccccggagtaaactgcagcaatggtgctggagccgcagatctgatttaggagtggaaagcgaacagtctgcctgcatcccgggacctagatcct

SEQ ID NO: 36995 - DNA, 529 bp, Homo sapiens
  chr18:44780673-44781202
  hyper
caatgctttcctcttcgagctgacatgcattttacacgtcaggactctcctcagccggctaattgattcaaattgttttattggttaaactggtgtcacccattttcatgatctatcaccacatggaggagagcatttccactcccatctccgttccgggcggctgcggttcacccaggccaaggacaggtaaaggagcccagacgcgggacccagaggaaaaccacaaaccgagctggcctcctcataactggagaggcgacgtctggaagtaagaggaggaggccggcacagcagcgcatatgggcttccagctacaaatttaaactggttgaagagaacccacgctcagccgggcctgggcccagtttcctccacctgggacacagtcggtttccgagccggcgttgaactccgcggtataggaggccacaacaaaacccgggtgggaactgtccgcggtgctgacgagatgcatcgttccaaagcacagcgaatcctactgtgttcaagtcgggaagaagcctcc

SEQ ID NO: 36996 - DNA, 264 bp, Homo sapiens
  chr18:44786883-44787147
  hyper
ctcgcccgcgggagtcgctgtccgagcttggcagtgctgaaaccgccggcgtgagctagggagctgcgggctgcggaggttcaggggcaaaaatctggatgctgtcctaagctagggagccgctttccacagcgtctccaaaaagtctagtttgccttctctccctagctctcttcatatcccccccaaccccccgcccacaagtgacaccagaacgttgtaaccaaaaattaattgccttaatcaaatcgacccaccttctgc

SEQ ID NO: 36997 - DNA, 150 bp, Homo sapiens
  chr18:44787701-44787851
  hyper
gtttagggtgagggtcggtctctcctcgcgccctgcttctcggcttagcttgctcagatccgcacccccccactccccacctcagacctctctgacgccgcctgttggtcaggcagggcagggcgaggagcgcagcgccagccccagccc

SEQ ID NO: 36998 - DNA, 30 bp, Homo sapiens
  chr18:44788251-44788281
  hyper
aaaaaaaaagttagtcgaatccgtctcata

SEQ ID NO: 36999 - DNA, 177 bp, Homo sapiens
  chr18:44789786-44789963
  hyper
ggaggatgaatggggcgctcgccgcggctcatggcgccccctaggagcggcaggaaacttctcctgcagggcagcgcgggccgggctccgcctccggaaggcgggcggggagggtagttgctgggggtccctaggccgggccccaggacatctaggacatgccgggggctgtttgct

SEQ ID NO: 37000 - DNA, 30 bp, Homo sapiens
  chr18:44790732-44790762
  hyper
aaatgaagggggcagcgatggggtcggaaa

SEQ ID NO: 37001 - DNA, 217 bp, Homo sapiens
  chr18:45058076-45058293
  hyper
aatgactccggtctccgcgccgctggtgttgcacaacttgtctgtgctggcttgagaccccggtgatccccttctaattgaaatcactttcccctgacctcccccgtaagcctgggagcttgttgctctctgcgccaacactcgggctgcggaggtcgggggaaatcctggctgggcaccagagctgcacgcacgccgcatccatcttccggccgcc

SEQ ID NO: 37002 - DNA, 140 bp, Homo sapiens
  chr18:45058307-45058447
  hyper
cgccaggtgcccagccagggtgggcgtcggggcagccccctggaaggcggccctgctggatcaccggctgcttggaagctcgcagcggggctgacactgccccctaaggggcattttggacatttcgtgggggggcttgt

SEQ ID NO: 37003 - DNA, 123 bp, Homo sapiens
  chr18:45275551-45275674
  hyper
cctcctaacagagaacggcgctcggagccgggaacgcagctgccgccgcccagccctgagccccgcgcttcgcgcccgcggccctgagctctgctgacccctggcggccgccgcgcgccgcgc

SEQ ID NO: 37004 - DNA, 90 bp, Homo sapiens
  chr18:45662989-45663079
  hyper
gcccttacgttccttcggctggcccctcgccccaaaggagcccgctggcgtgggccggcggcaatggggcagtggcgagagttgctctct

SEQ ID NO: 37005 - DNA, 110 bp, Homo sapiens
  chr18:45663423-45663533
  hyper
gcgccgccagggtcccgggctgggaatccacgcggccgcgctgctcgcgggagcctgccgcagccggcgggaggttgtcattgattcgtgctgggcgagttaagccattc

SEQ ID NO: 37006 - DNA, 30 bp, Homo sapiens
  chr18:45935031-45935061
  hyper
aaagtcccaggaaaacgtcactcaccaaaa

SEQ ID NO: 37007 - DNA, 202 bp, Homo sapiens
  chr18:47087502-47087704
  hyper
atgcttgatttcactcgccaaggagtgagtgctcatcggcagacactgggctctggccacgcgtcttagactccaaatctcggctcactggtccctttgaggaggtcgcctggtgttcccgtagccctccaccccaccgtaggagagcgcctgccacgagctccgcgcctcgctaagtgctttgctacgtgaactcttagtt

SEQ ID NO: 37008 - DNA, 67 bp, Homo sapiens
  chr18:47088061-47088128
  hyper
tccttctccagggatcgcctccccagcggacgcagagtttcagggaaatgtccgcctccgccacttg

SEQ ID NO: 37009 - DNA, 125 bp, Homo sapiens
  chr18:47339606-47339731
  hyper
aacaggaaattgcaccgaaatcgctgtcgctagcgccttacaagtaagggttttctccttaacccaaacaagcctttcgggctgggtttttatcacgtccgctccaaaaccgaggaggttgagtg

SEQ ID NO: 37010 - DNA, 339 bp, Homo sapiens
  chr18:47792640-47792979
  hyper
gccaggcctggagtgcggagagatggagaaagctgtagggtctggcagacatatcctgtgcttaccacgatcaccactttgggggtggggcccttaacctcccgctgtacggtgccaaaccgctggctgtacattttcgagtccccttcgggacgggggcggcgtccgccgcgtttcccccaaccgtggcgacctgcgggacccgcttccgcgacgcagaagtctggttgccatggtgcgcctcgcgggattaggggccggtagaggtgggcgggtcgggcggaagtcggtctggtcaccatgggggccgcagacgcctgcactcgggacttcctcttc

SEQ ID NO: 37011 - DNA, 30 bp, Homo sapiens
  chr18:49866847-49866877
  hyper
tcctctggctccctccgtttccttgagtta

SEQ ID NO: 37012 - DNA, 127 bp, Homo sapiens
  chr18:49867272-49867399
  hyper
cgtcgcacccccttccgtaccccacttcccttctcatttcatttggcgagtagtagaattggggtgggggatagcaagagatttggcgcttgcgctgcccccatttgcgcaccgatgataaaagata

SEQ ID NO: 37013 - DNA, 95 bp, Homo sapiens
  chr18:52989060-52989155
  hyper
attttcccatatggccgggccaagcgtggtgaatatgcaaagcaggaagagaccattcctggcgggcgggggaggccgcggcgctgctgtcagac

SEQ ID NO: 37014 - DNA, 125 bp, Homo sapiens
  chr18:52989156-52989281
  hyper
ctcaactttgcgcagcggagctggaaggcagcccggccctgatggagctcgaaatcctaatgcatacgcgagatcgattcaacttttccgaggggtttttattagttcctcgaataatgccgatt

SEQ ID NO: 37015 - DNA, 181 bp, Homo sapiens
  chr18:52989772-52989953
  hyper
aacagagtagcagtgcggcccgccccgggctccgcgggccccggcctccccggagctggtgggaagcgcggccgcccatgaacttcacctcgccccgccgcagacagccgcatgggcccagagcctacggaggggctggggcgctgctcccctcgctggcgctgggcgccccaagggcgca

SEQ ID NO: 37016 - DNA, 1404 bp, Homo sapiens
  chr18:53254613-53256017
  hyper
gtatttccaaagagacgatcaaactggtaacatccactataaaaccaaatcagggaaagaaaaaaaaaaagccgctcttcagcgcatcattttatgcaacaggaggtagagcgagaaatgaatggatcacagagaaaagagaaactactgagaacgatccgatctcaactttccccccaccctgcaccccacccccctcgcacactcacactcgcacacgcacacacactcgcacacaccactcccctccgcttttcaaagtagctatcaagaaattaaagatgagcgtctctggagtgaaaacacgtccaaagggggaggggtggggtgacagggttggggggagcggagtggagggtcgggtcctctaattgtccagcaccctaatttgtgaaagaaaggggttataaaaattaaagtcaggcccctggcaaagtcctcggtccctccgagggggcatcaaggggaggggcgggggggctggcggcgagggggagggaagcggcgggaggggaaggggtgtctcttctgggagcgccgggcgccgggagcccgcggcgcgggaggcgcggagccgcgtgcggggccgccgagcccgaaccccgcgccgccgggcgcctccgccccgccgagccccgcaggcgccggtacctaccgcccgcgcgcgagaaggggctctccgtgcaccgccggcgccgaggcggcgttcatgtctaaccgccgccgccaccgccgccgcctgctcctgcgcccgctcccgcgcctgctgcctccccgccgccgccgccgccgccgccactacagatccgcagacacacagccaagatccctgactcttaacaccaactctcttctccggggaggggaggggacggagggaaggggggagggggaaacacgccgaggcgcacggaattgcaagttcagcaaagaaatgggtgggggggctccggcggggagacgcgacttgctccgggtcgggcaggctaggatgcatccccctcgcacccaccccgaggggaaaaaaaaaaaatctcaacacctcccccgcctcgccaaaaaatacaaacgaaaattcatcgagcacctcatttttcctcagatcgtcagttacaatctgaagcctgaacagttcagtttttgcccgttgcatccctcggaggcactttgaaatttattcgagtttacatcccctcacttctttctttctcttactctcgttccctctcactcacacatccacacacggcaaagcaagtttatactaggctgcaaatacacgtgatgcaaaaagactttgccaagaggaacaatatttttctttttcgtctataaatcaagccacattttcctggggagattttcgtttcggtagttttgcgttgggggcgaaatctgaattgc

SEQ ID NO: 37017 - DNA, 380 bp, Homo sapiens
  chr18:53256942-53257322
  hyper
caccatggactcccccgtggagtcacattgataataataggtttccctgaaagatacattgtaatccattcacatccgggaactgcgggcttataaagagaaggagctgcggccgcggctgctcctccagacaatgactgggaaggggcggggcgggagcaggcgaccatagagtggtaaacagagcgcctagagaggcggccaagatggcggtgctggtcgaccacgcctcctccgggagcggaggcgggtggctgttctcgggtaggcgtcgcgcgtggggcggcactgtgggagttcccgaggccgaggtcgttcgcaggccccatttccctgcgctcttattcgtgttgccgcttcttggccgtccttgctctttg

SEQ ID NO: 37018 - DNA, 609 bp, Homo sapiens; identical to SEQ ID NO: 1338
  chr18:53446866-53447475
  hyper

SEQ ID NO: 37019 - DNA, 57 bp, Homo sapiens; identical to SEQ ID NO: 1339
  chr18:53447798-53447855
  hyper

SEQ ID NO: 37020 - DNA, 255 bp, Homo sapiens
  chr18:54789032-54789287
  hyper
ctgggagtgcatgtgcgttgctgagcgtggcctgagcccggtcagcggccgggcgccggtggcagcccccggtcccgcggcgaccccggcccaggaaggagcccggtagggggtgcgctttccctggcctcccgaggcgggatcggggccgggctccactcggtgagaggatcctgccagccagctgggtgaaagacccacagaaatcccgaactggctgcaagatgcattggtagctggcgcctttagtcgggt

SEQ ID NO: 37021 - DNA, 123 bp, Homo sapiens
  chr18:55019653-55019776
  hyper
atcctgtgcttagatcgaactgtaacattattccaatcacatttatcttgcaggcggcggaggagatggcagcctcgctggaaacgcgcgggggagcctgagccggcggccggggacgcacgg

SEQ ID NO: 37022 - DNA, 260 bp, Homo sapiens
  chr18:55020439-55020699
  hyper
aaagcccctagaagccgctgtccaaatcgatgtgattgcatttctcgtattcttcctcagcatcccttccctcatttcagaaatgggggttgggggaggctttcaggagggtgagggtggagggaaagacggtgtgtttgttcgggagggggcggcgagcagagatggacaggcgtgaggggagcgccctccccgcgccctgtccgcagactccgcgggccgggcccggggcggtgctggcggtttaatggcgcaggcgc

SEQ ID NO: 37023 - DNA, 141 bp, Homo sapiens; identical to SEQ ID NO: 4552
  chr18:55020804-55020945
  hyper

SEQ ID NO: 37024 - DNA, 431 bp, Homo sapiens
  chr18:55020965-55021396
  hyper
cgagagcccccgccccgctctgtgaccccgggaactctcccagcagggcctcctgacgggcaggtggcaactacaaagtgccacctgtggtccaagctgggaccgaggcgaggaacccagaggagcctcgcctggaccgaggagcggagtaggccggcggcccccgggggtccccagccaagttataggaagtgaaatcggacgtgggtttgggaaggaagaggttaaggcaggaaccacccccagactttccctgggtctccggtttcctctgccctttctccaaaaacaattctatggggctgcaaaggcgtagcgggtcaggctggcggggcggccgctgtccgcggtgctgattccctggtcctcgcagcgccgcgggctccagccctgcgcccggcgtgcgccctgctctccgcatgacggccatt

SEQ ID NO: 37025 - DNA, 33 bp, Homo sapiens
  chr18:55103381-55103414
  hyper
gcaacacctacaccacgctgacaccgctccagc

SEQ ID NO: 37026 - DNA, 303 bp, Homo sapiens
  chr18:55104869-55105172
  hyper
tgtcactacctacagcgagggcagggtgtaaggttgagaaggtcacattcaccgctttgggaggacgtgggagaagagactgaggtggaaagcgctttgccttgctcaccggccgtccttgccccggtcccagcgtttgctgggatttgccaggatttgccggggctccgggagaccctgagcactcgcaggaagaggtgctgagaaattaaaaattcaggttagttaatgcatccctgccgccggctgcaggctccgcctttgcattaagcgggcgctgattgtgcgcgcctggcgaccgcg

SEQ ID NO: 37027 - DNA, 597 bp, Homo sapiens
  chr18:55105464-55106061
  hyper
aatgtccaggtcccccgctgggaaggacacactataccctatggcaagccagggtgggcgacttcccatggatcgggtggaggggggtatctttcaggatcggcgggcggtctaggggaacaattcgtggtggcgatgatttgcatagcgcgggtcttgggatgcgcgcggttccgagccagcctcgcacagctcgcttccggagctgcgagctcaggtttccacccccgatcccccgggctttcctcgcaccgctgagcccagcttgtggggtgcactcgaccaacgcccgacagggctggggaatgtgacaggcagcaggttcacccgggcttggggagggggagtttccgctttgacagcattttcctttgccgtctgctggtggattcctattcccagtcggtaatcgccccgcagtgttgatctaagaaggtaaagaaaactaggtttccctgcaaagagcctcccccaaatcggcggactccggatactttgagtggatttagaaatttatgtaatctttctcctttagtttatttttcatcctctcctacagttttctctgatttgctgttggttcggggcaagataaag

SEQ ID NO: 37028 - DNA, 342 bp, Homo sapiens
  chr18:56887076-56887418
  hyper
agctaaggctggaggcgccggcgagcctggagagggaggagttcactaaattgtgttggatggaaggcgtcgaggaccggaggaattaatccgatgtggggaaggcggacggggctacgaggaaaaaagagggggcaatgtacactcagccttttcatcactcggcggggagatggatggttttccggaccgggcgtcccagcgccccggttagctatagggagacgtcagagcgctctggtccgcgatagaagagccccccagcccccccgcccgggcttccatataaagtaggggccctagtggaggccgcagcagtagcaccagcggctgcggcggcgg

SEQ ID NO: 37029 - DNA, 46 bp, Homo sapiens; identical to SEQ ID NO: 13078
  chr18:56887753-56887799
  hyper

SEQ ID NO: 37030 - DNA, 170 bp, Homo sapiens
  chr18:56888013-56888183
  hyper
aataatcttggggagcgttgtcccttgaaagcatctcagaaccctggtccagctcggtggcctcaacagcgactggcatgggctgaaatctaagctgcgcctatgctccccgcaaagccacaggtgtggggacctagggtgcagcgctcccgccccgggtttcacatctg

SEQ ID NO: 37031 - DNA, 232 bp, Homo sapiens
  chr18:56888404-56888636
  hyper
ttcgccctttcccctcgctcctttcccattccctctgcaacaggtcctgctctctaggcaccggcttggaggctccctcgccatggcccctagaacccaggcggagaggacggccgcgctgcgggtgcggagggcgcctgcgggtggggtcaggattccgccctgcgcgcactcgctgctttcgctcagctgggaggcaggaagcgcctggcagcctcggctcacccagcat

SEQ ID NO: 37032 - DNA, 177 bp, Homo sapiens
  chr18:56931541-56931718
  hyper
atcaaatgctgaagccgccaaggctctcgggtccgcacccagggtgccctcaccgtacgccgaccgtgtggggaacacgctctctggaagctgagttgggggtcctggtctctcttgccgccccctgcccccagcttcctgcgcgtgggctccagcggtctccgcaaagactttcag

SEQ ID NO: 37033 - DNA, 83 bp, Homo sapiens
  chr18:56932322-56932405
  hyper
gacacgccgccctcgcgcgcagagactgctccagaaagggaaaaacgcaaaacttaaaacgcggtggctcacgcctgtaatcc

SEQ ID NO: 37034 - DNA, 22 bp, Homo sapiens
  chr18:56932645-56932667
  hyper
gccagagcgacaccctgtctct

SEQ ID NO: 37035 - DNA, 136 bp, Homo sapiens
  chr18:56932957-56933093
  hyper
gctttcctcctagggcgggtcagagcagacgtcgtcggggtttgggaaggaagcatctccagacctcttgaattgactgaagccaatagaggcttgccctaggtctgtgcttggagcagcacggtgccttttcttc

SEQ ID NO: 37036 - DNA, 483 bp, Homo sapiens
  chr18:56934924-56935407
  hyper
agcttccagtgtcaacggtggatatcgagcacgctcaggcgggagtccgggactctccttcttcagagagtctcaggagattgtgaagcgggctgagatttcgagattccttcctcgccctagagccggcgccaaagaactgcagatactgtccagggcacgcccgcaagaactagctctcggggcggtggcgtagggcgctccaggacactctccgagcgcggcacctcaccagacgcgccttttaccgaactctgggttggcgagtgtggagcgagttggggaggttagagagtctcgcggctccgaaaaggaaaagcatctctttgcctcagttcttgtaccgctggtgatcaaccttgggtgttagggactggcaccgaaccggagatctgcttggtgaactgagaggagtccttaggagagcggggacgccaggggccgggggacacttcgctctcgccctagggaaggtggtcttga

SEQ ID NO: 37037 - DNA, 140 bp, Homo sapiens
  chr18:56935479-56935619
  hyper
cgcgctagcatctgagccttagccccatccactccggaccccaagcgcgcacgccggctccagggaagggcgcctctggtctaggccgccgaagcgttcggaatggggacgattctctgctgcagcgaagtgtccctaga

SEQ ID NO: 37038 - DNA, 147 bp, Homo sapiens
  chr18:56935927-56936074
  hyper
aggctccagcgcctgcggtgatgggagcggcgtggccagcggggcccggcagcctgttgccctccagctgcagggctgaggtccgcgaagtgcgttgaggcggccagagggcctctcctcaggcctgaaagtcgcccttctccccgt

SEQ ID NO: 37039 - DNA, 383 bp, Homo sapiens
  chr18:56936333-56936716
  hyper
gcgggaacttgtccccgaagccgggcccgcacgggtaggagggcggcggcggcgcgagaggttgcaggccggggcccaacggcggggagttcaggaagggcggaggcggcggcggtggcgtgtagctggcaggcaggctctgcgccggcggcccgaagcccggcaggctctgcagcgccgtggcgcccccgcccggcagcggcggcccgagccaggactccagcggcagcgcgcccccagccggcccgccaccgctgcccgggcccgccccgaggggcgacagcgtcgcggagggcggggagcggctgaaggagaggaggggcgagtcctgcagcttcatggaggacacttccagcttctcctgccgccgccacttagcccgt

SEQ ID NO: 37040 - DNA, 279 bp, Homo sapiens
  chr18:56939373-56939652
  hyper
ccccaaaggggagctcgtactacaaactggaacagactgcttgaagggcgatgcacagggaacatcgaagatctgtgcctctcccttgagactctgggcatgccaagtcgaggaaggacagtaataaatgcatggacacccgtgaattccgagaagcattggctgcaatttgggcctcgggccctcccagatcccagttcctcaacctgggcgctttacctggacccggacctctggtaggttgaccttgccggccagctcctcgcggctgtacacgtc

SEQ ID NO: 37041 - DNA, 408 bp, Homo sapiens; identical to SEQ ID NO: 1341
  chr18:56939763-56940171
  hyper

SEQ ID NO: 37042 - DNA, 680 bp, Homo sapiens; identical to SEQ ID NO: 1342
  chr18:56940565-56941245
  hyper

SEQ ID NO: 37043 - DNA, 632 bp, Homo sapiens
  chr18:56941557-56942189
  hyper
gggccaaggagatggcccagagctggctggggaaggaccttctcccggggaagaggcctctcgcctccccgagggttcaggagtaattggcttgcagttctttctcctttggaccccctcgaggcttccgtggcccacagtgactgatcggccacttggaaagatgattggatagggtgagtgtgtttcacctccagcagcgcggatggacaatggcgctgtgaacgtctcacccctcaaatctgaggcgagacccgaggcgagcgcttggccttccctgaactggtggcctgaaccgtgaattaaaatgctttcctataaaagctcaaggacctagaggacaatatccctaaaatctccttttcagtaggcgctctgatctccacagcaggggtgtcttctttatcccgcttgcgttcagacaagcgtttgctgcgtccctttagagggcaaggcaaccgtcgagggccacgtcgtgggcatcaaacaaattgggaaaggccagggccgttggcctggtggagtttaacgtccagtctggaagacaagacaaaggaagagggaaaacacacatcctcagatccccaacctttaaattggtgttagaaggatgtttgcggaggacaagtcaa

SEQ ID NO: 37044 - DNA, 30 bp, Homo sapiens
  chr18:57069866-57069896
  hyper
agaggtgactgaggccgctgtgctgaggct

SEQ ID NO: 37045 - DNA, 37 bp, Homo sapiens; identical to SEQ ID NO: 13089
  chr18:57363706-57363743
  hyper

SEQ ID NO: 37046 - DNA, 532 bp, Homo sapiens
  chr18:57364448-57364980
  hyper
gccgtcctccggctcctctctgtaggtccacgtgtgtcccaacgccaggagcagcagcagcggacccaggctcctgcccagctggcccctggcagctcctccccggctcggaggcggcggcaccatcagggaagctcccggcttcttcccagcgccgagctccgtccggaccaagcgtcctgctcctccgcggccgccgccgccttccctcttcccggcagggggcgccggagagcaggggcgtttgcaccacctgcacggggagcaggggtccggaatattatggggctggggggaaaatgaggctaggagttggggtatcggatgcaaacccagcagagaagcaggtaaagggggtacctgcggtgtccggctggcgcgagggccctgaggttcaagttgtctcgtcgggacgttcacgtccgattgacagacttgctggactcggcttggggctgcgccctcgcctcttccctctccctcctctgggagaagcgcgcagggtggggaaagcgggcggttgtttgcattt

SEQ ID NO: 37047 - DNA, 515 bp, Homo sapiens; identical to SEQ ID NO: 4560
  chr18:59000829-59001344
  hyper

SEQ ID NO: 37048 - DNA, 208 bp, Homo sapiens; identical to SEQ ID NO: 4561
  chr18:59001497-59001705
  hyper

SEQ ID NO: 37049 - DNA, 263 bp, Homo sapiens
  chr18:60263660-60263923
  hyper
cgctcccgcgcgggtcagcaattcgaagtccgccccagacccctgggccttcgggcgcccccggaagccgcagggactgtcggactgagcggcccccttgcttgggtgggagctggggtgcagagaggggctgttctcgcacccttccgctgcatcggtccccgggccagtgcggagactcctctttgcgtttccaaatcacttttacgaacaaaagaggcgcccagaggatatcaccccgggcgcaccgccctccaggggtg

SEQ ID NO: 37050 - DNA, 135 bp, Homo sapiens
  chr18:60264219-60264354
  hyper
agtgcgtccagcatacgtgggtgtggacgaaggtgagaaagggttctttccaaaggttcaagacagagcttccagtaccttctaaatccccagaaagtagtggtctagaagttgcttctccgcttcccaacgcca

SEQ ID NO: 37051 - DNA, 140 bp, Homo sapiens; identical to SEQ ID NO: 13094
  chr18:60985592-60985732
  hyper

SEQ ID NO: 37052 - DNA, 21 bp, Homo sapiens
  chr18:60985733-60985754
  hyper
tgtgcccgggctgggaggaga

SEQ ID NO: 37053 - DNA, 137 bp, Homo sapiens
  chr18:63417736-63417873
  hyper
ttctttattttcctgcgaaggaatccatctgtacagatccgccaggcgggaggtggaggagggtgcgcgagggtgcgcgcgtgtgtgtgtgcgcgcgtggcggccgagcggctccgtcttcgcgttcttttccagta

SEQ ID NO: 37054 - DNA, 399 bp, Homo sapiens
  chr18:67067494-67067893
  hyper
ttcagtcctagttaacgaaaacgcatgcataaatcaaccactcgggtcggtcggtcttctccactccttcagcagaggacgtcggcgcccggctgcctcgcccgcctgcctgtctctaggctgcgggaggattagacacatgcgcacgattggtctctttgtgtgcaccaggaagggtctggcgtcgatttacacttcctaacggggcagagacctggaacggccgcgagtgcttgggaataaaaatgtactgtaaacaaggccaatgaaataagtgtctcgctcccgctggccttccgcgttggaagtgtccccactgccctttccccgctgcacagcttgcgagtggagatttagagcccgggaatgaggcgccgtgtccttaggaatctcgcgccc

SEQ ID NO: 37055 - DNA, 57 bp, Homo sapiens
  chr18:67067894-67067951
  hyper
gggagcgctgagggaccggggagccgggtggggagcgggcctcggggcgcccggcgg

SEQ ID NO: 37056 - DNA, 113 bp, Homo sapiens
  chr18:67068698-67068811
  hyper
ggggcccacacctgccggggggctccgcagacggacctggggactccaggagcgcctgagtccccatcctcgagtgcaccgggctgtcttcgaccgtgcggggaagtcagtag

SEQ ID NO: 37057 - DNA, 214 bp, Homo sapiens
  chr18:67069032-67069246
  hyper
ggctgtagtttagggcgccttcgccgtggccgagggcggctcccgcgccccgcaagtgctcccctacccggggacccgcgcccgcgtgcaggcaggtgtgtgccccgcgcccgcccgcggtcactgctccgtgacggcaaagttgatggagacctttccctattcttgagagatgcgctgcctggcttgggagggaaaccgtgtagaacccaag

SEQ ID NO: 37058 - DNA, 238 bp, Homo sapiens; identical to SEQ ID NO: 13098
  chr18:70209148-70209386
  hyper

SEQ ID NO: 37059 - DNA, 440 bp, Homo sapiens
  chr18:70209493-70209933
  hyper
gggggccttcgtccccggctctgacgttcaaggccagggtcgttctcagaagaaaggcgcctgtgaacctgtcagggcacagaacccaaagccttacaccgggaggtggagccaccgggaagaagggggactgggagcaggtgcctgcggctcgggggttctccccgaaggccacccccttggtcccgcgcacagccaacccgctttccgatctggcacaacaggtccggagaaacgcccgggcgcagctggcagcgcatccctgaaggctcccgagcagcgcgcggggctgcgacgagggagggggccgcgcttctgcaggtcctcgtcgctaagacgggccccgagaccctcagaaggcgtcaccgccaccccgcccattcaccagcgcggagggggctaagacgcaggcaaagaaaaacctacgaatgcttgccttc

SEQ ID NO: 37060 - DNA, 89 bp, Homo sapiens
  chr18:70210724-70210813
  hyper
aacatccatgctgggcgagctccgctgtccgcgaagttgctctgcttagagaaaatgaggcgagtgggagctgtcgggaggaggacacg

SEQ ID NO: 37061 - DNA, 258 bp, Homo sapiens
  chr18:70211036-70211294
  hyper
cccctcgagctcccgcgctcagcgcgtccgcagcgcggctccctcgcgggtcccctcggccccgcagccccgccagtctccagagggcatagccgagcgctgccgcctccctaggactcggaaccttccctgctcccaagcccgccgcaccctccaacgccccggtcctgctcacccaaacgcccagagcaaaatactcccagacgtctcttttgaaaattagacacccttaaaagcaccggtcgcttctcttctttt

SEQ ID NO: 37062 - DNA, 185 bp, Homo sapiens
  chr18:70211499-70211684
  hyper
gaactgtccggttcccgcagggctagaagaggggcctccggcccgggtctgtgtgtctgctcctctggacctcggactggtggagcggctggcgcttgcgcttatttattaaattgcggtgtccgcgctcgctcaaaggacccggggagacgcgctgggtttcccagctgcgcctggagctcggc

SEQ ID NO: 37063 - DNA, 100 bp, Homo sapiens
  chr18:70534216-70534316
  hyper
catccctgaactgcacgctatcctccacccccggggggttcctgcgcactgaaagaccgttctccggcaggttttgggatccggcgacggctgaccgcgc

SEQ ID NO: 37064 - DNA, 36 bp, Homo sapiens
  chr18:70534427-70534463
  hyper
cgttcggccccgggaaaggggcgggagggctggctc

SEQ ID NO: 37065 - DNA, 335 bp, Homo sapiens
  chr18:70535220-70535555
  hyper
cggaaagaggagcgggtgggtgggcgtctgggaggcgggctggagggcggtgcaggggagcggggcggccggggggggggccggggggcggggaagggagggaggagaaaggagccggaagagggcagagttaccaaatgggctccttagtcatggcttggggctccacgaccctcctggaagcccggagcctgggtgggatagcgaggctgcgcgcggccggcgccccggggctggtgcgcggcagaatggggccgcggcggcggcagcaaggacatcccagccgcgcggatctgggggaggggcggggagggggtgaggacccggctgggatc

SEQ ID NO: 37066 - DNA, 93 bp, Homo sapiens
  chr18:70535575-70535668
  hyper
cgcagagagaggatgcagccgcaaatcccgagccggatcctcgtgccggacggaaggcgtggaagcgggaggggccttcgtgtgaaaatccct

SEQ ID NO: 37067 - DNA, 175 bp, Homo sapiens
  chr18:70535909-70536084
  hyper
ttactcctgcaaagacgcgggcttcttgcaattgagccccccacctcgaggtatttaaaaccaccccaaggcacacacggacccccgttcccccgcgccacttcctcctacaggctcgcgcggcgcgttaaagtctgggagacacgagttgcggggaaacagcaccggaagagcc

SEQ ID NO: 37068 - DNA, 838 bp, Homo sapiens; identical to SEQ ID NO: 13106
  chr18:70536187-70537025
  hyper

SEQ ID NO: 37069 - DNA, 33 bp, Homo sapiens; identical to SEQ ID NO: 13107
  chr18:70537332-70537365
  hyper

SEQ ID NO: 37070 - DNA, 378 bp, Homo sapiens
  chr18:72123440-72123818
  hyper
ctgaagtctcctttgcgcctgaaagaacggctagccaagtttccaatcaactaaaggtgggcgtttcattcatatgatgtgagcccagcgtacgcagcagtctgcaaaatgcgaaatgtttctttctctccctaattctctggctcagctgaggagctgctgggtgcgagctttcgggccctcccaggttaggaggcgcctgtcgaggaccgggacccgggatcctcccggtcccagccgcctccgcagcgctctctgctcgcccgagcgcacactgcgtcggttcccacagaccgcgaccgcggagagcctgggctctggagcgcaggggggccggggtcagaccagccctccgcatgggctcggtgagataggggg

SEQ ID NO: 37071 - DNA, 15 bp, Homo sapiens
  chr18:72124175-72124190
  hyper
aacccatgtccccgg

SEQ ID NO: 37072 - DNA, 48 bp, Homo sapiens; identical to SEQ ID NO: 13109
  chr18:72124237-72124285
  hyper

SEQ ID NO: 37073 - DNA, 143 bp, Homo sapiens
  chr18:73167786-73167929
  hyper
gtcccgcccgggttgcgcgcagcgggggccgcgtgatggatgggccgggccgggcacccgggaacccgcgagcgcggggctgggctctgggctgcgtccgggggccccgacttggttattgatcggcccaagcgcaggagaac

SEQ ID NO: 37074 - DNA, 32 bp, Homo sapiens
  chr18:73628017-73628049
  hyper
aaaggccagttaggccgcgaagctttgccaaa

SEQ ID NO: 37075 - DNA, 114 bp, Homo sapiens
  chr18:73628494-73628608
  hyper
ggaggagcctgagggccaagagggccggcgcgcggtgggcgcggcctgcggggatgccgggctctacggagcagcgcggggtcccgaagccccctaccgcgaggcctcagaagg

SEQ ID NO: 37076 - DNA, 273 bp, Homo sapiens
  chr18:74961385-74961658
  hyper
tcctctgtagcaggccgcggggtgagggtgggattaggcggccaattttacaaaactccagggagcgtcgccagcctcgatttcctggggttattcctgggagagaggcgttctcacggacagccaccctggggaggaggaggaggaaaggcactaatggatgaggaggcccgcgcacccctccgcctcccaccccggcgcgccctggaacgccctggagcgcgcccggcttccctcgcccgcctggcccgcggcatccggcagccccgcctt

SEQ ID NO: 37077 - DNA, 88 bp, Homo sapiens
  chr18:74961868-74961956
  hyper
tcccaaaagagctctcgccctgtggacgactcggaatccctggaaaagccgggagggagtcggaggcgccagcccactggggaggtgg

SEQ ID NO: 37078 - DNA, 153 bp, Homo sapiens
  chr18:74962018-74962171
  hyper
cgctgggcagtgcggggaagcgccgcgggaaggagcggctccgagcaacaggtgcagcacgcagcccctccgggagccagggaaaaccgccggcgaagatctggagcggtaaggcggagagaagggtctttccacctgcgcggctgcagccgg

SEQ ID NO: 37079 - DNA, 6 bp, Homo sapiens
  chr18:74962209-74962215
  hyper
cggagg

SEQ ID NO: 37080 - DNA, 250 bp, Homo sapiens
  chr18:74962692-74962942
  hyper
gggcaagccgcggagcaccaccaacctgttcatcctcaacctgagcatcgccgacctggcctacctgctcttctgcatccccttccaggccaccgtgtacgcgctgcccacctgggtgctgggcgccttcatctgcaagttcatccactacttcttcaccgtgtccatgctggtgagcatcttcaccctggccgcgatgtccgtggaccgctacgtggccatcgtgcactcgcggcgctcctcctccctc

SEQ ID NO: 37081 - DNA, 316 bp, Homo sapiens
  chr18:74963230-74963546
  hyper
ggggtctcagtgtcccgcggccctgccggagccttggcggcagcctggccccggtggtccccactctggcggcgctggtacggatctgtgcagagaggcttcctggccgctgctggagcgtgccattggcttgcgcaagaaagttacttggagtctgagagatgctggggaaagtttgcagttcacttcgcatggtccagtagaaccagtttctcctcccctccccttcctcggccctgcggcccttcaacgcccccaggttgcctgggcggtaggtaggcgggcgctgccgcatccttcccggtacagcaaaccc

SEQ ID NO: 37082 - DNA, 70 bp, Homo sapiens
  chr18:74963720-74963790
  hyper
cggggcggcccctctcccccggggtgcgcagtttgccctcgctccgaaggctttgcgcacaccgggctct

SEQ ID NO: 37083 - DNA, 246 bp, Homo sapiens
  chr18:75362850-75363096
  hyper
caggaccctgcaggacgcgggccgaggctcccagctgccggccatgccctcggctcctctcccgacacgcgccagcactgccccctgctggcctcccgggagcactgcccgctgccgcggcgggaggagacccgggaagaagccgggaccgcgagcagctggacgctttctccctggggctcagccacacattttagtcacagttacagactacgggggatttgaagccttcgctttagtttttat

SEQ ID NO: 37084 - DNA, 462 bp, Homo sapiens
  chr18:75611969-75612431
  hyper
tctccagctgagccccgaggaggccgctgctccgtgtcctggactctgagcaaagccgcgggccttagaccctccccagcctcaggcgagccccagtgccgacacctgctaagagacggtgcattgcgggctaaacccgcagacactgagcggggacgccacttccgacggcgtaaggcacctaaagtagccacagaggaaactgggggtgcaggagctgcaggagccccggcggcctgcaggggcggtggcgcggcgctgggcgcgcggccgctagatggcagcgcagccccggcccggcccgcgggaggcggccacgcgcgggggacgcggggcgcggcgcgctgagcgcgggtgccgaggctggagggcgcggccgggctcccgagtcctccctccgcggcatccttgtctccaccctcaaatgtcctgcaagccaggagcctccgtaggaaccgctgc

SEQ ID NO: 37085 - DNA, 332 bp, Homo sapiens
  chr18:77153184-77153516
  hyper
attaagtgattttcccgagcaggaagtggcatctggcctgcggttcagtagggggaggaaagggtgggcgcacctgcccctggctggcgcacctgccaggtagccccacgcggcaccgcgtgtgccgagcgcccctgaggatggaaagccccacgcggggcaggtggcacccaccctccgaagacgggacgggatggagcgttgagcttcggggcagctccggcccggcccgcgctggagacgcccgcatctgccaggatggcgtctcatagccctggtgctcacacatgacgccaggaagccccagcaacagtgaccgcccaggctctaga

SEQ ID NO: 37086 - DNA, 166 bp, Homo sapiens
  chr18:77159847-77160013
  hyper
tagcgttggcggcctcgggctgggacctccccactcccggggctccgcagggcgcgcacgtggcgctcgggggtcaccgttgcagccgctttcccgaggaggcccggattgaaaacttctttaaaaaaaaaacttaaaaaaaaaattccgtcgccctgggcgcagc

SEQ ID NO: 37087 - DNA, 132 bp, Homo sapiens
  chr18:77547916-77548048
  hyper
cagccagggaggagacgccggggtccgcgccgcggggcgggcgcttccccggacccgggggaggcgggacgcaggcgaaggccgccccgggagagcggggtcccgggagagcggggtcccggctgtggggga

SEQ ID NO: 37088 - DNA, 258 bp, Homo sapiens; identical to SEQ ID NO: 1347
  chr18:77548351-77548609
  hyper

SEQ ID NO: 37089 - DNA, 9 bp, Homo sapiens
  chr18:77557882-77557891
  hyper
aggctggga

SEQ ID NO: 37090 - DNA, 485 bp, Homo sapiens
  chr18:77557912-77558397
  hyper
cgccggagtccgggatgccggctccagagacgccgcgctccgccccgaggaggccgccggccgggtaagcggagcccggagctcgcggagtctggaccgcaggtaaagttgagcgcgccgtggggccgggggtggggggtccgcggcgaaggagccggggccgcagtgggcggtggggcggggggcgcgggctcctgtctgatggttccgcgcgcagcttcttctccgggtgcgcggtgcgcgcgggcgcgggagggtcgaaggggaccttggaatccccctgttcgggccaagggggcgggggcggctcggggccgggcggggctggtgcctccccctcccgctcagcgcccagagtccgggagtcgaggggggcgtcgggccggaggcgctcgccggtctggccgcgccgcgcgcgtggatggaggtctcggccgcggatcgccccgtctattcgcgctggtcctgcgggagcccgggtgagc

SEQ ID NO: 37091 - DNA, 726 bp, Homo sapiens; identical to SEQ ID NO: 1349
  chr18:77558416-77559142
  hyper

SEQ ID NO: 37092 - DNA, 74 bp, Homo sapiens
  chr18:78005084-78005158
  hyper
tccccctccgcggggcgccccattcattagccaggagactgggcgcagggccgccggggcgggcggggggctta

SEQ ID NO: 37093 - DNA, 78 bp, Homo sapiens
  chr19:496464-496542
  hyper
gcttccccgcggcctcgggacagaggggactgagcatggatttcggactggccctcctgctggcggggcttctggggc

SEQ ID NO: 37094 - DNA, 268 bp, Homo sapiens
  chr19:591263-591531
  hyper
agagcgagaccggcgcgtgtccccgtgggctgtgtgtgaacaggggcccgtgaccgcggcggggttcccggggcgcgagcctgtggccggagaggtgtgtctccaggagtgtgtttgcgtggtggtcgcgggcgtgtgcgcctccggtgggtttattttggtgggacgtgtggtttgtgtgtgttgggaccaggtggcgggcgtgcgcgtgtacgcccggggccggtgtgcaccggtgggcagtagtgtgagccgcaggcaggtctca

SEQ ID NO: 37095 - DNA, 89 bp, Homo sapiens
  chr19:639980-640069
  hyper
acgccgcgggaaccccgagcgcgtcgcggggaccgcgcagctacccgcacctggagggcgacgtgcgctggcggcgcctcttctcctcc

SEQ ID NO: 37096 - DNA, 103 bp, Homo sapiens
  chr19:661158-661261
  hyper
ccgtgtccaaggccacggggcgaggaagtggctccaccacaccaggatccagtcctgtgcgggctctaggagcagctaaatgtgcagccgagtcaaggcagtg

SEQ ID NO: 37097 - DNA, 61 bp, Homo sapiens
  chr19:822595-822656
  hyper
ggcgggattgcggggcgcggggctgggggctgggggctgcgggatgcgggcagggccctcg

SEQ ID NO: 37098 - DNA, 87 bp, Homo sapiens
  chr19:1401710-1401797
  hyper
ggcaccgcagccccgcgcccggggacgcgaacctgcaggctggggactggaatccccgccttgccgcttacgcgccatagattcctc

SEQ ID NO: 37099 - DNA, 197 bp, Homo sapiens
  chr19:1446633-1446830
  hyper
gacccctcctcactgcgccgacgcggaggctgcgccagctggggcggcgggggcggctgcgggggcatcctgcggaggctcggccctgcgcagggtgggggcctgggccacgccctgcgcttctttgggcctcagtttccccttctgggcgcgagcgtatggcctgctttgacgttcgccgccgctgctgttcgtat

SEQ ID NO: 37100 - DNA, 359 bp, Homo sapiens
  chr19:1450073-1450432
  hyper
attggctgtctcacccgcatccctcatcccgcatcctcccccgctcgcggtggtctcgcccagcgctaggagcggcagcgccgcctgcccaggcccggaccgggctttgtccgccccggagcccctgcccgcgccgcggagaccccggagcccgcgcgctccgaggccaccccgggccgggatttccggtggggcccgcggagccgcgcagagggaggaggccccagacccaggcgccccgccagcccagctgcacgtaagcgggtgtgtgtcctcggggaggagggcaggggcgcgacctccgcctcgcgtcgaggtttccatccctggctctcagcattgcccgtcagcacagactc

SEQ ID NO: 37101 - DNA, 77 bp, Homo sapiens
  chr19:1523753-1523830
  hyper
gcccccaaccccccacgcgcgagagagcctcagtttcccgctcggtaaagcgggcgtatcagcggttcccagccagc

SEQ ID NO: 37102 - DNA, 107 bp, Homo sapiens
  chr19:1524442-1524549
  hyper
cgtgtccgtgggttgcgtgtccggggtgtgggcgtgcggctcggcctcgggatgcgacgctgtgttgcccctgggtgtgtgtgcgagcctggcgagggtctgagtgt

SEQ ID NO: 37103 - DNA, 49 bp, Homo sapiens
  chr19:1718861-1718910
  hyper
cgtgctgcggggtgccggggcgcagagcccgcggcgggagctgtcagcg

SEQ ID NO: 37104 - DNA, 30 bp, Homo sapiens; identical to SEQ ID NO: 13129
  chr19:1719137-1719167
  hyper

SEQ ID NO: 37105 - DNA, 180 bp, Homo sapiens
  chr19:1725554-1725734
  hyper
gggaggcgatgctgccgacgctattgctgccattactattacggagagatggggcggggcgggagcaccgggcccttcccggaagcccttcctgagcttattcagtgcctggggccgcggcgatcgatgacagctgggcgccggccgagccccctccgggccgcgcgggggcgcatgcgc

SEQ ID NO: 37106 - DNA, 61 bp, Homo sapiens
  chr19:1726021-1726082
  hyper
ctcttatcttggggacgcacggttccagcggcggggggcgagggtacggctgggtgggggc

SEQ ID NO: 37107 - DNA, 415 bp, Homo sapiens
  chr19:1749776-1750191
  hyper
ccagagctgcccgggcgccccgcaactgcgggcaggaaatccgggacgtcgggcccgccaggggcgaaaccccaaagtcgcgacacccggggtggggaggtcaggacgtccccacggccaacgtggaaccttcgggagccgcgcgctcagcctcgccgggacccccgccaggccgtaaaagcccagagtctccccccaaatctaaataaaatccccagaccccgcccgaacgaaggcggctggagtccagagggagaactcctgccacacactaggcaccggcggccgggatttggggcgcccgcaggtttcgggggccgggagtgggagcagagcggatctagggctgcggctgggcttgggtggggcgcgcattcattgccatcgtttagtaaaacctcgctttaataaaagc

SEQ ID NO: 37108 - DNA, 36 bp, Homo sapiens
  chr19:1752836-1752872
  hyper
ggcctttggcaaccccgaggccgggcagcccattgt

SEQ ID NO: 37109 - DNA, 692 bp, Homo sapiens
  chr19:1753502-1754194
  hyper
ccacatcctggtggccgcgctcgcagccgggccgggccgtgcgccgcgcagcctggcagcctcgcgcgcagccaccggggagcgggcgggagtcatgcagcggccttgagcactaggggccggcgctgaggagcgcgcgcggcgggagggcagccgagcatggagctgagcctggagagcctggggggcctgcacagcgtggcccacgcgcaggcgggcgagctgctgagcccgggccacgcgcgctcggcggcggcgcagcaccgcggcctggtggcgcccgggcgcccgggcctggtggccggcatggcgagcctgctggacggcggcggcggcggcggcggtgggggcgccgggggcgcgggcggcgcgggcagcgcgggcggcggcgcggacttccgcggggaactggcgggcccgctgcacccggcaatgggcatggcctgcgaggcgccgggcctgggcggcacctacacgacgctcacgcccctgcagcacctgccgccgctcgcggccgtggccgacaagttccaccagcacgcggcggccgcggccgtggccggggcgcacggcggccatccccacgcgcacccgcacccggcggccgcgccgcccccgccacccccgccgcagcgtctggcggccagcgtgagcggcagcttcaccctcatgcgcgacgagcgggcggcgct

SEQ ID NO: 37110 - DNA, 658 bp, Homo sapiens
  chr19:1754224-1754882
  hyper
cggcaaggagctgcccgccatggggtcgccgctgtcgccgctgcccaacgcgctgccgcccgcgctgcacggcgccccgcagcccccgccgccgccaccacccccgccgctggccgcctacggcccgccaggccacctggctggggacaagctgctgccgcccgccgccttcgagccgcacgccgcgctgctgggacgcgcggaggacgcactggcccgcgggctgcccggaggcggcggcggcacaggcagcggcggagcgggcagcgggagcgccgcggggctgctggcgccgctgggcgggctggcggcggccggggcgcacgggccgcacgggggaggcggcggccccggcgggagcggcggcggccccagcgcgggcgcagcggccgaggagatcaacaccaaggaggtggcgcagcgcatcacggcggagctgaagcgctacagcatcccgcaggcaatcttcgcgcagcggatcctgtgtcgctctcagggcacgctctccgacctgctgcgcaaccccaagccgtggagcaagctcaaatccggccgcgagaccttccgcaggatgtggaagtggctgcaggagccagagttccagcgcatgtcggcgctgcgcttggcaggtaggagcgtggcgcgcagggccagaccc

SEQ ID NO: 37111 - DNA, 757 bp, Homo sapiens
  chr19:1757305-1758062
  hyper
tggggaaacaggctccgtttgtgcctcgccttcctgacttgtgacaatgacaaacagtctcagctctgggagtctgggtttcctgtcgaggaagggagagttagaacagtcgccgtctcaggggtgcgtgggggaaccggaggggtgagcgcagctcctggcaccccgagcctcccgcagggcgctggggcgttgaggatgataaacccggaccacgctgcccgcctgctctctgccgggtccgctgcccacgccgtggccccgccgcgcggccccgcggccgcggggttcacgccgtcaaccttgcgcacctgtcgcgtctcaggtgccctgggggccgcgtctacaccaccggactccgcctggggcgtaagaggtggcgggggcgagggccgcggggtcactaggctccggcccaggcctttagttccggtcgctgcgcaaatgaaaagcggttaagtggcggcaaatcgcggcggttagggggagacggccggatgcgtccccatctccacctaacacggcgacgccccaacgctggtgctcggaaagggaactctgcccccgccccgcccccgcaccatttcaaccccgcagcagaggactcgccgccctttctactccggcatccccattccccgctccgcgagcaccgcgggcctccccaggcctcctccaaggagaactttgcgccccgggtctcccgtcgcgcttgcccggctcggggcgggccacgcgtttccgcaggtgccgagtg

SEQ ID NO: 37112 - DNA, 33 bp, Homo sapiens
  chr19:1758771-1758804
  hyper
ggcgggcgggctcctcggcgggggtgggggcgg

SEQ ID NO: 37113 - DNA, 334 bp, Homo sapiens
  chr19:1762172-1762506
  hyper
ccatctggagaccctcgtgctggctgctgggggtcctgcgtgccttccgcgcgcccccagctgcgcccgccagccctccaaccctcctgccctcctgccctcctgccctcctctctgggagtcgggacagaagctgctgggctctcctccctggagctggggctttgggaaggtcgagtagaccctcagtgagtgggatgcgcgagttggggacgctagttgcggggcagcaggggtccacgcatttccaagcgccctttcccgtccaaggacctgctggggggatgactgtgcctcagtttccatcacccagcaaacgccgtcccgcagcacc

SEQ ID NO: 37114 - DNA, 169 bp, Homo sapiens; identical to SEQ ID NO: 13138
  chr19:1762627-1762796
  hyper

SEQ ID NO: 37115 - DNA, 30 bp, Homo sapiens
  chr19:1764269-1764299
  hyper
gcccccaccccatggcggcccagcctccag

SEQ ID NO: 37116 - DNA, 300 bp, Homo sapiens
  chr19:1765665-1765965
  hyper
tgactctcgggactgcggcccggtggggacacagggctctgggtcactgcgtccacttgataaaccaggaacctgatgtccagagaggccagggtgcgcgttcaaggccactcggcccgcagagcccacccgcgtccccatggctgcagtggtgaggggagcagggggaggcagagaggagcccaccctggggctgggcggacatggatgcgtaacccacaccgcaggcttctgcggggtgacacccagactcaccccaagaccctgcacaccctacagctctcacgtctcacgtccaca

SEQ ID NO: 37117 - DNA, 30 bp, Homo sapiens
  chr19:1768342-1768372
  hyper
agtgagtgaggccagcgggggaggccagac

SEQ ID NO: 37118 - DNA, 230 bp, Homo sapiens
  chr19:1769737-1769967
  hyper
cgcggtaaacagctccgactggatcgatctgggctgtgaggagctgtaattagattgaacgccgggaaggggggcagcagagcctctttttgctgcaatcgacaaaacgggaagttttttcagactctgcctggcccggcccctcccccagcctctgcctctggggtccccattaggcaccagattggagcctgggaggtggggtgggaaagggacgatatgcatcctac

SEQ ID NO: 37119 - DNA, 41 bp, Homo sapiens
  chr19:1775395-1775436
  hyper
ggcccccgggggccccgccggcgccacggccactttctcca

SEQ ID NO: 37120 - DNA, 444 bp, Homo sapiens
  chr19:1776259-1776703
  hyper
acctttaggcaccttcgtggagcgcaaggaaggacgcagctccggacacgggagaccacgcccaggctcccaggagaaggggacccggccggagaaggcgccgctggggccgcccggaggagcccctctgcacgggcccgtggagacgcttcctgcgtggaaccttctggaatccaccgcccccctttccgcccgcgtcagggtctgaactgggcttgcaggggggcagcggggttgaacgtggtgttggtttccactctcgccaaagagagaagacgccgaggaaggtggattccgcttgctccattttttgccaaaaatatttacaaatgggaagggtcggaaatgaagatgagcgcccccctcccaccccgcgctctcccccgctcctctcatctggtctgggtgacctccgagactggccggccgcgggatcccaggagc

SEQ ID NO: 37121 - DNA, 21 bp, Homo sapiens
  chr19:1776990-1777011
  hyper
agtgccaccccttcccgaacc

SEQ ID NO: 37122 - DNA, 391 bp, Homo sapiens
  chr19:1856988-1857379
  hyper
tgggaacacagctgccgcacgtagctcggcggcggcggcggggacatccgcagccccagccggccccgctcacgtggtcccactcccgccggggccagggggcccgggccagggtcgcctctccggcctgggtgcctgccagccccgccccgcgcttggagactgaggcgcgcacatgcgcacgtgggtggcggggcagggggtgcacgggctacccacccacgctgcgctgggcgaagcgcctctgcgaaatgccaggccctgcctcgcacacaatccactcgcagggaggagggtggggtgaacttgtgggggcccagagcgcgctgctcctagccagccgggcccccaggtgcacagccacccagctgctccgcgctacctggccgag

SEQ ID NO: 37123 - DNA, 100 bp, Homo sapiens
  chr19:2251135-2251235
  hyper
accccttcctggagacgctcacgcgcctggtgcgggcgctgcgggtccccccggcccgggcctccgcgccgcgcctggccctggatccggacgcgctggc

SEQ ID NO: 37124 - DNA, 186 bp, Homo sapiens
  chr19:2251610-2251796
  hyper
gggtcgggcacagcgcagcgcgggggccaccgccgccgacgggccgtgcgcgctgcgcgagctcagcgtagacctccgcgccgagcgctccgtactcatccccgagacctaccaggccaacaattgccagggcgtgtgcggctggcctcagtccgaccgcaacccgcgctacggcaaccacgtggt

SEQ ID NO: 37125 - DNA, 856 bp, Homo sapiens; identical to SEQ ID NO: 4572
  chr19:2252588-2253444
  hyper

SEQ ID NO: 37126 - DNA, 40 bp, Homo sapiens
  chr19:2253696-2253736
  hyper
cccagggcagctcctcgctcagggccgggggcggcggcgg

SEQ ID NO: 37127 - DNA, 435 bp, Homo sapiens
  chr19:2289837-2290272
  hyper
tgaaaaacagtcctgcggttgggcgtctacaaaaaaaggggaagttctgcctggggagcgccgtgcagccgtccccttcccctccgggaaatgcataggtggacacgcgagcggccggcccgcgggggaggggaggggagggtccgccctggggacccctcagatcatcttcatgttgaacttgcgcgcgcctccctggcccgccgcggcggccggcccatccaccttgcggaaggagtactccaccgagaagttgtttttgtgctgcccgcggccgcggctccacacgaacagcagcacgaagcagaagaggaccacgcccaggaaggtgatgcagcccatggcggtggacaccaggatggtggtgaggtcgagcggcgcgcgcagggccgccagcgtctcgttgtgggcctcgcccggggtccggttggcggc

SEQ ID NO: 37128 - DNA, 238 bp, Homo sapiens; identical to SEQ ID NO: 4574
  chr19:2290630-2290868
  hyper

SEQ ID NO: 37129 - DNA, 392 bp, Homo sapiens
  chr19:2302559-2302951
  hyper
ccccagcaaggggcacgtcccaccaggcccggactgcccgtctgcccctgcagggcccctcgctctggtggcgggctcggtgagctctgctgcccggtctcgggagtctgggggagcgcggcgtcgacccctgtggagggaggactcgtgtttcaaggacagagcctcattaccatgcacgaccagccgcagctgaggccgcagaggcctttggcaggggggccgggccggcggcagggacggcgttggcggtggtggacgggagtgggggtctgtcctgaacaggtgggggtggtccctgtgctggcccccgccatgcgatcgcaccccaggactctcctcctcttcctaagccccagcatgtgcctggtgccgcgcgggtgctggaggca

SEQ ID NO: 37130 - DNA, 33 bp, Homo sapiens
  chr19:2308140-2308173
  hyper
agccgccgccgccgccgccgccgccgccgccgc

SEQ ID NO: 37131 - DNA, 106 bp, Homo sapiens
  chr19:2478809-2478915
  hyper
aactttttttatttccgcaaactaaaatcaacaagcagaaaaataccccaggaagtcggcctccgggccagccgggcttggcgcagtgctgcgttttgcctgtaaa

SEQ ID NO: 37132 - DNA, 30 bp, Homo sapiens
  chr19:2703070-2703100
  hyper
ttataggctccctctcgtgggaccctccgc

SEQ ID NO: 37133 - DNA, 30 bp, Homo sapiens
  chr19:3244155-3244185
  hyper
tgggccaagagatcacggaagccataagga

SEQ ID NO: 37134 - DNA, 30 bp, Homo sapiens
  chr19:3270512-3270542
  hyper
agcgcgggcagggcccgcctgggcgtcggg

SEQ ID NO: 37135 - DNA, 205 bp, Homo sapiens
  chr19:3361138-3361343
  hyper
ggctggaggttcgggcgcgaggtggcgccgggacgcgatcactcggcacgcagacgtcgctcgccaggggttgcgcttgcgcggggacctgccccgagaggggcggggcggcaggggttccccctccctgagaggccgtggaagtcccgaggggtgggtggttacagcagcacaggggttaggacgggcccgggaggtggctaag

SEQ ID NO: 37136 - DNA, 15 bp, Homo sapiens
  chr19:3585992-3586007
  hyper
ggggccccctttgca

SEQ ID NO: 37137 - DNA, 240 bp, Homo sapiens
  chr19:3785596-3785836
  hyper
ccacgtgtactcacacgcatacggatgcatgcacacgcacagaaacacacagggctcggacacagctgcgcgcagacaagcaaaggaccacgtccacgtggaaacaggtgtgcgcacacgtccccgcgcatccgcgcgcacaagcgctccacacctgggaacgtgcgcacctgtcccccgcccccggcacacacacagccgccccacactggaacacctgggcgccagcgccgggccact

SEQ ID NO: 37138 - DNA, 357 bp, Homo sapiens; identical to SEQ ID NO: 1351
  chr19:3785864-3786221
  hyper

SEQ ID NO: 37139 - DNA, 103 bp, Homo sapiens
  chr19:3786583-3786686
  hyper
gcgcggcggggaccgggggtgagggagagtgagctgcccgtccggggagataagcaaggcgccaagcccggactcccagaggacacttcgtactctgcaattc

SEQ ID NO: 37140 - DNA, 139 bp, Homo sapiens
  chr19:3821971-3822110
  hyper
gttcgtcggatcacacgcgcggaagaggcccgaccacaggcctcccagcgcccgccgggccctagcacagcccggacgggtgtcggagctccccctgctggacgcacccggtactgcagccggtgccgccgccccctca

SEQ ID NO: 37141 - DNA, 157 bp, Homo sapiens
  chr19:3822134-3822291
  hyper
cgttgaaactgcactcgcacagcttgcagtggaagcgaagcactcgcccttcgtcgctgaacacctgagacacagaacagccgcacgcgcaccaggcacgaggcggggtgggatgtgagatgctaccgctgccaggtcgcggcggagccttcctcct

SEQ ID NO: 37142 - DNA, 210 bp, Homo sapiens
  chr19:3868851-3869061
  hyper
ggctgggactggggccgggccgggcgcacgcggcgggagaaggggtaggcggggtcccggccaggctgcaggggccgggactggcgggggctggcgcggcggggcagttacctgtactgcgggccgccgccctgcgcgaagtcgaaatactgactcgtcgccatcttggcgtcttccccgagcctggcggacccgcgacgtcacccgccc

SEQ ID NO: 37143 - DNA, 85 bp, Homo sapiens
  chr19:3869118-3869203
  hyper
cgcgaagccctcaccttctcgcttccttctcttaggctagggagacaccgccccgcgaccacacctgccccgaggccccgcctcc

SEQ ID NO: 37144 - DNA, 304 bp, Homo sapiens
  chr19:3880484-3880788
  hyper
tttaaatctctgatgcgccatcagaaaattatttctgcctctgcccctggcgtggctttcggagatgcttgtctgtcagccaatggggaggatcggattctggcagggggctgtgcttttccgtcaggccgccaccccccaccccctcctccctgcacacaaaagcagcataaattaaccgtcttcgggaagccgagcctctgccagccctgagctgggaagaagcagctacctcggaggcagggcgcgcaggcgggcggcgatgagagggggcgcagccgcagccccgcgctggggagcccac

SEQ ID NO: 37145 - DNA, 59 bp, Homo sapiens
  chr19:3881573-3881632
  hyper
ggccgtccccaaatgcgaagccaggatctgagtgcaggagtgtccggggcccactgagg

SEQ ID NO: 37146 - DNA, 106 bp, Homo sapiens
  chr19:3933108-3933214
  hyper
gacctcgttggaaaacgaagctccccgcagggtcccggcctctagggctgctgtgcgggcgggggtgggtgagttcgcttccttgacgccacgagaaccagtctta

SEQ ID NO: 37147 - DNA, 257 bp, Homo sapiens
  chr19:3933461-3933718
  hyper
gctatttccattcggcggcgggaacaggtgccggcgcctccgccccatccccaggggccgcctcccccggggcggcctccaggctgccgagacctataaaggcgccaggttttctcaatgaagccgggacgcactccggagcgcactgcgtggtcgcaccctacccgggctgccttggaagtcgtccccgccgcccctccgcaccggcatgaagctcatcgtgggcatcggagggtgagcgccgggggacctggtgg

SEQ ID NO: 37148 - DNA, 81 bp, Homo sapiens
  chr19:4077899-4077980
  hyper
gggagatcatggctgcggttctggtccagccagacctcctgggtttgttctttttttaagaaccaccgcaatttaaagagc

SEQ ID NO: 37149 - DNA, 197 bp, Homo sapiens
  chr19:4198002-4198199
  hyper
tgaaagtgtgagtggcgagagccctgccggccgcgtggaggtgcgaggctgcggacgtcgcgggcccggaggcacctgcgcgcccttggccgactcggaggaggtggagatggacgcccgcgggtcccctggagatgcagccggcggcctgcgctggtgagggagccgggcccccggcgccgcgtcctcctcatcct

SEQ ID NO: 37150 - DNA, 92 bp, Homo sapiens
  chr19:4279567-4279659
  hyper
cgctgcgctgagaacccaggcgtccgggctgggagaggggccgggagcgtccgcaggtggcgctggcccggatctcccgaccccaggaaggg

SEQ ID NO: 37151 - DNA, 70 bp, Homo sapiens; identical to SEQ ID NO: 13159
  chr19:4304487-4304557
  hyper

SEQ ID NO: 37152 - DNA, 35 bp, Homo sapiens
  chr19:4380549-4380584
  hyper
gaagatgtgggagggcgtcacgggtgggtatctgg

SEQ ID NO: 37153 - DNA, 32 bp, Homo sapiens
  chr19:4597471-4597503
  hyper
agaatttctgcccatcgcgcacttccatgctg

SEQ ID NO: 37154 - DNA, 189 bp, Homo sapiens
  chr19:5292630-5292819
  hyper
tggggtccacaggcccgagaggagcggaaacaaatggatggaggtaaacttcctgcgattttcgggggtggctaagagcagggattcctgccatgcaccccccaccgctacctgccccctctgcggtcctgttgcctcctccgccttctgcgaagtccccagtcacagctcccccgggctggcagcgaa

SEQ ID NO: 37155 - DNA, 71 bp, Homo sapiens; identical to SEQ ID NO: 13161
  chr19:5293067-5293138
  hyper

SEQ ID NO: 37156 - DNA, 27 bp, Homo sapiens
  chr19:5293155-5293182
  hyper
cggctcggagatcgggcccaggccccg

SEQ ID NO: 37157 - DNA, 175 bp, Homo sapiens
  chr19:5293462-5293637
  hyper
ccatgaaacactgagcgaaggggcgccccagggagggcacgacccaagacccctccctcccgaagacgtctcacggggagcctctacactgctcctcgcttccccagctctgatcgtagccatggcaacgcatgaggaggctggatgccggacagggcggcggagggctccccaa

SEQ ID NO: 37158 - DNA, 122 bp, Homo sapiens
  chr19:5294020-5294142
  hyper
tccaccggaggggcccggaatgtagaagcccagcgggacctgggggtctggggacgggacaggggcagaggccgggatggagacccaagggctcccgcgtctgctcccatccctggaaaaaa

SEQ ID NO: 37159 - DNA, 30 bp, Homo sapiens; identical to SEQ ID NO: 13164
  chr19:5338746-5338776
  hyper

SEQ ID NO: 37160 - DNA, 106 bp, Homo sapiens
  chr19:5339037-5339143
  hyper
tcttcctgcctcctccggcttctaggtatcatccctgctgctcagccgggactccgacacctcggacacccgcttcactagccgcggctgccgggatgtgttttta

SEQ ID NO: 37161 - DNA, 30 bp, Homo sapiens
  chr19:5339394-5339424
  hyper
ggaaagagggtcaaccgaagaaggaggtcc

SEQ ID NO: 37162 - DNA, 352 bp, Homo sapiens
  chr19:5340451-5340803
  hyper
cccggccctgtccctcggggcattgtccgggcgcagctaccggggcgcagcggctgggcgtgcaactggctgcagccgagcatcctccgagcacaatggccgtgcaggcttccccggcacaaagccggcgcgctgcccactcggctgcctccgagaccccccttggagcgcctgcatttttttttcctctaatccatgattttatttttttttttggctttacctggaggctggctgggctgggctcccccggctctgccccgcttcacatcgtggctgttgcatgggatccgagcggagcccgagcgccagcggctcgcggcgtgcgcgcgccggccgggctgccgggcgg

SEQ ID NO: 37163 - DNA, 38 bp, Homo sapiens
  chr19:5436741-5436779
  hyper
acccctcccgggtcccgggagctcgcgccctgctcccg

SEQ ID NO: 37164 - DNA, 214 bp, Homo sapiens; identical to SEQ ID NO: 13167
  chr19:5437029-5437243
  hyper

SEQ ID NO: 37165 - DNA, 63 bp, Homo sapiens
  chr19:5567596-5567659
  hyper
ggcgcccgcctcccccgccgctctccaggggtccccggccgccgcccccgccccaccccaccc

SEQ ID NO: 37166 - DNA, 432 bp, Homo sapiens
  chr19:5827883-5828315
  hyper
gggggcgcggccttgcgggctgcgcgagctggaggtgcgcgtgagcgagctgggcctgggctacgcgtccgacgagacggtgctgttccgctactgcgcaggcgcctgcgaggctgccgcgcgcgtctacgacctcgggctgcgacgactgcgccagcggcggcgcctgcggcgggagcgggtgcgcgcgcagccctgctgccgcccgacggcctacgaggacgaggtgtccttcctggacgcgcacagccgctaccacacggtgcacgagctgtcggcgcgcgagtgcgcctgcgtgtgaccctacctcactcggccggcgcggcggccactccccccgcctcgacggcaccactggccggccccgcgaaagactgcgcgtgcgtagagcacgccggcgcggccccgggactctcgcgataactgtactga

SEQ ID NO: 37167 - DNA, 30 bp, Homo sapiens
  chr19:5962276-5962306
  hyper
gaagctgagggcagacgcttcaggagaaaa

SEQ ID NO: 37168 - DNA, 56 bp, Homo sapiens
  chr19:6393996-6394052
  hyper
aactgcgcatgctcacggcgcaaccattcattgctccacttcgcaaatactccagc

SEQ ID NO: 37169 - DNA, 44 bp, Homo sapiens
  chr19:6501870-6501914
  hyper
gcccgggggaggcaccggggctctttgtgcgtgaggaggggaca

SEQ ID NO: 37170 - DNA, 53 bp, Homo sapiens
  chr19:6502724-6502777
  hyper
tatttagacctcattcgccagaatccttgcagtaaccgcgagccctcccagtg

SEQ ID NO: 37171 - DNA, 45 bp, Homo sapiens
  chr19:6531154-6531199
  hyper
gctgctgctgctgctcgctgccgcctgcgccgtcttcctcgcctg

SEQ ID NO: 37172 - DNA, 498 bp, Homo sapiens
  chr19:6590325-6590823
  hyper
gcaggtctgaaccagcggggaacgtgaagtcgagaccttcaaaagaacttcttcgtttcccgaatcgttttcctggatgtcactgggcgcgagagcaccgcgcgcagcggactctctacgctgcaaaggcgcccggcgcggtccccaaagggacccctcccccacccggagcgagtggctggggccatcccgtcctaggaggccccaggaagcccccacgcccagccttgtgaagcccccagcagcctctgagtcagcctgccgggggaacaccagagccgagtcatcttccatttccatgtgtgcctacctttcccatcccgggatctccctgtacctcctggcagggctgcctgtctcgtagcccctacaccgggcagcctggtccccgcctcgcctccctgttctggtctctgtctctgccctaccagatcttcctctctggcctctttgtacccatctcattctgtcttttcggtcacgcgcctctctatgttt

SEQ ID NO: 37173 - DNA, 123 bp, Homo sapiens
  chr19:7197100-7197223
  hyper
aacttttgacagcttcgtggtcagcagcgacgaccgcaggagcgcgtgtccttgaagcggggaagcgccccttttccttgcctgacaataccgccccacacgcgatgacgcctttggaataga

SEQ ID NO: 37174 - DNA, 270 bp, Homo sapiens
  chr19:7565964-7566234
  hyper
tcccgccgccatccacgccgccgtgggagctgctgcaagcgcaggcgcgggaacgcacgctcgccatgcaggccggcaacctgcacctgcacgaggacgcgcacgccgggatcggcctctccaacgcgcacgccgcctacggctggcccgagctgccggcgcgcacccgagagcggatccgcggcgcgcgcctcatcttcgaccgcgactccctgcctcctggcgaccgcgacaagttgcgcatcccgcccaccacgcaccaggcgctct

SEQ ID NO: 37175 - DNA, 335 bp, Homo sapiens; identical to SEQ ID NO: 13172
  chr19:7794909-7795244
  hyper

SEQ ID NO: 37176 - DNA, 152 bp, Homo sapiens
  chr19:7795540-7795692
  hyper
gacggggtgcatgatcggggtcgggggtcagcactcaggacggggtcggggtcgggggacgcggccagggctcagggccggggtcgcgtcgggccctcaccgcgctcacgcagttcccgcagggcgctctcctgctccatcagcttcgcctg

SEQ ID NO: 37177 - DNA, 50 bp, Homo sapiens
  chr19:7795734-7795784
  hyper
cgtccccgagcctgggagccgcagggtgagaggggcgagggcggcgagga

SEQ ID NO: 37178 - DNA, 486 bp, Homo sapiens
  chr19:7852985-7853471
  hyper
tgtacatctttgggccgtttgcagtcacgcgtgtgcacatggcgtgcacgtatgtgtgcgagtccccacgcgtttgtctcccatcggcgtgtgtgcacatagtgtgcgctatatgcctgcctgcccgcccgctctgtggtcccgagtcgggggaccccgcaccccccgggcaagggaaggatttccgagtccctggccttgcctgcaggagcctctctccgcagcctccacggagcgcgcggcgctgctcggctgccaggacctgctgaggacaaacggtgtgtgcagagccgggcgcctgggcgcccggggcgtgtgcggcgggagcgtctgagaccccagagatggagtcctgggtgcgtgggggccctgtggtccctgagtctggccacggggtgtggaagggagtcccctgagtcctcccaagtgacccggcgggcatgcgttttgggatgggggtcgttccagcctcgaagcagacggcgg

SEQ ID NO: 37179 - DNA, 60 bp, Homo sapiens; identical to SEQ ID NO: 13177
  chr19:7853543-7853603
  hyper

SEQ ID NO: 37180 - DNA, 110 bp, Homo sapiens
  chr19:7853873-7853983
  hyper
actgatcatgcaccccgtcctgaccctgacgctgcactctgaccttgactgccactcctagcgccggccacacccggaccctgcccaggtgtaaccgtccttgaccctgt

SEQ ID NO: 37181 - DNA, 30 bp, Homo sapiens
  chr19:7926920-7926950
  hyper
cgccggcgggcagagcgccccctagggcca

SEQ ID NO: 37182 - DNA, 95 bp, Homo sapiens
  chr19:7927441-7927536
  hyper
ccctgcccgtggcaccgcccccggacgcgcccctacatgaggccccgcccccaatccgcctctgccggcgtcctgcctcccgatctgcccctgcc

SEQ ID NO: 37183 - DNA, 302 bp, Homo sapiens
  chr19:8115235-8115537
  hyper
aagtctgggtaacaccgtcttggccgcggcccgcgggttgggaaggtagggggcagtgagccgtagcggagaggctggccccagcccgccacgccgcttccccacgctcgcagccacgcggagccgcgtcctggtccagcctcacccacccagagcaagaggcggaggaactggaacagcgccccggcccgtgggctgccactggccgcagcaacgggacgggtgagagcacctgcccccgacgcgtcttaactgctctggtggggcggggctgaccgtgcaagccccgccccagtctaagc

SEQ ID NO: 37184 - DNA, 96 bp, Homo sapiens
  chr19:8428705-8428801
  hyper
cctcaagcgtgcgccctctccgccactgggtaaggcgggggcggaatagggggcttgcaatttcacactagaggcgggcaccgtgggggaaagaag

SEQ ID NO: 37185 - DNA, 126 bp, Homo sapiens
  chr19:8429231-8429357
  hyper
agccctgatgctctgcgccgccaccgccgtgctactgagcgctcagggcggacccgtgcagtccaagtcgccgcgctttgcgtcctgggacgagatgaatgtcctggcgcacggactcctgcagct

SEQ ID NO: 37186 - DNA, 145 bp, Homo sapiens
  chr19:9434811-9434956
  hyper
tggtcctagcctttgcgcgtgcgcggcgtgtctgcgtgggcgcatgcgcataacggccgccatcttaacagcgcgttcccgttggcgtctgaggtaagtttttgtttctgggcggcgttcggtggtgtcccggtgcagccacgcg

SEQ ID NO: 37187 - DNA, 118 bp, Homo sapiens; identical to SEQ ID NO: 1354
  chr19:9473938-9474056
  hyper

SEQ ID NO: 37188 - DNA, 56 bp, Homo sapiens
  chr19:9517735-9517791
  hyper
tacggcattcacttccgtttccgggagcgcacttccgtttccaggcatgagggcaa

SEQ ID NO: 37189 - DNA, 106 bp, Homo sapiens
  chr19:9517879-9517985
  hyper
cgactttccaaagctagtagagagatcccagcgtcccccgggaaaggcagaaggggcggggcgataccaagacggagacaatggggcggggcgatgccctggaggc

SEQ ID NO: 37190 - DNA, 122 bp, Homo sapiens
  chr19:9608931-9609053
  hyper
tttaaggcctcagaacgcttggacacttttgaagacgggaacacacggctgaaaacagccctcggacgcgcccatactgcacttcccacccggctcctctaggggaccgaaggtcccaatgg

SEQ ID NO: 37191 - DNA, 57 bp, Homo sapiens
  chr19:9609379-9609436
  hyper
attctagtttccctccgcgtgggtgcggaggtatcaaggggtcggctcagtgcctgg

SEQ ID NO: 37192 - DNA, 405 bp, Homo sapiens
  chr19:9903623-9904028
  hyper
tggtgcaggggaaaccgttggttcagctgcggttcctgggaagggggtgccgctctgatcacgcgcacttctgattcccctctcggggctcggaagcggctgagggctctggacccggtctccgaggcgtgaggcggtgggagggtcggcggccgcgtcctccacgaccctggggagaagtcccagtttccgcgcagccgacaacggttggaccccgtccctccggcttcactgggcaccgtgggggcagaacccggcggcggcttggggtgggggcgggaccacgatggagggagtctgttgggcgggacctcgaaatgcctctgctcgctttcctctgcattcatgcggcttgtacgaggatgcgctgtttcctggtggtttgttatacggcagtagataact

SEQ ID NO: 37193 - DNA, 191 bp, Homo sapiens
  chr19:10024331-10024522
  hyper
gtcccttctctggcccgccgcggggcgctcggtccctcgacacccaggcgccccgggggggcgtgggggagggggcacgagcgcgagctgcggggcagggggtccgggacggggtgagggggggctcggggacgcgggctgcggctcggcgcgcctggcgggctcctcttataaagcgccggctcgggccc

SEQ ID NO: 37194 - DNA, 55 bp, Homo sapiens
  chr19:10121131-10121186
  hyper
cggtgcagtcactcgcggcggccgctcctctcagggtccgcgggaaactgcccga

SEQ ID NO: 37195 - DNA, 64 bp, Homo sapiens
  chr19:10197697-10197761
  hyper
cacacgggagtggggcgctccatcgtgtacggtgaggctgcaggggtcccgggcctggtgcggg

SEQ ID NO: 37196 - DNA, 118 bp, Homo sapiens
  chr19:10347133-10347251
  hyper
ggtcagccaagggagcgctacagaggactggaaaacgctggaggcctggacttcctgatggtcttggtgggggtcaggaggagagcttggcctaccccggtggcggggggcggggggc

SEQ ID NO: 37197 - DNA, 30 bp, Homo sapiens
  chr19:10397660-10397690
  hyper
cggggccccttagtccgggctttttgccat

SEQ ID NO: 37198 - DNA, 392 bp, Homo sapiens
  chr19:10398074-10398466
  hyper
cgcctacagtgagggacaggggctcggtcccggctggggtgaggggagggggctggaagaggtgggggaagggtagttgacagtcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcg

SEQ ID NO: 37199 - DNA, 313 bp, Homo sapiens
  chr19:10400448-10400761
  hyper
tcatgccggcctccacgtagaccccaggggtcgctcactcctgccagctcgccttcaccaaggccaggagcttagcgcacgctcgcctcccgcccccccgccgcctctgccgccgccccctccttggaaaccaagttaccaacgttaaaccaatccccaagcgcaactctgcctcccccacaccccacccgccgcgccgcgcggagccgtcctctagcccagctcctcggctcgcgctctcctcgcctcctgtgctttccccgccgcggcgatgccagggccttcgccagggctgcgccgggcgctactcggc

SEQ ID NO: 37200 - DNA, 173 bp, Homo sapiens
  chr19:10400989-10401162
  hyper
tcgatagcccctacccgcttcgagatcctaggtgttcttccgcacccaacccttcgccctggagacccagtgtctctcctgtccgctccccgggtacctccttacgctgtgctgtgcaccatggtccacggactggcatcttccccactcgcggtccgcgaagactccatctc

SEQ ID NO: 37201 - DNA, 30 bp, Homo sapiens
  chr19:10402001-10402031
  hyper
ctcattcgcactttccgtgagttctgggtg

SEQ ID NO: 37202 - DNA, 81 bp, Homo sapiens
  chr19:10402409-10402490
  hyper
gccgagctggacctgcggccgcacggactgggactgtttgaaaacagctcggcccccagagagctccgaaccttctgtgag

SEQ ID NO: 37203 - DNA, 41 bp, Homo sapiens
  chr19:10406119-10406160
  hyper
gcccagatcagctggcgcgcgcccccgggggccctcaacat

SEQ ID NO: 37204 - DNA, 133 bp, Homo sapiens; identical to SEQ ID NO: 4582
  chr19:10406278-10406411
  hyper

SEQ ID NO: 37205 - DNA, 111 bp, Homo sapiens
  chr19:10406919-10407030
  hyper
catgaggactgacttcgtgcctgtgggagtgcggggggcggtgggagaagccccccggagcttggccaccctccgcgagggtctccaccccgcaggtccgtggctatgggt

SEQ ID NO: 37206 - DNA, 64 bp, Homo sapiens
  chr19:10407044-10407108
  hyper
cggcggggggcgcggcgctgctggccgcgggggccggcctggccttctacgtgcagtccaccgc

SEQ ID NO: 37207 - DNA, 82 bp, Homo sapiens
  chr19:10530397-10530479
  hyper
tcagacgacagaggccgaatcgcgtgcacaactccgcaagcacacaccgaccacaaacgcatccaagcgcttgagaacacat

SEQ ID NO: 37208 - DNA, 519 bp, Homo sapiens
  chr19:10531475-10531994
  hyper
gtctctgtcactgcccgggccccgggagggccaggccaccctgaagcctcccccgcagcacctgtggcggcagcctcggacccccatccgtatccagcagcgcggctactccgacagcgcggagcgcgccgagcgggagcggcagccgcaccggcccatagagcgcgccgatgccatggacaccagcgaccggcccggcctgcgcacgacccgcatgtcctggccctcgtccttccatggcactggcaccggcagcggcggcgcgggcggaggcagcagcaggcggtaagactccccgcggcggatgcgcgcggaacggatgggcgcgcagggaggaggcaactcgagctgccggccgcagggggcgctaggatgcgggtggggtcggtttggctggcgggggcggagggaattcggctgcgggggcgtctgggacctggcccctggttgtgcgctctacgggaggcttcctgctgaagcccatcctggggtccatttagggggcgccacgctgcgcgt

SEQ ID NO: 37209 - DNA, 203 bp, Homo sapiens; identical to SEQ ID NO: 13192
  chr19:10616329-10616532
  hyper

SEQ ID NO: 37210 - DNA, 114 bp, Homo sapiens
  chr19:10624739-10624853
  hyper
cgcgtggcgcaggtcgcggttggtgagcgtgtagatgatggggttcagaagtgagttggccatggccagtcccaggaagggatcggcctgcaggagtacaggacaggtgcgcgc

SEQ ID NO: 37211 - DNA, 702 bp, Homo sapiens
  chr19:10624965-10625667
  hyper
cgcgcccgggtcgaggtggtccccgcagtcccgggccgtgccggcaggcgccgcgcgttggcgcgtacctggcagtagatgcgcgcgtagagtgcacagatagcggccaggatgcccacgaaggcgagcacgcagaagagcacgtaggccttggcgtagagcggcaagacagtggagcaagcgtccaggcgacccaggcaattccagcccagcgctggcaggagcccgaggagcagcgacacgccccaggccgcggctgccatcgccagcgtgcgcccccgactggagacgggcgcgggccccctgcgcgccatggtgaggctgcgctccagcgcgatggccaggaggctcagcacggacgcagtgagtgccacgaagacgcctccctcccgtgcgaaccagagcgcgggggacagtttcagcgtgagcggccccgacagtaggatgttggcggcgtaggcggcgcctgccagcagatccgacaacgtgaggctgcccaggagcaggaacatgggagcgtggaagcgcgggtggcgtccgagcaccaacaacacggctagattctctagcacgatgaaggcgcacaccgccaggcacaccacggcgtcggcgcgcaggccggcacccggctggtagcgcgcaccgcggagcttgccggtgtagttgtaatgcaggacgatgacctcgctcaccggcgccggc

SEQ ID NO: 37212 - DNA, 45 bp, Homo sapiens
  chr19:10625744-10625789
  hyper
cgtaagcacgctcgcagcagccggctaagtcgtgggaaaggggcc

SEQ ID NO: 37213 - DNA, 19 bp, Homo sapiens
  chr19:10628995-10629014
  hyper
tccgcggctcaagccatcc

SEQ ID NO: 37214 - DNA, 190 bp, Homo sapiens
  chr19:10629393-10629583
  hyper
aggccctgctggccgcgggtggggtgagggcgccccaggagagatgagccagaggctgagaataagtgtggatccgggataccctcgtgggaggaaactcagggggcactcaggccgggtcaggcccccatgtagccccttggggatcccagccctcctgcccccgctgttccctcggtgggcagaacct

SEQ ID NO: 37215 - DNA, 118 bp, Homo sapiens
  chr19:10691879-10691997
  hyper
cgtggggcgggtttgcgactcccctgtgcatttctcagaagaaaggtcccctaaatgcttacggccagtgagctcgaagagcacgcggtcattgaggcccagccgcagctctggcatt

SEQ ID NO: 37216 - DNA, 30 bp, Homo sapiens
  chr19:10806164-10806194
  hyper
gctgctgcaaaccaccgcttccaaacttcc

SEQ ID NO: 37217 - DNA, 544 bp, Homo sapiens
  chr19:11529608-11530152
  hyper
ggctagtcccctcctcgctgcgggtcccctcctcccaggtcctgaggacatggggtggcatttggggatgtcccagggcccagtctaatagaacctgtctctagctctttctgccgactgcgctcagagactcgcgcccccatccctaagaggaaccagtcgcttcactgggtcaagggccgcgagtccccaggaggggactccagggcaagttcagattgggagcagataccgtccgacgggcgggcgcttggagtttctggacctgcgggtcaccagggatgcggggtccggggatcccttgtccccttaccagggccagctctttgcctgctgtgcgctccatggccggcgcccgtccctctcagtggcgccgctgagtgaggcggaagggccggcgggtggcgggtggcgggcggcgggcagtggccgggcgctgaggccagaggggcggagcggccgagctgctggggcggggcggggcagggcaggccggacccagcctctgggtgcctccagccggacccagcgccagcccaggaga

SEQ ID NO: 37218 - DNA, 275 bp, Homo sapiens
  chr19:11531328-11531603
  hyper
gatttactgtgggaacgtctggcccggccccttcctcccctccgggcgccgctggccgcctccgttcccggtccgggccgcgttcagcccctgaaggggccccgtggggcctgcgctagacccggagggatcgggggctccgaagggggccgcctggtgggtgtcaggacgagtctaggacctccgagagcgacggtgcttcttgtgactttcgattaatttctgggaacggatcttgagtgatgcgcgggtcactacctcgttgtcctcctcct

SEQ ID NO: 37219 - DNA, 17 bp, Homo sapiens
  chr19:11532425-11532442
  hyper
cacgaggcccagcaggt

SEQ ID NO: 37220 - DNA, 35 bp, Homo sapiens
  chr19:11533057-11533092
  hyper
gtgtggcaggaaccccgcttcgtggctgcgcctct

SEQ ID NO: 37221 - DNA, 30 bp, Homo sapiens
  chr19:11533564-11533594
  hyper
tagggagcgtaggggcgctccacctcctct

SEQ ID NO: 37222 - DNA, 239 bp, Homo sapiens
  chr19:11590953-11591192
  hyper
ggccgaggcccggggcgcgcgatccgacgccacccgctttcccagggctctcggggacgctttgtcgctttggcttggcccagcaccagtgatcgggccctgcgtttgcctgggcggcctgcggggtctgggcctggatggaggaagcatccttagccgccgcggcccctcccccatcaggcctgctggagagggggcaatcccgcctccagggcggcgtcggacgcctcccgaatcgc

SEQ ID NO: 37223 - DNA, 51 bp, Homo sapiens
  chr19:11591537-11591588
  hyper
ccgctgcagatgtggcgatgaaggcggcggctccctcgagggccagggacg

SEQ ID NO: 37224 - DNA, 30 bp, Homo sapiens
  chr19:11591796-11591826
  hyper
caagtcctctcccctcgcccaccctccctc

SEQ ID NO: 37225 - DNA, 714 bp, Homo sapiens
  chr19:11592671-11593385
  hyper
aggcgttgggggtggcgcagcctcctttggtgcgcgggcgccggtgcatgtttacgtcggggcgcgggaactagcacacactggggcggggtcgccagggcgtgaggcttcagcaccacagacagcaatccgacagtccggtcgagggcgctgccggcgaggtagcccagaccccctaactggagagcggcagtccccacccaatcctcgttcctgcacgccctttaggctccagactgtcagagagcgccaccagcgaggagagcctaatttgcccaatcaggggcggcccttgagataaccagttactggaagatgccctagagatcgagccaatgggagtgcgcgcaccaggggatgctgccacgcctggaaagggcaggccaatcgcagtggcccgcgcaataggggcggtggcggtgcagatccccgggtggcccctcttgggctcgccggggcgacctggctgcgggcgctaggggccccaagcgatggtctgttccccaccccgtgttcctcccggtttccgtcatcggaaactgagctaggaggggggctgctcctgggcgcgcggaccccgctgcggttcccatggaaacctgccggctccggcagtgcggggagagtggaggggacctgcctcgcggggggagggagctcgcgggggcggccccagcggccggactcgctcatccttgccgattcttctgtccc

SEQ ID NO: 37226 - DNA, 136 bp, Homo sapiens
  chr19:11650677-11650813
  hyper
cctcctcccccccagcgccggccccagagccgcgcagagccgcgcagagacgccgcgccttataaggcggcctcggggagcccgggccacgctatataagggccggtttgctttataaagccgggctggtggcgtg

SEQ ID NO: 37227 - DNA, 231 bp, Homo sapiens
  chr19:11689321-11689552
  hyper
tctgcaggccctccacgggaccgcagcctgggagggcaggaggccctgcacctgcggccggtctgacctgctcctcacctccctgcctgcctcctccgtgctgggcgccgccgcgacacgtcccgcggacattcaggagtcccttcagtccctgcgagcgcggacccgggagagagctctcattcaacgctgaggccactggctcacagatctccccgggtcaccctgcga

SEQ ID NO: 37228 - DNA, 171 bp, Homo sapiens
  chr19:11805426-11805597
  hyper
ggacgcccggggtcccggctgccagcccagccccaccctgcggccgaggggaccgagggccgagctccgccagcggtactccggtccacagagcccggagtcgctggctgggaggccggggacccgccacggccagttccaaccagcccctcctcccgtctcgggatccct

SEQ ID NO: 37229 - DNA, 278 bp, Homo sapiens
  chr19:11909455-11909733
  hyper
ccacggctcctgtgacgctgtcacctgcgctgtgacctgctccggagtcataaagaggacgccgggacaccaagaagcagggaaatggtaaagtgcccggcctagcgtccagatacgtggaagaggggctgggtggaaccaacaggatcctgctgtggcgggacccaggcctccgctcgggcgaccccggcgattgggacccgcgtcccccatggcgtggcttggccctcggtccgctcggccgccaggtggggctgggcccgcagctgggaccccgg

SEQ ID NO: 37230 - DNA, 158 bp, Homo sapiens
  chr19:11909793-11909951
  hyper
gctccgcgcccgcagcccggcgtcttcccagattgtgcgggggccacgggagggtcatggggggtcggatgtgtcccgcctttcttctgctaaaaattaaactgaggctctgttaacagttaaagagtttgttggagcaacagcgattccgagtgaga

SEQ ID NO: 37231 - DNA, 333 bp, Homo sapiens
  chr19:11959427-11959760
  hyper
ctgtcagtctggctccgcagggcctgatacccagggcttccgctgtcacttagacgtggggggcggggccgaacattccatccaatcagaggcactggctcggggccctgcccactgtgcatccaggcacggaggatgttgcattcctgccgtcacctttgtcgctgcgagggcggcggttgggatctggcctttccagccccgagagggacctagtgcctctacccagatttctgtcgctctgtcacctgcgctatgccctgctttactcacaggagctgtagagaggaccccggtacatctgaaagccgggaaatggtgcgtgtgctggcc

SEQ ID NO: 37232 - DNA, 316 bp, Homo sapiens
  chr19:11959761-11960077
  hyper
ggagtggtgcgatgggggaggggctgcctggaactggcgggacccgggcctccctgtgggcgactccggggtctgggaccgagtcctcctagagctgctcggccctcggtccccgcggccgctggatgtgggtgggccggcagccgggactccgggcgtcctgtcccgtccctgcccgtcgactgcggccttggccccgaagcccttttgtgcagctccgcgcccgcagcccgacgccccagcttgtgcgggggccacgggagggtcatgcgcggatttcgactcgggtgtggatttcgtccgtaggaggagcagc

SEQ ID NO: 37233 - DNA, 30 bp, Homo sapiens
  chr19:11960297-11960327
  hyper
ctggagtaagtggtccggaggcggctcagg

SEQ ID NO: 37234 - DNA, 30 bp, Homo sapiens
  chr19:11998469-11998499
  hyper
gctgtggtcagaatccgtctgtctggctct

SEQ ID NO: 37235 - DNA, 342 bp, Homo sapiens
  chr19:11998761-11999103
  hyper
gtgtagagaggaccccgggacatctgaaagccaggaaatggtgcgtgtctggggccgggtgtcgtgagacgggggaggggctgcctggaccgaccggaaccgactgtggcgagaccctggctttcctgcgggcgactttgggatctgggaccgagtcctcctggagccgctcggccctcggtcccctcgactgctcggtgtggctgggccggtagccgggacaccaggcgtcctgtctcgtctctgcgcggcgactgcggttccagagccctctatgggcagctccgcgcccgcagccacgcgtctacccagattgtgcgggggccacgggagggtcatgtg

SEQ ID NO: 37236 - DNA, 62 bp, Homo sapiens; identical to SEQ ID NO: 13209
  chr19:12075756-12075818
  hyper

SEQ ID NO: 37237 - DNA, 20 bp, Homo sapiens
  chr19:12076359-12076379
  hyper
tcgtgcgtgggaggagcagt

SEQ ID NO: 37238 - DNA, 392 bp, Homo sapiens
  chr19:12146632-12147024
  hyper
tttgaccggatccagcgatagattctttaagccagaggtctgtaacctttttagcaccagaaccggtttcgtggaagacagttctcctacgggggcagatagtttcggaatgaaacttccacctcagatcaggcattttatcctcataaggcgaacccaacctagatccctcgcatgtgcagctcacaatagggttcgggctcctatgacagactaatgcctctgctgatctgacaggaagcatatctctggcgataatgcccgctggctcgcccgccagccgctcacctcctgctgtgcggactggttccttacaggccatggaccgggggttggggacccctgccatagagtactgttgaatagaaactttagctcgtccggcggtgggc

SEQ ID NO: 37239 - DNA, 281 bp, Homo sapiens
  chr19:12163055-12163336
  hyper
tgtgtttccctcagccgaggtctctcctattcggctcagaataaacttattctacacgatttgggtttttccgttaccaaaccacaagccaggactgggagtttctcattcattaatcgctgtttgctaaaataaactctcattttttaacagtgcctcagtttaatttttaactggaaaaaaaaaggaactggggaccccacagcccacagctcctcccacacgaaccccacacccgaggcaggatcccccatgacccttccatggtcaccgcacaatct

SEQ ID NO: 37240 - DNA, 161 bp, Homo sapiens
  chr19:12163456-12163617
  hyper
cagcggccgaggggaccgagggccgagctgcgctagggggactgtgtctggagcccagagtcgctgcaggggggcccgggccccgccacagcgggttcctctcggttccacccagtccctcctttcgccttgggactccccagcaccgcatgctcaccatt

SEQ ID NO: 37241 - DNA, 131 bp, Homo sapiens
  chr19:12163881-12164012
  hyper
tgacagcagaagccccgggtaactgggcgctgcagagccgaagcgactggttctggccacactttccaaggtcagctccctccctccctcccacctttacttcgaatatttgccttcggccaaacttgctc

SEQ ID NO: 37242 - DNA, 706 bp, Homo sapiens
  chr19:12175445-12176151
  hyper
tcaggatgcagggggcggggcctggcgctccacccaatcagagtcgccggggtggggcccggccaactgtttatccgcgggtcacattgccgttcgcctcagtctttggcccctcccgccgggtgaggttggcaccccgtttttcctgctctgagagggaccggttgccaccgccatacttctgtcgccctgtcgtctgtgttgtgactgctttggacgtgggagtcacctgaaagccaggaaatggtgagtgtgagcccccgctgggagtcccgagacttgggggagggtaggcggaggctggttggaactggctggaaccggctgtgccgggacccggacctccccgcggcgactcgaggtctggggcccgagccccgctggcgcagctcggccttcggtccattcggccgccgggtgcggctgggccggcagccgggacccctgggcgccctgtctcgtcgccgcgcggcgactgcggccccagcccgggagccctctctggacagctccgcgcccgcagcccggagcctctccatattgtgcggggccacgggagggtcatgggggcaatcccgccttgggtgtggggctcgtgcgggaggagctgcgctgtgaggccctcagtgccccctttctcctgttaaaacttaaacaggcccggtgctgggaatagaggcgtgagccaccgcgcctggcctagcgt

SEQ ID NO: 37243 - DNA, 336 bp, Homo sapiens; identical to SEQ ID NO: 1357
  chr19:12203013-12203349
  hyper

SEQ ID NO: 37244 - DNA, 288 bp, Homo sapiens
  chr19:12203350-12203638
  hyper
gctgtggcgggacccgggcctccccgcggcgactccggggtctgtggggctgggccggcagccgggacccggggcatcctgtctcgtcccttcgcagcgaccgcggccccggacccggagccctctttgggcagctccgcgtcttcagccgcgggtctcctcagattgtgctgggccatgaggaggatcatggggggaatcccgtctcgggtgtagggttcttgcgtcagaaaagcggtggtctgtggagtccccagtcgtcttttctcctcttaaaagttaaaatgg

SEQ ID NO: 37245 - DNA, 325 bp, Homo sapiens
  chr19:12266983-12267308
  hyper
ggggactggggaccccgcagcccaccgctcctcccacacgaaccacacacccgaggcaggattgcctccatgaccctcccgtggtctccgcacaatctggggagacgcgggactacgggcgcggagctccccagagagggctccggggccggggccagggccggggtcgcagtcgcagcgcagagacgggacaggacgcctggggtcccggctgccggcccaaccccaccctgcggccgaagggaccgagggccgagctacgccagggggactccgctctgcagacccgaagtcgctgcaggaaggcctgggtcctgctagagcc

SEQ ID NO: 37246 - DNA, 390 bp, Homo sapiens
  chr19:12267309-12267699
  hyper
gttcgagccggttcctcccggcccctcccccgtctcgggacccccggccccgcacactcaccatttcccggcttccaggtgtcctggcctcctctccacggatccctctaacagtccagtcacagtgcgggcgatggagcgacagaagctatggcggaggcacctggtccctctcggggccggaaaaccgagatcccgacctccctttggtgcaagacgcctgggagtcaggaaagcgggaatgcggcctccccttccccggatggacagttggcaggaccccgccccagcgcccctgattggatgaggctccagtccccgtcccatcggtcctgagtgacagcggaagccctgggtaacaaggcccggcagaaccgaaatgacctgttc

SEQ ID NO: 37247 - DNA, 126 bp, Homo sapiens
  chr19:12306068-12306194
  hyper
cccgggtccctctggcgcagctgggccctcagtgccctcggccgcagagtggggctgggctggcatccgggaccccgggcatcctgtcccgttcctgcgcgacgcctgcggccccggcctcagcct

SEQ ID NO: 37248 - DNA, 43 bp, Homo sapiens
  chr19:12306229-12306272
  hyper
cgtgtctccccagattgcacgggagccccgggagggtcatggg

SEQ ID NO: 37249 - DNA, 234 bp, Homo sapiens
  chr19:12475809-12476043
  hyper
ctcagcaggagaatgcggtttcttcacctcccgtcccaggattcgcctgtcacttccccaccaaccagcgaccccacacttcagccgcccctgtccagacccctaaacacccccatccccaaacctctcatggaggcggaactggggtcttctctcctctccccctattaaactgtttctgctgcaggccttggagtctcggtgcagtgactcggaccgcgaacctgtgccggt

SEQ ID NO: 37250 - DNA, 30 bp, Homo sapiens
  chr19:12476667-12476697
  hyper
tgggcttcctcccttcgctgtgacctgacc

SEQ ID NO: 37251 - DNA, 254 bp, Homo sapiens
  chr19:12750856-12751110
  hyper
cagggcaccctactccgctcacctgcgacggcagcagccagtccccacgggcggaggggacctcatgcgacattcagcccgcgagattctcagagactgctcgcccgcaacacgcagtaacgatctcaggagagcccatgatggggcggcgcgtgtcgtagccgagaagactctgtcatcgccggcgacctcctggaactctctcttgcggtttgcagccagatcacttcccatacacgcggcagccaagctca

SEQ ID NO: 37252 - DNA, 180 bp, Homo sapiens
  chr19:12936457-12936637
  hyper
gggtgtcctgaggggcggggctgggggaagggtcgctcccccaactcagggccacgcgtccgctaggggccgctgccgcttccactgccactcccgctgcccgcagcgtccaggatggaggtgcgagggctgcgggaacgccgggagggagcttcccggccccgtcgtcctggtctggga

SEQ ID NO: 37253 - DNA, 101 bp, Homo sapiens
  chr19:12945480-12945581
  hyper
ctggtctcgaggctgcgcaggcgcaggagccgtgcgtccactgcacggagtgggacactgaggatcgctgtggagtgtggggaaggcggggacaaactcag

SEQ ID NO: 37254 - DNA, 30 bp, Homo sapiens
  chr19:12949855-12949885
  hyper
tatgctcagtcactgcggctgtgggtgagg

SEQ ID NO: 37255 - DNA, 36 bp, Homo sapiens; identical to SEQ ID NO: 13221
  chr19:12952093-12952129
  hyper

SEQ ID NO: 37256 - DNA, 13 bp, Homo sapiens
  chr19:12952130-12952143
  hyper
ccctgggcgcggg

SEQ ID NO: 37257 - DNA, 98 bp, Homo sapiens
  chr19:12978444-12978542
  hyper
ggagagggggctctccggagatgtgagcaggggaatggcggagtttgggggcggggtcgaagggggcgtgtcttccataaccacgccccctccatgca

SEQ ID NO: 37258 - DNA, 38 bp, Homo sapiens
  chr19:12996096-12996134
  hyper
gccctttctcatgtccggggccccgccccctcacctgt

SEQ ID NO: 37259 - DNA, 152 bp, Homo sapiens
  chr19:12996701-12996853
  hyper
gcccagagtctcgggcggcggcggatattgcgccccggaggcctcgctgggcgccagagcgcaggtctggggcgcgccaccgggctccgggcccgagaagttggtgaggaggagatccaggtcccaggtggcgtccgcgcccctctcatcgt

SEQ ID NO: 37260 - DNA, 30 bp, Homo sapiens
  chr19:13030286-13030316
  hyper
ggcgcgctctgggtgcgcttgtgtgcccct

SEQ ID NO: 37261 - DNA, 88 bp, Homo sapiens
  chr19:13213616-13213704
  hyper
ccctctcacccctggcggcgcagcggccggaggatgctggcccagtgcagataagggccaggctgcctggccgcgcctgataaggagc

SEQ ID NO: 37262 - DNA, 280 bp, Homo sapiens
  chr19:13616677-13616957
  hyper
ctggaagaggggaggcggagggaggagggggaggcgcagctgctgctggggttcgggcaaaaggatatggccattcggtgatctttttggcgtattttctcaccacgttgtcttcgctgaagaggaagagagaccggttaaccgtgaggcagttctgtcggacggggatggggttgtagagtgccatggtccgcgctctctgcgccattgactgcttgtacatcctttgcgccccgggctgcccgccctgccggctgcccccggctcctcgcccgcctcc

SEQ ID NO: 37263 - DNA, 307 bp, Homo sapiens; identical to SEQ ID NO: 1360
  chr19:13617158-13617465
  hyper

SEQ ID NO: 37264 - DNA, 43 bp, Homo sapiens
  chr19:13617489-13617532
  hyper
cggtttgcaaaggacgccccccccgggacgcagtggaagcttc

SEQ ID NO: 37265 - DNA, 234 bp, Homo sapiens
  chr19:13617846-13618080
  hyper
aaggagtcttcacaccgcagggtccaggtttaaaaaaaaaaaaaaaaattttttttcttcctgaatcaccaacggctgcctcttctgctcccggaggaagtgtgagtgtgtatgtgcgcacagcgtttcgctcaatggtgcctcatcttggggttaaattgcagcagtgaaatcctgaaaattcccaacagggggaaaagagagagagagagaggtatgcgccctccgcttagc

SEQ ID NO: 37266 - DNA, 225 bp, Homo sapiens
  chr19:13618288-13618513
  hyper
acccacccagagtgtcgacacatgagggcccgcgaccaatcgtggaggctcgtggaggcgcgggggtaccgggctcagcggagtttgtgggggagagaggggagcgtcgcatggttgggaggcagggaggggggaattggggtgcttcctcctcccctgggaggaaagcctgttttccaccccgttccatttcggttgcagacagccggacgctccccagcatct

SEQ ID NO: 37267 - DNA, 365 bp, Homo sapiens
  chr19:14320287-14320652
  hyper
tcctggacttgtgagcggcgtgctcaggaggcaaagagtgcggaggggctggggggcgcgtaaagagccctggcgcccctcaggccttcggctgcgcagccgcagtggaggccgcgccagcaaccgggctccgggaaccaaggcgtccgcgcgcgcacgcagactcgcccgcgcgccgcgtgccccgcgctgcccaggtcggtacccgcgcttcggacaccctgctcccagggcgctcctcgcttccagcctcccactttgcgccttgggctccccatgagccccgctcctgagacaccccacgctctgtgtattccgtcccacgggacctccacgcccacggtgccacgcgcctcgagtacccc

SEQ ID NO: 37268 - DNA, 334 bp, Homo sapiens
  chr19:14583182-14583516
  hyper
catccaccctggaggcgcacgcggcgtccctgcagccccccgcgcggccccagtggatgccgaagccccgacgggacacacggtcctgcctgggctcgcagaatggctttttattcccaaaggctctgcgccgcgcacctgggcccagcccagggtgggctggcttagtcgttgggcctctggttgtgcttagaagtggctgaggccgctgtgccgggagctgcgcagcgagctggcctcccaggcgctcggtgttaggcccagccccgcggggccgcccttggctccggccctcgggggcaagaggcgaagcagttggcgcagcacggcctgg

SEQ ID NO: 37269 - DNA, 107 bp, Homo sapiens; identical to SEQ ID NO: 13230
  chr19:14583613-14583720
  hyper

SEQ ID NO: 37270 - DNA, 173 bp, Homo sapiens; identical to SEQ ID NO: 4597
  chr19:14584240-14584413
  hyper

SEQ ID NO: 37271 - DNA, 321 bp, Homo sapiens
  chr19:14584536-14584857
  hyper
cgccagccgcccgggggacccaggccgatgaagcaccacgtgcccgggtactgcagctcatagcggcccacgcgcgccagcggcagcagcgccacggccaaggccaccgcggccaccgcggccagcgccaggcgcgcgcgggcgaccgagacccgcgcggcgtggagcagcggccgcgtgacgcccacgcagcgctccacggccatgccacagcccagcagcagcgggcacaggccgaagaagaccatgcagccgcccaggaagtggcaggccccgccggccggagcgcgccccgcagtgtacagacgcagcaccagcgcg

SEQ ID NO: 37272 - DNA, 186 bp, Homo sapiens
  chr19:14667548-14667734
  hyper
ctccgtccctgacatcggctttgggactgttcctgagccggctgctgcgggtgcccttccagcaggcgggagtaagtctgtgcggccacaagggggcagtggggagcgtcgcagcctccgccgcttgcagccagtcatcccggtggtgacgggtcagctcggcctctgcaccgaaagtatctcgct

SEQ ID NO: 37273 - DNA, 47 bp, Homo sapiens
  chr19:14886822-14886869
  hyper
cgggcgcccctcccacaggaaaacgctgtggccgcctgttggggtgc

SEQ ID NO: 37274 - DNA, 668 bp, Homo sapiens
  chr19:15090061-15090729
  hyper
ggggaggtggggagacgggcagggagacccggggataactaaggggataggaaactcaccagaacgaccaggagaaaagcggtggcaacggctctaaggggcaagcaggagctcagagacaaagggcggcggagaagtggggacgtgggcgcagggagcgccccacacgcctgaccccagcgcctcggatcccccacctgcccgcaacctccgcgccgcagccacaccgagtccccgcgccgagccgcggagtccccactcaccggcgtccggagcggcgggggcggcctgcccgcgcctcggcctgcgcgctgcgcccggatgcaggagccggagcccggcgaagcgcccggccggggccgcggggacccgccagggactgtgcagcaccggcgcggggaccggaccgtggaggcaccggcgcggagccgggacgcgctatgctgcgggagggatccgggccggccctgcgctcacgtgggtgtgggggcaccgagcggccgggggagggggcgggatcccctccgcgatgccctccgcctcccccgcgcccagcccaggctccgcagccgtgtgggagaagggggacagcgtgcttgcgaagggagggggactgggggtgggcgggggtgagtggcctctccggcatccagcccccgccccctgct

SEQ ID NO: 37275 - DNA, 1 bp, Homo sapiens
  chr19:15090745-15090746
  hyper
c

SEQ ID NO: 37276 - DNA, 120 bp, Homo sapiens
  chr19:15090747-15090867
  hyper
cccccgccccctaaaccgcctccggagccctcggaggccccagcatccctggcggagcgcggggaacaggccctggcaccgcgggacccgctccagcagcctcggcggaggcctggggaa

SEQ ID NO: 37277 - DNA, 339 bp, Homo sapiens
  chr19:15121641-15121980
  hyper
gcgtgttggtacccccggctgagcgcagccaggacacacgcgttggggccccagcatggcgcgaggcagctcaggccatggcgaggaccgcgcacattctgaccgatcgctgcgggcaggaggcggtgaccatgtggcagcccaaggacagcgtgctggacccgaacgtggcccaccacctcggccgcgccgcctacatccagccctggcgcttccgcgtggagatgatcaaaggcggcggcaccttggagaagccgccgccaggcgagggcgtcacgctgtggaagggcaagatgaagccgcccgcctggtacgcccgcctgccgctacccttgcacc

SEQ ID NO: 37278 - DNA, 295 bp, Homo sapiens
  chr19:15217958-15218253
  hyper
gcgccacgatcgtcacgtcccatcgaagctggagcggatccgggcacccggagcccccattccaacccctcccggccccaggcaactacatctcccagcatcgcccgctcgggccgcgggaaaggggaaaaaaaaaaaaagtttgggccaagcattcccggaatgtgcttcctgctggcgcggggcggggggcgggcggggaggcccgggcggggcggggagggcgcggggcggcgcggccggagcccggggcgcgcactcggctcggcccggcccgggccgcagcatggccgag

SEQ ID NO: 37279 - DNA, 683 bp, Homo sapiens
  chr19:15288218-15288901
  hyper
gcacagagaaacagacggggcaagtggatgggcaggtggaaagagaggcagggcccacggacaaacagactgggatggatgcatagacagacggatcgatcgggtggatgggctcacttgcaagtgcgctcgcggccaccggcgtggcagtcgaagttgtcgtagaggcaggcgggcgagctgcaggcggggtcgcagcggctgttgttgaagaggcgccagcactgcagcgcctcgcattgccgccaggggtcgcccacgctcagcgagcagtcgccgccgtcccagccgcagcctgggctgttgcactcgcggtcgcagcgctggtccccgcgcttggcctggcaggcggcgcgcgggcaccgcggctcctccgagacctcgggtgccgcggcgggcgcctcgcagcgcggcccggtccagccctgcgcgcaagcgcagcggaagaagggcgcgagcggcgcggggcggcaggagcccccgtggagacagggggcggccgcgcagctggcgttgctggcccccggcggcgaccccgggaagctgcggcaggagggtcccgacaaccctggggggcaggcgcagcgcggcccgcggggcgtctgctggcatgggacgcccaccgggcactgcagctcccggcaggagcgcgccacccgctcgcaacgcggaccccagaacgg

SEQ ID NO: 37280 - DNA, 164 bp, Homo sapiens
  chr19:15333656-15333820
  hyper
aacattccagacacacggatctgtccgagaccctcccctgctggcatgtgaagccttttatagtctcacgtcttcctagcccaaactttcctcccagtctcacggaaatgctaaatcatcccggcgtgggaggcttctgtgggtcggggcgcagctttgcaagg

SEQ ID NO: 37281 - DNA, 120 bp, Homo sapiens
  chr19:15334731-15334851
  hyper
ctgggggtccctgctcggtcgggacagtgggaccgccctgtgctgtggccgcgcgcagccccccgcaggcttcggcgctcgcactcttgcgtgggactgtccaaccgccacagggagctc

SEQ ID NO: 37282 - DNA, 777 bp, Homo sapiens
  chr19:15342587-15343364
  hyper
agttctcagggaagccgtgcagaaacagcatgaggggtccgttacctcgtccagccgagacatagtgcagacgcaggcccgagctctagggggagggcacagcctgaagcctggggaaccctctctcccgaggcttgaaccgtctcgaccccacgcgaccccgcagccccgatagcgcccccgtgcgatcaccttgaggttcaggaaaccgtgctcacccagcgaggggtcgctcaggcaggcgggggacgcgctccgacggcgcccgcagcagccgcgccggggccggcacagcacgtgcgtgagcgctatgcagccgtagaccgccgcggccaccagcgccaccgagaacaccaggctccacatgaaggcgcgcagcagcttcagcgacaggcgcgacggcgccagcagcgcggtcaccaccagctccggcatgtcgccgcgctccgggaccacggcggcgctgccggccaggggcacctgcagcagcggcgaagcggtgtcagggctcaggggcccatcgcccttggcctggggcccctccgtgccgtcgggatttgtgggacgcgctgaaggaagaggcgggcggctccgacagaaaacagccagagcgcaccactcacctgagtgccaggtaaacacctgggcgcgacagggacaggaaacaagggtagggtgcggaggctggggaggaagaggttggaaaggggggaaataaatgggcggggcctagcaggtcctgtgcggggcttagggccggggcggggcccaggaaga

SEQ ID NO: 37283 - DNA, 202 bp, Homo sapiens
  chr19:15343929-15344131
  hyper
gggccaatgagctgacggtaggccggggagggggcggtggggtggggtgggcaatgggcaatgagacggagggcggggccgggacctaatatggcgggtcaggagggtctggaagacgaagaagagggacaggcaatgccaggtctaggactaggagggaggcgcgggcggtattagcggctggaggaggcttcgggaggcc

SEQ ID NO: 37284 - DNA, 208 bp, Homo sapiens; identical to SEQ ID NO: 13242
  chr19:15619208-15619416
  hyper

SEQ ID NO: 37285 - DNA, 300 bp, Homo sapiens
  chr19:15695292-15695592
  hyper
cccagacgaggttcccggcgcgatggggccgggatgggggtcctgggcacagtcagagtccccaccccctcccccgggaactgcatcggccagacgttcgccatggctgagatgaaggtggtcctggcgctcacgctgctgcgcttccgcgtcctgccggaccacgcggagccccgcaggaagctggagctgatcgtgcgcgcggaggatggactttggctacgggtggagcccctgagcgcggatctgcagtgacccaccactgtcaggtctcagagccacccgcgccctcctcaggca

SEQ ID NO: 37286 - DNA, 138 bp, Homo sapiens; identical to SEQ ID NO: 1362
  chr19:17007251-17007389
  hyper

SEQ ID NO: 37287 - DNA, 347 bp, Homo sapiens; identical to SEQ ID NO: 1363
  chr19:17007446-17007793
  hyper

SEQ ID NO: 37288 - DNA, 100 bp, Homo sapiens
  chr19:17008419-17008519
  hyper
gggagccctccctggcgtccgagggtgggagtcggggtgtggcaggccgcggtggggggcggcagtggctccgcgcactcacccgggccccgggcagggg

SEQ ID NO: 37289 - DNA, 114 bp, Homo sapiens; identical to SEQ ID NO: 4603
  chr19:17008585-17008699
  hyper

SEQ ID NO: 37290 - DNA, 296 bp, Homo sapiens
  chr19:17137063-17137359
  hyper
tggacaactggaaatcgccacccatgatgacagcccgggtcacacgaagggggcgaggtggggcggggggagctgacctcagcacctttagcttttgggagtccctgtacctccacagagccacttcggaaactttagggcgccccctcctcaagacgattcgggaacaagaggccaggtccagcccagcgcggaggctgtgtggccttgggcaggtcgctgcaacactctgagccagtacccgcgacccccaccccagaaggcgaccgacctcctctgtcgccggaggatactca

SEQ ID NO: 37291 - DNA, 65 bp, Homo sapiens
  chr19:17137395-17137460
  hyper
cgccgacagcagcaggagcaggagcgggagcaacggccagagcagggcgccgctcatttttcggc

SEQ ID NO: 37292 - DNA, 586 bp, Homo sapiens
  chr19:17392502-17393088
  hyper
cagaccctgcttgagcgcctccgggtgtcaagggcccctgaggacactaaagctctcgaaccccgatgtggacccccgtgcggcgcggggcagcctggctgggaaccctgctcggccctggagaggggccccccgagccgaggggaggagcggcgcatgcccacaagccccccgcgggaagtaggaaatcgaccgaccaggcggtgcgcttcggacccagccagggcatgtgctcggaggcccgcctggctcgcaggttgcgggatgcgctgcgggaggaggagccgtggtgagggcggggccgggggcgggccaggagtgggggtctttggccggggtccactctgaccgcggtgtttgcagggcagtagaggagctgctgcgctgcggcgcggaccctaatttggtgctagaggacggcgcagcggctgtgcacttggcggccggagcccggcacccgcgcggcctgcgttgcctcggggccctactgcgccaaggcggggaccccaacgctcggtaagatagagcctgggtccggggcggggtctccccaagccgaagtctgggaatccgggaaggggcgccc

SEQ ID NO: 37293 - DNA, 490 bp, Homo sapiens
  chr19:17501171-17501661
  hyper
tttctgtgcagtttccgttcaggacgtctccagggtctaaagctgagtgtcgcatccagcgtgggggtgcctctatacacgtccccgcagaccccccccccatatgtgtcctccaggccgacgcccccttccggcagggggccgactcaccctcgtgcgcgccgcgccggccgccggcagcccccggagggtccggagcgagagcgcgagcgagggctgggccggggtcgggaccccgagcggggacgcggccggggcactctgcgctgtgggctcatctcggcttccaggacgttactgccgggaagggggaagggggctgtcagcctctggacccctgtccccagacatcgccagccctcatccgccagagcgtccctttgctgggaactccatccccagagatccccatctcccagggtttcccgctccccaggatccggcatccgttctcgacccccagccattcccgggacgcctccctagagac

SEQ ID NO: 37294 - DNA, 129 bp, Homo sapiens
  chr19:17559138-17559267
  hyper
gcagcccccgcagctcggcgcggcccgcctgcagctgaaacagcagctgcgcgcccagcgccgccagcacggccgccgcgatgcccagcagggtcattgcagccagcacccggccgccgtaagaacggg

SEQ ID NO: 37295 - DNA, 737 bp, Homo sapiens
  chr19:17716787-17717524
  hyper
ccaaggcgcaagccccgtccctccccgcccagcgccctccgcgcaggcgcagtgccgctcggccgaccgcccgcgctaaggcgcaggcgcggcaccgccctcctcggcggagcgcgtgtccgacttgagcttcacgaactccttggccacctcgtcgttgctgcgctgcgagaggattcgcagcaccgtgaggcccgtgtcgtccatgtggatgcggcggccgagcggcagccagcaggcggcgctcccgcgctgggccagctcacgcagctgcagcacggccagccccaccgtgcggtcctcgcgcgcgaagcagtagtccttgacgcacacctgcagctcatagcactcgggacccgcgtcggcgctcagcgtgctgcgtggggaggggcggaacgtgagacaggccacacctactgtgatgccccgcccacggccccgtccccaccgcatttgcgggccacgcccacaccggggtgcccacacctgtcacctcccacgctacgctagccccgcccctgccccgttacttgacctacaaccctgtgcttggccgcgcccacagcagctgaccccgagctgggccacgcccacgcctgttcttcccatttttccacccaccgaaaaatgaccgcatagttttacatccagctcccgcccctcagacaccgccctgcaaggccatgctcccaccctgagatacccgcgcctgtgccctctgccggctgaactgctgc

SEQ ID NO: 37296 - DNA, 377 bp, Homo sapiens
  chr19:17791026-17791403
  hyper
tctccctgtcttccccggtcagtaaatggtccctgagtcaccgtcttcgtcgtcacatcccgccacctccccgcctgcgccgggttgctgtatcagggtcagcggggcggaagcgccacccttccccagcgggcttcgggtcacacgcatgaggctatttatagcgtgggcgcgcggagggcgtgggaggcgcgccggcggacaggggggcggggatgaggggggtgcccactgctgtccccagcgacgagcgggtgaagacaccgcgtcatgcggcctcaaaggtctttggggcccccagaagcgctgactgatgaatgtagtggccgtacccggggaggctgaggcaggagttcaggctgcgggacacccctgca

SEQ ID NO: 37297 - DNA, 37 bp, Homo sapiens
  chr19:17798697-17798734
  hyper
ttccgggtagaaccccggatacccgtccacgtccaca

SEQ ID NO: 37298 - DNA, 92 bp, Homo sapiens
  chr19:17798977-17799069
  hyper
gcctcctacctccaacgcaaagcagagacatgtctccgagctcgcaggtgggccggaggcggccgggccggctctgtcgggtcgggctcagc

SEQ ID NO: 37299 - DNA, 52 bp, Homo sapiens
  chr19:17906008-17906060
  hyper
tctgggggtgagtgtcggcagcccccggaggatctggcggaccccagtggtg

SEQ ID NO: 37300 - DNA, 327 bp, Homo sapiens
  chr19:17958484-17958811
  hyper
caaccccgcagcccccgtcgcgcatgcgcaatgactcctccaggtccgcaaggcaggcatctcccggccttagtcaaagccgaagcccagagaagcgagcgatcggaggatgcgagtctcggctcacgtctgcctcgcagctttcctccgaggcctggaaggcgagctagcctttgccctggcagcaccctgccccagcccagccatcccccgccaccaccatcctcccccagtgtctgggccgagccctgcggcatcgccagctcttacctagcgggcagggaccctggactttcgaagggcgggcagagccgggaggcagcgaga

SEQ ID NO: 37301 - DNA, 149 bp, Homo sapiens; identical to SEQ ID NO: 13255
  chr19:17983002-17983151
  hyper

SEQ ID NO: 37302 - DNA, 261 bp, Homo sapiens
  chr19:17983405-17983666
  hyper
gccagcttctgaactcggtcctcaccgccctgctcttcatgcccgtcttctaccgcctgggcctcaccagcacctacgaggtaccggacagaggcccgggggtaggacctgccccactggcagtgctgggaccccgtgtgggggaggcgctggggctttgggccgctgtacaggaggacgcggatggcacctcggtgctttaacggaaggggcccctaggcagacacgtggggagggttctaggaagaggccccaggcgcc

SEQ ID NO: 37303 - DNA, 285 bp, Homo sapiens
  chr19:17984627-17984912
  hyper
actgtctacactgtgcgcttgcgggccacgtcggtgtctgctgagcggtggctgctccaggagcccgcgcccgtcaggcgcaagtgggagggcgcgtgcacacgcatggaccagtcctccaggtccacggggtacgcacaggcacgggatggcacctgtgcacgggtgtgtgcgtgcggcggggcccccacgtgcaagaatctggcgggcgcggttggcttccggagggaggggcccacctagagagcagaccagggacccgagaggcctcggctcctgggtaag

SEQ ID NO: 37304 - DNA, 40 bp, Homo sapiens
  chr19:18062522-18062562
  hyper
tgggaccttccagcccggtcaacgtcgccagctgcccgaa

SEQ ID NO: 37305 - DNA, 188 bp, Homo sapiens
  chr19:18077737-18077925
  hyper
gcaagagggggagttcgaagaccagccgcatgccggggggttgcagggggcgccggggaatgtgggatctttaaatatgggcggggcttgcggggtcgtcgaaggcggtgccaacccgggctcggccaatcggcggcggctcccgcgtcgcaccgcccccttctctcccggcccgggcgggcgctcgc

SEQ ID NO: 37306 - DNA, 136 bp, Homo sapiens
  chr19:18078136-18078272
  hyper
ggatgggtgagggtgcgggaggatccaggatctgcagctcagggagcccgaggagggaggcacgtctcggagggggacgcggtttggggcaggggccaagagggagggtctccgtgcggtccggagcctaggagac

SEQ ID NO: 37307 - DNA, 30 bp, Homo sapiens
  chr19:18336422-18336452
  hyper
ccccatccctccccacgaggtcacagtcgt

SEQ ID NO: 37308 - DNA, 30 bp, Homo sapiens
  chr19:18336877-18336907
  hyper
cagagtcaccaactgcgagacaaaagtagg

SEQ ID NO: 37309 - DNA, 371 bp, Homo sapiens; identical to SEQ ID NO: 13259
  chr19:18343439-18343810
  hyper

SEQ ID NO: 37310 - DNA, 84 bp, Homo sapiens; identical to SEQ ID NO: 13260
  chr19:18343879-18343963
  hyper

SEQ ID NO: 37311 - DNA, 74 bp, Homo sapiens
  chr19:18714507-18714581
  hyper
gaggtggggtggacacggttcttgggccggccctgatgattttccggggcaaacttggctcgagggctctgtct

SEQ ID NO: 37312 - DNA, 35 bp, Homo sapiens
  chr19:18715047-18715082
  hyper
ctgcagctgccctcccggggctgggcgggggacac

SEQ ID NO: 37313 - DNA, 78 bp, Homo sapiens
  chr19:18716735-18716813
  hyper
cagcctggctgaaaacggttctaagcgccgccggtggcggggactccgcggacccccgtgcgccgggtcccgcagggg

SEQ ID NO: 37314 - DNA, 206 bp, Homo sapiens
  chr19:18718176-18718382
  hyper
catcctgcctcttttcgattctccgcgagtagcctcggccccaggctttgctggaagaaaggagaaaaagcaggaaggcacggagtccctcgccttcgccctggctgcgctgtccccttcgcgcgcgggatgggtttgaggttgctctgggcgccccgggggcctcgggagggagctcctgcgtgggcagacggggagatgtagtc

SEQ ID NO: 37315 - DNA, 123 bp, Homo sapiens
  chr19:18723837-18723960
  hyper
tccgcgccgtccgcccgcgatcccttcgccccccagctcggggacacgcagaactgccagctgcggtgccgcgaccgcgacctcggcccgcagccctcgcaggtgaggcgcgtgcggtgccag

SEQ ID NO: 37316 - DNA, 20 bp, Homo sapiens
  chr19:18898213-18898233
  hyper
aaaccagccaagccccgccc

SEQ ID NO: 37317 - DNA, 112 bp, Homo sapiens; identical to SEQ ID NO: 13264
  chr19:18899103-18899215
  hyper

SEQ ID NO: 37318 - DNA, 126 bp, Homo sapiens
  chr19:18899432-18899558
  hyper
cgcagtctgcatgctcgtggcactcgctgggcgagccgtcggggcagaagcgctgtgcgcgccgctggcagccggacgcctggtcgcccacgaagccgggctggcacgggccgcactggaaggagc

SEQ ID NO: 37319 - DNA, 267 bp, Homo sapiens
  chr19:18900266-18900533
  hyper
tgatgacggcaagggcgcaaccgggagaggagaggagagctgttccctcatgggcgaggggaggaaggatgagggcgggcatccccagcagaggggggcaggggtcgtcggggcgtgcgtgcccggcggtggcggggggtctgggcgtgcgttccctggctgtggaagggtcgttgggactggcgatcccctgcggcgaggagggtagctggggcggaccacccctggcggtgagggagtcgtcggggcgggcgtcactagctatgt

SEQ ID NO: 37320 - DNA, 146 bp, Homo sapiens
  chr19:18900756-18900902
  hyper
gacgtcggtgcagtgcgagccgttgcccgtgaagcccgcggggcaggggccgcagcgcgcgccgctctccgtctggatgcaggccacgccggggaagcagaagccgggcgcgcagtggagcaggggccgcacgctgggtaggccgg

SEQ ID NO: 37321 - DNA, 955 bp, Homo sapiens
  chr19:18901318-18902273
  hyper
tgtgtctctgtctcccgtctcttctctctcccgaccgccccgccgcgctcaccgcacgcgtcacactccatcaccgtgtttttcaggaacgtgatctccctgacctgcaggggtgggatggaatcagcggggtcccaacctctcctcatccctcgggtctcccctctctctaccccggggtccctttctacagcctcttttcgccaaggactccctacccgccgacccccttccctccccatctcctctccaccttctcgggtacttcctctctcctcgctgggaactgagacccccttccgttccctggcactccctgccccgcacccgggccccgcacctgctgccgcagcagctcccgcacgtcctgcagcgccgcgttggtttcctgcagttcccgaagcatctgcgggcccaggtctgagcctgcggcggcaggggacctggtgaggcgtcatggggccggggaatcccaccaccaactcccaccgttgcagcgaacccggacctccgaggccccactgcgctcctctagtctcggtcccgccacctgctttctgcgcccggcacgtcccctacgaacagtccgtgagccccaaacagcctggatcccgggcctctcacgggtcctacagtccgttgtggggccgtgggcacggcgcgggtgctaacgcggcttacccaacgggctctggccctgtccggacgcgccgagggcagccagggtgagcagaagaacgcaggcggtgtcggggaccatggcggtggcggggagctgggtggctgctcgctttctaccgcccacgaggcccgcggggcctatttatccccaaggcacggccggccccagggacggcccaccacagccctgcccaacgtccagcctcaaggtaaacagatggcgctggcccctgcgttcaagtccccgcccggaatgccccgcgaagtcgcccgc

SEQ ID NO: 37322 - DNA, 4 bp, Homo sapiens
  chr19:18980714-18980718
  hyper
tccc

SEQ ID NO: 37323 - DNA, 30 bp, Homo sapiens
  chr19:18981207-18981237
  hyper
aggggtcctggggggcgtggccgggaactg

SEQ ID NO: 37324 - DNA, 294 bp, Homo sapiens
  chr19:19006016-19006310
  hyper
ataggcacaaggcagcgaccgggcagctcctgcctcttcccgattacagcgggcaagccggccccgccgccgcacggacccagcagaaaacgggcagcggacctcgctccgggccggggcgcagcccgcatggcagggaggcgcatggcgcaggccgcggtgcgccgagccctcccgttcccggtcctgggcttctcagtgtctggctcggccctgccggaaagagcgcgcggtggccggagccatccaccgcgcggggccccctggtcccaaactgaccggaaagggccgtgc

SEQ ID NO: 37325 - DNA, 572 bp, Homo sapiens
  chr19:19006592-19007164
  hyper
agtccggggtcccctcgtcccggcccccggccacactgacccgaaagaggcgcgcagtggccgcggagcgcagggcggtccagcccagcgcgccgagcgccagcagcagcagctcgggcggcgccaggtgcgcgtgctcagccaggccgcgacgcgccagcccccagccgcagtccgtgcagccccgcgccgccgccagcgcgctgccccagccgcgctgcactagctgcgcgtagctcggcatgggctcgggccccgtcggccccgccgcgggccccgccgccgccataccgcccgctcgcccgccgtgcccgtcgcctgcgcccgcccgcggtagccgacggagccgcgcgccccgcgtcacgcgccgcagctgggccgggggcgcgcgggcgggagagcggagggcggaggggcgggaccggcgcaagctccgccccgctgggggcgcggctggggggcggccagcggggacgcggggcgccctggaggcgggcccgcgcccctgcccgtttcccagcagagaaacccaggcgcgggggccggagctgggggcccgttggacctggacc

SEQ ID NO: 37326 - DNA, 269 bp, Homo sapiens
  chr19:19322660-19322929
  hyper
gggagccccctccctcgcgcagccagaggcctcgggctggcgggggcgcatgcgcagagagccctcgcggcccctttataagcactgaggcggcgctggggccagcggagcgcagggcgcaggggctggacccggcgcggagctggctgagtcggagcgcagcgtcctttgtgcccggcggccgccccgggatgcgtccgagctaggagccaggtgggggatccgtgagggggccgtgttgcgggagaagacttcgggattagagacag

SEQ ID NO: 37327 - DNA, 73 bp, Homo sapiens
  chr19:19373696-19373769
  hyper
ggccgcgggggcccacgctcccctggagcagtggctggagcgcgggcggagaaagaagcgctctggacttgga

SEQ ID NO: 37328 - DNA, 35 bp, Homo sapiens
  chr19:19383770-19383805
  hyper
ccaccccaatcctgccgggtcggagctgagctggg

SEQ ID NO: 37329 - DNA, 309 bp, Homo sapiens
  chr19:19649094-19649403
  hyper
cgccggagttggacccgagcacgccgcggagcccggaccctccctcggacgctctgccccggccatggcgtcgctgctgccactgctctgtctctgtgtcgtcgctgcgcacctggcgggggcccgaggtgaggcgcctccagcccccgcgcccagcccctgaggctcccgagggcctggcagccggccttgggtgaagccgcactcggggagagaacccagggacccacgcgcttccccggggactgggtccccttcaccagtcggatccccgcgaccacctggggcgcggagcgggcctcatccatt

SEQ ID NO: 37330 - DNA, 347 bp, Homo sapiens
  chr19:19651135-19651482
  hyper
tggaagcgcgcaccacggactgggccctgccgtccgccgtcggcgagcgcgtgcacttgaaccccacgcgcggcttctggtgcctcaaccgcgagcaaccgcgtggccgccgctgctccaactaccacgtgcgcttccgctgcccactaggtgagggcggggctggatgacgggggcggggctttgaatgggcggggctggcgaacgccgggaagagtcgtggtgggtggggctgggaggggcaggaccgtgtgggtgtgggcgtggctgggaagagccgggggacccttaggcgtaggacgacgtcagggggcggggccaggcagggcggggcttttgaagagagg

SEQ ID NO: 37331 - DNA, 336 bp, Homo sapiens; identical to SEQ ID NO: 4606
  chr19:19651512-19651848
  hyper

SEQ ID NO: 37332 - DNA, 70 bp, Homo sapiens
  chr19:19651990-19652060
  hyper
cgctggggatgcgtgtcccgggcgtcctctggaggcgcagaagtgcgtgcggcctcggtgtccaggtagg

SEQ ID NO: 37333 - DNA, 438 bp, Homo sapiens
  chr19:19843591-19844029
  hyper
tggggctcccggctgcgggtccagctcccacagagaggaccgagggccgaactgcgcccgcggtggcccccgggtctgcaaaccccggagttgactgcaaggaggtccccggcctcggccacagacggttccaaccagaaacctcccctcggacactggccccgcacactcaccatttcccagcgtccgggaagtcacggtgtcctccctacggatctgtcagtacctgcaggtcacggcgcgacaaaggatgcgctagagccaccttcggccttcaggagcaggtgaaacgcaatcttcccatgggccaggaatggcgacgtccgcactgcgcaggcccagcgtggcgccgctcacatcttttcagctgaggtcctgattggacagatccaatggccccgcctctttatcactgagtgacagcggagcaggaagggg

SEQ ID NO: 37334 - DNA, 209 bp, Homo sapiens
  chr19:19932203-19932412
  hyper
aaagacaggacaccccggggacccgctgtcaacgcagccgccatgttatggctggggcggagctgggcaatgagaacttggagcgcagattgtggagctgactgccgggaggcctgagttctgccactgccacagccacagccacttcctccccagttccaaccagcccctctccctctctcgggatgtcgaactggcactctcaccat

SEQ ID NO: 37335 - DNA, 120 bp, Homo sapiens
  chr19:19932472-19932592
  hyper
cagggccacagaggctgggcctctaggagctgacggcacagagcagtgaagacgatagctggatctctggcgtcagcgagagacaatgggcccgccaaagccggaagccggaaaccgtcc

SEQ ID NO: 37336 - DNA, 28 bp, Homo sapiens
  chr19:19932652-19932680
  hyper
atgcttgaggccccgccccctcaggtcc

SEQ ID NO: 37337 - DNA, 7 bp, Homo sapiens
  chr19:20011714-20011721
  hyper
ccggacc

SEQ ID NO: 37338 - DNA, 74 bp, Homo sapiens
  chr19:20011722-20011796
  hyper
aacagggcggcttctggtttggcgggtcctttgtctctcggtgcagccggagctccaggtctcctcttcactac

SEQ ID NO: 37339 - DNA, 120 bp, Homo sapiens; identical to SEQ ID NO: 13275
  chr19:20012036-20012156
  hyper

SEQ ID NO: 37340 - DNA, 723 bp, Homo sapiens
  chr19:20149645-20150368
  hyper
ttccttcaagctcttcggctggacccccaaccacaaaccgtggctgggtgctctctgagcataaatcactgttaacttcaataagttttcaacattttaaaggtgactcccatagtttttaaacaggagaaggaaaagactgaggacccccgggatcacagcacttcccacgcacaaaccacacacggggtctggactctgccctgaggacgcttccattgtccccgcagtcggggcagacgcaagaacgcgcgcggctcttcccagggtgggctccgggcgggaagcgggagaacggaacgggatgcccgcccagggtcccggctgctggcccacctcgcatcctgtgcccggaggtgatcgacggccgagctgtgcctgccggggactccagtccgcagactccggagctgacagctgggaggccccagtcccgtcactgccggttccggccggtttcaaccagccctgcccccacctcgggatgcgcggcctggcacactcaccatttttcggcttccgggatgtcgtggagtcttagctctggatctcacagcatctgcaagtcagagggcaacagaggctgcgacagtcaccgggaactactagagcagaggatactaagcaatgaagatggaccctgagctctggctggagcgagacaaaggccccgccagctccaggacaccgccccctctaccttggctgcgcacctgattggac

SEQ ID NO: 37341 - DNA, 251 bp, Homo sapiens
  chr19:20162654-20162905
  hyper
gtcaggaaaccagcacgttgggggaggcgggatcacagttacttgctgagacaagctgccctggctacgttcactcccgtcaggtaggagaggttaaagaacaggaaggctccccctccgcagggcggaactgctctgaaggcatggaggagcgacgctgaaggtggaggcttcgcccaccatgccgggagctaaaatttcttaaccaatgccggccagcgatggcagggctgcgggactacaatcccagc

SEQ ID NO: 37342 - DNA, 388 bp, Homo sapiens; identical to SEQ ID NO: 13278
  chr19:20162906-20163294
  hyper

SEQ ID NO: 37343 - DNA, 240 bp, Homo sapiens
  chr19:20188764-20189004
  hyper
caggcagctggagcgaagaggaaggctttcgggtttggcgcggccatttgtctcttgctgcagctggtgctccaaatctggtcttagctgcttcgtgtcttcttctccagcctctgtggccctgtgacctgcaggtattgggagatccacagctgagggacccccggaagcctagaaatggtgagagtgcctttccagcattccgagagaggggagggactggttggaaccgatgggaag

SEQ ID NO: 37344 - DNA, 37 bp, Homo sapiens
  chr19:20189420-20189457
  hyper
caacgtagttcttcttcaaagacgcaacttcctggtc

SEQ ID NO: 37345 - DNA, 30 bp, Homo sapiens
  chr19:21646407-21646437
  hyper
ccggggtccctgcaccggaggagagtgagg

SEQ ID NO: 37346 - DNA, 86 bp, Homo sapiens
  chr19:21769289-21769375
  hyper
cggcacctggagtctcggtggaacccggcagcggtgggcgcggaccccggagaggctgccccgagcccgagcaccccctgaccggg

SEQ ID NO: 37347 - DNA, 21 bp, Homo sapiens
  chr19:21769579-21769600
  hyper
cgcctgcgtgggactccaggg

SEQ ID NO: 37348 - DNA, 300 bp, Homo sapiens
  chr19:22018434-22018734
  hyper
gcgtgacccaccgcgcccggccgactctcctgtttctaatagaccaaaagagggactagaaatgccacggaccaaagctcttcctattcatgaaactgcatcacgagtcaggattctctcctgacgaccctcctgtggcccctgcacaatttgggagagacgccgcgttgcggctgcagagctgcccacagagggctgcaggccgggacacagtcactgcgcagagaagagacaggacgcccggggctgcctcccagagcagccgccatcttatggctgaaggggattgaggccgagctg

SEQ ID NO: 37349 - DNA, 44 bp, Homo sapiens
  chr19:22018914-22018958
  hyper
ctggacctctagcagcagaggacacagaagaacgaagacgagac

SEQ ID NO: 37350 - DNA, 218 bp, Homo sapiens
  chr19:22018959-22019177
  hyper
cagagctccaactgcagccagagacaaaggccccgccacatcccggaagccgccctgtcctctcctgccccgtgcctgattggacggtttccagcccagcgtccctgattggataacttctaaggtcctgcccccgcaaaccctgaatgaaagatgtgatcagacgctgggctgaaagaagaaagaatgacagcctaggctgccgccttttcaggcag

SEQ ID NO: 37351 - DNA, 39 bp, Homo sapiens; identical to SEQ ID NO: 4612
  chr19:22034379-22034418
  hyper

SEQ ID NO: 37352 - DNA, 3 bp, Homo sapiens
  chr19:22034419-22034422
  hyper
agt

SEQ ID NO: 37353 - DNA, 592 bp, Homo sapiens; identical to SEQ ID NO: 4614
  chr19:22034446-22035038
  hyper

SEQ ID NO: 37354 - DNA, 146 bp, Homo sapiens
  chr19:22610555-22610701
  hyper
gccaggagtctggagcgcaggtgccgggcaggcagcactgggagcgctcggcgacttggctggaggccgaaggtgccgcccctggggaaccagagcgcctttgcaaggtgggctcggcgtacactcccctatccttctgtggcccc

SEQ ID NO: 37355 - DNA, 431 bp, Homo sapiens
  chr19:22715206-22715637
  hyper
gtggggttggggccacgtcagctagattgcggcttaccactggggaacaattcctgtcggccaccgcgcaactgtgcgactgaccagaggaggcgtaaccagggcctactacagcgcagaatagggggcgtggccgccatcctccaagtccattggtcgatgagaaagatgacagagaaaggaggcgaggccaggcagcagcgcgtccaggtgggtgtgaggcgtcacaaggaaagctgagcaggcaattgctgccccgcccactctgggaagaggggcggggccgcccgctccagagggacggaagcggcggggccgccggatccagggacaatggggtggggcgggctttccctgggtgggcgcagcggcttcctgggtccccctcacgctctgggtcagagttcctttacaggcggacctgagaggca

SEQ ID NO: 37356 - DNA, 60 bp, Homo sapiens
  chr19:22715898-22715958
  hyper
agctggatccagtcccgggctctcctgcttcccagctcctcctcccgcacccaacagcac

SEQ ID NO: 37357 - DNA, 56 bp, Homo sapiens
  chr19:22806000-22806056
  hyper
tctccctgccagttgcggtcgtgggcggcctcgccttggagccctggccacggagc

SEQ ID NO: 37358 - DNA, 17 bp, Homo sapiens
  chr19:22806297-22806314
  hyper
cgcggggagcccagccc

SEQ ID NO: 37359 - DNA, 96 bp, Homo sapiens
  chr19:22817131-22817227
  hyper
gtctctcgctgcagtcggagtatggtctagtgttcgctgttctgcgtcctctggtcctagaggcccatcctctgtggccctgtgacctgcaggtat

SEQ ID NO: 37360 - DNA, 107 bp, Homo sapiens
  chr19:23253781-23253888
  hyper
ccaaggcacccaccacgcagcacgccgtccctttcggcgctcggaaagccctcgggcgaacccctcccgagcccacccctcccgggacctcagaagatggctcagga

SEQ ID NO: 37361 - DNA, 144 bp, Homo sapiens
  chr19:23254114-23254258
  hyper
cgactcacaagggacgcgccagagctctggtcccattgagacagttcagctgaaggctgcgggccttcccgagctccgcccagctcacagcggggacggtccctccctcggcagctgccgctggagctccggaggacaagagaa

SEQ ID NO: 37362 - DNA, 256 bp, Homo sapiens; identical to SEQ ID NO: 1364
  chr19:23257752-23258008
  hyper

SEQ ID NO: 37363 - DNA, 287 bp, Homo sapiens; identical to SEQ ID NO: 1365
  chr19:23258305-23258592
  hyper

SEQ ID NO: 37364 - DNA, 79 bp, Homo sapiens; identical to SEQ ID NO: 1366
  chr19:23258652-23258731
  hyper

SEQ ID NO: 37365 - DNA, 151 bp, Homo sapiens
  chr19:23299633-23299784
  hyper
ggaggaagtcctgcccgaaaaggctgcagcctacgctgtcactcttcattcagtccagcatctgatcacatctgtcactcagggcctgagggggcggggccttaaacgttatccaatcggggacactgggcggggggccgtccaatcaggc

SEQ ID NO: 37366 - DNA, 30 bp, Homo sapiens
  chr19:23300324-23300354
  hyper
agctttggtctgtggcgttcccaattcctc

SEQ ID NO: 37367 - DNA, 30 bp, Homo sapiens; identical to SEQ ID NO: 13295
  chr19:23386702-23386732
  hyper

SEQ ID NO: 37368 - DNA, 496 bp, Homo sapiens
  chr19:23598350-23598846
  hyper
gtttaacaaaagagactgggagccccaccggccacagctcctcctacgcacacacgagtcgggattctgccctgatgacccgcctggcatccctgaacaatctgggaaacactcggggctgcgtgcagagctgcccagggagctccagatagggcgccgcagggactgggcgggacgcgcgggtcattgctgcgggcccagccaccatcttgcggccagagggacctgggacggagctgcgccagcagggactcaggtcggcaacccaggagcggtgaggaggccagtcccgtcggtttctcagccagctctcccctctcgggatgctcaacccctcacactcaccctttcccaccttctggaatgtcctggcatcttagctgtctgtgcacgtcccaggacctgcagatcacagggcaacagcctgtcaccggctggggcgagaggggggcagaggtggaggacgttgaatagcagaaagcgatcccaagctctg

SEQ ID NO: 37369 - DNA, 209 bp, Homo sapiens
  chr19:23654103-23654312
  hyper
cgcatcgaggatgtgacccattccctggccaagggtgtgggtggggaacggcaaccgatctcactgcctggcggggcagcttcctttccaggcaaggcggagacctgcagggcgtggagaccccgcccggcgcagaacgcgctggccagtgggcagcttgacagggtccccgtgtgcctagcgaccctcttcagcgctgcatccatgag

SEQ ID NO: 37370 - DNA, 104 bp, Homo sapiens
  chr19:24154540-24154644
  hyper
agctctgcagttctccgccctgcctggaaaggaagcggccccgccaggtagtgggatcggccgccgcgtcccgtcctcacccttggccccgagggggtgacatc

SEQ ID NO: 37371 - DNA, 172 bp, Homo sapiens
  chr19:29284404-29284576
  hyper
ccggccagccgctgtcgctgtcgccgccgcactcgcctgtccggacgcaccttcctcctcctccgcggcccccgagaagctgggcgcgcaggcaagggaggcgcggcggcccctgcggctggtcagttcaccaggtgcctgctcccgagcgagttgccaccgaccccgccgc

SEQ ID NO: 37372 - DNA, 391 bp, Homo sapiens; identical to SEQ ID NO: 1367
  chr19:30015572-30015963
  hyper

SEQ ID NO: 37373 - DNA, 905 bp, Homo sapiens
  chr19:30016024-30016929
  hyper
cggggaccagaccgcgctccctcagatggctggggagggagcagactccgggtgaaggctgggggaggtaccgggatgccgagtacgccagagcaggcgggggatgggttccggcttcctgccgcctcggcatctcgctttgcaccgggcaaagaaggggccacgaccggcgaagagcgcgtggagacacagggacccgcgatccaggggcaggaaccccgccccctcccggaaacctcccgggccctgagtcgtgcccggcgctccccaccccaccccacccccgccgcccctgccgtcactcacggccgctgcgggctggctagcgtgtgcgctctccgcgccgcaggcacctgctcgctgggcgctgtgcgctcacttctccctcgcgcactgcagactcccggcgctgccgccgccacccagcgtagtctccggctgggcacagcgttccgcccttctcgcggccccgggcgcccacccatccgtcatggcccaggcctgggccaaacagcggggcagctggttgcccaaactggggtaaggagttgagggctgggagctgcagagaggaccgagggacacacggggagcagggatgagcggccgtctcgagccgtgcagactgggaagaagccagggagagtttgggtgggaggactcccaacccaagcgggtgcggggcggggctgtactccaaccagaaagacggtggtccctccgagcgacccccgaggagagagggggagcgctctggggcgggggcggggcgggctgtggcaggagaggggagggcgggggcgatgcagcggtggaggcggcttggcgcccagccactgaccgccccctcccttcccctcccctccccctctccccgcctctctccggctccgggtccgccacgc

SEQ ID NO: 37374 - DNA, 59 bp, Homo sapiens; identical to SEQ ID NO: 1369
  chr19:30017451-30017510
  hyper

SEQ ID NO: 37375 - DNA, 145 bp, Homo sapiens; identical to SEQ ID NO: 1370
  chr19:30017577-30017722
  hyper

SEQ ID NO: 37376 - DNA, 974 bp, Homo sapiens
  chr19:30017765-30018739
  hyper
cgttcccagtcccgccggggccccggctgcggaaaggatgcctgcggggagcgggagtaggcgcgccccagccaggctctggcggtgcggccaggggcgggggagaagcacgagtcgcccctgccgccccgccccatccggagggaagcagtaggcagccgatggccggtccctgcctcggccctgcagccgcttccccgaactttgctagcccctccggccgtgcgccagggagcagctgcggggtggggggcacaaggccagccagccagagaccgactgcctcgctttaggttgccccaggcccccgacctacagctggtcacgcctctctctctctccccacccccagctgcattcacagaagtccccaaagatgtgacagtacgggagggagacgacatcgaaatgccctgcgcgttccgggccagcggagccacctcgtattcgctggagattcagtggtggtacctcaaggagccaccccgggagctgctgcacgagctggcgctcagcgtgccgggcgcccggagcaaggtaacccgccgcccacgcggtaccggcgcgcgcccggctcgcgcccggggcggcgaaggctaacccagggagggaagcagcgggcttcactcgcgcagggcgccgccctgtggcgcagcccatcttccaccttcgcatcccaaagcatcttcaaagtcagcagtggttacccccaaacctgtcaattattttgacagcatcgctgttcccaccacctcccagaactccattcacgcccagcccctaaagagccacacctcagcctggtcgcttgctcgtgctcgctggctgcggccctctgatgggtgctgggtagtgaaggaagcccccttggtcccatcaggctctccccgccctctgccactttgaggaccccagggctcccacggctgcgttccagaggccaccagaaaaccgagtaccggaaagccggcagg

SEQ ID NO: 37377 - DNA, 416 bp, Homo sapiens; identical to SEQ ID NO: 1372
  chr19:30019113-30019529
  hyper

SEQ ID NO: 37378 - DNA, 81 bp, Homo sapiens; identical to SEQ ID NO: 1373
  chr19:30019530-30019611
  hyper

SEQ ID NO: 37379 - DNA, 271 bp, Homo sapiens
  chr19:30019660-30019931
  hyper
cgcgcctgccagcctccgctctgcgggcattcctcctagcaccgggagcgcgcggctgctcgccctcgccgcgaccgtggcgccagcttcccgccccctctgccccgccctgagcatctgctctgcgccctccgctgcaaccctttatcctccgcctggattgcgggtctgggtgcggggtgttgcaggcttgcaggggacggggtagggggtggttgtgccaggctgcgaggggcccgggtcatggggttgctaactctgggaggagatg

SEQ ID NO: 37380 - DNA, 613 bp, Homo sapiens
  chr19:30019993-30020606
  hyper
cggttcagaggtgagggctccctgggtgtttgttgagagccgtagagcagtacttcccgaagtccccaccggggcgcaggggaggagcacttcgctggggggcttctggagatcccgcggaaaggcgggttggtagcaggtggccagggagccaggcagcagcctcagcgttgcttgccttcttaagaaagcacagtgttagctgtaaagggcggggtccggtgacagggtggctttccttaggaagcgattcgggcaggccctccgtgctccgggaggtgaggagggccggctggggcgggactgtcggttggagcgcgtcggggcgggaaagacgtggggaagttaaggaacaaggaatccagcctggggtttcctgaaggtgcaggagggaggaaggagaggtggactctgcccttctgaagcgccagctacgggaagacaagcagtgttggtttgtatgggcggggcagatgcaaggtgggcgtttggttaacgtgatggggacgtggggacacagtccaaagagctggctgcctggcgtccacgcagagttggaagccctatgccactgggtagacgcgggtgaaagggaagccggatcgtgatggtg

SEQ ID NO: 37381 - DNA, 196 bp, Homo sapiens
  chr19:30020843-30021039
  hyper
agcacaaggcccaggcgatgctgcgcgtgctctcgcgcttcgcgccgcccaacatgcaggccgccgaggccgtgtcccacatccagagcagcggcccgcgtcgccacggcccagccagcgccgccaacgccaacaacgcgggcgccgcgagccgtaccacctccgagcccggccgcggcgacaagagcccgccgcc

SEQ ID NO: 37382 - DNA, 103 bp, Homo sapiens; identical to SEQ ID NO: 13308
  chr19:30021252-30021355
  hyper

SEQ ID NO: 37383 - DNA, 402 bp, Homo sapiens
  chr19:30215009-30215411
  hyper
tctggtctaaatccccgccgtaggattttatttttcggtgctgaggtgctttgctggaggagctgccagggggagctgcgcggggcaggcccggggtaccagaggcccttgctttagcggcggccctgcgtgtgccagaggcttgcagagtgatctgagcacgccaagagattgctgtcaagtaagctcctccacaaatctgcagaaacctcaaagattacagcgctcgcacggcaggagcgcagcggcttcccatacgccggcagacaatggggcggaggaaggaaggggacggtggcctggggacccccgcgcccgcagcacgtgcaccgagcctggagcgcccgctttacagatcttgtcgctccacccctaaaacaaaggccccggggccccatctgt

SEQ ID NO: 37384 - DNA, 30 bp, Homo sapiens
  chr19:30334621-30334651
  hyper
cgtaccaggccaggccggccctgaggggca

SEQ ID NO: 37385 - DNA, 182 bp, Homo sapiens
  chr19:30713411-30713593
  hyper
gccgggaggtctccccggggacccccactcagcttgctcaggtcctggaggcatgcagagggcgtcggcgccgacagggggagccggagagccccctgcccggccgtctgcggggctcaggcggggcttggcctccgatgagcgcgctgtctctgcccggtgggtcccaccccgcccggcca

SEQ ID NO: 37386 - DNA, 362 bp, Homo sapiens
  chr19:30713685-30714047
  hyper
cgaggccgcagaagccttgggcctccaggcctggaaggggctcccctggcctggaggccatgggcccggcccagaccggccagacaccgccagggacccccagaacgacgccaggacgcgcgccgggctccgtgcctcccacggcccaggcgaggccggcggctcgagggttaaaaggcgacccccattctgtaggggagaaagtgccttttctccaagtccatatggtcacttcctttcgacctgctcggccctgctcgcctctttgtccgctctgtcacttataaagaatcacttgacttacaataacaggttcaaaagacgacggagtataatcagttgatccacgaagaattggaata

SEQ ID NO: 37387 - DNA, 230 bp, Homo sapiens
  chr19:30714426-30714656
  hyper
tctcagggcagggtccgaggatgctggcagcggcaaggcccggtgcccgccgacggcgcgcctggggagaggaccaccggcggtgagggcccaggcccagcgcccagggcagctgcgacgcgtccgtctccaacgccggcacgctaacccagcgctcctcccagcgcaaagttttctgtgtctctcccctcactcttggactggttgcttgccaccgaatgactccttca

SEQ ID NO: 37388 - DNA, 581 bp, Homo sapiens
  chr19:30715288-30715869
  hyper
tttgcccagaggacccgccttgcaaagttgccttaaaaaagttattttgtttgataattaagtcctggagcccatcgcatgatgattattctacacccataaggcagagaacctgcgtgacgtttttctcgaagtttaattaccgtatgctaatttccttgcctactacgtgattaattaaaatcatattttcataatcatttggcactagtattgttttagaattatcatgatctcctaaatagtgtctgtaaataaagtcgcctctaatggcaggcgcgggaggcgaggctgaggacctctccgcgtttgtatcgcggcgattggcaacataactgccttatttacattaaatacgccacaaggttacagcgcggatcaacgtcatttgatcgctgatgactcccttaaacgcccgggctgtgactgattcttcgcgtcccgctgtccaccgagattcacccgggagtttttttttttttttttttttttcctcccagaaaagaaacagactttaaatagtttcaggagcaggtaagaattacgctttttcctcgccccttctccgtctctctctcctc

SEQ ID NO: 37389 - DNA, 554 bp, Homo sapiens
  chr19:30716216-30716770
  hyper
ggcgacaatggagagcgtttttaatggtacaatgcatttcacctaccagatagggggaggccgagccggggatggggatgtctgctggggctgggtgatgagtatcaatgaacggggcgattctgaaaagaggctgatgaaaatcgagcccgccctgccccggctgggctgggaacagttcgcagggctctgccgagtgggcgagtgaggcgcgcgagcagggcgcccgtcccccctcagccccggaaaatgatcaagtcaatcgtgtgggcatgtttcattattcattgaacacaatcttttacaacgctccgtttacgtgcccgagtttgctcctgacgcccgcgtttcaatgtttaaggtaaggaaaacaaaggtgggggggggatcgcggggcgcggcgcggtgcggggggcgcggcgcgggggggcggcggcgggtgggggggcagcttcggcgtccgggaggtggcaaagtgagtttggactcttggcgcggcccccccgtcccctccccctccccatctcggcgaggcctgccgcccggttccttct

SEQ ID NO: 37390 - DNA, 782 bp, Homo sapiens
  chr19:30716952-30717734
  hyper
cgcctccccgcccgcggtcccgggaccgttactttgaaaaggagtcccgaggcctggcgcccggcgcgcgatcgggaccccgcgtccagctccggggacccggccggcgccccccacccgcgagcggcccgcgagccactctcaggccccgggaaactttcaagagggtctggggggtggggggagtaaaaaggggagggggtaggctggggccgcggaaacttctgctcaagtgactttccccattttctcctctgcctgggacgggggttcgccttgcgctctttctctggtccgcgctcactgcggggttccggcccctccgcccgtggagagagggtaatttgcaaccttttttttttttcaattaaagttagctgatgcttacaatgtgtcaaacttgcgggcgccgagagccgctgagatctgccattttgtgattgcatcggcctcctgtgccccgggagcctggccaggctgaggccggagagttggtttcagggctgaggtgccagggtccgaacccgcgaccccaggaaaggccgtggcgcctgcaagcgcaggcggcgcccgcagcacctgccccagccgggcctcggcctgggggcccagccgggggccaaagaggaaataaataaataaataagtaacaggttatggagggaaaagagccggccagtcccaggctggagaaatgaggccaatcagagcgaggaagtgcgggcgtgggggctctggaaggcagaggagaggcagggcttgcgcggcgtctgggaagagtg

SEQ ID NO: 37391 - DNA, 989 bp, Homo sapiens
  chr19:30717942-30718931
  hyper
aaagtgtccagatctcgacgcgcccatctgttgcagttttgcaaataatttaaaatatagatatctccatatagacggatgtatgtgaagtggaggaaggtcgaaacgcggggaagttagggaaaaagaaagaaaaagggctgggcagagagagacctgtgttgctcactcttcactctgcggagtgaactccggcagggctttctttggggacaggtggaaagttaagtcccccccttttcacttctgtattgtgagtggttcctactgtgtgcctgttggagaacatgtccaccgttcccgagttaggtggaggattggaatgttggggggcggggagcgttggagttgaggacgcagtggccaggggctgggggccgagaaagagcagggcggggtctcagccccgcgtgcgggtggcagcggcggccgggttttgtttgccagatattgttatgtctaacgggtgcctcgccggagacgtgatttgtcagccgccttcgttttcactttagcagaaaatacggcagctgcgaggtgtcccggcctgcggggctcgggcacccggtgcgtcctgggggctgggtcgtgtgcgcgggtgggagccggcggccggcggggccggggcgaggggcgagcgggaggggcggagtgagcgagcgcgcggtacggccctccggttcctcctgcgccttctcccggcagccgccgccgccgccgccgccgctgtgcaatttagcagaaatccgacaggggccgcgtttgctgagcgcatccggcggccgggcagcccgagcgggccgccgggcctggtcggccggtgtagaggcgcggagggggccggcggaggggaccggcggggatgggcgcgggaagcacgcctgaccagagcacgcgccgttccccaaccctggtgtccccggcgagttgggcagccccgcgcgccctgaccttgacgccccagtctccagccagggcttaggtgaact

SEQ ID NO: 37392 - DNA, 29 bp, Homo sapiens
  chr19:30718991-30719020
  hyper
ggtgagactgggaacgcgctgttttcttt

SEQ ID NO: 37393 - DNA, 803 bp, Homo sapiens
  chr19:30719236-30720039
  hyper
tggggacagggcccccgcccccgccggggtcgggtttgatggtgaaatagtaaacccacgcacggagggtcgccaggaaagtggacattaccgctttaattaacttcgagatgctccggcggcgggacctggcgtagccgtgacgcgcccccataaatctgcccggcccggggctgctccgagaactcgtacagtagcggcgtcagatccatcccgcgcctcccagtccggagtccatttgcataattggattttttttttttgcctccttctttctccctgaaacttgtttgaaaacccaagtgaaaaccgcgacgatctgcacactcaaaagcaagtgccaagtaagtgccctgcggtggcctcggcgcgccccggggtgagcgcgcaaagccgggagcgaggtgccgcgagctgcgcgccgccccgggccggcctcgcgtgtgggcggctgggcggctgggcggcgggaggacggcctccgcgggctccgggactgcccggctggctgctcgcacaactttttttttttcccccgtctgctgacttttcgggccaggtgaagtgtttgggccacgcgtgtacctgtggcgagactcgggaggcgatcttggggggcgcgcggtcgcagttgggcatcttgcctgggtcgggggcgggcagtcggtcccagtggccgccgctgagggcagagctgcgagcgagcggggccggctgctggtcgcgccgcgccgtaaatgcaagcctgtagccaaatgcttcccccattattctaaggtttgtgtctgcgtgtgcgtgtatgt

SEQ ID NO: 37394 - DNA, 566 bp, Homo sapiens
  chr19:30865459-30866025
  hyper
cgccctgaagaaaggcgccttggcaccgcctcggtgcccaccagaaggtgcccggattgcctcttttgcgcaaagacaaagggggtaattttttggcaagaaaacaaacccaaggaaaacacaacaaactgagtgttgtttttttttctttccctcctgcaacttctcggaccgtctctgccctctctcctccagagagggcgagtttcatcctggagggaggccgggggagctgcgaggccacccccagccggcgcccgggcggattgcgagcccccgcgggtccggccgggggagcggagactggccccccgcccgggctggggcgcctgccgcccgcgagccggaagagcgccccattcacgagcaggcagccctggcagagggttaattgaggatcattgttgttggttccaggaggagcgaagcgcctggagatcgggcgcgcgggcgcggctctgggagcgggggaaggtgaggggaaatgggacatgatggcattaataatcgttaccaaagacggtgggagtaacaaaggaatgcgtctccgagacgccgcccagccc

SEQ ID NO: 37395 - DNA, 51 bp, Homo sapiens
  chr19:30866452-30866503
  hyper
cgcacagtgcgctgcggcccggggtgtgggaggtcccgggacttggggtgt

SEQ ID NO: 37396 - DNA, 91 bp, Homo sapiens; identical to SEQ ID NO: 13318
  chr19:31839837-31839928
  hyper

SEQ ID NO: 37397 - DNA, 1236 bp, Homo sapiens
  chr19:31839941-31841177
  hyper
cgcacccaaacaggagagcggcgcccggagttactcagtgcgggcagaagagcggggcgaggagcggggtcgcgcccgctggaggcgcggggcgagcggaggaagaggaggaggagagcagaaggaaggggaagcggctcgtacctgctgcgcgccggggcgcctgctgcttcctcctcggcatgatgcttctccggcgactgccactgccgccgccgccgccgctgccgggctgaggacagggagggagggggcggcgggcccgcgggggggcgaggcgggcctgctctcagcctcccccccggagagcggccgcccgcaggatgctgctgcgcccaggctctccgcgtcccccccgcgccgcgctccgccgcgaaccccgaacgtgcggagggaagaaggagggcgggcgagggaggctcggggagggaggagcacgggggggaggaggaggcagaggaggaggaggtggaggaggaggaggaggaccgcgctgccggcggaatgggaagtttgacaaatcgctccagaggccagaggaggagggggcggggaggagcggcggccctgcccccccccgccccgtccccagacgaggtgcgcggggttcggggctggggggcggggagagggcgggcagagcggtgggaggaggagcgcgggagcggcccggaccggtactgccccggcccccgcccctaggccgggggtcacggcatccggggggacgcgcagccgccgccgcggcccggggctcggcggtccagtcttctgcccgtggcgcggctggagcggcggcgtcggcaacaggcaagcttaaaggaaaaggagatgatcgtgtcaatcgcccgcccgcgggggcgccgcgcccccgcccccggccccaggcccgcgtgggacccccgccccgccagcgaaaggggtgccgcccctccgcctccgccccgtgcgcacacgcgggggcgcggcgccagccccgccgagcccgtcccggggcgctcgttaccccccacccctattcccacccagcgttcgtccccagccaccccccagctgccccacccggctcgcactcctctccacccgccgactccggagcccccagcgtggtccccgggccggggctggcgtcccccggggaagccagagcccacgggcaggccccctccagggaggaggcgggcgcgggccggggcgggtgggggcagccctcagaccccgcgccacccagctcct

SEQ ID NO: 37398 - DNA, 59 bp, Homo sapiens
  chr19:31841442-31841501
  hyper
gagagcctagggggccgccgcgccgtgtcccgcgcccggcctgccggggctgctggact

SEQ ID NO: 37399 - DNA, 30 bp, Homo sapiens
  chr19:31841966-31841996
  hyper
caccggctgcctgagcgctcctggagcagc

SEQ ID NO: 37400 - DNA, 195 bp, Homo sapiens
  chr19:31842286-31842481
  hyper
ccccggctataaagccgcctccagcgcctttccgcgcgcaggagcgctcggagttgtggggtacggaccccaggcggggcagggagtccgaggcgggctgcggcggggctctcgggctggcggactcgggggctgaggcgccgtgcgcgttgggtgcccgcggccgcagaggccagaaccgctactcctccaggc

SEQ ID NO: 37401 - DNA, 30 bp, Homo sapiens
  chr19:31842828-31842858
  hyper
cgcgtagccggccgccgccgctgggtcgct

SEQ ID NO: 37402 - DNA, 172 bp, Homo sapiens
  chr19:32715595-32715767
  hyper
taaatatgttcattccgctcttgcgatcggtgataaaccggaggcggccgaggccgacagaggtcagcaggccgctcgccacgggtctgcgagcggacactgccaccctccggccgcgcgcgggactgcaccggccccaccgcccggctctcccgcccgctcgctgcccgcc

SEQ ID NO: 37403 - DNA, 43 bp, Homo sapiens
  chr19:33166926-33166969
  hyper
ggatggacgagggagcgggggaccgctaacggggctccctctg

SEQ ID NO: 37404 - DNA, 414 bp, Homo sapiens
  chr19:33166988-33167402
  hyper
cgcacgtcgagggtcccgggcgggctccgtggacgttggcggtagcgccgagcgagtcacggaccatgaagagcgttcgtgccgcgcggcccaaggccgggatgggggttagccacatcctgccgcgctgagggggaggctaacgggcgcgggcggccgggcccagccggagcccaccgcgatggcgagggaggagtgcaaggcgctgctggacgggctcaacaagacgactgcgtgctaccaccacctggtgctgaccgtcggtggctcggcggactcgcagaacctgcggcaggagctgcaaaagacgcgccagaaggcgcaggagctggcggtgtccacctgcgcccggctgactgctgtgctgcgcgaccggggcctggccgccgacgagcgcgccgagttcgagcggct

SEQ ID NO: 37405 - DNA, 30 bp, Homo sapiens
  chr19:33167843-33167873
  hyper
ggccctagccgtgtgcgtggcgaagctgag

SEQ ID NO: 37406 - DNA, 42 bp, Homo sapiens
  chr19:33685611-33685653
  hyper
agccagagccggagccgcagccggaaccggagccggagccgc

SEQ ID NO: 37407 - DNA, 80 bp, Homo sapiens
  chr19:33716537-33716617
  hyper
tgggactggggagggcgagggcgcaggcctggggttcccgcgcccgctcggctgctgcgtgtggccggccatgtcgctgt

SEQ ID NO: 37408 - DNA, 58 bp, Homo sapiens
  chr19:33717533-33717591
  hyper
ggtgcaggtcccgcgcgatccagcccggctcaagaaggccaggcgacctggaatgccc

SEQ ID NO: 37409 - DNA, 37 bp, Homo sapiens
  chr19:33717859-33717896
  hyper
ccttccccccagtggcggcctccgggtttgctggggc

SEQ ID NO: 37410 - DNA, 60 bp, Homo sapiens
  chr19:33792521-33792581
  hyper
cactcgcgcggaggtcggggtgcgcggcgcccagccccttgagcgcgctgccagggcccg

SEQ ID NO: 37411 - DNA, 295 bp, Homo sapiens
  chr19:33794450-33794745
  hyper
cgagggtgtccaggccgccgggctgccaggtccgagcacgcacagggagaactctgcccagtggttcgccgggcgctgtagtccccgggatcctagggaccgaggcggccaggccctggggccccttgagtgcggcagctaatgctctcaccgcggcgggggaaggagcttgccaccgagacccccagccacgtgcgtccctcgcattctttaccggggccggggtggcggctacggaccgtcagctgggcccagatggagtcttgggagccctcaagtgtctcctgtccttgcc

SEQ ID NO: 37412 - DNA, 15 bp, Homo sapiens
  chr19:34112272-34112287
  hyper
atggatgcggacacc

SEQ ID NO: 37413 - DNA, 404 bp, Homo sapiens
  chr19:34112326-34112730
  hyper
cgagctgaagcccagggatatcccagaatcttcctcaggatcaatcttccgcctttcaccggccctgcgcccccgcagcatcgggtcctgggcgcgcgcccctgccccgctgtggtcaaggcccgccccggtgacgcctggtccttttcccgggttggcgccgcgtgcgacccaccgaggcagtggcagcactggccgcggtctggagcctagcgtcaggccggagtccggctctcctgaaccgggagaccggcgcagccccagccacgaccgctcccacccccgcggccgccggaccgcgcccagcagcgactctttctgagagcgctgccagaggggccgcgggagccgcagagcgcgcgtgggcgcggcgcccgcgagcccccgggagggccgagtgcatc

SEQ ID NO: 37414 - DNA, 82 bp, Homo sapiens
  chr19:34113221-34113303
  hyper
ccccacccctgttcccgccctgcgcaggctcctggcctgcagagacgccaggaaggggtcccgagcgggccccggactgcac

SEQ ID NO: 37415 - DNA, 32 bp, Homo sapiens
  chr19:34113366-34113398
  hyper
cggggctcgggtctggttgcactttggggacc

SEQ ID NO: 37416 - DNA, 651 bp, Homo sapiens
  chr19:34113399-34114050
  hyper
gccccggtagcgggaactttaattagactttctctccttggatctcactcgctgccgcgcttctgggaactgccgtccctcgggccctcttggtccctgcggactcccgctccgcctcctggccctcggtgctgcccgcggggaggcggcgtcgggcgctgagcagcgagcgccgagggccaggcaggagcgctcggggcgctggggcttcctggcgcgctcggagccggggctccggacgggttgcggcgggcagagactatgggggaagtttaagtggccttggcttcctacccagcggctccgtcgcgcgcgtccccgacccgcaactctccagggcaccggcctgtgagtgctggaggcgagtgtgcgtgcgtcagcgatggtgtgaaggtgtgtgcgtgcgtgtgtcgggagtgcgggagtcggagcctggggcggctccagggggcggggaaatgatccgtttggccgcgggaccgagccgagctctgacggcggctgcaactccggctaccgactctgcagacccgctctggcctcgctggaggccagccgggccaggagggcgatcacgggttttggcagtgcccgatgctggggcttgggtctgatgtgaccccgattccttctccagtgcgggactcccgc

SEQ ID NO: 37417 - DNA, 17 bp, Homo sapiens
  chr19:34114286-34114303
  hyper
cgcgtcccggcccctct

SEQ ID NO: 37418 - DNA, 73 bp, Homo sapiens
  chr19:34175192-34175265
  hyper
cttgtaacagggcagcggacagcaggtaaattgccttccccgggagtagcgtgccgcccggcaggggcctggg

SEQ ID NO: 37419 - DNA, 75 bp, Homo sapiens
  chr19:34175542-34175617
  hyper
taagcgagagccgcgcgcagggaagaactagtctgacaaaacagaaggaggtggtgctctcgggggactgggctg

SEQ ID NO: 37420 - DNA, 114 bp, Homo sapiens
  chr19:34288561-34288675
  hyper
aaacacacccgggggcggacccccgcctctgcagcgcctttctgtcttccggcggcccccacccgcgactgcagaaagataagcttcaagttttcgctccgtatctcaaatgtg

SEQ ID NO: 37421 - DNA, 32 bp, Homo sapiens
  chr19:34311466-34311498
  hyper
acgcagaccagatctcgcgggggtgggctggg

SEQ ID NO: 37422 - DNA, 79 bp, Homo sapiens
  chr19:34396820-34396899
  hyper
tccctggggacccaccggatcggagagggggtcgggggcgaaaagcgccaggaggctggcagcccgggctggaacccgg

SEQ ID NO: 37423 - DNA, 30 bp, Homo sapiens
  chr19:34972190-34972220
  hyper
cgcatctgcgctaggcgcacagtattcctg

SEQ ID NO: 37424 - DNA, 126 bp, Homo sapiens
  chr19:34972522-34972648
  hyper
cgcggccgccgccactccccccacattccagaggccgcagcgccgtctccttcctcgcattcctgcccccgcaaaggagtccctccgccccgcgcgaggccgcggcgaggagggggcgcggcccgg

SEQ ID NO: 37425 - DNA, 449 bp, Homo sapiens
  chr19:34972675-34973124
  hyper
cgcgcgccgccgagcagggcgccgcgtcccccggcccgcgcgtggccgccggaacgaccccggcccggcgccggccccgccccgccccgcgcccaggggtcccggggcgggctccgggcttcgggcggacgatgcggcggcccggccggagcggcggcgggaagcggaggcggaggtgacgcgccagggccggcgggccgggccatgcagcgctccagggcgggcgcggacgaggcggccctactcctggccgggctggccctgcgggagctggagcccgggtgcggctctcccggtcgggggcggcgggggccgcggcctgggcctggagacgaggcggcgcccgcgctgggccgcagagggaagggcagcggcggccccgaggccggggcggacggactgagccgcggggagcggggtccccggcgcgcggcggttccggagctcag

SEQ ID NO: 37426 - DNA, 215 bp, Homo sapiens
  chr19:34973242-34973457
  hyper
cgctccggtcgctcggacccgcgtcccggtcccgggccgccttcggtgggcagcgcccgctccagcgtttccagcctcggctcccggggctcggccggcgcctacgctgacttcctcccgcccggcgcctgccccgcgcccgctcgctccccggagcctgcggggccggctcccttcccgctgcctgcactcccgctgccccctggccgggaggg

SEQ ID NO: 37427 - DNA, 91 bp, Homo sapiens
  chr19:34973553-34973644
  hyper
cgctcggcccggcagttccctgcgcgcatggctggggtccggggttccgagactgcctcgggtaggcggccggatcagcggaggagagcac

SEQ ID NO: 37428 - DNA, 121 bp, Homo sapiens
  chr19:34973645-34973766
  hyper
gggctggctgggggtgcagcagtgcacggggttgggacgaggaaggtgcatcccctggggactggggagcgcaaagggtgagtgagtgcgcctggatccccagcagcggcttcacccctgc

SEQ ID NO: 37429 - DNA, 255 bp, Homo sapiens
  chr19:35068601-35068856
  hyper
cgtgtcctgggggcgggcccgggtggcgtggcttggctggacagggagggtaggggcggtagtggggtttgtggcactccagcgtagcaggttgcatctgcgggtccccgcccctgccccgcccccagcccctcccatggtgctggatccaggcagctgatgtgcaggcggggacccctggctgggcgcggtcctgggcgcgtccctgcgcggttcaggcttccatgcgcgctgagactccgctggctctgtggc

SEQ ID NO: 37430 - DNA, 30 bp, Homo sapiens
  chr19:35168907-35168937
  hyper
tgagagcgaagtgggcgcgagagcagacgc

SEQ ID NO: 37431 - DNA, 377 bp, Homo sapiens
  chr19:35263586-35263963
  hyper
cacctcaccctctcccgggatctccataacctagggcatcaaaagggagaagcacagagtcccggcatccgccgtattacagcggatgggtgcatgcgggcggtgacccgagctcgcgcgggctgcggaaccctccactcaccaacgccggcgccgccatgggcccagggggctgggtgaggccgtgagagtcggcgaggaagccggtcctgcgggctcggccgaccccgggctccggctctgggctgcgagggacctcagtccccgccgtcgtgtaaaatgcacacaaggttcgcggcgccgcctctgcgcgccgtgaggacacagggctgtcgccaaggccccaggaagggttttgcagacgcttgtgggggtgg

SEQ ID NO: 37432 - DNA, 26 bp, Homo sapiens
  chr19:35395923-35395949
  hyper
cccagctgcaagggccggcgcaccca

SEQ ID NO: 37433 - DNA, 216 bp, Homo sapiens
  chr19:35396250-35396466
  hyper
cgcacaagctgctcttcacgggcaactacctctgcaagcttcacccccggccccgccacgccccgcagggttccctgtctggtctggatcacctcgctctccctgcgcctctctccttggcctagctagacaagtgcttctcacgatccagcgcgtttaccgctcggtttcgtcgccgctaaggggtggtggtgtctgatccgtcaggctctgcgc

SEQ ID NO: 37434 - DNA, 30 bp, Homo sapiens
  chr19:35503957-35503987
  hyper
agtttgagtcctgggcgcaggccctggagg

SEQ ID NO: 37435 - DNA, 126 bp, Homo sapiens; identical to SEQ ID NO: 13334
  chr19:35531737-35531863
  hyper

SEQ ID NO: 37436 - DNA, 121 bp, Homo sapiens
  chr19:36024853-36024974
  hyper
aagtgatgttcatggcgcttcgcgtgaggtgagctttgccctccctgtgatgcacaaaacaaggacacttggaaccttgccggggacgtgctgaccacttcgcaggcgagagctcagggaa

SEQ ID NO: 37437 - DNA, 730 bp, Homo sapiens
  chr19:36048580-36049310
  hyper
ccaggctgaggtaggcggtctggaaggcctcgcgccactgctcgtccagcggcagctcctggcccttgataaggatggagctgcagcgctccagcacgcgctcgggggcgcccttcatcaccagcaagtgtcgcgggtcccgcgggtcctccagcgtatggatggacagctgtgggcgggggggagaggcgaggctgtggacgggggaacggggcggggctgtggacgagggaacggggcggggctgaggagaggggcggggccgagagctcggtgcgggctctgagagctgcggggaagggtgaaggtggaagatggaggccttgtgtggaggggtccttggtagaaggtaagcgttaaggcggggctaggtgcagatttggagtcctggacgcagggaatgaacagaattagggtgcggagttgggctgggggcggatttggagagcgaggtgctccccatggacagtcccgccgaggagaagctgtgggcggggctgggtggtgggcggggccttgcctctggtggacggggccataggcggagcgggagatggggtggggtttggctgcggagagaaggggcaaggagcgaagcccctcgtggcccgctgatgtgggtgtggcctggggcggggcccgaggtgggcgggcccaggccgtgggcggggccggctgcgcacctggaacttgttggtggagttgaagggtatctcgcagacttttggga

SEQ ID NO: 37438 - DNA, 225 bp, Homo sapiens
  chr19:36334979-36335204
  hyper
ggtttccatggtgggcggggctcacagtgcacgtccagccgcagccgcgcttccgcggtgccctcagagttctggcagtgcagctgatagaggccgtcgtccgcgcgggtcacattccacagatgcagagccccgctggacaggatgcgatgccgggggccgcccgctggggaaggccagaataagggacctggcaggacctcccatccccgggacccctcccca

SEQ ID NO: 37439 - DNA, 96 bp, Homo sapiens
  chr19:36336604-36336700
  hyper
gcggattgctgctgacgctgacgcatgtcaagtttaaggcgtctcccgggcgcagtgcggatgcgttggccaggatcgtcacgttagttgggggaa

SEQ ID NO: 37440 - DNA, 102 bp, Homo sapiens
  chr19:36337017-36337119
  hyper
tcccagatttctccacgctgccgagatgcacgcgccgcgactcctgcggcagccgcgactcggtcacggtgcgcgagtcctacgggccgggagtgactgggg

SEQ ID NO: 37441 - DNA, 208 bp, Homo sapiens
  chr19:36347809-36348017
  hyper
cccagagacccaggccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttggggg

SEQ ID NO: 37442 - DNA, 147 bp, Homo sapiens
  chr19:36351801-36351948
  hyper
ttcgtccagttgggccgattctgcaggcaaagccggagcccgtgtccgtggacgtgggggaagacgcttccttcagctgcgcctggcgcgggaacccgcttccacgggtaacctggacccgccgcggtggcgcgcaggtacagccct

SEQ ID NO: 37443 - DNA, 30 bp, Homo sapiens; identical to SEQ ID NO: 13340
  chr19:36361080-36361110
  hyper

SEQ ID NO: 37444 - DNA, 405 bp, Homo sapiens
  chr19:36449891-36450296
  hyper
tgtttccagggctgccgcttcatcacggctttctcggaaaacgggggcgctgagaagcccaacttccagctatatatgtcgccaccgcccacagggcccccgacggcgatgctggtgacagcgctccctgcgtgggcgccactctccccgtgctccccgcgcctgcagccaggcacgacggtgtgggtgtgcccgcccggggcagaggagctgcagggctcgcggcaggcggcgctgtgcaagcagcgacgtcgcggcccgaggaagtggaggcggtgaacgcgcgtgggcgcgcctcccgggacacggcgctggctctgcggcgctacctgctgggcactccctaatcgatggtgacgccgtcgctgccgcccggcgaccggcacaaggagtttgcggtggtgg

SEQ ID NO: 37445 - DNA, 15 bp, Homo sapiens
  chr19:36450544-36450559
  hyper
cgccccagggtcgct

SEQ ID NO: 37446 - DNA, 567 bp, Homo sapiens
  chr19:36523333-36523900
  hyper
gctggagagggtgcccggcaggctccagggtccaagcccctaggagcttccagggccccgggtggcctccgcgcaactggatcttgggcaaccatagggacccccgttacccatagagggccccggtgtgtgcgcccagcgcctgccacctcccccaggcccagccccccattcttctcctcccgcgtcaggcccctcagtcgcggctgccccctccccgggtttgtttatctcgggattcaggatgcttcgcccctccccttctccgcgggccgccccctccccatcttacctcgggcagacagcgctggggaccaaagtggagactggggagactgtgggagcaatggggtgtcggtgtcaggggacgtgatgggggaggcaagggagacagagagaaggggacgaggcccagacgccgacagggggtgggggcggagagggaggggcgcgactgcgcatgcgcctgctgcccccctaccggcggcgggggaggagggaccaggaggagggaccgggaggcgctcgcattgatggaggggccagaggcggcgactgaaaggggag

SEQ ID NO: 37447 - DNA, 41 bp, Homo sapiens
  chr19:36736016-36736057
  hyper
agacccggcgagcctcgctgcccttgcgagagccatggatt

SEQ ID NO: 37448 - DNA, 265 bp, Homo sapiens
  chr19:36736314-36736579
  hyper
cgacgcccacccagaaaatccggatcacatttcccgtggtccaccgcgcatctaggaggttacctgcgtccaggcggtgacttgcgagggaccacctttcccagggtccacggcgcatttaggtggtggcttgctctggactacatttcccagggtccaccgcggatctaggaggaggcttgagatgcagcctcccagcttcgaggctaccacctgcccgaattggtgctttggcagagtctctggtgcccgggtgaatgggttc

SEQ ID NO: 37449 - DNA, 225 bp, Homo sapiens; identical to SEQ ID NO: 4642
  chr19:36822242-36822467
  hyper

SEQ ID NO: 37450 - DNA, 335 bp, Homo sapiens
  chr19:36822557-36822892
  hyper
cgtggccgaatagcccaagactgaggactcacacttcccactttgcacctggaggccacctgcagaccaaccttgcgccaggcttccggaaatgggagggcgggcttccggaaacggcggccaatgggaaacgtgatcagatgttactaggcagacagtccgtttccaggcaacacagaagaaaggaacgcgctcagtcagcctcaaatagacggagatttcagccaatggatgtgcaggttccctccacattagccaataagaagtgcttggggcctacctgcctacaagcacagcaaaagctttcctgcgcatttttgcgctggaatggctac

SEQ ID NO: 37451 - DNA, 281 bp, Homo sapiens
  chr19:36909068-36909349
  hyper
ctcgctctcccagagctctgggattacagatgtgagccacctggtccggcctagtctgcgcgtttctgctgggagtctttggcgtgcagaaactgaccgagggccatttctctgcagctgggcccggtgtgggcagaggatgctggggtcagtcacgcactccacggccacaacaaccttcgctcatacaatagtctctgcacccaagtcagccgcacagactccgtcacgtcccagccccggccccgtcacgcccacgacacacacacccgggcctgagg

SEQ ID NO: 37452 - DNA, 312 bp, Homo sapiens
  chr19:36909623-36909935
  hyper
cgctcgctggtgcagcccctgctctgcgtgaacccggagccggagctaggtccgtcccagcgaggctgcgcttcgagtcccttagcgcctggggacggcgcggcagggcctggaggggagcggggacagatggctggcgcgttaaagaggggcgcccgcgaccgcctctctatagtgccaactagggagccctgtgagcgaggacggcgctgcgagtctgtccctggcgcgctcctgggtgggattctttcactgggtgtggctgttgggatttgagaccgtgtgactccggagattcggggaagccagttc

SEQ ID NO: 37453 - DNA, 18 bp, Homo sapiens
  chr19:36912332-36912350
  hyper
cccggcaccaggggacgc

SEQ ID NO: 37454 - DNA, 81 bp, Homo sapiens
  chr19:36912480-36912561
  hyper
cgagacaagccggtgcgcatcaccatgcgcggcctggcttcggagccgctggacacgctgcgcgcgcgtccctgcgcgacg

SEQ ID NO: 37455 - DNA, 148 bp, Homo sapiens
  chr19:37095665-37095813
  hyper
cacattcatagtcaccgctcagcgccgtcacacaaacggccccgcccccactcagtcccgcgggcccaatcggggacagtcagggctgtcccgggctgtgcacctgctgtgcacacacaccccctgctgtgcacaccccccgcccccc

SEQ ID NO: 37456 - DNA, 103 bp, Homo sapiens
  chr19:37096487-37096590
  hyper
gcgaagggggattttgcccgttctgatcccgcggaagcgccatcgctggcggcgggtccccgcgcggagcgggcgctgtgtgttcgcgcgcgcgggcgcgcgc

SEQ ID NO: 37457 - DNA, 629 bp, Homo sapiens
  chr19:37157547-37158176
  hyper
atagacattcccttccgcggcactggtgagccaggatttcttaccttcagcattctcagggaaggctctggtccaagctctgattcggattccaagcgaagccacacgcccagctcttccttctccaccggcccgggacatccttacctgcctctacccggagaccattcctgcgaggctcctaccggaagtagctgtggacagcagtgtcctctgggaaatgcagtccgaggggagagcgcctggggtggagcgggtgtgttccgccgggctccgggatgcacttgcgcagtttcacccgaggctggagtgacgccaacctgttaatgttcgttttcggattctggacttcgggttccgctgaggacggatttcggaataggcacagtggctgccccgaacccctcaaggcggcctccgcgggctgtggctgaagataattttcggcgggcgcggactaacccggcttccctttgtggagttgtggtgagaaaggtgttttgttgtgcgcgtgtccgaaggtgactccggaggagaaggtggatatgaactgacggtgagggtgtagcgcgtgagatttgtatgtgaaacgatttaaaaaaaaattttttttttggccgggcgcggtg

SEQ ID NO: 37458 - DNA, 1048 bp, Homo sapiens
  chr19:37263345-37264393
  hyper
ggtactgcacagacacgcaaagtcacacacccaccccgggacacgcagtccaaccacacagtcaccggttcttcacatccgcacgcacaacgagggtcgtccaggacacacacacccactccgggcgcgcacagtcacaagcgcccacctgatcacccagagtcagcaccacacagccacagtcacagaccacggagacccacggcagccatcgcgatcacacacgcaaactcctctcctcagccctccacacacaaaaggaccggagccggattcctcaccctcagcattctctggttccgctcggggccagcctagccaagttcctcaggactccaaggcgcggcggcagctaaatcggcacagcaaacggtcccgccacctggctaagaggaagccaaaatctcgcgagacgtggcgtcggcctgcgggatcctctgggaaatgtagtccagagcccgactgcgggcttccctatgcctctcatttccaagcctggcttgtttccttttaccgctcctctccaacgaggatcgcagagccctcatgccgagcggctcgctatggggccggctcgcccgctagagtggtcaggcctgattatccctggcagctctgttatctggggtaagacacaggaaaacgtgcttccggttctcggcggaagtagccccgaacggtagaaccgatgggaaatgtagtccagggcagaaaagcggtcaacccagccacgatgcgagccaaaggattcttggctccaagcctggtcctggctgttagtttggaactcatgcacccagatgctaactcgccctcagaatgcagaggggatgaaacactgaccggacaattcaatctgtatatgggtgagtccagggctcagtctgcattgcgcggaaaatgaaggtgaaggtggaggtgggacctgatggtctcgtcccggatagggttgaagaagtgggagaaaaggaatcaaaatcgtggatgggataagattgtgcgcgaatgctctctgggagcggatcgtggccgacgagggcccgaagat

SEQ ID NO: 37459 - DNA, 32 bp, Homo sapiens
  chr19:37287904-37287936
  hyper
tgcttgtaggaaggtcggccacaagcacttct

SEQ ID NO: 37460 - DNA, 189 bp, Homo sapiens
  chr19:37288236-37288425
  hyper
cacttcttattggctaatctggagcaaacctgcatatccattggctgaaagctccgtctattttagggtgactgagagcgtctcttccttctgtgttgcctggaaacggactgttcgcctagtaacatctgatcacgtttcccattggtcaccgtttccggaagcccgctctcccgtttccggaatccc

SEQ ID NO: 37461 - DNA, 99 bp, Homo sapiens; identical to SEQ ID NO: 1383
  chr19:37288606-37288705
  hyper

SEQ ID NO: 37462 - DNA, 101 bp, Homo sapiens
  chr19:37288706-37288807
  hyper
attaaaggtaaaaaacggggctttttcatcccactggggtaaaacgcccttttatttctagccaggtgttctgttgcagaacgcctcgaagggagggagtg

SEQ ID NO: 37463 - DNA, 30 bp, Homo sapiens
  chr19:37328802-37328832
  hyper
ctccccacacattcacgaaggactatgcct

SEQ ID NO: 37464 - DNA, 165 bp, Homo sapiens
  chr19:37329224-37329389
  hyper
tcggaatcactcacccggccctgcggtcccttgatggtggaaggttccgcgatctttctattaaccctaaagggacagagggctgacaggaagttgcccggggaacggtgcactctgggaaatgtagtccggagcctgggccgtctttaactgccccggacaccg

SEQ ID NO: 37465 - DNA, 257 bp, Homo sapiens
  chr19:37340845-37341102
  hyper
cacaagcaggcccaccgcggtctcacacacactcgagccttcctttgcccagtctcacatgcatgactgggatcgcggatttgtccccttccgactccccatgctggttcggtcccagacgctcaggtgccacattggggtgcgctctcccggctcctccacacgctacgcagctgcccgcctcaagagcgtctgcgtgcttccagcgttaagtggaattccaagcagcctccggggcacagttagtctggtcactg

SEQ ID NO: 37466 - DNA, 32 bp, Homo sapiens
  chr19:37341165-37341197
  hyper
cggcgaggcttggactacgtttcccaggagac

SEQ ID NO: 37467 - DNA, 664 bp, Homo sapiens
  chr19:37341469-37342133
  hyper
tgctgaagtgctgttcgcaggctatggaggaggcctggccaagcaaaaagggctcagaggagcctgactaaagcttggtctagggactccttgtcaggtgagactcccggaaggctccgatgggcagctcacctcaaagagatagttttgttggtgccagagtccgcgccaggggaatcgggatggctgggctgtagctttcggcaacctgtcgctttctggactacacttcccagaagcctctaggcccagggcactctcccgcgataactagattgtctcttgaggagtgggcgggatcttcccgcggatttgggcaagcggccttggggctttgtgagatagctagggtcgacttgtgtggattctagtagaacggagctgaccctatccgaacaggcgtaagtgaggcggctcggagcctggcgcgacaggaactcccgacctgtgtgggctgcgtggggaacaggctaaggagcgattgtgaggagtgtgtacggttgtgactgggggcgtgtgtctgtgcgaccgtgtatggaactgtgagggcggggaggaggactttttgtttatgtttgtgcgggtgtgagtagagtttaattgtgaccgggttgggcactgtgtttgcgagtgtgaggttcctggaccgcggttgtgactgtat

SEQ ID NO: 37468 - DNA, 387 bp, Homo sapiens
  chr19:37406765-37407152
  hyper
ctccacctttcaggccgctccgcccgcaggggcccaaggcgccagctccccatcggtcttcggtatcctcacctaagccctttccagtcatcccggatgggaacttgcagacctgagccagttctcctggggaccaaaatatctcacctcccagatctaagggtcccgccaggagtgacgaaacgttcgaattcctgcgagaaaagtggcaggccaccaggccctctgggaaatgtagtccagagcgggacccacgccgattcctgtcagctcctcgcctgggcccacccgaaacggctgctccctcaactctcaacatccagccgagcctcggagttgcgggtcgccgtagcgctgcgcaatggagatgagcctcccggggaaccc

SEQ ID NO: 37469 - DNA, 221 bp, Homo sapiens; identical to SEQ ID NO: 1386
  chr19:37407153-37407374
  hyper

SEQ ID NO: 37470 - DNA, 215 bp, Homo sapiens
  chr19:37407375-37407590
  hyper
ctgccgagtccccgcagcagggggcgagcaagggactcgcggttgacgggacacggatcctctaaggcccagagtgtcccgagtagcggcagtggggagtgctcagggtacgctaatggtgagtggttgcagttgatgggacaaaaaactgtgatgggagttagtgtgggtgtgtggttgtgtgtgtgagtgtgacggcacgaataatctgatgg

SEQ ID NO: 37471 - DNA, 520 bp, Homo sapiens
  chr19:37464048-37464568
  hyper
tttcccagggggccccgcggccaaccttttccggccgaagaaggctagtcacctttccttggcgggtgttggaaagcaaagggctggaacgtcccgggctgcggagctcgctgggttgggatggactcgttcagacctgagtgctaggacgccgaagggggcggtgaggcgtcccggcgaggagctggggtcgtctggagtttaaaagacaggtggctctcggagatgtgcgggctgcatgcccacgcttcaccgctaggggaggtcagggctgtgcgatggggaaggaagagagtgtcggggcggtgcagtcgggatgggagaagggtgtcagggccactggcccccagctcggcagagggcagtgtcgggccgcgcgcaggcagggagtgggtgtggtgtgaggctggcgctggagcggtctgggaatgttaggaggtctagggtatcgcggccctgcgtcctcttgtctggactaaaagtccgggcagttctccccggacctggattgtgggcccag

SEQ ID NO: 37472 - DNA, 72 bp, Homo sapiens
  chr19:37464666-37464738
  hyper
cgtgtgccgggtcatcgaccccatctttgggaggcctgggagggggcgggacaccctcgctgtacattctgg

SEQ ID NO: 37473 - DNA, 865 bp, Homo sapiens
  chr19:37957671-37958536
  hyper
tcccactgtcatgcacgtttgcacgcaggttcatactgaaagataaaagggaaagcgcctccacgaaatccgcttacggacacgatcccggggccacactcagccagacgaatgtctggcaaatgacagtcacttcacgccagactctcacagtccttcacacgccactcccactgcctcagggaaccacaagcacaggcatcgccccgcccggcgtcctcctccaaagattggggcaccaggaccgcgggcccccactcccacccagcacaaagagtccggcgctcagagctagcggtttcccgaggactcaccaccaagcccgcggacacaggccccgattccacacttaacgctgccaaagtggcagagccggcgcgggctgggacagaggcggcactgaggccggcgctgtcggtggctgagagcgccacaagtctcggtccgttacaccaggggcgacgcttcccagaggcccccgcggctcacccgggcgggactggcttcactgtttgcgcgtcctgagaagcagaccacggtgttccagggctcacagctccgcgcaggggagctcagcctaggttttgcacgagcggcctcccgcgagcccagctctgagagattgggagcgcaacttggtgctgagaagaatcgaatcgttccgctgcttcctgcgccgaactacatttcccagaggccttcgcggccctacttccccgaccccacctgcaaaaaggcacttccttcttacagtcggctggagctgcaggttcgcaaggtccgtgaaggaagcccggctcagtgtgtttagttccgtctttttgggtctctacctgaggctagaatacagcggggtgaaggtggt

SEQ ID NO: 37474 - DNA, 15 bp, Homo sapiens
  chr19:37959786-37959801
  hyper
cctcccaattttttt

SEQ ID NO: 37475 - DNA, 632 bp, Homo sapiens
  chr19:37959873-37960505
  hyper
cgcacaaaccttttccctgcggccaacctgcgattctcaactccccgccctggttgctaagggaggcgcgcagagcgcttgtgcctgcgcacttccacaccagcccgtgtagtgtgacgctgggccccgtccctgtgaccgggccaggctcggagctgcagggaatccggactttcgggctctctggaaggccggggagaggccagtgtgggaggacctggtggggaggaggccgtgttacaaaccctgcgcggagctgcaccgctgctgccagacactgcgacgccgcgaccttttctactccggactacgtttcccagcggaccccgcgggagttgggccggcggcccctttgtgtcctccgggggcggaggcagctgaggcgcttctttccgggcccgtaagggctgggttccatccaactaagggtagcggtgagacccgagtgcagattccccgagccttcggggcaggaaggagatcttccaccagttctgttctgcaggtcgggagtgggctgaggagtggcgtgtgggtctccggaagctcgtcgcaggccatctgtgtgactccggtgcgagtggaggttggtaccgttcagtgcgaggctgtcaccccgtgtgcctgtccac

SEQ ID NO: 37476 - DNA, 30 bp, Homo sapiens
  chr19:37960799-37960829
  hyper
agagactgtgtgccacggagaggcttttaa

SEQ ID NO: 37477 - DNA, 107 bp, Homo sapiens
  chr19:37997089-37997196
  hyper
tatgcactgtatattcgttcccatcgctcccgtctcacttctccatcccccacctaccaaataaactgcttgcactcattctttcctcaggtcggcttctcgggcaa

SEQ ID NO: 37478 - DNA, 304 bp, Homo sapiens
  chr19:37997687-37997991
  hyper
agttttaaacatggccgccccaggtaggagtcaagtgggcgtcgccatcatacctccaattacagctttgagaaacccagaatcctgttcactggaaggttgccgggtggcggctgacagcctcaaagtcgcaattgagtctgcgcaccggccattcaggatgggacgaccttataccgcggtgaggcggcgtggcaggacgaccaatttcagattcagggcgcggatgcagcataaatgggaaggcacggtttgagaaacggtcaaacctgggactagtggaggatagtgagctgccgactac

SEQ ID NO: 37479 - DNA, 131 bp, Homo sapiens
  chr19:37997992-37998123
  hyper
gtggccgactgggtcagctatgggtgcccgtgagggtcaatgacaagggaactgaagggttaagagattcggcgtctgagcctcgcggggcctcagtggtggcggacagaggtttgcgggagtcagtggca

SEQ ID NO: 37480 - DNA, 465 bp, Homo sapiens
  chr19:38042365-38042830
  hyper
tggccccctcctctccgggggatcgtcgccttggtcccccgaccctaggagtcgggcagggcagaaccaggctaaagaaacgtccagcgtagcttcaaggatgcaccgcgtgatccctatcggatctccccgacgcgtcaggcctgcctagacggtgctgggagcgcgtctccttgaacgttgtcccgcctgggattgcgaggtaggtaccgcctgcctgtgtgtaccggggctgctgtctccggggaggggcttctggcggacaggagaaccaagcagcctcaggagctgcctgggtgtgtgtgtttctgtgcgagtgttgcatatctctgtgtgtgtttctgtgcaagtgttgcatgtctgtgtgtgtggggggggtggtgtctggtgaaaagaatgtgtctcgtgcggtggagcgccgtttctctgtagtccgcgggctctcttatgcgccctcttgtggtc

SEQ ID NO: 37481 - DNA, 40 bp, Homo sapiens
  chr19:38086122-38086162
  hyper
gtgtgggtctgtgcgcgcgcgtgtccgagtgtcctctgtg

SEQ ID NO: 37482 - DNA, 1254 bp, Homo sapiens
  chr19:38146010-38147264
  hyper
cctcttgggccttttcgctacggccgagcctaagtggctgaagcgcggacgaggatgcgcggggcctcggtctccaactgcaccacaggccgcacccacgaacctggtccggcacagttactaccgcccgggcctccaggcctcagggctgcagaagctcagtcccgggaaaaaaagcacaccggcctgaggctccacaggaaccttttctccaccttggcccggcctgcaaaacctggcccactccgcgctcttttccctcagaaaagcagcggccacagtggcgcccggctcccagccccagcctcacccgactcagaggatagcccagccctgggagtcagcggcgccagaatacgggagagcgcctgtctccgtcgcgaatgcgctagcgcgcgggggggcggaggcaagtcccgcagctgctccgggccgggaggggcgcgtggggccgggtctcggcggggatagtcgggccggggagacggagccagaggggccgcagtgtccctcgcctcaggcctctacctgtaatggccgccccgtgactgaccagtgccattaaagataatccaggcctgctcccctgtggacactgcggtccaaaatttaaaaaaacaatattccgcctttttatttttcatttggttctcggctcggagacaggcggaggctgcgagccccgccccgcccccagcgacgcctcaccggaacctttggaaatcggcttctgcctcgagtgcgcaagcgcgcggggggcgaacgctggggcccttcagggagcaagggagaagtgtggggccgcacctgccgaggggtcgggaggtttggaggagggtggaggttggctacaggatcccgatggggatggagtgttcaaatctaggcctgtagccgtgaccctggcgtgagttggatggaggaaaccccagtatcgcgagcctggaccaaggcgcggcgcgtgctgcctgtggtgtttgctgagtgacggccgccgcgcccccgcgtacctggaccgagtgcctggccgctggcggagtagtgtttccgtgcacggggctgctgcgtgcgcgtgtgccgttctctagcgggggattaggatggtgccgcagagaaggctgcgcggtggtgcctgactctgacgctggctgtagcgggtctctggggtctttgcggtttgtgtctgcgtttgtgacgtacctgacatcggatctgtgactgtggctctgcctcatccagcgttatttccagaat

SEQ ID NO: 37483 - DNA, 145 bp, Homo sapiens
  chr19:38182815-38182960
  hyper
caggtgacgatccctcgcgggcactcactctcgctcacactacaatcagatcctccatgcggctttcatatactctgtcacactcgcagccagaatcccctcggatggactcttgcaaacctccagccccatcccgggatccgtg

SEQ ID NO: 37484 - DNA, 148 bp, Homo sapiens
  chr19:38183111-38183259
  hyper
cgctcccacgtctccgggcgcagcttgtgccagcgactactaggtcagggggcgcagctgagagaattcaagcaacctccccgcaaccggttccgccgcgtttgtgggctggtagcccggaatacatttcccagaggccttcgcggcc

SEQ ID NO: 37485 - DNA, 2 bp, Homo sapiens
  chr19:38183260-38183262
  hyper
ac

SEQ ID NO: 37486 - DNA, 211 bp, Homo sapiens
  chr19:38183263-38183474
  hyper
tgcttcgcgcaggaacgcagccgcctcccgactggaggacgcggtagcggagctgctcaaagcgaggtgctcagccctgggaggctcagggctgcccgaggggcttagtcccagagccagtgctgtcaggggctgagcatgtgaatagggcagtcggaagaccatgtgtgtctgtggcttttaaatacaccccgaacgtctatctctttta

SEQ ID NO: 37487 - DNA, 141 bp, Homo sapiens
  chr19:38210017-38210158
  hyper
tttctctgttgtagtcgtactaggctgaggaaggcacaggaagcagcagggaacctggagccaagggtcaatagaccccacagagcccagcgaagcacgctttacaaaggacacacacggcatgtacaggtcacacaaggt

SEQ ID NO: 37488 - DNA, 180 bp, Homo sapiens
  chr19:38210571-38210751
  hyper
aatcctaaaaacctacgagaaatacggcagcgaccacttggaccgcgcctcccacccaccgctcgagccccggagacttctgggagtggccgccttgcctcgagtgcgcatgcgcagatcggccactactgggcccctggcctgaggcttagggtggagttagtgcgttcttagggccag

SEQ ID NO: 37489 - DNA, 90 bp, Homo sapiens
  chr19:38308247-38308337
  hyper
tggggctgctggaggcgttcagagcgcggaggccccaggcgcgggccgggctctctcccgcctcctcaggcccgggggtgctggagctgc

SEQ ID NO: 37490 - DNA, 145 bp, Homo sapiens
  chr19:38308394-38308539
  hyper
cgacagggccgggcgtgcctgtgtgacgtgggtgcagctgtgggactgtgaggggtgcgtggtcgaccttgcgtaacctggatgtgcagtgcgtgtcctttgcaaagcgtgcgttgctgtggctccgtggcgtcagcaacccttc

SEQ ID NO: 37491 - DNA, 30 bp, Homo sapiens; identical to SEQ ID NO: 13381
  chr19:38701199-38701229
  hyper

SEQ ID NO: 37492 - DNA, 500 bp, Homo sapiens; identical to SEQ ID NO: 13382
  chr19:38701550-38702050
  hyper

SEQ ID NO: 37493 - DNA, 92 bp, Homo sapiens
  chr19:38718791-38718883
  hyper
atacaccacctcacacggacccgagccccacacacccgctcccggcaccctgctcacggcgaagccacacgtgtaggcgcttgcctctaagt

SEQ ID NO: 37494 - DNA, 310 bp, Homo sapiens
  chr19:38746768-38747078
  hyper
ccgggctcaccatgccgcggtacagctcctccaggcgcccgtcgatccacttctccacgtccagccgccgctgcagctcccgccggtcatacttgacggtgacgcgcgcgtgccgcttctgcagccccccgggactgccccctggcccgcgggcccgcgatggagactgcagcttgctcagcacgcgcttgcccagccgctgagctgccatcgcgctgctggacccagcctggccccgcgctgtgcgccttcgcctcgcgccccgggtgcttcttacgggccagggcggggctagccgggggcgggggct

SEQ ID NO: 37495 - DNA, 95 bp, Homo sapiens; identical to SEQ ID NO: 13384
  chr19:38747106-38747201
  hyper

SEQ ID NO: 37496 - DNA, 206 bp, Homo sapiens
  chr19:38747202-38747408
  hyper
gggacccagagtcccgggcgggtccctgcatcgggggctcccgggccgggatcctgtggggcgggggcctgggacagacactcgggacccggcctgtctgcgccctctggcggtggcggggtggggggctgttggtgcgggagcgcctgcgccgctgtcgctgtagaaggtcgagcggtcacttgttccttcgttcattcattcac

SEQ ID NO: 37497 - DNA, 68 bp, Homo sapiens
  chr19:38853068-38853136
  hyper
agaaatggacagctacgaaaagatctacaacctcgagtccgcgtacgagctgccggagcgcattttcc

SEQ ID NO: 37498 - DNA, 339 bp, Homo sapiens
  chr19:38877688-38878027
  hyper
cgagggtgaggcctggggctcccggggtaccatgagtcccgggggtgtggcgctgccagggaaccagacacccagcccacgagtcaggcgcatggcctgggaggtcatctcgggctccaccagggacgtccggcgggagtcgggggcgcggtccgagggctgcacttttcgggagcccccgcccgcggatggctccgactgcaagttccccatttctgacggagctcggagactagtcagaaaaatttactccagtcagcctgccagggccgtggggaccctacgaggctggctgtacttgatctaatgcgtccgcaccggccccgcccctgttctcca

SEQ ID NO: 37499 - DNA, 35 bp, Homo sapiens
  chr19:38879840-38879875
  hyper
ggacaaaggaagcagcgtcacgtgactgctcattc

SEQ ID NO: 37500 - DNA, 170 bp, Homo sapiens
  chr19:38924266-38924436
  hyper
tggtccaatggggcccgggggcggggacttcctcccatctctgtccagcatgcgtgtactcctcgcagttccatctacctcgcgggtgcctctggtgtctccagaggtctccgaccccagcccgcccccagccctcccgcccagcccgcagccccctccctctgttcccc

SEQ ID NO: 37501 - DNA, 95 bp, Homo sapiens; identical to SEQ ID NO: 13388
  chr19:38924437-38924532
  hyper

SEQ ID NO: 37502 - DNA, 85 bp, Homo sapiens
  chr19:39282953-39283038
  hyper
caccctcggggcagacgcgatggcagcggccccggctctgcggaacagctgggaggactcgaaggacggcgtgggttttccctgg

SEQ ID NO: 37503 - DNA, 86 bp, Homo sapiens
  chr19:39283060-39283146
  hyper
cgccctccgctctccccgacggcccggaccccggtcctagccctggtcactgtgacgggaggggaagcggacgccaagtgcagccc

SEQ ID NO: 37504 - DNA, 362 bp, Homo sapiens
  chr19:39466200-39466562
  hyper
gtcccctacctgtcccggcgctcacctggcgggctgctcggaggcggcagcggcgggctaagcttccctttcccactttgttctgggaggcagtcgaggggctccccgtgatcggcgtggcccagggggccccgggaccggcggtctgggcggtcggtcctctcccggggcgtggcggctgcagcccggcgccgggggcggcgactctgagatccagcgggcgggggcgggaggccgcccctcctccggctgcggggcccagcgggagcgagggcgggcgggcgggggagcttggagggctgcgtgcagcgagggggaggcccagttgccgcgaggccagcggggagcggggccagccccgc

SEQ ID NO: 37505 - DNA, 92 bp, Homo sapiens
  chr19:39522783-39522875
  hyper
ttggctcaggtccagcgcctcttcgggttccggctccggcgcggggacccgggcggcccggcccctggagaccgaggcgcccatggtccccc

SEQ ID NO: 37506 - DNA, 118 bp, Homo sapiens
  chr19:39589701-39589819
  hyper
tgggggctgacaacccgaaggccgtcccccggctgcgcagggacacccagcagggcatgtatgacgccgttctccatgtgggtgaggcatccgcaggggcgcgcgcagggacggtggg

SEQ ID NO: 37507 - DNA, 56 bp, Homo sapiens
  chr19:39687591-39687647
  hyper
tgaaaccgggacagtcgcgcagcctcgagggatggaggaggtgcgtgagggacacg

SEQ ID NO: 37508 - DNA, 222 bp, Homo sapiens
  chr19:39687755-39687977
  hyper
cgtcgctgccatcgcccgcagccccggaggcccccgagctccccgagccggcgcagccgtccgaggctcacgcccggcagctgctgctggaggagtgggggccgctgagcgggggcctggagctgccccagcgcctcacctggaagctgctcctgttgcggcggccgctctaccgcaacctgctgcgctcgcccaaccccgaaggtgcgcaagggcccagag

SEQ ID NO: 37509 - DNA, 359 bp, Homo sapiens
  chr19:39754874-39755233
  hyper
gggcagaggccaaggcgaggagggggccggctcccgctctctctccctctgtgtgtgctgcgcctcccctgtgagcctaacccaaggcaggggactggacgcgtgggaccctctctttggcctccctgacgtccctcaggagcagagatgcgaccgagtgtgtgggccgcggtggccgcgggactgtgggtcgtgtgcacggtgggcgcggcgatccgccagcgctgcctgctctcgcactaccgctcgctggagccccggacgctggcggcggtcaaggcgctgaggaaccgctaagtgagtgaccgcccagcccttgcgccccccggtacactggccccgccgggttcccacacacc

SEQ ID NO: 37510 - DNA, 247 bp, Homo sapiens
  chr19:39755264-39755511
  hyper
cgcccagcaggcgcctcttgtacgtcagagcccacagttcccaccacgagatccccgcagtccccgtcgtcagcgcgaacgcaggctcagggtcagtcacaaaaggagccctgcagggcggactcggctccaggtcgcgggcgcagggctatgccgggggagagcgggatgcaattcaaccctggttcacgccttcggggagctccctggttcagtacacgacaggcacgaccgtacgctgccagta

SEQ ID NO: 37511 - DNA, 415 bp, Homo sapiens
  chr19:39989727-39990142
  hyper
ggggaggggtgagtgcgacctgaaggtcctggggaaggagcgtggggcggacgggaagcctgggtcctcccggccgcctcaccctgcgcccgtctccgtcccagacacggcccgctggcgtcttcgagctgcagatccactctttcgggccgggtccaggccctggggccccgcggtccccctgcagcgcccggctcccctgccgcctcttcttcagagtctgcctgaagcctgggctctcagaggaggccgccgagtccccgtgcgccctgggcgcggcgctgagtgcgcgcggaccggtctacaccgagcagcccggagcgcccgcgcctgatctcccactgcccgacggcctcttgcaggtgcccttccgggacgcctggcctgtaagtgctgcccccgggggactcccggt

SEQ ID NO: 37512 - DNA, 258 bp, Homo sapiens
  chr19:39993399-39993657
  hyper
gcatccatgttcggccgggcccaccccagcacccctcctttgcctgtcctcgcagggcccgcctggagcctgctggcgcgcgtggctggcaggcggcgcttggcagccggaggcccgtgggcccgggacattcagcgcgcaggcgcctgggagctgcgcttctcgtaccgcgcgcgctgcgagccgcctgccgtcgggaccgcgtgcacgcgcctctgccgtccgcgcagcgccccctcgcggtgcggtccgggactg

SEQ ID NO: 37513 - DNA, 45 bp, Homo sapiens
  chr19:39997688-39997733
  hyper
cctggacctgggccacgccctgcgctgccgctgccgcgccggctt

SEQ ID NO: 37514 - DNA, 335 bp, Homo sapiens
  chr19:39997748-39998083
  hyper
cgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcaccccgacggcgcaagcgccttgcccgcggccccgccgggcctcaggcccggggaccctcagcgctaccttttgcctccggctctgggactgc

SEQ ID NO: 37515 - DNA, 150 bp, Homo sapiens
  chr19:40005754-40005904
  hyper
ccgcgtctcagaacccggtgcgggagacgctctccccgcccaaagagggaaggcgggcgggactccccaaccggcttgccccggtccccctgggccccatgaataaccaggcgcggaccccagccccctcctcggcgcggacttcaacct

SEQ ID NO: 37516 - DNA, 251 bp, Homo sapiens
  chr19:40006197-40006448
  hyper
ctgactcctccagtccgggtcccagccccagccccagcccagctcctggcagggattcgggccgcgctccccgtcttggactcctacctggccccggccctacctttggatccgcccccggaacctgctccggagctgcctttgttgcccgaggaggaccctgagccggcgccgagcctgaagctcatcccgtcggtctccagcgaggccgggcccgccccggggccccttcccacgcgcaccccgctggc

SEQ ID NO: 37517 - DNA, 164 bp, Homo sapiens
  chr19:40006498-40006662
  hyper
cggccatcgggctggcggatccccccattcccagtcctgtcccctcgcccatcctggggaccatcccgtcggccatctccttacagaattgtacggaaaccttcccctcctccagcgagaacttcgcgctggacaagagggtcctgattcgagtgacctactgg

SEQ ID NO: 37518 - DNA, 204 bp, Homo sapiens
  chr19:40324814-40325018
  hyper
ccacgccctggactccgcccccatccctccctctccgctcccctcacgtgacccacactgacactccgcctgcgcgagatggccgcttacctgcacgcatgcgcagcgagctaccaatcccacccaagaaccgaaatccaggctgccgctgcgcaaaggcagctagaaacggagcatgcgctctgtgaccgagtgagaatttac

SEQ ID NO: 37519 - DNA, 489 bp, Homo sapiens
  chr19:40723945-40724434
  hyper
tggtgggcccgggggcgggggcgggcaggccgctagggcgggccccctgcgccgccttcagctgcagcagcgctcggtggtacttgccgatggcctcccggaacttcttctctcgatagcagcgctggccctctgccttgaacgccacggcggcacgcaggctgctgtcgagcgccgcgcccaggctccccgacggctctggggtaggaccgggacgagccgagccatggcgggagcccgagcctgggcccgagcccggtggggagagggcgggaggcgggcgcggcggaggctccggggcagcgctgagcatcagcaccggggacagcgcgccgcgctgcattgtgggaaactcctgccgccgccgctgcagctaccgcatcgccccccgcggggctggtccccaccctttctccgccccctcacctccggcagccgactccggctgccccctatgggtctagggaaacccctcgagacttcccccat

SEQ ID NO: 37520 - DNA, 121 bp, Homo sapiens
  chr19:41018532-41018653
  hyper
caggtcatctgcaaccgcgtgaaccacgtgcacggctgcctggcggagctgcaggagcaggcagcgcggcgacgcgcggagctggaggcttcgcggagcctgtgggcgctgctgcaggagc

SEQ ID NO: 37521 - DNA, 15 bp, Homo sapiens
  chr19:41019048-41019063
  hyper
ctgctggactggctt

SEQ ID NO: 37522 - DNA, 47 bp, Homo sapiens
  chr19:41019075-41019122
  hyper
cgcctggcagccgccggtgacttcggccacgacgaagcttccagccg

SEQ ID NO: 37523 - DNA, 522 bp, Homo sapiens
  chr19:41025379-41025901
  hyper
cgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggccc

SEQ ID NO: 37524 - DNA, 48 bp, Homo sapiens
  chr19:41055131-41055179
  hyper
tgggagagctgcaggcgcagacggcggcgctgccgctggagccggcga

SEQ ID NO: 37525 - DNA, 444 bp, Homo sapiens
  chr19:41059909-41060353
  hyper
tacatggtcttggcacgtggttagcgagctgggggtgcttgttaattgccccgtgggccgtgccagtagcagaggagcgtgtggtcttgcagggcctcggaacgccccctctccacccacatccccttacctcctgcccccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggtgcgcccgagctgggggtgcg

SEQ ID NO: 37526 - DNA, 303 bp, Homo sapiens
  chr19:41073555-41073858
  hyper
cctccatcctcagatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggc

SEQ ID NO: 37527 - DNA, 132 bp, Homo sapiens
  chr19:41074018-41074150
  hyper
cggaggcggcggccggagcggcaggagtcagcggagcacgaggcggcacacagccttaccctgggccgctatgagcagatggagcggcggcgcgagcggcgtgagcggcgcttggagcggcaggagtccagc

SEQ ID NO: 37528 - DNA, 43 bp, Homo sapiens
  chr19:41102899-41102942
  hyper
gaactcgaggtcccccgcgcccctagtccggcacctgtccctg

SEQ ID NO: 37529 - DNA, 13 bp, Homo sapiens
  chr19:41105989-41106002
  hyper
gctctactgaagc

SEQ ID NO: 37530 - DNA, 69 bp, Homo sapiens
  chr19:41106351-41106420
  hyper
gctggcccgttagaaagctccgccgaaccagcccagacaacaaaagcgattgtgcgggttggcgcctgc

SEQ ID NO: 37531 - DNA, 39 bp, Homo sapiens
  chr19:41119370-41119409
  hyper
cggctcctttgcctgtacttgtgcccctggctaccgacc

SEQ ID NO: 37532 - DNA, 21 bp, Homo sapiens
  chr19:41119669-41119690
  hyper
ggggggcggtgtttgcaggga

SEQ ID NO: 37533 - DNA, 59 bp, Homo sapiens; identical to SEQ ID NO: 13408
  chr19:41354396-41354455
  hyper

SEQ ID NO: 37534 - DNA, 232 bp, Homo sapiens
  chr19:41354575-41354807
  hyper
cgatgcctcgcttgcccaccccgaagtcccgcagggtggcgatggagaagcgccggagctgcttggcgcgctccccgttgctgaataccacgcctggggaggtgaacgcgggaatggagacaggccagggggcggcaggggcaggagcggagcagctccaaggggctccccaagggtggaggagagagggagtagggtgggagagagatggattcagcgccattgcccagca

SEQ ID NO: 37535 - DNA, 75 bp, Homo sapiens
  chr19:41596078-41596153
  hyper
cgacgccctccggggcacgcacggtgagtaggggaccccgagtgcgagggcgggaacccgcgctttctgcctggg

SEQ ID NO: 37536 - DNA, 185 bp, Homo sapiens
  chr19:41641726-41641911
  hyper
ggagcccagcaaaggcggggccaatgtgtggatagggcacttggaggtctggtaaggcagcaaaacgaacgaagccggccgcaggagtcggaggccccgaaagggatgtagccagtgacccggcgcttcctggatggggcgtggccggttcccgggcccgcctcctttcccgtccccaccacagg

SEQ ID NO: 37537 - DNA, 459 bp, Homo sapiens; identical to SEQ ID NO: 13412
  chr19:42028283-42028742
  hyper

SEQ ID NO: 37538 - DNA, 46 bp, Homo sapiens
  chr19:42419428-42419474
  hyper
ccgccgtgtctcacacgcgtctctgccatctcgcagtctctgtgcc

SEQ ID NO: 37539 - DNA, 60 bp, Homo sapiens
  chr19:42445049-42445109
  hyper
gcccgctcccggactcgcgccccccgcgcgtccactctgatttctcggcccatttttctt

SEQ ID NO: 37540 - DNA, 115 bp, Homo sapiens
  chr19:42574036-42574151
  hyper
gagagctgggagacccggagaggccaagaagggggcaaatgaggtggagagatagggaggagggagaggaggatggagaggagcaggtggaagagaaaggcggaggagggtgggg

SEQ ID NO: 37541 - DNA, 221 bp, Homo sapiens
  chr19:42636368-42636589
  hyper
agctgtgggggttagcggggacccggcatgggagagagggagttgctagagtacagaggagaaggacaatggagacagctgaggaggaggggcaggcagggcccgcagagcaaacctaaatgtgctgcctgtcctctgagcagtggcacaggcaccagcccccttacctggagcccccatgctggagtgaaccatgctgcccgccccgccagggctggggg

SEQ ID NO: 37542 - DNA, 116 bp, Homo sapiens
  chr19:42683705-42683821
  hyper
aggaggacgcaggcacgcgctgcgcggtcttggcttagcagctgcaaccgcccttcgctttgttaccagcaaggctaccccatgcatactgagtggacacgcgggaccctcatgtg

SEQ ID NO: 37543 - DNA, 42 bp, Homo sapiens
  chr19:42774775-42774817
  hyper
atatttgggggcctgcggggggctagccgactcagccaccct

SEQ ID NO: 37544 - DNA, 104 bp, Homo sapiens
  chr19:42827981-42828085
  hyper
cgcccctggagtacctgaccccgctcccggccccgccgccgcccccagcgcccggacccctgagccctcctcctgcctttcgcactccccgcgccccaacaccg

SEQ ID NO: 37545 - DNA, 184 bp, Homo sapiens
  chr19:42828316-42828500
  hyper
cgtgcgtccacacctggggtggaagggttctccgggggagggggacgggccttcggggccgcatctgccccccgagggtcccggacggcctctgaccctgacccccctcccaggccgggaagcaggtggaggagacagcggtggcggcggcggtggccccgaggggccgcgtggtgaccatggc

SEQ ID NO: 37546 - DNA, 114 bp, Homo sapiens
  chr19:42905723-42905837
  hyper
cgtccctgcggcggtcgccgcagcagcagcagcaaaaggcagcggtggcgtgcaggtccagccgtctcggtgaccggtgtgtgtgcgcgtccccctccccgtggcgagggtctc

SEQ ID NO: 37547 - DNA, 68 bp, Homo sapiens; identical to SEQ ID NO: 13416
  chr19:42906129-42906197
  hyper

SEQ ID NO: 37548 - DNA, 54 bp, Homo sapiens
  chr19:42927424-42927478
  hyper
tcatcccgttgtccccgcaagcggcaatgggccagtccgcggacccccccaact

SEQ ID NO: 37549 - DNA, 238 bp, Homo sapiens
  chr19:42928122-42928360
  hyper
agggggaaagtggggcgcctctgagcctctgcctggggtgggggcgggccaggtcctctgccaactcaaagacgaggcggggcgccagcgctggaggcgtggctgtgcctgagagccgttggaggagggagccccgctttccctctcctgtctcctagttctcctattgcgcttttcctgggggatctttctccctctgtctccgccccctaatccatgctcccgataatgagggtgg

SEQ ID NO: 37550 - DNA, 140 bp, Homo sapiens
  chr19:44203673-44203813
  hyper
cttgcaccctgtctccgtctcggcaggcggccggaacgtgaacgtacgcggctgcggctcccgagacctgtgcagcgccctggactggacccacgggctctctgtgctcccaagacactggctgtcgagccactgcagcc

SEQ ID NO: 37551 - DNA, 229 bp, Homo sapiens
  chr19:44302881-44303110
  hyper
gcccagcggaggccacgccttccccgaggctgccaggcctctcatcgtccctcccggagcccagccccgctctcccgcgcaccttggctcaggttggggagggcgtcatgagtcatgaggtgggcgttgcatttgtcagttgtgcagccgcgcaccaccgagtagtctggcggcagcgcgtccgcgttcgattgcgtctggcccgcaggaggcccggtccagcagccct

SEQ ID NO: 37552 - DNA, 61 bp, Homo sapiens
  chr19:44324840-44324901
  hyper
tgggaattgtagtcccgggccggaaacgcaggagacgccagaaacccaagtttgggacggc

SEQ ID NO: 37553 - DNA, 15 bp, Homo sapiens
  chr19:44324902-44324917
  hyper
cgtcccaagggtttc

SEQ ID NO: 37554 - DNA, 16 bp, Homo sapiens
  chr19:44405908-44405924
  hyper
tgatttctgtggagac

SEQ ID NO: 37555 - DNA, 162 bp, Homo sapiens
  chr19:44405925-44406087
  hyper
atctactcaccacgtaggggctacagcagctcggacaccggaaaaagatctagagctcgagggtgaccctagcgcggtgacttctgggaaatgtagtccacccggaataaccatgtccacggcgcccgccattctgtagcctatgctcggagggcacatgag

SEQ ID NO: 37556 - DNA, 46 bp, Homo sapiens
  chr19:44455621-44455667
  hyper
gcatcccgagggactcggtcctgtcacgtttcgccctatttggggg

SEQ ID NO: 37557 - DNA, 110 bp, Homo sapiens
  chr19:44488496-44488606
  hyper
tgaggtttggagatgcgaggggtgggagggaagtttcgttgccgtcgatggagccttctggcgttgggggctgtactcaggtccaccggaggagtcgtcgggggttcggg

SEQ ID NO: 37558 - DNA, 431 bp, Homo sapiens
  chr19:44711532-44711963
  hyper
gaagctcaggttactcggaagtatttccgctccaaggagcggaactatggccggtttcccctggggcattctgggaagtgtagtcaggggcccgcgtagcctggggcacttccgcttttggatggcggagctagggaattgtgggaagtgatccggggtttctctttagttgctgggaagttttttcgctctaggagggcgaaaacaagtgtttggatccgctgggaccctccaagttttctcagcctcgtcagggagcaagcggggccctggccctcgtctggaggaaggctagagaagctgtggccagctgggaggctggagttgggagcagtttgtgttctttcctctcggctgagcctcacgtttggagcagttcttgcgtccccgggttgggagcgtcctggatcggttgtcgcttggttagaggg

SEQ ID NO: 37559 - DNA, 195 bp, Homo sapiens
  chr19:44905416-44905611
  hyper
actgaccctaagcttcgacccgaagaggcacagcgcaagtcgctgtcacgaaacgtgaagatgcactgttttgtcaaacccagggctgctccccaaaccgagcccacgctcgagcccacgctcttcccatcctatcccgggtaggtcgggccgctgaacttccctagtctaccccacctacgaggccttatcatt

SEQ ID NO: 37560 - DNA, 336 bp, Homo sapiens
  chr19:44952282-44952618
  hyper
ccacaagtgggtgggcggctaccctgagaaaattcatgtcatcgatccgcaactgacacagtggagtctcccgcactgcagatctcatctcaaagccagagctggcctcaaactgcttttccaagcctggactgcgagggctgccgacccgggcccaccccgcacaggcgctcagaatgttcgatacgtgcgcctccttacacccctgcctcaccaggccgagctcatggaaatccgtgggcttcgaccctccgccgcacgttgtcccttcacactggtcctatagagccgatcctaattcccatggcctgacagtacaaccgcatggagatgcac

SEQ ID NO: 37561 - DNA, 46 bp, Homo sapiens
  chr19:44952619-44952665
  hyper
tctctaagacgcctcaccactgcctaagaagcaatcaaggtgacgc

SEQ ID NO: 37562 - DNA, 85 bp, Homo sapiens
  chr19:44952666-44952751
  hyper
cccaccggaaacggaagtagtcgactcgaggtgtgggactacctttcccagaaccctccgcagcgcagtccgatcctaggggcga

SEQ ID NO: 37563 - DNA, 80 bp, Homo sapiens
  chr19:45300099-45300179
  hyper
acagctcaggaagtccgggaacattattcgaccacagcaaacaagagagccagcaggaagcggggcggtgggggggaggg

SEQ ID NO: 37564 - DNA, 158 bp, Homo sapiens
  chr19:45655399-45655557
  hyper
cggcttgagcgcgctgacggctcggatgagacccatgcgccggcggatggagtggtccaggttgaccgtgcagcgcagcaggctctgcgcctcggccacggtgaaggggaagtcggcgcccaggaagcgctcgaagagctcggggtcgccgtccaggt

SEQ ID NO: 37565 - DNA, 747 bp, Homo sapiens
  chr19:45655647-45656394
  hyper
cgcccccggtctgctgccggtcctccaggcactgcagcgcccagctcaggcggcacggccactggttggcgagcaccacccacgccaccgcctggcgcggcgtggggcccccaaagtccccctgctgctgctgctgctgcagcaggcgcacggtgatgggcacggtgttgacgatgcgccgcatggacaccacgttgtcgggcacgtactcgtagaggcagtcgcgctcgtcgtgaaggcagaagagcgcctcctggattcgccgcgccgcctcgtcgtcgatgcggccctgcccgcgctccgtccccgcctgcgcctgcaccgccagcagctgcgcgctctcgcccccggcgtcccccggcagccacggcttgcgcgtcatctcgcggtacaacaggtcgtcgcggctctgcaccgcatcgtgcaggaactgcagcttggtgcggcggcccataatgggcacagagaagggcagcgtgacagtgcggttgaggaagaggtagccgttatcggccgtgcccttcatgttgcccgcgctctctaggcacgcggccaggatgctggggtccacgaccaggatgaagatgaagggcgcgtggctgtcggacagcagcgtgttgatggcgttgagcacgcccaccacgcgctccgggtagcacgtgtccagcccggtgacctccagcaccacgcgcagcctgcgccgctggtagatctccaggaagcacaggaagtcggtgagcagctcca

SEQ ID NO: 37566 - DNA, 82 bp, Homo sapiens
  chr19:45656661-45656743
  hyper
gcagccccaggcacacgcggcgccgacaatgccactcgctctggcagcagtcctgcctggtggccggcttgttgcccagcac

SEQ ID NO: 37567 - DNA, 171 bp, Homo sapiens
  chr19:45656790-45656961
  hyper
cgcacaacgtggtcaccaggccggcccacagcttgtcggtgcccgcgtactgccaggcgctaaagcggatgaaaaggaactgcacgttcctgcgccgcaggtgcacctcggtgatgatgggctgcaggaacaccaggtaccacagtagctgcgggacgccccagccgctca

SEQ ID NO: 37568 - DNA, 164 bp, Homo sapiens
  chr19:45657177-45657341
  hyper
taaagagctggaagccggtgcagaagcgggggcgtggagaggcctggagccgggcttggaccggaagcggtctgaaggccaggctgtggggtcgggatgggcagaggtagagccggcagaggagagatgggaggaggcaaaaagagatacgaggaagagccagg

SEQ ID NO: 37569 - DNA, 30 bp, Homo sapiens; identical to SEQ ID NO: 13431
  chr19:45755404-45755434
  hyper

SEQ ID NO: 37570 - DNA, 472 bp, Homo sapiens
  chr19:45826794-45827266
  hyper
taaccctcgccccctcggtgccactgggagatttccgctgtgcgggggacagggagggtctcggtcgccgggaaaggagttatttttagagggcgctttgctgtctcctctgccgcaaaggccgagacccgaggcgctgggtatgggggggttcgggggcaggtgttggaggggggttcgccacgtgtcctggttaattataaccgggcgtctcgggtgtcctcgggcctcgcctccttacaagggcagccacggggccctgggtggccgctcccacctcccggggaagggggctgggcagcgacgccgttcagagcgcgggcgccagactcgcgcagatctgggcagagcaagcgctctcggcgcctcggctgtgagcaaggacttccagggctgagaggggggttctgtggaggagagtacagtatagaggaagccgctttctcctcctgggacgcgccaggattgcagg

SEQ ID NO: 37571 - DNA, 388 bp, Homo sapiens
  chr19:45888837-45889225
  hyper
agtcagcataaccctcgcggtaagggtcgcacttctcgaaggcggtggcgccgtcgctgagcgtggtggcgaagattgcagcgccgtgctgcaccagcgccatgcagatgactgtgtcgttgcacgacgccgcgcagtgcaagggtgtcctaggcgtgggggtggggggttgcggggaacgatgcgtgagaggctgcgcgtccgcccacgggggacccagcccaccgcgcgggtcggggctcaccagccgtggctgtcgggggagttgacattggcacccgcggtgatgaggaaatccacgatagagtagttggcgccgcagatggcgttgtgcaaggcagtgatgccctcctcgttgggctggctcgggtcgttcatctgagtgcac

SEQ ID NO: 37572 - DNA, 91 bp, Homo sapiens
  chr19:45889315-45889406
  hyper
cgcctgctgcaccacctccagctccccggtcagcgccgcgtccaggaggagcaccagagggttgaggcgcgcgcggcgggccttgcgcggg

SEQ ID NO: 37573 - DNA, 58 bp, Homo sapiens
  chr19:45931217-45931275
  hyper
aacgttagttaagagcgaggggaaaaaattgccctgggttctacgttatttccaagtt

SEQ ID NO: 37574 - DNA, 634 bp, Homo sapiens
  chr19:46001719-46002353
  hyper
agggctgaaggatggcggtcctggcccgccagctgcagcgtctcctctggaccgcttgcaagaaaaaggagagggagaaggaggggagggaggaagaggaggaggaggaggcggggcgcagggcccccgaagggcctcggtctctgttgacagcgccgcgccgcgcccagcggccgcacgggggtgccgaggcgtctgggggcctgcgcttcggggcgagcgcagcgcaaggctggcgcgcgcgcatggaggatgctcactgcacttggctttcgttacctggtctgcccccgggctgggccttgtttgccgtcctcgacggccacggtggggctcgagctgcccgcttcggtgcacgccatttgccaggccatgtgctccaggagctgggcccggagcctagcgagcccgagggcgtgcgcgaggcgctgcgccgagccttcttgagcgccgacgagcgcctgcgctccctctggccccgcgtggaaacgggcggctgcacggccgtggtgttgctggtctccccgcggtttctgtacctggcgcactgcggtgactcccgcgcggtgctgagccgcgctggcgccgtggccttcagcacagaggaccaccggccccttcgaccccgggaacg

SEQ ID NO: 37575 - DNA, 91 bp, Homo sapiens
  chr19:46105207-46105298
  hyper
gagcaacagagggggcgggcaccgagacggcgcgggagactgaggcagcccccgagggggcggggaggagcggtctcgccacgagcagggc

SEQ ID NO: 37576 - DNA, 34 bp, Homo sapiens
  chr19:46148823-46148857
  hyper
ggccaggattggctgcgcccggatccccctaggt

SEQ ID NO: 37577 - DNA, 65 bp, Homo sapiens
  chr19:46173896-46173961
  hyper
gctctaaggggcagacggcgggggagctgtaccagcgctgggaacggtaccgcagggagtgccag

SEQ ID NO: 37578 - DNA, 113 bp, Homo sapiens
  chr19:46180359-46180472
  hyper
ggctggggtgagctccgatcccgtcccccgcccaacccagcgcgcctctcctcggctcccccaactgccctgctggttggcctctgcgggtctcctcccgtctctaggcttct

SEQ ID NO: 37579 - DNA, 21 bp, Homo sapiens
  chr19:46283058-46283079
  hyper
tcaccttcagaatctcgaagt

SEQ ID NO: 37580 - DNA, 484 bp, Homo sapiens
  chr19:46379893-46380377
  hyper
cgccttgccggctgcgtgtcacccccgccccctgccgcgctggctccccgtccgtcccaccagccttgctgtcctgggcaggccggggaattcctcccggttcctggaaaaaacaactggggccgagagaaaggccctcagtctccccaggcacccgcccccctccctcgggcctgggggtctctcccggagtcggccagcccgaggcaggaagccctgcggtttctggcttctcccaggcggcctccggatctggcccccgccccccggccaacagcccaaatattattccgcgggaggagtcggtggtggcgggaggaggcccaggctgaaagaggctttcagggcggccaggcctggggcttcctgtccccaggctcgggcctcaggccgccccagtggggacctcaggtggccggaggggcggggtgttgttgtagggtcctcgggggagggtggggccatccgtcggggtgtctggtgg

SEQ ID NO: 37581 - DNA, 117 bp, Homo sapiens
  chr19:46476943-46477060
  hyper
acagagcctggagagcggccgtgagcaggatggcagggccgaggggggtctccgatagggccgggaaagaactgagaggtggggtctctcctgggaccacagaggctggggactgga

SEQ ID NO: 37582 - DNA, 354 bp, Homo sapiens
  chr19:46477118-46477472
  hyper
cgagccccccagaccctgctcggggtggggggccggaggagcgtggccggagtgggaggcggaggcggccgctagtgggggcccggggggcggcgggcgcgggcggcggcggcgacggggctggcggtggctgctggcccgagcatcttcttcccggaggctcccacagcgcctggcccctcccacccaacgaggtcacgcccatgccgggtagggccacgcccttcggcgcccccattggtccagccttgaagcctggaccacgtccctctgggttggccacgcccctcccggcggcagagagctggacccgactcccccaggctgctgggaggaccccgggctcctccaagc

SEQ ID NO: 37583 - DNA, 259 bp, Homo sapiens
  chr19:46519255-46519514
  hyper
cgcgattgagtttgtcggggcgggcgggaagctgacagctgcctctgtggtctcaggaggcggactccgccggtgcagccgcccccgacgcgggaggaccgggcctcatcgtcccgggagcgctccgcgtcgcgaggccgcggcgccgcgcgctcctcatcccgggagagcggccgcgggagccggggtcggggccgccctgcgcgcccctcgccctcgcccacaggtctgtgcccctgccctgcggtagggaggggac

SEQ ID NO: 37584 - DNA, 30 bp, Homo sapiens
  chr19:46907252-46907282
  hyper
gcatcccccagatggcgtccccttcctctg

SEQ ID NO: 37585 - DNA, 215 bp, Homo sapiens
  chr19:46907501-46907716
  hyper
ggctgaccccagatgcgcctagttgggaatgtgctggaaagatacgccccctggagggagtgcgcccaggaagtggggaggagcgtttgagatcgaaggagtggccgcgtaaaggccctgaggtctcgcaaggaagggtcccggggcgtcccaggccctgttctaggtgcaagaaacaggaacctcctggagcgagcatgcggtggggaggcagg

SEQ ID NO: 37586 - DNA, 30 bp, Homo sapiens
  chr19:46908092-46908122
  hyper
cgggttggatttccacgtgcctggagttta

SEQ ID NO: 37587 - DNA, 416 bp, Homo sapiens
  chr19:46916572-46916988
  hyper
agctccaagttggggcgcgcgggctgccagcgactcttcctgccccaggccccagggacgcggctggaacttgggacaggacttcgcagacaaagacggtccagtcgaagctattcaatatggccgaggcgctgggaggccccagcccgggcctccagtagggtcccccgcccccaggcaggccgccacccagctccaggctgaccttgacgcgccgcagcctgccagcccgcgcgcttagagctctgcaccgtggagcgcgcgggcaggaagttcctcctcgccctccgccagaatgaggcccaccttcccccgtctcatcttacactcccagactctggaagactgacaggggggctgtccactcccttcggggcggcctccttcccctcccccacaggggtgtggccgcgccc

SEQ ID NO: 37588 - DNA, 15 bp, Homo sapiens
  chr19:46917060-46917075
  hyper
cggttcccaaacctg

SEQ ID NO: 37589 - DNA, 140 bp, Homo sapiens
  chr19:46930026-46930166
  hyper
attttctgcaaagggcgcaggcgcctggggtcagcctgtggtctccatagcaacggtcggacgcgctgctaggttctggctctgactgcgcctgcgcggctggtcccgcggggtctcccgagtagcggaagatatttgtg

SEQ ID NO: 37590 - DNA, 275 bp, Homo sapiens
  chr19:46932061-46932336
  hyper
agagtgtcgtaggcgcggccctggcaggcagggaggcgcgtccctcaccgctggcccagaggttgcactcagtgccctgtcgccggactaggacgaggatgtggccgctgcacttgctcccgcggtgacgtcaccgcctccttccgctctgcggcctggcggtctccatggcaaccgctgaagcatccatctcctctgccattggccgactggccgcattgaaatcaagagtctgagggggtcattcggaggtgaggggtcggccaccagccctc

SEQ ID NO: 37591 - DNA, 67 bp, Homo sapiens
  chr19:46974500-46974567
  hyper
gccccggtgctcacacgtgtccctgaatctgcagcaaaaggccctaggaccctcccccgggcctgac

SEQ ID NO: 37592 - DNA, 41 bp, Homo sapiens; identical to SEQ ID NO: 13444
  chr19:46974568-46974609
  hyper

SEQ ID NO: 37593 - DNA, 291 bp, Homo sapiens
  chr19:46992718-46993009
  hyper
ccccagcctccccaccgcatgctccctgcgggagggtcctgtttcctgcaccaagaacagggcctgggacgcgccagccctggataaatctcatggactgcgcggatggcgctgagggctcctcccagacagtcgccttctctcccaggagggggcaaccgcgctccgctccacccgtcgccagaggctccacgcgcgggacagacccggctgctgcagcctgtgctggtctctgtgcaccgggacccttccctgcaggatctcaaggcctttacgcggctgctccttcga

SEQ ID NO: 37594 - DNA, 15 bp, Homo sapiens
  chr19:46993246-46993261
  hyper
gagctggccctaagc

SEQ ID NO: 37595 - DNA, 107 bp, Homo sapiens; identical to SEQ ID NO: 13446
  chr19:46993281-46993388
  hyper

SEQ ID NO: 37596 - DNA, 77 bp, Homo sapiens
  chr19:46996589-46996666
  hyper
tttcctcctcccatccgggcttcctccgtcgggatcgctggcgcccccggcctgcgagggcccgagaggggaacgtg

SEQ ID NO: 37597 - DNA, 45 bp, Homo sapiens
  chr19:47143100-47143145
  hyper
acagacactgcctgccgtgagcgcagcctccgttcctctcctgag

SEQ ID NO: 37598 - DNA, 14 bp, Homo sapiens
  chr19:47152977-47152991
  hyper
cgtcagaaagggcc

SEQ ID NO: 37599 - DNA, 170 bp, Homo sapiens
  chr19:47523113-47523283
  hyper
ctgggcgccacagcccgcgcgtcccgctgcgccccgcgcgccccggggtctatggagctgcccctccgcgccgcccggccggccccacgccgcgcccggagcctgctctgcggccaagtaatcggactggcggtcctgcgggtaggggaagcttgcgggctggcaggagg

SEQ ID NO: 37600 - DNA, 162 bp, Homo sapiens
  chr19:47523562-47523724
  hyper
aggacacctgggccccgagtgtcgggtcaatcctgggggcgtcctggggcagaggctgcggcggctgcgtccggggctggggctcgcgcgccggggtcttcagggaggaagttgtggtcgtggggatgtggcggtccgaacacgtggcgccatcccgagagg

SEQ ID NO: 37601 - DNA, 162 bp, Homo sapiens
  chr19:47524772-47524934
  hyper
ccgttcccaaggccccgggaggcggggctcgcccccagttcccaagcccctgagccccggggccccgccgacacctcctccgcgccgcccgcccagcctgcaggcgcagcgcaaggagaagtcccggaacgcggcgcgctcgcggcgcgggaaggagaacct

SEQ ID NO: 37602 - DNA, 202 bp, Homo sapiens
  chr19:47742701-47742903
  hyper
cgcagggcctgagtcctggctttccgcggtggggaaggggtctcccgggtcccctcggtgtggccggccctgcaggccgggaggctggaccggggccgggtgggggctgggcgggggcgcgggcgtccgcagggtccgagcggccggcgcgcgtgtgaaggttaccgcttcccggcggggcgggggccgcgcgctgttgctg

SEQ ID NO: 37603 - DNA, 30 bp, Homo sapiens
  chr19:47746438-47746468
  hyper
agctcccgaatcctgcggtaacttggtaac

SEQ ID NO: 37604 - DNA, 7 bp, Homo sapiens
  chr19:47910558-47910565
  hyper
gcccggg

SEQ ID NO: 37605 - DNA, 57 bp, Homo sapiens
  chr19:47921726-47921783
  hyper
cctgtcttctatccccgttcccatccccagggagacaggctccgtggggccagcagc

SEQ ID NO: 37606 - DNA, 39 bp, Homo sapiens
  chr19:47925553-47925592
  hyper
ctttctatctctcctcgccctctccgtcttttttgttgg

SEQ ID NO: 37607 - DNA, 573 bp, Homo sapiens
  chr19:47933200-47933773
  hyper
agccaggggagggggcggagaagggaggccgagtcccaggagaggaggccgagtctggggggaaaaggagaccagggtccaagagcaggtgcagccgagtccctagccccgggcgggcggtggggacgagtctctgcgcgaggccctagaagccccggatgtggcagtacgcctccaggctggcgaagaggatgtacaggagccagaggcccaggaagagcgcggtggtggcgagcttgggtccgcgcgggccgcccagctcgccgccgatgtgcggccggcgccggtacagcagcacggcaatgcccacgaaggcgaagacggtgaagagcgtgacggagaaggccagcgtgccagtgcgcacctcgaaggggcggccctgcaccgcccagtacacggcggccacagaccaggcgacgcccaggccaaggaacacgttcaccgcgttggagccggtcacgttgccgatggacgcgtcggcgcactggtcctgcagcgccgccaccttgctggcgaacgtgtctgcgaggcagagacatacaggtcggaggggctttgcgccgccacccacag

SEQ ID NO: 37608 - DNA, 143 bp, Homo sapiens
  chr19:47960799-47960942
  hyper
cgaataccacgcacaccgggaagaagaccagggtcagcagcgcctcccacacctgcgggcggcgggcgtcagggcgaggccgggcgggccgccttctccctccccgcctctctgtctcagtctctgtccgcctctgccactcc

SEQ ID NO: 37609 - DNA, 207 bp, Homo sapiens
  chr19:48076465-48076672
  hyper
cacgcgcggcgcaggcgcgcgtacgtgaccgcgggccgcctcacgcctcccagagcggcctcgcgcgtgcctcctggccgcgcgctctcggctgcttctccgaggggcggggcttgccgcgggcgggaaaggaggcggttggtcgccattttgggagggggcggttgagggcggagagtgagaagagtgagccggggaggagcggcg

SEQ ID NO: 37610 - DNA, 49 bp, Homo sapiens
  chr19:48774925-48774974
  hyper
acgaatctctgtagtcggtccttcctggcggcctcgttaggttgattta

SEQ ID NO: 37611 - DNA, 41 bp, Homo sapiens
  chr19:48775188-48775229
  hyper
ggaaaggggaaggcacgaatgacccacgtgttcagaccccg

SEQ ID NO: 37612 - DNA, 32 bp, Homo sapiens
  chr19:48867764-48867796
  hyper
ccttaaaggggagaccgcgattctaagaaggt

SEQ ID NO: 37613 - DNA, 231 bp, Homo sapiens
  chr19:48901882-48902113
  hyper
cagcccgggcctagacgtgcggcccgtggcgctggtgctcaacggctcggacccgcgcagcctcgtgctgcagctctgcgacctgctgtcggggttgcgcgtgcacggcgtggtcttcgaagacgactcgcgcgcgcccgccgtcgcgcccatcctcgacttcctgtcggcgcagacctcgctgcccatcgtggccgtgcacggcggcgccgcgctcgtgctcacgcccaa

SEQ ID NO: 37614 - DNA, 205 bp, Homo sapiens
  chr19:48918159-48918364
  hyper
caagggtttctgcatcgacattctgaagcggctggcgcataccatcggcttcagctacgacctctacctggtcaccaatggcaagcacggaaagaagatcgatggcgtctggaacggcatgatcggggaggtgagggggcggacgggaggcggggaatcttcggggcggagtcgagaggcgggcacagccgggcgtggtggctca

SEQ ID NO: 37615 - DNA, 85 bp, Homo sapiens
  chr19:48918604-48918689
  hyper
gcacagagtgagactcagtctcaaaaaataataataaaaaaaaagaggtcggcaccctggggcaggggcgcggccaaattgagga

SEQ ID NO: 37616 - DNA, 14 bp, Homo sapiens
  chr19:48947361-48947375
  hyper
ggagaggatttggt

SEQ ID NO: 37617 - DNA, 42 bp, Homo sapiens
  chr19:48994825-48994867
  hyper
ggggacaaaccttcacgtcccatttaccgcatcccccaaaag

SEQ ID NO: 37618 - DNA, 406 bp, Homo sapiens
  chr19:49127373-49127779
  hyper
ccttaacaaagatggcgacaacggcgctgtctatggggccgcgacgtcgtctccgctgcgcgtcggccctcacccacgatggcggccagtctcccgaagcgcgaggccccgcccagctctcggcctctcccgcggccggtccctgcaccaagctcgcgagctgactggctccaccccccgcgccctcgtattggtgcggcccaggccggctgcacggccattggctgagcggatgcacaccctccccccacccctaggtctgatgggggctgttggtgctgacttgcgggaccgcctggaggaggacccggcgtgtgaggagggtgcgggggtcggggcagggaccggagtctaggggactgagggaccaagaggaacagagactcaggcccgggactggggcacc

SEQ ID NO: 37619 - DNA, 184 bp, Homo sapiens
  chr19:49242534-49242718
  hyper
gcgccgtggccagcacgctcttgtagttggcgcccgatgccagtccggcgccgaagatcttgaggacccccggaggcgccgtggcgcgggtagccagcgggggctcgggggccacgcccgccgccagctccggcagcttcttctcgctggcccagcgctgcgcgccccccggggtcccagggcc

SEQ ID NO: 37620 - DNA, 131 bp, Homo sapiens
  chr19:49399218-49399349
  hyper
caagcacagccctgccgctggattgttgcgggctccgcacgtaaagaatctcgcgccaggctctcgtaatgagaccgcgccccgccccggacccctagaccccgtctccgcaatcccgggtttggggtggg

SEQ ID NO: 37621 - DNA, 105 bp, Homo sapiens
  chr19:49560299-49560404
  hyper
gccagcccaggggctcggcgtgcaccggccatggcgggggctgtgcaggaggcggtgccgagcgagagcccggcttacttgggatagaaccgaaagtcccgcgcc

SEQ ID NO: 37622 - DNA, 30 bp, Homo sapiens
  chr19:49649675-49649705
  hyper
ggaccatttcatcatcgtgggttgtggggg

SEQ ID NO: 37623 - DNA, 30 bp, Homo sapiens
  chr19:49652144-49652174
  hyper
gtggggggcgtggcccgaagagaccaaatg

SEQ ID NO: 37624 - DNA, 109 bp, Homo sapiens
  chr19:49924453-49924562
  hyper
cgcagcagacgcggccggctccactctcttctttaaaccaatgagagcgcggtccgcacgaacggcgccccaggcgcgctgatctagccctctgcggaccaccgggttg

SEQ ID NO: 37625 - DNA, 445 bp, Homo sapiens
  chr19:49925697-49926142
  hyper
ttattaagatggggacgggcagcgcgctcagggcgcatccaacaccagcagcttgtgcatgtacgagttcagccagtggcggcgctcgagggcggccagcaaccgcgcgcgctcccggaaggccgcgtcgtccgccagcgccaggctcctccgcggcctgggggtggcgggatccgcccaggcccgtcctggggggcggaggctgtggagagacgcggtgaccgcgcgtccagactcgctcttgccgccgcctgtcctccccgcggtctaactcgaagccccgttactgcccagtccgtggagtggctcggtccggctccccctgtctctctcgttctctgtgtgggtctctgtctctctgctcaccaggttcgaaactccccaggtactgagaccgagtctgatgcacttgtccgcccacagcgctcagcgcatggccaggcgc

SEQ ID NO: 37626 - DNA, 34 bp, Homo sapiens
  chr19:49926495-49926529
  hyper
actcccgaggcagtgcggacgccccagggcacca

SEQ ID NO: 37627 - DNA, 134 bp, Homo sapiens
  chr19:49932009-49932143
  hyper
cgcgggggtcgcccgcagcgtctggaggccctgtcccccgccacgctccccaacaacttcgtgtgagccccaccgagttctgccggacctgcacatccccacagtgaaggaaaaccctgcgcttctggtatgct

SEQ ID NO: 37628 - DNA, 633 bp, Homo sapiens
  chr19:49935736-49936369
  hyper
aggctgtcctagagccggcccaggccccgccccactcacctccgcagttcatcaacttgcgcacgttggtggtggacatgatgcggcggctccgcaggaagtccgcgatctggccgccgatgggcacgatgatggtcatgaccaggtggggcagcgcggacaccaggcctacctgcgggaacaggtgtacagggacactagggttcggggccgccggctcggcgtctctgcccggtccgtgcaccaccggctcctccctgcctcgggatcgccgccagttccctcccgccgacccctccgcgcccccctgccctctcctcctgggctctaccttgctgatctcgaagccgaacacttcttcgaagtaggcgggctgggagatgagcagcaggtagaacgtccagctgcggcagaagttggccacgatgatggcatagactggcatagacgtgaagaagcgccgccagggagtgctaaacttctgtgggggcgaggggagggccgctaagacggggagcggggctgagggcttctccgcgtcccttcagggaccacagtgtagttctgcagaaaccaaaggatcccgaccgcactgaaacttctatggacccaaaggcgcgggctacaccatgt

SEQ ID NO: 37629 - DNA, 345 bp, Homo sapiens
  chr19:49936853-49937198
  hyper
tagcccctctctttgcgttccagtcccgtctcctctagagtctgcaggaaccgtccctgatctacacgctgtgcaggttcgtggcttgctatctctccccgccccttccccgaagatttggtcccggaccgtgagggggttcatgagtttcgcgctctctccgatggcgtcctcgatgtacttgcgctcctcctccgagatgctggggtgcagcgcgggggactcgtaggagacgagcagccagaacaggtaccagaagatcccgaagctgcctgggggggtcaggagggggatgggagcgaggtgaggaccggccccgctccgccccagcgccacccggaacca

SEQ ID NO: 37630 - DNA, 770 bp, Homo sapiens
  chr19:50194104-50194874
  hyper
acctggggtgggctgcgacctcccagctgagccttgttcctcgaagagacaggagactaagagacaatgagctgagtgaggagcccaggaacccgggttccgaacagctgcgtagaatgcgagcggccaaatggtggagaatctggccgggtaaaaggagacggaggactggggatcgaacggatgtaggggattggacgccgtggctcgaagggggcggggatagaacgcggggattggaaggaggcggggataaaacccgggacctgaatacccggctagggacacgagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtggtaagtactggaccccaggggctcgggctccggcggggcctggagtcctgtgtctagggttgggcgtgcaagcctctccatcacttgtcctcgacgctcgcctccgctcacagcctcagcatcccaggctgcgaggcatgcgcagtgggtgcttccttccccattccctccagcacgggcggggggaggggacgctgagcggatgaatttatagacaccatccccctcgccttggcatgaaaagcggcaatggggtggacagcgtcaatgtctaaca

SEQ ID NO: 37631 - DNA, 506 bp, Homo sapiens
  chr19:50316207-50316713
  hyper
acaccgaacccccttcggtttagatacaggcgtccaaggccccacctgctgacgggcgggggcgccgccgcgactgctcctgcagaatagggggaccccgctggaggccgcgaggcacagcagatgcacagtgccgcccgtcccctcctcccccatttaggactcccaccgcggtccctcacgtggggactgtcagtgcgggtcttggagcatggcggtaatcagagtaactcggcctgtggtccggagccgccagagggcgagatggggagctgattggaagaggattaacttcccgccttcttcacccaactcaaacagaccctcaaaccctattcaggcacctcccccaaacccattaggttctcttccgccctagccggaagtcacggtacccctaacaaagatggcggcaaattgaatttgcaaagctttctagtttctccgaggaggtaaagagaaccaagaagccggattgaagatgatgactgcgccaaggcgttgcc

SEQ ID NO: 37632 - DNA, 15 bp, Homo sapiens
  chr19:50393562-50393577
  hyper
gaacaccttggtggc

SEQ ID NO: 37633 - DNA, 40 bp, Homo sapiens
  chr19:50393971-50394011
  hyper
gtcatccacctctcccgaccccgcccgtccctgacatccc

SEQ ID NO: 37634 - DNA, 391 bp, Homo sapiens
  chr19:50553997-50554388
  hyper
tgggggcttggacctcggatcggcctcccacgcgaagcttgctccccaccagcatccccacgttggtggcgacgctgccccggccccacggatacttccgcgcctgtcagactccctgatgaactacccttcccagagtaccgcgggagctcgggctcctgagggcgacggtcctctgatggcagatgcgggagaaactctggcgtcaggcggccctcgcgtggagcacacgaagtcgtggcttattctggcttcagtatgtggggtggagaaggcgatccacgcagctgcgtctatttcctgtggatcaatcgcaaaatacgttctgtaagccccgcccccactgcgtgcgggcggcttttgtctccacggcaaccgtcaactctggaaa

SEQ ID NO: 37635 - DNA, 30 bp, Homo sapiens
  chr19:50651036-50651066
  hyper
gtgcagtgctgctttcgggttctggggtca

SEQ ID NO: 37636 - DNA, 30 bp, Homo sapiens
  chr19:50651328-50651358
  hyper
gacccaacttgggcccgcccccggagcttc

SEQ ID NO: 37637 - DNA, 30 bp, Homo sapiens
  chr19:50706864-50706894
  hyper
ctgtcctggcggacacgcccctctttctcc

SEQ ID NO: 37638 - DNA, 30 bp, Homo sapiens
  chr19:50815293-50815323
  hyper
agcttctgcattgggcggttcatgcaccca

SEQ ID NO: 37639 - DNA, 271 bp, Homo sapiens
  chr19:50815780-50816051
  hyper
agagtccctttagctcgctctctccctccccgaatcccacactattgacttgggggatggggtgggaggggaggagaatcacgttttgtagaagtttatcatgattgtggttattttgaaaagctgaactcaaaagctgggtacgtgtggcggactggcgagcagggggagacgttgggaagaggtcagtaccctttggaaaagaccctcaccccctttccccgcctccttcggctttcgtgaaggtcaggggaaacgggggggcttgtta

SEQ ID NO: 37640 - DNA, 53 bp, Homo sapiens; identical to SEQ ID NO: 13470
  chr19:50816431-50816484
  hyper

SEQ ID NO: 37641 - DNA, 734 bp, Homo sapiens
  chr19:50818424-50819158
  hyper
agagacacaaaaggacggatgacaagagacagatggacagagatggaccaaggagatggagagagaaagtgaacaaatcggggagtcagtcaacatcgatgagaaagggggagacatcggggaggggggagagactccggattaggaggcaggttggtgcccaccgagcctcccccgccccattcccaccacagtccaccgcccttccccccctccactggtcccctcacctgaggcaaaaggtggggggcagcaaggcgggatggtgggcggcaggggcgtggggaggggctgggtggaatgcatgtgggagcagccagcggagagggcagggaacggtgcggccgccgtagcggggctgggggctgacctagttgtagggaaagagagcaggcagggggtggggtctgcaagggggctgagtggagcgaagctggcagtgcccttggggaatccgatgagaactccaggagcagtgggggggggtggggggggagggaggctcctccagaagattctaaggacggggtcgggggtggggggcggtgaggcggagggctggggagagggacatctttaaagggtccaagaaggctctgagcttctgacgggtgcgggaaggctctcacaggcatctcacagctaatgggactcaagatccagcaacagtgtgtgtggtttctgcaaagcctggggctgcctgcagggttctgcacccccgcagggagctctgt

SEQ ID NO: 37642 - DNA, 84 bp, Homo sapiens
  chr19:50829625-50829709
  hyper
gggccatgtcccttccgcacctcctcttccccacctccccccatccaaccccaaatctcgccaactcagcgctttctggggacc

SEQ ID NO: 37643 - DNA, 510 bp, Homo sapiens
  chr19:50831498-50832008
  hyper
cgaagagcgcccacacgcggggctgccagcggcgccaccatgtgccgcccgcgccgcccgcgccccctggcggccccccggcgccgccgcccgcgtcctggaagcagaggcgcttgagctcgccgcccgctccgtccaggccgccgccgcccgcgcccgcctcgtcgtccaggcctccgtcgtgggcgcctgcggcgttggcggcgttggcggcgcccgcggggtcgggcgcctcgaaggagtcgagcgcctcctcagcgtcgcgatgctgccggtaggtcatccagcagcaggcctccacgtcggtctcgtcgatgccccagaagccgagctcctcctcaaacaggggcccgcacacgtcggctgggcagtgcagcttgccggtgcggtagtagttgagcacgtacgcgaagactcccgggtgccggtcaaagaagaactcgtcggcgcccgggtcgtagtcgaagcgtgccgccgcctcgggctccgtcaggccggccagccgcgtcc

SEQ ID NO: 37644 - DNA, 58 bp, Homo sapiens
  chr19:50832951-50833009
  hyper
tgagactgcatggggcgggaactagagatggaggactttcccgcgcaagggggacagg

SEQ ID NO: 37645 - DNA, 142 bp, Homo sapiens
  chr19:50833828-50833970
  hyper
taacgaacgctacaccgcggcggactgcagattggaggaccgagggtagatgaggactggtgaggagggggcacgcaaggaggcagagaggacgggagaggggagaggccaaagcgccaggaagcaccgtcaagactgaggc

SEQ ID NO: 37646 - DNA, 35 bp, Homo sapiens; identical to SEQ ID NO: 13473
  chr19:50836356-50836391
  hyper

SEQ ID NO: 37647 - DNA, 32 bp, Homo sapiens
  chr19:50836392-50836424
  hyper
ggctgtcttaccgcccccggaccctgagcctt

SEQ ID NO: 37648 - DNA, 66 bp, Homo sapiens
  chr19:50837323-50837389
  hyper
ccggacaagcagaggcggacgtcaccctgagcaaactgcaaggcgacaaggcggcaactgggtgtc

SEQ ID NO: 37649 - DNA, 30 bp, Homo sapiens
  chr19:51055016-51055046
  hyper
tggtccctttctccccggctctgtctgtct

SEQ ID NO: 37650 - DNA, 56 bp, Homo sapiens
  chr19:51111640-51111696
  hyper
tatataattggatgccggaaatttggatcttttctacgtttcgcatttctgtctct

SEQ ID NO: 37651 - DNA, 67 bp, Homo sapiens
  chr19:51142512-51142579
  hyper
accccctcccacctccgggcccccagctcccgttgagggcttagagactacaattcccggcaggtct

SEQ ID NO: 37652 - DNA, 171 bp, Homo sapiens
  chr19:51142587-51142758
  hyper
cgctgctgcggcttcatagacccggcgctgcaggatctgctgggagttgaagtccttaatgcctccgggctgcagagaggatgggattttttttttttttttaaggttttggggggttaagatgctggggtcccaagacgcttcaggggaggggaacgatgtccgggactt

SEQ ID NO: 37653 - DNA, 277 bp, Homo sapiens
  chr19:51142834-51143111
  hyper
cgaggggtgggatacacccaggtgtttcgggacccccttccagggccacgtgcccctcccccggggtggccagagagcgctgcagcgctcccactccccggcccgagatccacgcgcctctgcatctaccccgcccccatgcgccggggccgaccccagggatttgactggggctggggctgtggcaggaggagggggaggagcggactcacccggagccgccgctgccgccgctgccgccgccgccgccgccgcagccccgcgcgccagccgcggt

SEQ ID NO: 37654 - DNA, 30 bp, Homo sapiens; identical to SEQ ID NO: 13478
  chr19:51161225-51161255
  hyper

SEQ ID NO: 37655 - DNA, 534 bp, Homo sapiens
  chr19:51161720-51162254
  hyper
gttggaggtaaggtccggtgagatcagagagaaggagggatctcgagtgagtaggggcccgagtttgagtgacccagtagtgaccgggatagaggtctgagcctggaaaggcagctgtgagggggtggaagagactgagcacatagtaggtgtggggccaggggtgatagggtggggacaggcctggagtgcctagggtagagcgcagcctgcagtcgccagtggagggtcgggcctttgggcggtttgagatggagcctcgacagacagtgattaggacgcagaaccaggctaagagagcgtaaggagcctagagcgacccaggcgagagggcagggctggaggggagtttagggacggagcgatggtccgctggaccagggcctgtaaacgactccagggaccaggcagggactcttcgacgatcaaagccagggctgaaacgacctgcgagttccttttccgtccccaccccccttacaggtggctcatcgcggtcacggacttccagacgcgctcgcgcttgctgcgctc

SEQ ID NO: 37656 - DNA, 100 bp, Homo sapiens
  chr19:51162427-51162527
  hyper
gcaccgccccgcgggctggggccacccacccggagccccggaggacagggggcgttgccttcccaggaaggaggcggggccggctcgagggggtggatac

SEQ ID NO: 37657 - DNA, 49 bp, Homo sapiens
  chr19:51162729-51162778
  hyper
ggaagacctgggcaccggggctttcagcgcgtgccgagccctgtctcag

SEQ ID NO: 37658 - DNA, 15 bp, Homo sapiens
  chr19:51170723-51170738
  hyper
cagttttcaaggaac

SEQ ID NO: 37659 - DNA, 164 bp, Homo sapiens
  chr19:51171112-51171276
  hyper
cgaggactccttcagcgctcgctcgcgggcggccagggccagccccagcggggaggcgggatccagggccttgccggtcagcgggtgcaccaggggtcgcgggggcaggaagctggtgaaggcgctgctgcccccgccacccccgtaggctcggctaccggccc

SEQ ID NO: 37660 - DNA, 291 bp, Homo sapiens
  chr19:51197503-51197794
  hyper
agccacactgacacacgcaccgtcgcacagtgacacgcagcggaaaaagaggaggggaggggaagccgggggcgggatgcgtgtgtgatggaggggggatgactgtgaatgggagagaggggtatgaatggggggacttgccaacaccgtgaagaggtgtggggatgtggggatcagagggacaggggcctgggatgtaggcggatgcgggtaagccacggtggctccccacagggagggctccggggaatgggggcgctaagggcggcagaaaggcgagtgggctccaaa

SEQ ID NO: 37661 - DNA, 60 bp, Homo sapiens; identical to SEQ ID NO: 13484
  chr19:51198175-51198235
  hyper

SEQ ID NO: 37662 - DNA, 634 bp, Homo sapiens
  chr19:51198514-51199148
  hyper
cgggggcgcggggcgcggggtcgggccgcggcggtagcgcgaggaccgcggacggcgccggcttcagcaccgcggacagctccggaggcgggcggcgggcgcgaggcttaaccccttggcgtcctgcgccgggcggcggagggggccgggcaggggggagggggccgggaggggaacgcgggggcccccttggcgggagaagggggaggggcgaggcttggaggggggaggagaaggggaggcacttccggtctgggcccccccttaatccccctcccccctccagagccctcccgcgcaggtgcagagctagagagcgcggggagagggaggcacaacatcacacaagatgcctcgcagccgcgtgcacggacgcgcggacggagccccgcttccccggcagggacaccgcgggtgagagaggccccaggcggggacacgcagcccaccaccacagaccaacacgcaacgcacctcgacacagtcggcaagaaaggccaggacattcagactgggccccaaggccatgagcaacacccctcccccaccagagaagcccaggcggaggggcgaacacaccaccacagctccccgagagagcgtggaccccgagccagcgcggggagggggcggc

SEQ ID NO: 37663 - DNA, 396 bp, Homo sapiens
  chr19:51227602-51227998
  hyper
ggtcctcaggccccccgctgcatctccaggctccccctccagcatgatccctgtctgtccgcagtgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggtgagtccgcggcgcgcggggtggaaaaaaatgagactatctgggccaggaatgggactggttgagaaggtgaccctaggtgtccggggcgggagagttcgggagagctgctgtgtgctagcggacggggttagagagct

SEQ ID NO: 37664 - DNA, 21 bp, Homo sapiens
  chr19:51228248-51228269
  hyper
gcctccttctctacccggccc

SEQ ID NO: 37665 - DNA, 271 bp, Homo sapiens; identical to SEQ ID NO: 4679
  chr19:51228368-51228639
  hyper

SEQ ID NO: 37666 - DNA, 91 bp, Homo sapiens; identical to SEQ ID NO: 4680
  chr19:51228702-51228793
  hyper

SEQ ID NO: 37667 - DNA, 167 bp, Homo sapiens
  chr19:51281496-51281663
  hyper
ggtgggtttgagtctcggggagcgcgcgggagctgggcacggccccgtgcttgagaggatctggcattttcctgggcagcctcggcgagagagagtcgtggaaggtgagttaagcctccggattatactctgccaagcagggactaaaaattcgtatccaacagaat

SEQ ID NO: 37668 - DNA, 121 bp, Homo sapiens
  chr19:51412508-51412629
  hyper
tctggaaacagtgtgcggctgacagcacccactgcggatgcaccaggacgcccgagcagaacaattcgttttccatgaccagtgccgcctgccagggctgcgagtgcgggctgcagtcctc

SEQ ID NO: 37669 - DNA, 354 bp, Homo sapiens
  chr19:51520138-51520492
  hyper
ctcaaggagaatcagcgggagaggagtgacgggcccagaaatgcggaaaaggaccacaccgccccctggcggccacagcgcaagcccggtctctcctcctgctggaaggacaccggggaccgcacctccagctgtgggagttccgagagaccccgccctgcccgctcctccctggaggccgcctccacagccccccgtggcgtcctcggggatggatctcctcctacttgtttccgcagtgcgcggccgtcagcacccaactctggtccaccaggacacccgcgcagtggaacgagaggccgttgaagagcgagacctgccagggctgcgagccgcgcgcgcacggggagccat

SEQ ID NO: 37670 - DNA, 54 bp, Homo sapiens
  chr19:51522680-51522734
  hyper
tttccccctccttcacgcgcggggtggggatccgaggctcggagccagtgggag

SEQ ID NO: 37671 - DNA, 132 bp, Homo sapiens
  chr19:51568572-51568704
  hyper
ctcaccccaggaagccgtccctcctcccctgccctctggcgagctgggtggtcggtgcactctcgcccttttcctccagagtctgccttccattctacccctctgggtctgtccacacgcttggtattagcc

SEQ ID NO: 37672 - DNA, 30 bp, Homo sapiens
  chr19:51814766-51814796
  hyper
tggggacgcctggggcgggaggggtagggg

SEQ ID NO: 37673 - DNA, 172 bp, Homo sapiens
  chr19:51815103-51815275
  hyper
gcccccccctgcgcccggggcccggctccggcttctcgccgccgccgccctggccggcttggccgtcatcagccgaggtaccgcagcgccgggggcggggggctcggccgggacgccagggtcttgggtgggtaatcgggggatcaggggtgggggtcgagggctgcatccc

SEQ ID NO: 37674 - DNA, 135 bp, Homo sapiens
  chr19:51830260-51830395
  hyper
ggcgggggctgggggcgggaccccttcgtccccacgcggctaggagaattcgctgacccttgcccctcgccagatcctccgaccatcacggacgtgaccagcgcccgcaccgcgctgggccgggccgccctcctg

SEQ ID NO: 37675 - DNA, 182 bp, Homo sapiens
  chr19:51830821-51831003
  hyper
gcggtgggagtgacccgaggtacatgaggtgctagaacccgaggcgatgggtcactggggtagggggcagaatgctgggtcaccggggaacggaggagcctgagagtcggggggctggcctggctgggcgctgcggcccggcccctgacccggatccctggcaggctgagcagcggcacggc

SEQ ID NO: 37676 - DNA, 270 bp, Homo sapiens; identical to SEQ ID NO: 1395
  chr19:51831120-51831390
  hyper

SEQ ID NO: 37677 - DNA, 85 bp, Homo sapiens
  chr19:52074277-52074362
  hyper
ttgtccttggctgtacggaataaaagccctttgacgatggcggcctccaatatcataatccgtatgggtgcggccatgccgtcct

SEQ ID NO: 37678 - DNA, 30 bp, Homo sapiens
  chr19:52097396-52097426
  hyper
cccatggctgcagggcgcgccgaagagccc

SEQ ID NO: 37679 - DNA, 60 bp, Homo sapiens
  chr19:52205780-52205840
  hyper
ctcggagcaatgcttcgggccttgtaacattagctaggggagcatcgggcaagggttctt

SEQ ID NO: 37680 - DNA, 450 bp, Homo sapiens
  chr19:52207294-52207744
  hyper
gacttgtcctatttccgagatatgccgcgggccgaaggatacctggcgcggatccggccggctcagctcacgcaccgcgggacgttctcctgcgtgatcaagcaagaccagcgccccctggcccggctctacttctttcttaacggtggggcggggcgcggccgcgtgagtgagcggggtcgggagaggggtggggctcgtgcctggctgacgtgcgcgcccccgcagtgacgggcccgcccccgcgggcggagacagagttgcaggcctcgttccgggaagtgctgcgctgggcgccgcgggatgccgagctgatcgagccctggaggcccagcctgggcgagctgctggccaggcccgaggctctgacgcccagcaatctgttcctgcttgcagtcctcggggccctcgcatcagcgagtgcgacagtgttggcgtggtgagttctgg

SEQ ID NO: 37681 - DNA, 494 bp, Homo sapiens
  chr19:52222430-52222924
  hyper
cgagtgggctgaaggcgcctctactcacctgcacgtagtccaccgaatctccgagcgccttgaaggctgtgtacatgacctcgcgcttgccgccccagcgctgcgccacgcacacgcacctgcgagtcctcaccagcgcctccactgccagccgcccaggatcctccgcctccacctcccgataggctccggcgcccaccgcgcccgccgccgcgggttcccagggctggtggtagttgccgtcccacacgtacgtggcggggtcctcgtcagcgaagacctcgcggaacatgtcgaccatgtagaggtcctcggcgcggttgccatccaccaccatgaggacgcgcagccgcgcgcgcgggtacagcagggcgcgggcggacgccaggcactggcgcaggtacgcggggtcctcctggtaggcggagatggtcagcgccacactgcgcgcggtggctgcatccagcggcccccgcgccgccgccgccacccgc

SEQ ID NO: 37682 - DNA, 17 bp, Homo sapiens
  chr19:52223142-52223159
  hyper
cgcgtcctgctgggagc

SEQ ID NO: 37683 - DNA, 214 bp, Homo sapiens
  chr19:52408028-52408242
  hyper
acaagaactctcccacgccggaccgcaaaggcaccccaacccaaaggctccaccgcccaggccgccagctctccccacaggctcctcagaagctccctacccctttaacctactccacggagagacccaaacactcacctgattttcttctggctacacctaaattccctgaatgcttcctttcctggcccttaaaccccggcactggcctatg

SEQ ID NO: 37684 - DNA, 30 bp, Homo sapiens
  chr19:52430054-52430084
  hyper
attggattccttttccggttggctggtggc

SEQ ID NO: 37685 - DNA, 76 bp, Homo sapiens
  chr19:52511308-52511384
  hyper
catcaccactgtccacgaacacgcccagccacggacagaatttcctcccccgtcaccacagcgaccacccagtgac

SEQ ID NO: 37686 - DNA, 434 bp, Homo sapiens
  chr19:52531450-52531884
  hyper
cacagacccacaggccgcgagtccatgcccagaactcgactcacccgagcccgaacctctccagacaccactggcagcgacaaaacgccgcatccacgtccgaaaacgcttcctattcagacgcgctcctgcgcggactccgggaagctgagcggtaaagaccgtgaagcgaggcgaggaccacggagcctgcccgggatcgcgagttcagactgcgggcgccgctctatgaggtcacagggctgcgcccatcgcagcgtttctgacaggagcggccataatggctgtgggaatcactcttagtcacctcagtgcctttctctcttcgttgcaagggacactcaagagtcgggtgcccagccaaggccaacacggcgcagtggcattctattcagcctgctgtggaaaaaagatggcggcgccctttgtgccca

SEQ ID NO: 37687 - DNA, 89 bp, Homo sapiens
  chr19:52800826-52800915
  hyper
ggccctggagcacagcgctccaatctcaatccaggagaagccgcgtcttctgcccagtgctgggattctgcagacgccacccatctctt

SEQ ID NO: 37688 - DNA, 93 bp, Homo sapiens
  chr19:52839463-52839556
  hyper
ccgctctctatgctgcgcgcgcgcagttttttgcagacccggaagcggatcgcgtgggtagaaggtcacaccgcagcgcgtcagtttcccttt

SEQ ID NO: 37689 - DNA, 46 bp, Homo sapiens
  chr19:52839996-52840042
  hyper
ttttcctccttgatccgggccttcctactccccaggcctccccttc

SEQ ID NO: 37690 - DNA, 38 bp, Homo sapiens
  chr19:52840043-52840081
  hyper
cagccatcgctactcccgacccccgggtgtggggacgt

SEQ ID NO: 37691 - DNA, 29 bp, Homo sapiens
  chr19:52872845-52872874
  hyper
tgcagcgcacgacctcggctcactgcagc

SEQ ID NO: 37692 - DNA, 172 bp, Homo sapiens
  chr19:52872934-52873106
  hyper
gcgagcgcccctacagccgatttaaaattaattttaatagcaggaattttcctggatctaatcatcaacaaactttccctctgccgggacacaatctatttccagatagctgagttcttccagtctccacggcaggtctagcctccaaaacgagacgagctgggagcgaggc

SEQ ID NO: 37693 - DNA, 427 bp, Homo sapiens
  chr19:52873107-52873534
  hyper
gagggaagcgcaggctccgcccaatcccacccgggcctggcctcgcctcgcctctcagctgcgcgcgcagtttcctggagacccggaagcagattacgtggagtgacggtcatgctgcggcgtgtgagtttccctttgtttagattaaatctgggatgctgagtcccctcgcgcttctgtacccggcatctcaggggtcacacagaccttgaaatccccgcatcgctccctccaccccgactaaactcagacgttctaatgagagtctggcggtcgcttccctgagtgttaaaatcgctcggaggctggtcctgtccccggtctttcaccacagggccatgtagacagctcctgtcgcggagtttgcctgcttcaaatccttcagtgacccctagacacggcccgcgctgcgtaaagttctcacccg

SEQ ID NO: 37694 - DNA, 89 bp, Homo sapiens
  chr19:52900885-52900974
  hyper
gatataatctacaaccgattttgctctgcgcaggtaagatccgttttcagaccaaaaccctgaaaacaagcgcagccagtcaagcgaac

SEQ ID NO: 37695 - DNA, 69 bp, Homo sapiens
  chr19:52900975-52901044
  hyper
gaagcgcaggcccggcccaggctttgtcccggcccgccctggtcccagccagtccggcctctaggatgc

SEQ ID NO: 37696 - DNA, 266 bp, Homo sapiens
  chr19:52956606-52956872
  hyper
ttggctgctggtcaccgatagggtctttcctcaaaaacctggagaacagacgcgcccagagacaggccgaaggcagcgcagaccccgcccctcaccgccccaccctctcttctctcgggtctcgcccatccctggcctcagctgcgcgcggtttcctggaaacccggaagtgaatcatggggcgtgaactcgcaagcgcagtttcctgaagacccggaagccgatcgcgtggggagccggtcttggagcagcgggtgagtttccct

SEQ ID NO: 37697 - DNA, 1 bp, Homo sapiens
  chr19:52957230-52957231
  hyper
c

SEQ ID NO: 37698 - DNA, 33 bp, Homo sapiens
  chr19:53031314-53031347
  hyper
gcccctggagcgtcgcgccgcagccccagtccc

SEQ ID NO: 37699 - DNA, 91 bp, Homo sapiens
  chr19:53073313-53073404
  hyper
cgtgcttcagccttcctgaccgctctcgcctccaaagcccgaaaaatagagtcgctgggagcgaggctgagagacgcacaggtcccgcccc

SEQ ID NO: 37700 - DNA, 368 bp, Homo sapiens
  chr19:53073405-53073773
  hyper
gccccgccctctgccggttctaaagggcaaggtctctccgcctggggccccgcctctacctcgatcaggccccgcccaccttctcgttggctccacccaggcctggctttagtcctgtgcgcacacatccgcgcagaccaggaagcggatcccgtggagtgaaggtcgcaccgcggcggtgagttttgctctgtgttgtattaagtctgcactccccatatccccggcacttccgtacctgggacgtggggtcaccacagacctgtaaattctcgcccatcttccttcaaccagagcaaatgcagacgttcccctgggaatccggaagtcgcttccttttgtgtttaaagtcgccctgaggctgttcc

SEQ ID NO: 37701 - DNA, 46 bp, Homo sapiens; identical to SEQ ID NO: 4684
  chr19:53073819-53073865
  hyper

SEQ ID NO: 37702 - DNA, 172 bp, Homo sapiens; identical to SEQ ID NO: 4685
  chr19:53073866-53074038
  hyper

SEQ ID NO: 37703 - DNA, 38 bp, Homo sapiens
  chr19:53104584-53104622
  hyper
ggagtgaaggtcccacggcagcgcgtgagtttctctct

SEQ ID NO: 37704 - DNA, 58 bp, Homo sapiens
  chr19:53104953-53105011
  hyper
gcccctcgagtgcagcgccgtgcccccagtcccgcggaggctgcgtcctctgcctggt

SEQ ID NO: 37705 - DNA, 280 bp, Homo sapiens
  chr19:53141079-53141359
  hyper
tggagcagcagggcccgccacgaggagggaggtgggggggagacggcgccttaagacaaggttggggtctgcaggattccaggaccaggcaaagtacgcggcctccctgggactggggccctggcgctgcgctccagtggcctacgaaggcgagggtgggaggcgcccagggcgggaatccagctctcgggtgaggactttaaaaagcgaggggcgggaggagtcagaaaacagttttgagcaggaaaactacgcgacaggaagtgtatacatcgcccta

SEQ ID NO: 37706 - DNA, 200 bp, Homo sapiens
  chr19:53141419-53141619
  hyper
atccggactctcatggggacgtctcaatttgtcctgggtgaaggaagaagggagagaatttccaggtctgtggggaccccacgtctcaggtacagcagcgccggggacctggtaagcgcagacttaatagaagagcgaaactcaccgccacggtgtaactttcactccacataatccgcttccgggtttgcgcgcatgtg

SEQ ID NO: 37707 - DNA, 216 bp, Homo sapiens
  chr19:53193364-53193580
  hyper
ggcgggaatccacttcgcgggtgaggacgttaaaaagcgcggggcgggaggagtctgaaaatgattttgagaaaaaaaaaaaaaaaacaacaacaactacgcgataggaagtgtatacattgccctagagcagaaagacaggggatgggaccaacctcagggcgactttagacccaaaaggaagcgacttccagactctcacggggatgtctctat

SEQ ID NO: 37708 - DNA, 30 bp, Homo sapiens
  chr19:53193928-53193958
  hyper
tttgggaggcgacagcggccaggaagtatg

SEQ ID NO: 37709 - DNA, 161 bp, Homo sapiens
  chr19:53194235-53194396
  hyper
gtgcaggcgcgaaggcgggagcctgaggtcccagctactcaggaagtaggagcaggaagatcgctgagccctggggtccaggccagcctgggcgacaaagtaacaccccctcccgcaaggccaccttccttgtctccctctctctccgtctctctctctct

SEQ ID NO: 37710 - DNA, 111 bp, Homo sapiens
  chr19:53361072-53361183
  hyper
ccccaggaaggcagacggataattcaaaagccctggaatagtctggaaggaggatgcaaactagaatgtaaaatgcaaagccctttctgggcggaacgtaggatttcatgc

SEQ ID NO: 37711 - DNA, 403 bp, Homo sapiens
  chr19:53400389-53400792
  hyper
ttgattgcatatattcgttttccaggagttggaactaggtagcaacaccgcacaaggagggaggtggggagcgacggagccttcggacaggggtggcgtctgcaggatcttaggaccaggcagaggacgcggcctcccgggaaccggggttgaggcgcggcgctcctgaagccgccgagagcgacggtgggaggcgcctagggctggaatccagctcgcgggtgaggacttgaaacagcgcgaggcgggaggacaggtcaggaagggttttgagaaggaaaattccgcgataggaggtgtctgcacgaccccactgcagaaagaccgaggacgggacctgcctcagggccactttaaactcgaagggactcacggactctcacccggacgtctcaatttgctc

SEQ ID NO: 37712 - DNA, 80 bp, Homo sapiens
  chr19:53426559-53426639
  hyper
caggtacagaattgccggggacctggaggcacagcctcaatacaacacagagcaaaactcaccgccgcagtgtgacttcc

SEQ ID NO: 37713 - DNA, 36 bp, Homo sapiens
  chr19:53466073-53466109
  hyper
actaggaaacgcacacgccgccgtgcaactttcagt

SEQ ID NO: 37714 - DNA, 187 bp, Homo sapiens
  chr19:53496179-53496366
  hyper
ctgcgctccagggaccgacgagggtgagggtgggaggcgcccagggtgggaatccacctctcgggtgaggactttaaaaagcacggggtggagggagtcagaaaatagttacaaacaggaaaactacgagatacgaagtgtatacgttgccctatagcagaaagaccggggacgggtctagcctcag

SEQ ID NO: 37715 - DNA, 139 bp, Homo sapiens
  chr19:53496648-53496787
  hyper
tatgtggggaccccacgtcccctgggacagaagtcccagggacctgcggagcgcagacataacacaacacagagcaaaactcaccgctgcggtgactttcactccacgcgatccgcttcccggtttacgctaaactggg

SEQ ID NO: 37716 - DNA, 15 bp, Homo sapiens
  chr19:53496813-53496828
  hyper
cgggacatggcaggg

SEQ ID NO: 37717 - DNA, 135 bp, Homo sapiens
  chr19:53497254-53497389
  hyper
cttccctagagccaccgcctgggatgcgggatggagtgctcaggccagggaggagtgaggtcaccacctgctggttaaacacagcagagatgcgggcgcacaagggggcgtgggagggcgcggggtgggatcctg

SEQ ID NO: 37718 - DNA, 304 bp, Homo sapiens
  chr19:53561495-53561799
  hyper
tatgcgggaagaagacgcgaatggcaggggacagggactggtctcagagcgagttttacccacatggcgaggtccgtatttacctcgggtgaagggcgcgatgcggggattttaaggtcagcagagcgggtgtggaaaagcgggacggcgaatcgaaggcttaatctacacctaggcacactcttgctcggcggtgtcaccttcacacaccgcgatccgcttccgggactccaagaaactgcacgtgcgcgcagagcccgggtagcctggggcggagcccggggagaggcggggtctgcagagg

SEQ ID NO: 37719 - DNA, 103 bp, Homo sapiens; identical to SEQ ID NO: 13514
  chr19:53635501-53635604
  hyper

SEQ ID NO: 37720 - DNA, 75 bp, Homo sapiens
  chr19:53635885-53635960
  hyper
ggaaaaggttttaagcgggaggaagaagcaaaaggccggggacggggagcagcctcaaagcgacttcaacccaaa

SEQ ID NO: 37721 - DNA, 420 bp, Homo sapiens
  chr19:53661466-53661886
  hyper
gactgcgaaggggaggcctggggagcagcagggcccggcacgaggaggagggaggtggcggggcgacggcgccttagaagaggggtggggtctgcaggatgccaggaccaggcagaggacgcggcctcgccggtaccggggctgaggagctgcgctccaggggccgacgagggcgaggctgggaggcacccagggcgggaatccacctcgcgggcgaggactttaaaaagcccggggcgggaggaggggtcaggaaagggttttaagcgggaggaagacgcgaaaggccggggacagggagaagcctcagagctacttcaacccaaagagaagcgactccgaacccacaccgcgagtcagctggggtggagggcgcggtgcggggatcttaaggtctgtagctgccgggcgcagtggctc

SEQ ID NO: 37722 - DNA, 318 bp, Homo sapiens
  chr19:53662186-53662504
  hyper
tagcgagcccgggaactggctgcggaaacggggcacggcggttcgcaagtttaatccatactgagggacactcacgctcggcggcgtcacccgcacccaacacgatccgcttccggaactgcagaaaactgcgcgtgcgcggaaaagagcccgggcactctgggggcggggcctggggagaggcggggtctgcggacgaaacgctggggcggagctggggcggggtctgcgcttccctcagcctgcctagcccgcagtctcatttttcccggtttagaaacgctggagtgttcactatgtccccgggagcaccgttcc

SEQ ID NO: 37723 - DNA, 482 bp, Homo sapiens; identical to SEQ ID NO: 4686
  chr19:53696167-53696649
  hyper

SEQ ID NO: 37724 - DNA, 13 bp, Homo sapiens
  chr19:53696650-53696663
  hyper
gtggggaaaggcc

SEQ ID NO: 37725 - DNA, 100 bp, Homo sapiens
  chr19:53700343-53700443
  hyper
ggttttctgtagacccggaagcggatcgcggggagtgaaggctgcgccgccgagcctgagtttcgctctctctagattaaatctgcgcttcgcagtcccc

SEQ ID NO: 37726 - DNA, 31 bp, Homo sapiens; identical to SEQ ID NO: 13520
  chr19:53700646-53700677
  hyper

SEQ ID NO: 37727 - DNA, 30 bp, Homo sapiens; identical to SEQ ID NO: 13521
  chr19:53757742-53757772
  hyper

SEQ ID NO: 37728 - DNA, 73 bp, Homo sapiens
  chr19:53758105-53758178
  hyper
cgcgagatccgcttccgggtcggcaggaacctgcgcgtacgcgagtgcactggggcggcgcaaggggcaaggg

SEQ ID NO: 37729 - DNA, 32 bp, Homo sapiens
  chr19:53868692-53868724
  hyper
attctactttgcatccgcgtttcagacaattc

SEQ ID NO: 37730 - DNA, 214 bp, Homo sapiens
  chr19:53868957-53869171
  hyper
agacgcgcgcaaacccggaagcagatcgcgtggagtgaaggtccctcagcggcgcgtgagtttcgctccatcttgtatgaagtctgctcttcccaggtccccggcgcttctgtccctgggacgtggggtccctacagacctggaaattctcacccgtcttccttcgcccagagcaaattgagacgtccccgtgagagcccgggggtcacttcct

SEQ ID NO: 37731 - DNA, 70 bp, Homo sapiens
  chr19:53966826-53966896
  hyper
ctgggccgtggatgtcgcctgctctcatcctcttgccctccaggactgggtcctccgggttctgattggt

SEQ ID NO: 37732 - DNA, 28 bp, Homo sapiens
  chr19:53970370-53970398
  hyper
agacgaggaaggaagcgctgcgggaggg

SEQ ID NO: 37733 - DNA, 180 bp, Homo sapiens
  chr19:53970458-53970638
  hyper
gcttcctgagtagctgggacctcaggctcctgcccccgcgcgcgcatccctcccaccccggcgccccatccagcaggtggtcacctcactcctccctggcctgagcactccgtcccgcatccatggcggtggctttagggaaatctctgaagttgagcacggggtggacttgccctcctg

SEQ ID NO: 37734 - DNA, 282 bp, Homo sapiens
  chr19:53970758-53971040
  hyper
cagacaattccagggcttttgaatagtgcctcaaccttactggccggtctcgactccaaaaccctaaaacaggcgctggagcgagggtgacggactcacaggtcccaccccggccccgccctctgcgccttccaaagggcaaagtctctccgcctctcgccccgcccctgcttcgtcaggccccgcccacctcccaggtcccgcccaggcctggcttctgtcctgcgcgcagattcgcgaaaacccggaagcggatcgcgtggagtgacggtcccacggcag

SEQ ID NO: 37735 - DNA, 336 bp, Homo sapiens
  chr19:53971109-53971445
  hyper
cgtggggtccccacaaacctggaaattctcagccgtcttccttcacccagagcaaattgagacgaccccgtgagagtccgggggtcgcttccttttgtgtttaaggtcgccctgaggctggtcccgtcccgggtctttctgctatagggcaatgtatacactttctatcgcgcatttttcctgctctaaacctttctctgactcctcccaccccgcgctttttgaagtcctcacccaaggggtggattctcgcccacttcggccggtggagcgcagaaccgcggccccagtcccgggaaggccgcgtcctctgtctggtcccgggatcctgcagac

SEQ ID NO: 37736 - DNA, 562 bp, Homo sapiens
  chr19:54024000-54024562
  hyper
cccttccagatacgtcgattcccgggttatgagctacatttcccagaagccctcaaggcaggacgcccttagggtcgcgtagagttgcatgctgggaaatcctgacagccgcttccaactctgtggatttccgggttatggactacatttcccagaggcctctgggtcacggctccatttgcgccgtgtagagttgcatgctgggaaacactgacgggcgcccttccagctgcgtcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgag

SEQ ID NO: 37737 - DNA, 262 bp, Homo sapiens
  chr19:54024622-54024884
  hyper
ccagaggctgcctggtggggccccgccgtggcccagtgactgagataattgtcttcgtctgtggggtaatgcgaacaagccccgttcccctaagccgtgatgcatgcggggttgacgcggccgggctctgtccccataaactgtgacacaggtgtgtgtagacgtctatgagggccatagcgccgggctgtaagggcatctgtaggggtgacgcagccgggctgtgtctctgcacctccgttctgtgcgaggtcaatgctgg

SEQ ID NO: 37738 - DNA, 30 bp, Homo sapiens
  chr19:54371989-54372019
  hyper
cgctgcgaggaatcccggaggggtgtttcc

SEQ ID NO: 37739 - DNA, 30 bp, Homo sapiens
  chr19:54382737-54382767
  hyper
gctggtccgcaggctcggactaccagtccc

SEQ ID NO: 37740 - DNA, 413 bp, Homo sapiens
  chr19:54409951-54410364
  hyper
ctcccacagtgtggccgcagcggcgagaactttgacaagttcttcacgcgggcggcgccagcgctgacccctccagaccgcctagtcctggccagcatcgaccaggccgatttccagggcttcacctacgtgaaccccgacttcgtgcacccggatgcccgcagccccaccagcccagtgcctgtgcccgtcatgtaatctcacccgccgccactaggtgtccccaacgtcccctccgccgtgccggcggcagccccacttcacccccaacttcaccaccccctgtcccattctagatcctgcaccccagcattccagctctgcccccgcgggttctagacgcccctcccaagcgttcctggccttctgaactccatacagcctctacagccgtcccgcgttcaagacttgag

SEQ ID NO: 37741 - DNA, 30 bp, Homo sapiens
  chr19:54411138-54411168
  hyper
agcgagagaggggcacggagatcactgaga

SEQ ID NO: 37742 - DNA, 155 bp, Homo sapiens
  chr19:54411454-54411609
  hyper
gagtctggggagtgccggggaccgtgcagatggactacatttccccgcaggcctcgcggcagacccttcccccaagtgcggctccttgccgccagggctgatgggaaatgtagtctccggtcagggccagaccagtggagcggtgtgccttgtct

SEQ ID NO: 37743 - DNA, 91 bp, Homo sapiens
  chr19:54412658-54412749
  hyper
gggcgcgggcaccggcgaccccggtggcggcggcggcggccgggggaagcctcggggccggtcatgcggctgcggggcccgcggcccggag

SEQ ID NO: 37744 - DNA, 184 bp, Homo sapiens
  chr19:54412808-54412992
  hyper
cgcccctcgaggtggctgcgagccgggtttggggcaacaagggacccgagtggctccaggggtggtgagatcctggcggtcgggacgcccgaattcgagcggctatgggggatgcagggacacctgggcctggcgatcccggaggacggggtccgagggtcccggagtgggaaactgcactcct

SEQ ID NO: 37745 - DNA, 143 bp, Homo sapiens
  chr19:54413008-54413151
  hyper
cgagcgtgggctggggagggcagaggccgggtccctgaggaaggcgaggtacggggcgagggcggaggacccaggcccggccagagcaggatgtgggtctggaaaggggtcccagaaagggggagttacggtctcccgagaga

SEQ ID NO: 37746 - DNA, 125 bp, Homo sapiens
  chr19:54413467-54413592
  hyper
cagggtgatggtgcccgtttccgagcccacagggctgcgaggggaccaggcagctcgcggtcaaacccctgagccgccaggcgggggatgggaggaaaagctggccagagcgttccctgactccg

SEQ ID NO: 37747 - DNA, 44 bp, Homo sapiens
  chr19:54445558-54445602
  hyper
cggagctccccctgcctcctcctcctcctcgtcttaggggggtc

SEQ ID NO: 37748 - DNA, 30 bp, Homo sapiens; identical to SEQ ID NO: 13533
  chr19:54463032-54463062
  hyper

SEQ ID NO: 37749 - DNA, 203 bp, Homo sapiens
  chr19:54465531-54465734
  hyper
gggtggcttcccatgcgatgaggatcgtggagccccctggggcggaggcggcgcgggctaggggcgagggctgtgagtgtgagcggtggtggggactcctccgagtggggttagtgggatggtgggacgactttcttgggcagaagacaggagtggagagagatttcatcttatttattaattattagcggtggtggggactc

SEQ ID NO: 37750 - DNA, 427 bp, Homo sapiens
  chr19:54466163-54466590
  hyper
tcttctcctctaatgcgagatctcgctccttgccctccaccagccgccgaccatggccgcgctctgaccccctccccggccgcagcctcctcctcgccgcccccctccccagccccgccggccccgggccccccgcttctgcctgcgctgtgaacccccccccagccgccggcacggccccgcccccgctgccccggtggtggcccacggccccccggctgcccgtggtcaaactggagtcgctgaagcgctggaacgaagagcggggcctctggtgcgagaagggggtgcaggtgctgctgacgacggtgggcgccttcgccgccttcggcctcatgaccatcgccatcagcactgactactggctctacacgcgcgccctcatctgcaacaccaccaacctcacggccggcggcgacgacgggac

SEQ ID NO: 37751 - DNA, 102 bp, Homo sapiens
  chr19:54481331-54481433
  hyper
tcagtggggttgccccgcccccaaccctgaagtatccgcccccaccactgccctccccgctcctccagggttgaaaagaggcgtctgcgtgaagatcaatca

SEQ ID NO: 37752 - DNA, 217 bp, Homo sapiens
  chr19:54481751-54481968
  hyper
gcggcgactctgcgccgtgactggttgtggaatcccggactgggattggccaccgcgccgcagagctgtggggcaatctgcggcggtgacgggccactactgggagccggctgggaaagcctgtattgccattggtagctaccccgagaacgcggcaaatcctaaatgatgattggctgcggcctcagccaggttccgaaatcgcaaaatctagttg

SEQ ID NO: 37753 - DNA, 371 bp, Homo sapiens
  chr19:54482817-54483188
  hyper
cagggagagtgatttcgataaataaagagggggaaagatattccaagagagagaaaaatagtccgaagaaaaaagaaaaggacaaagaaaaagagggagagaaaatcagaccgagaaatagagaaattttaaaaacaggagagagaatgaggcaacagtaaaataaaccagaacacagccggagagagagaatcacagaactgtcgggaggcgccgcgagatggggggccgggaagggggcgcaggcggccgcgtctgaccgccctcgctctccctccttttcctttccttcctcccccgcaggagttgtccgggcctccagcatcttccccatccttagcgccatcctgctgctgctcgggggtgtgtgc

SEQ ID NO: 37754 - DNA, 117 bp, Homo sapiens
  chr19:54483189-54483306
  hyper
tggcggcctcccgcgtctacaagtccaagaggaacatcattctgggcgcagggatcctgttcgtggcagcaggtgagaggcagagggagggggcgaccggggcggcccacctgggcg

SEQ ID NO: 37755 - DNA, 168 bp, Homo sapiens
  chr19:54483364-54483532
  hyper
cgcgttcgtgtgtctgcaaagccaccttgccccgagcacccccgggggcccggagccttcctaggcggtccccaagctccatcgccacccgctgggtaaggtgggtgtagttctcgcgtcgccttcggaggagtaaaccgacacaggcaggtgtctggcgcgtaagac

SEQ ID NO: 37756 - DNA, 197 bp, Homo sapiens
  chr19:54483533-54483730
  hyper
ccgggcgcttaggatcccaagcccgccgtcctggagacggaaggggaggagctggggagggggtgggaccttgagacacaattgggctcttgaggatagagaggcggggctgggtcttggagggcgggcccaggagaggtagaaagtgatctgagcgccgatgaggagcctgctttaaggggcgggcctttggagac

SEQ ID NO: 37757 - DNA, 103 bp, Homo sapiens
  chr19:54485544-54485647
  hyper
ggacctgctcaaggccggcgggggcgcgggcggcagtggcgggagcggcccctcggccatcctccgtctgcccagttaccgcttccgctaccgccgccgctcc

SEQ ID NO: 37758 - DNA, 325 bp, Homo sapiens; identical to SEQ ID NO: 4694
  chr19:54485672-54485997
  hyper

SEQ ID NO: 37759 - DNA, 29 bp, Homo sapiens
  chr19:54486106-54486135
  hyper
cgcggcgggggagccgaggggcgtgtccg

SEQ ID NO: 37760 - DNA, 192 bp, Homo sapiens
  chr19:54494879-54495071
  hyper
gggcggaggccaggccggtggcggtggcgggcacagccggacgcttcggaggcagcgcggagctggggtcggcgcggggccgaggcaggagagcgagaggggcccctgctcgggagtcgggggtgggagccccgagggggggccctggcctggggctgagcctggcgcgaacccgaccgggaaggccctggg

SEQ ID NO: 37761 - DNA, 118 bp, Homo sapiens
  chr19:55684817-55684935
  hyper
gagtccaggcttggccgggggcttggggtgggagtcagggcgcaggcagcagcctcactcggtccgggggccgcagcgagtgccactgggcaatgggccgccgcgggttggccagcat

SEQ ID NO: 37762 - DNA, 91 bp, Homo sapiens
  chr19:55685239-55685330
  hyper
gcgcctttcttcctgcgcagccaggtttctaaggaaatgaaccctcaggactcggttgcggagcgggtgtgttcggcgcctcctgggggag

SEQ ID NO: 37763 - DNA, 630 bp, Homo sapiens
  chr19:55690528-55691158
  hyper
ttgcgcgaacagccgcgcagaaaccggacagccaccgcgagtcatgctgggagttgtagtatcagcctccccgcacttgagagggggtgtccaggacctagttccatcctaaagggataccctcttcctccacggccccacaggcatcccgctgacttctgcctcgtcctcgcccctccgcagggtctgaaccggaagcgggcgaaggcagacgtgggaaccagcagaccgcgttgcccagagcaacagccgggctcctctcaagcggggtgagagcaaagctggttgcccgggcaacgggttgttgccaggacaacgggcggggctgacgcacagacgcggagtcccggcggggcaggctcgctccggggcccaccggtgcctgggaaccccccaatagcccgactgggatcctgaggtcccgcgaggtggggagcgggcagcctgtggtccgagcgcccacagccgactgctccctccgcacctggtcctgggagctgagacgcaggttccctcttccctctccccaattttgctggagggcgggtcgggggctgcccggtgcctgtgctgagccccctcatccttcttggcctgttggtctctccacgcatccgtgctgctctcgtg

SEQ ID NO: 37764 - DNA, 30 bp, Homo sapiens
  chr19:55865272-55865302
  hyper
gtactcgcagggctgcgtgctcttcccgcg

SEQ ID NO: 37765 - DNA, 237 bp, Homo sapiens
  chr19:55952667-55952904
  hyper
tacactccagtctcacgcgcagcccgcataatttaaaaaatggacagatggcatcacgcccgagctcaggaccctgcagtggccccatcacacttaggataaacccgggcccgcctacttctcctcacctcctgctgcccaccgccgccagctgcacgggcgcttccctgccctgcaggccaccgagggcctttgcacgcggttcccctgcccaaaacctctcgcccacagatctct

SEQ ID NO: 37766 - DNA, 746 bp, Homo sapiens
  chr19:55953773-55954519
  hyper
cacccccagcgcccccggcgcccccagctagcggcggcggcgtggtggcccagcgcggcgtgtcgtagttggagcaggaggcctgcgccaggcgcatgtgacggtgctcacagcagaagcggtagtggcaggtgccacagcagaagcggtaggagccggtgctgcagttgaaggtggcgtcgtactggcccatgacatcgtagtagccgtggcagagctcggcgggagggggcgcccgggccgccgcgcccgccccgcccgcggggccggtcctggtgccgttggcgcctgggctcgccgcgcccccgccgcccgtcagcgccccggtcaggcgccgcaggtgcgccagcagggcgggcagcgggcccgcgggctcggcgctcgtggcgttggacgggcgcgccctggcctggccggcgctagaggccaggagtacgaggagcaggagggccggcatggggcttgcagggggtcgcactgggccgccaggctgcggggagaacgagagcagaggttggagcgctgggcgggagagaaacggtcagagggtgagaaacgtagagatgggtgggcagagaggctggggagggcgggcggggggcggcagagtgtggggagcaacaggcgccaggaggcaggaagggcggagggagctgagctgcgtgggcccaagttggccgccccacgcgcggtgggcgacgatgggagagtaatggaaacgcgcccgggcacggctgggggagaga

SEQ ID NO: 37767 - DNA, 35 bp, Homo sapiens
  chr19:55962393-55962428
  hyper
aatgctcagaggggacgcagcgtcctagagaagtg

SEQ ID NO: 37768 - DNA, 160 bp, Homo sapiens
  chr19:55963107-55963267
  hyper
ctctctccgtcccggcgcctgtgtcccgggctgtccccagctccgagcctcagttccctgcgcgcctccatttccctccttcccccgcccggtctccgtcacccctctgtctccacatcccgcttgtctctccttcctggctccacgtctctttctctgt

SEQ ID NO: 37769 - DNA, 147 bp, Homo sapiens
  chr19:55963577-55963724
  hyper
gagagggatgctgggcgctccgacgctgggggccaggggaccggaccttctgggaggggtctgggctcccagggtcggcggtgggggctccgattgcccaacgcggggcgggctgactgacagctctgacgccggtgtctctgagga

SEQ ID NO: 37770 - DNA, 53 bp, Homo sapiens
  chr19:56015184-56015237
  hyper
cttttttttttctggcgctcagcacgcatgcgcaggcgcggtgggcccgggaa

SEQ ID NO: 37771 - DNA, 30 bp, Homo sapiens
  chr19:56728573-56728603
  hyper
ttggctctttttgcccgtatgccgaagagc

SEQ ID NO: 37772 - DNA, 131 bp, Homo sapiens; identical to SEQ ID NO: 4695
  chr19:56728658-56728789
  hyper

SEQ ID NO: 37773 - DNA, 75 bp, Homo sapiens
  chr19:56879479-56879554
  hyper
ccacggccgaactcacgcctacgtactcagtcaccagcggaaccctctccaccaggctccgcgtcgaggccctac

SEQ ID NO: 37774 - DNA, 90 bp, Homo sapiens; identical to SEQ ID NO: 1399
  chr19:56879555-56879645
  hyper

SEQ ID NO: 37775 - DNA, 345 bp, Homo sapiens
  chr19:56879646-56879991
  hyper
tgggggctgcacatgcgcactgcgagtcctcgcctactcccagaaaccacccgggcgcatacgcggtgcggccgctgcttcaggtcggcgggctccagggagacctgggtgggcagcgtcgccgtttctcctttcttgggcagtatttttcccagcgccacgcggaggctgggccattatgaggtttgtgttgcgtcggggcggtccgtctcagaggcgctccggggaggagtgggcggctgaatggccagaggcccagggatccgttcaggtcagcgctggcgtccgggcctgagtttggaggtggcgggtgccttacaagaatgctcgcgtgatcagtgtgtt

SEQ ID NO: 37776 - DNA, 193 bp, Homo sapiens; identical to SEQ ID NO: 1401
  chr19:56904511-56904704
  hyper

SEQ ID NO: 37777 - DNA, 274 bp, Homo sapiens; identical to SEQ ID NO: 1402
  chr19:56904723-56904997
  hyper

SEQ ID NO: 37778 - DNA, 358 bp, Homo sapiens
  chr19:56904998-56905356
  hyper
taaaggcagcagcccggccttgaagccggatctcgcgatgtttcagggtgagccggacgcaggcgtgcctgcgcagtgcgcggaggagtgctgttcgtgtgttcgagtccctgggttgcttcctggggtctgtggtgctgggtgtgctatctgcgtgtgattctctagcgagagattgtgggcgagtgaccgagtgggcaaggggccgtcactgtgtgtgcgtgattttgacagtgtgtggtggtagcttctgactccgcgtgggtcgttgaatgtatgactgggaccgtttagcggtggatacacaactgtgtgcggctgtggaagattgcctcatccgttacgttcccatttccgt

SEQ ID NO: 37779 - DNA, 508 bp, Homo sapiens
  chr19:56915142-56915650
  hyper
gcccacgacagtgcccgatacagcaggcgctcaataagtggcgaatgaaagacagggcaaggcggagagagaagaaacagaaagggaaagagaaagcccgggccgccagagcgcttaatcacacgtacatcctaccgggcccctctccagctggctcaggctccacactggtcctccagctcccttttctcagcgatggactcacagccccacccggagcgctggagcgcggacgcggtcactgcgcgtgcgcctcaccgcgctggcaccccggcctggcagcctttggggacctgaaccagctgcgcctgcgcaggtggaacgggtggaacgggtgggggagcggacagtcgaacggcctgagagggctcagctggtccgggtgggattctgaaggccagcggaggtgggcttactagggaaaggggcgcagcagtaactacccgcaactgagcggcgggatctgcggccgcccggggccctcggccaacatcccagcatcctctgc

SEQ ID NO: 37780 - DNA, 284 bp, Homo sapiens
  chr19:56915651-56915935
  hyper
ccgcgccggccccggactccatttcccagcggcccctgcggcctgccctagggctgcggcgcctttgtgagcgcggccgccggccaggatcgagccctggcccgggccctggcccagccccggcctccaaggaccgcgccgaaggaggtgcccactggagggaggaggcggtgaggagcgcgggatggagctgacgccgggagcggccatgccaccatgtgtgggaccgtgtgtgacagtgtgtgagaatgtgtgagacattaaggaaccgtgtgtgacaatgt

SEQ ID NO: 37781 - DNA, 196 bp, Homo sapiens
  chr19:56988468-56988664
  hyper
cgggccgagaacccacgcaggcgcgagcccaccgcccacgcaagcacccgcgcagacgcccacgccatcgtggatgcgcaaacccacgcgcgccttggcaggaacgtccacgcagtggcgggcgcgccgcccacgccctcagacacacccacactctcgccagcccccttacctcggtcttcccgggctcagaccc

SEQ ID NO: 37782 - DNA, 138 bp, Homo sapiens
  chr19:56988963-56989101
  hyper
ggtctcctaggggactggcgcctggccctgcttttcatcctctcaggagatcacgtgtggacactgaggcccttcctcgagctctttaaccaaacccaacctccccaattcgccgccttccccgctcccacaaccaca

SEQ ID NO: 37783 - DNA, 102 bp, Homo sapiens
  chr19:56989524-56989626
  hyper
cagtgagactgactgcgtcggggttgagactgggtggatgaggctcaccccggcggggagaagggacgaggaggggcggacagcggaaggtccgggagtgtc

SEQ ID NO: 37784 - DNA, 261 bp, Homo sapiens
  chr19:57018744-57019005
  hyper
gccagagtcacaacacggtcggggttcctcgtcgctgtcttattccaaaataagcttaacacagaaagataatgacactcccacggactggcacagaaggccgcgctccgaatgacatcgcgatcacagaggcacagacagcgtcacaaagccccacgcgtactcacaccgaaggctcagccgtcgcgcgtttccctcccaggccccaggaactagtaactagggacgcttctggtctctaggcgaggagagggggagagc

SEQ ID NO: 37785 - DNA, 500 bp, Homo sapiens
  chr19:57019006-57019506
  hyper
caatctttgcgcctgcgcacactcctgctcttacccgccggaaccctgggccacgcccggctcgcgtaatcacgcactgcgcaggcaccgcccgctctgctctaaggtccctctcactccttcagcagcccgaggacaatcccctcaacactaggccacgccttgtctccgcccctctcgtccgacccctggagagaggctggcgcctgcgcgatggggggttccagcgtcgactcacggagtccttcggatgagagcgtctgggtgccagacgaggccgggggtttgttttgggtggtttgggagtccgagctcgagggctgggccaggaagggcaggcgaggcgggcggctccgacgcgggtcgcgaaggcccagccgcgtcctctgtccccaggacgactacatttcccagaggccagcggggcgcgcgtactcgagtctgcggggcggaggccgcggctcggggctgctgggcgttcggggcggcttggggcggcg

SEQ ID NO: 37786 - DNA, 30 bp, Homo sapiens
  chr19:57019931-57019961
  hyper
ggctcaatgagaggccggtgtgtgttcgag

SEQ ID NO: 37787 - DNA, 30 bp, Homo sapiens
  chr19:57049841-57049871
  hyper
ggtgtgtagtcagagcggcctctgcttccg

SEQ ID NO: 37788 - DNA, 238 bp, Homo sapiens
  chr19:57078361-57078599
  hyper
ctatcgcgtaggccccgcccgcgccccaagccccgccctgtcatggttttcctctccagagggtagccgctacgccttaccgactgcgtttcagtgctgtcccactgctcctgcacaccccacgcctgcgaccctacccaccacggacaggcgctcctgcgagctggaagccagttctctgcgtcctgagcctggcagctgcatctgaacactcggagcctggcgatggcttccagaa

SEQ ID NO: 37789 - DNA, 251 bp, Homo sapiens
  chr19:57079002-57079253
  hyper
ctgtgagtgcccatacgtggtgagcgtgcggtgctgtgctgaggaggggcgagcgcgcgcggggatggcggcccggtgtgtgactgtccggtgcgtggccgcgaatctgcgcctgcgtgcatggcccggcggcgtgcggaaggcggtgtgtgttggaatgagtgaagcactttaagtggccaagagcaggaaacccggccggaggaggcttaccccgttctcccctgtatcgactgcgtagagcccagtgt

SEQ ID NO: 37790 - DNA, 5 bp, Homo sapiens
  chr19:57106546-57106551
  hyper
ccact

SEQ ID NO: 37791 - DNA, 21 bp, Homo sapiens
  chr19:57106588-57106609
  hyper
cgcgcgcgggtttctgggaag

SEQ ID NO: 37792 - DNA, 73 bp, Homo sapiens
  chr19:57106836-57106909
  hyper
gggcgcaggagagggcgtgcaggccgggaccgaggtgcgcctggagaggctgagcggccgaggagaggctgag

SEQ ID NO: 37793 - DNA, 272 bp, Homo sapiens
  chr19:57149347-57149619
  hyper
agggctttccccaggcggatgggttctttgaaggagggggaaaaaaaaaagtcttctccagctattctgtgtagagcgtcagcaccaccgaacgctaatgcttgaatggtttagaactgcggacagctcacgccagacagattcagcaccacggacagcccccaaggcagctcgtgatgtgaatggttcagcaccgcagacagctcaagcctcgccggacagccctgctggaagtggttcagcaccacggatagccccgctaatatccatca

SEQ ID NO: 37794 - DNA, 666 bp, Homo sapiens
  chr19:57154254-57154920
  hyper
ccgctggccttggggcgtctgtcgcagggtacctcgaacataacctacgtgctcatcagctagagatggaccagctcggtaccacacccccctgcaaccacgccgcgggtaccccgcctctgcggctcatccactcccttccccacgcgcctccaggtgcaggcttcccgggggtggaggaggggaggaggacacccacgctccccaattcccccacctcccatctcccacctccccccacccccccgcagcctccgcgtctgcgcagccgcagtcagtgcggcgccagctctgcagagcccagacagggtccggttggggagggtgagtccttcgagggacccccgcgggcgggaaggaggcggagaaaaggggctgggggcgcgggcggcgatccggggatgcgcgcgcgagtatggatgcgcagagggtgtgtgtgcctgggcgagggtgaggggcagaaccgctccagggatagggtccggggagagggcgtctccaagcccgtccggtgggagaggaccggggtctgtcggggtcgggtctgtttctccgcagcggaggtctgtgtcctggcttgggggttgcaggtgaattccagcctcctcgtgaggaggggagcacagacctgtgtaccctcgtggggcggcacgggcacgtgcgctc

SEQ ID NO: 37795 - DNA, 215 bp, Homo sapiens
  chr19:57182912-57183127
  hyper
acacctgcaggaacacgcgcacactacacaccgttgctctcgcctcccggtatcaccttcgaacgcgctggccggccccctcctagcctggtgcagtcggctccgcttctactcagtctcgggtcctcctgggccaacgcagaccctggtgcctccttccttagacgagctaaggtcaagacttctgctgctgcggaggagcccgcgcaccaggc

SEQ ID NO: 37796 - DNA, 36 bp, Homo sapiens
  chr19:57276895-57276931
  hyper
tagcaagagtgtgagcgagtgcgaatgtccctacaa

SEQ ID NO: 37797 - DNA, 114 bp, Homo sapiens
  chr19:57610714-57610828
  hyper
gccacgttctcgcggcgccacctggtggccatggaccgccatcgccgctggacgtcagggccgccaggcccagcgagatgtcacctcctctgaggagccttccaggatcgcacc

SEQ ID NO: 37798 - DNA, 232 bp, Homo sapiens
  chr19:57617484-57617716
  hyper
ggcctccctgcatcccggagcgcactggggatgaggactcacccaggagagcccgagacacctgagcggccggcacaaaggccctagggaagtgtgggggtacccttggtctcaaagcgctgatccgcctgtgccccctgacctgccagggccggcccccgcttgggtcttggagggcgctgcgcaagcctgcgccccgcactcgcccgggaagggaagggcagggaagggg

SEQ ID NO: 37799 - DNA, 32 bp, Homo sapiens
  chr19:57617831-57617863
  hyper
cgaaaacggcctgggtccggcttcctcctccc

SEQ ID NO: 37800 - DNA, 88 bp, Homo sapiens
  chr19:57618082-57618170
  hyper
ttcaaggtctgtcaccgtagggggcgggggggcgcgtggagccgctgggggttcggcccaccccgcgaaccgagctcccggccctgtg

SEQ ID NO: 37801 - DNA, 70 bp, Homo sapiens
  chr19:57683265-57683335
  hyper
caggcaagggaaatgcgtccccgggccggggggcgcgagcgggggtccggggccgcgagctggggtccgg

SEQ ID NO: 37802 - DNA, 110 bp, Homo sapiens
  chr19:57683576-57683686
  hyper
gggcgcgcgagggggcggggcgcgccgggctcgtcctctccgcggcgctcagtggcagcagggagggccggtgagatgccagagcaaggtagggtcctgtatttggggac

SEQ ID NO: 37803 - DNA, 94 bp, Homo sapiens
  chr19:57683805-57683899
  hyper
cggttgatgtcaggcagtgctgggaggcgttgctctccgggttcgcttctctcctgttgtcctaactctgcatctctcccgggtgaatcacaga

SEQ ID NO: 37804 - DNA, 100 bp, Homo sapiens
  chr19:57703285-57703385
  hyper
cggcagcggtgctgacggaccgggcccaggtgagtggacggtggcttcgcggttgccgcttccttgccagcgctgaggcggtttccgaagtgggtgggag

SEQ ID NO: 37805 - DNA, 30 bp, Homo sapiens
  chr19:57832233-57832263
  hyper
gcgcaggtgagtggacgaggttttggcctt

SEQ ID NO: 37806 - DNA, 212 bp, Homo sapiens
  chr19:57862426-57862638
  hyper
ctccccctccctgcacgacgcctcttggcagacatccgggagaacccgaaaggcgctcgttgcctggttggatgcagggtacaaactacgttacccagaaatctgtgcccagctcattgttagccggcgtgcagccaatgacagcccagaaactgggcgtttcctgctgctctgggctgcaggggcgagacttctggcgtcgccgtcgtgac

SEQ ID NO: 37807 - DNA, 319 bp, Homo sapiens
  chr19:57862639-57862958
  hyper
tatttttcctatgcccggtccgtgcattctggttgtgaaggctgagttctagagatcgggtcggctttctacgcggctctcgtggaacctagcaaagaaagacagtgaagactgcaggaccttccttcgcgcttttgttacaatccatgacccctgtcgtgggacgggcggcctctcgcggaggtgtctgccggggctgggctcttaccgaggcctccacacacgtcctcttgtccttgtctcccccagaagcagccgccttagtcttgtgagcgtttttacaccgggtagattgagacttggagtgctacactcagcc

SEQ ID NO: 37808 - DNA, 15 bp, Homo sapiens
  chr19:57989033-57989048
  hyper
aacactagtaagcgg

SEQ ID NO: 37809 - DNA, 342 bp, Homo sapiens
  chr19:57998952-57999294
  hyper
tccaatctccatctccgaagttatgcccacttcctggaagtttggaggcacgggaactacattgcccaaaaggcgcagcgccgcgaggcggcgatccctgaccaatgaaaagaggtctgcccgagcgtgcgacacgcaatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctccc

SEQ ID NO: 37810 - DNA, 275 bp, Homo sapiens; identical to SEQ ID NO: 13572
  chr19:58011070-58011345
  hyper

SEQ ID NO: 37811 - DNA, 178 bp, Homo sapiens
  chr19:58011346-58011524
  hyper
cgctgtgttctcgcagctcagaggcgggtctgaggctcggtggcggcgcccagggtggcccgggccctttcctcggtcgttgtctcaccgccacaggctccgatggcggcggccacgctgagggaccccgctcaggtgagcgccgcgtcctcccggcctcccccgaatcctaaagccc

SEQ ID NO: 37812 - DNA, 28 bp, Homo sapiens
  chr19:58038557-58038585
  hyper
attgagtcctcacagcgcggcggactgc

SEQ ID NO: 37813 - DNA, 200 bp, Homo sapiens; identical to SEQ ID NO: 4705
  chr19:58038923-58039123
  hyper

SEQ ID NO: 37814 - DNA, 204 bp, Homo sapiens
  chr19:58070569-58070773
  hyper
tgctgtgcactgagacggacacacacacatcacccagggagccgttcaagcttcctcaaccccgggggggggaagagtaaatatttctactttgcgcgcgcaaaaatgaaggacgaggacagtaacgggacttgttcaaggtcgcaggcccgagaaaggacatggttggaagagccacgaggaggactgcggtcgctcctctca

SEQ ID NO: 37815 - DNA, 303 bp, Homo sapiens
  chr19:58071094-58071397
  hyper
ctcaaaaccctaccccgggtcctacaacggtgcggaggtgagccccagtcgccctaccatccttcccagcacagttctgagagcgcggaccaacacgccccaccacaaacgtccacgccagcgaggccggaagtcccgcccctgtgtcgcggtcgcctgccacgccttttcctgcgccggcccactgccttctaggtaatgtagtcttgtcccgtaagaggccaggcttggctctttttccttttttattatgcacaccatgtttctgtatatctcagatgatcttagcggagcaagtgtaca

SEQ ID NO: 37816 - DNA, 507 bp, Homo sapiens
  chr19:58094961-58095468
  hyper
cagagcaggagcagccgggggcgcggcccccacgtggcctcccgggacacgtgcccacagcgcgacacctaagtcgctcctttcacagaatagccttggccccggcacggcctcgaacgccttgaccccgcaagggaggggcacgaggctcctttgctcccgcaggagcgtcgaatacgtatggaatacgcgtcggtgtggatctggcctcagcttcctgagcctgaatcaatgcttctaatcacgtgggcgctcagccgcgacgggaccacagaaatcgaccagcggcctgtttaaggagcgacaaggcccagccctctcctgcattgtggcgacgccatttccctgcgcccccagcgcggccgcttggcttttgtttgaggtgacgctgggcggcagcatccttccctcagccctggggaccagcggggactacagaacccagaaggttttgtctccagccgcagggatgctgagccaatccgcgctgagaaaagggtcgtttcc

SEQ ID NO: 37817 - DNA, 308 bp, Homo sapiens; identical to SEQ ID NO: 1406
  chr19:58095469-58095777
  hyper

SEQ ID NO: 37818 - DNA, 154 bp, Homo sapiens
  chr19:58111112-58111266
  hyper
ggtccaggagaagggcgacctctgccagcccaagaagcggtgagaactacattacccagaggcccgtgagccaggttcttggcgtggagccaatgaggctcaggggagggacatttccgctctgtccaacttgtcggagcggaacttccggcgt

SEQ ID NO: 37819 - DNA, 323 bp, Homo sapiens
  chr19:58111541-58111864
  hyper
cccgaaactgagggacgcgtgaagggttttctgcagcccggaccgcactgtccggcacagtgaggcgctggtgctggatctcgtttctggtagtgtggcagggagcgggagagcgacacggtcagggggctgcgcgggcaacagcttggagctgcgcctgagccgggaggctggggagacccaggccggcctcacgcgtgcaggtagcagagggtggggcagcgccgcgctgcattggccccactgagtttcaccagcacactgagggccacagcgcgtaggacagaagaggggcacggccccagtcacgcttctaaaagttt

SEQ ID NO: 37820 - DNA, 631 bp, Homo sapiens
  chr19:58125422-58126053
  hyper
tttctcagcgcccctcgcagtaccatttggcctttgcccagcgtgcaggggagttagccgtcaccacggccaagtgcacatgagaactgcattgcccagaaacctgtgcgccgcccggcggcggcactcttaggggcgtctccctgcggacggaagctctctgggcgggacttccggtatcttcctcgcggtggacatcttgtcggctcttaggtggaaccatcggagcagaagctcggggttgctgggcggttccgaggtgacggaagcgggagggtgcgggagaagtcgctgttcgctctgcggagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcaggtgggtgctgcctttcccagactttcgcccgccccaaatcctgaagttccaaatgaggagcgcctgtctgagtccctgcagcgcaggccccagtgtccaaggcagcggggcgctggtgggtgggggcgagtgtgactggcagaggggcagcctgagcataggtttggagctggactgagccc

SEQ ID NO: 37821 - DNA, 39 bp, Homo sapiens
  chr19:58126054-58126093
  hyper
tagcagtcgggagcgtgtgtgaaccgtagtcaggcctgc

SEQ ID NO: 37822 - DNA, 55 bp, Homo sapiens
  chr19:58144370-58144425
  hyper
gacgcagcttcctagcgctcccagctgtctgcacacaaggcgccctccgtcgcag

SEQ ID NO: 37823 - DNA, 366 bp, Homo sapiens
  chr19:58175608-58175974
  hyper
atgaaagtgaggggtcgggggtcggggtcgggcgcggcgatgccgcagctgcggggctcggtggactcggcgagcaagagccccaggacgctgctggcggcgggcgaggagctggggcgcggcgcggggcggctctaggcgctgtggccgctcagcgtctgggacccagcgccgcccaggtcagggaatccttggtgttcccgccccgcagcacccggggcgggggaggagtcggcgcggtcgtgcggccgtggaggacagcgagacccggggctgcggctgcaggccgaggggcccctgggacagtgagaagcagcggcgggagctagtcacggggcagggagcgctcagcggtaaagacggctt

SEQ ID NO: 37824 - DNA, 467 bp, Homo sapiens; identical to SEQ ID NO: 1407
  chr19:58219926-58220393
  hyper

SEQ ID NO: 37825 - DNA, 217 bp, Homo sapiens; identical to SEQ ID NO: 1408
  chr19:58220515-58220732
  hyper

SEQ ID NO: 37826 - DNA, 413 bp, Homo sapiens; identical to SEQ ID NO: 1409
  chr19:58238326-58238739
  hyper

SEQ ID NO: 37827 - DNA, 25 bp, Homo sapiens
  chr19:58238987-58239012
  hyper
gctacaaggaggagccggaagtccc

SEQ ID NO: 37828 - DNA, 180 bp, Homo sapiens
  chr19:58239013-58239193
  hyper
cccacgcaccccccgcaggcactgaaacacccctctcctgggccctcattgggtatgcaacgtataggtttgtgggtagagtgtggttcccactgagctatccttcaaggcaggggattctcggcctgggctcttgggaaaactcgaagtaggagggccaagttgtttgggaaaagtaac

SEQ ID NO: 37829 - DNA, 371 bp, Homo sapiens
  chr19:58281000-58281371
  hyper
tcaagccaggacttccggcgtcctagccgtggcagccattttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcaggtgagcgctgcgacctccgggccttacccaccctacccacccagaccctgaggcccctgatcgtgagggccgcctcctcgcgtccctgcagcccaggcctctgtcagggacggagaggcgccggc

SEQ ID NO: 37830 - DNA, 30 bp, Homo sapiens
  chr19:58361192-58361222
  hyper
cacgtaacgtaaggccgagacttccggggt

SEQ ID NO: 37831 - DNA, 29 bp, Homo sapiens
  chr19:58361543-58361572
  hyper
gtaggaacactgaggcgctcacaggaggc

SEQ ID NO: 37832 - DNA, 531 bp, Homo sapiens
  chr19:58400042-58400573
  hyper
tccgggctgcagagccgtgaacaggcgctgctacctcgctgcttttgggtgacgatgaggtgacctgaggacacagaaggccccacaattacctgagcggagagcctcagcgtagccgcggcagccatcgaaccacgtggttttaagcagagtcgggaggatagggcgaccagccaggagatatgggcacgacggtccgtatcctggcccaggagtgggtcacgctgggcgccgtcacagagctccagagtagcctctgtgcagcggaggacaactgctccccgacttctgggttcagtcaccacagtgcggacctagcgctcaggagcctctcctacaaataaatccaacaccaatcaaaatggccgccaccagagggcgccggaagtccggacccattgtcacgtgcacacaggaaacgcctttattctgagccctcagaggtcttctacgctatcattcgaggctgagttttctgggtaatgtagttccctaggcaacaaggagggtaaagggcgcaattcccagagg

SEQ ID NO: 37833 - DNA, 403 bp, Homo sapiens
  chr19:58446443-58446846
  hyper
agacctgtgaacagtcgccgctctctcgctgcttcaggattcgggttaggatgaggtgacctgagggcagggaaggcacaattacctgagccgggagcctcagcgcggccgccgccatcccgagtacgcggggaaagcactgccgggagcggcgggcgccgttacggggcctaagatctgcctctgtgcagcaagaaggactcttcaccttctgggttcagacaccgcggttcggacccatagctccagcgcctctcacctcacaaaccgcagaaacacacccaacattaaccaaaatggtcgctaccagagaacgctgagaatcccgccactacgttacgtgcgcacacagaaacgcctttattctgagcccttactggttctgttgcgctgtcattcaatg

SEQ ID NO: 37834 - DNA, 194 bp, Homo sapiens
  chr19:58458530-58458724
  hyper
gggctcaagccaccccgtagccccatgcctggccttggagccgggtgccctcgcaatggctgtgtcacctctgtgccccagggctcagtggcgcctctcatcaggggctccttgccagtcgcgccctcccttccctagcacaccaggtgttggaaacgggagcccctccggcgagcccccgtgtcctgtcctgg

SEQ ID NO: 37835 - DNA, 183 bp, Homo sapiens
  chr19:58459049-58459232
  hyper
ccacaaggaggacaacggaagtcccgccgcgaccgcgcgtgcgcttacggaaacaccacctttcggaggcctcattggctgaaggtcgccgtcgcccaacgcaggccattctgggtaatgttcccacaggcgcacggcgggagagtgagggtcgcctccacctccttccggaagtaaaggcca

SEQ ID NO: 37836 - DNA, 1028 bp, Homo sapiens
  chr19:58513683-58514711
  hyper
tgcttccagagctcccgacccaaatttcctcctcaagaccgacgcggccgcgacgctgcaaaagctcgtcccggcctcacctggctcgcggccggcggtcccccttgaaggcggcgcagcaggatcggggtctgcccgcctggggcgtttggcttttgtcccgcgccgaggtccggcccaggagtgcgcttgggagctcccggcgcggcctcggggacaaaggcccgcggagccgacgtgcagcagagttcacccaggcccgtccgaccagaaaacgaagaacgcccggaggcgggaggccggaggcaggctgctggctggagaaccgacggcaacgacggcgcaaagccggcgcggaaagggcaggcgcaggacccaccctgacgccgcctctcccagccggctctcctgaccccccaagccccgcagctacggcggccccacagcctgagcaaaggcctcacctcagccgcggacaatggcggctgcttccccggcgtcgaccggagcgcgccgcggggtctgctgggagctgtagttccaggcgggcacttccggcgtcgggcagcggcgccgccatgacaggttcctgggccgcgccgcctcgccctgcctgggcggggttgggacctttctggcacctgcgtcgaagccggcggcaggatggactttgttgtcccggtcccagaccaccctcctccaccgtcgcctcccactgcaaaaaggcctgggtaagtcgcggccccgcgggcctcggtttgcccatccgcaaaatggcgcctcgtggtaccgggtttcccgggaggagctcggcgagttctcagcgctctcgagggatccttccatttggcgttcgcaagattgtgagaaagtgactgctgttattctctttaagataaggaacctaattcgagctacccttctctgtgaagctcgacggctgagaacgtcagggctcgttcccaagtctctttccagaggccaggctttatgggagcatgggttaccagcgacgcaccctgtgagtt

SEQ ID NO: 37837 - DNA, 52 bp, Homo sapiens
  chr19:58520901-58520953
  hyper
gcctctccgccctgacgctgatgctcgtctggctgcccgttctttggcatca

SEQ ID NO: 37838 - DNA, 48 bp, Homo sapiens
  chr19:58521268-58521316
  hyper
tggccgaatccaggacgaccaggccagacccaccggcagtaccttgcc

SEQ ID NO: 37839 - DNA, 288 bp, Homo sapiens
  chr19:58545100-58545388
  hyper
ggacactgtataaaacggttgcgtgtctggaatgccgtcgttttgccccgcggccccatcgtacatgcgcatccccgcagccgccaccgtctccactttccgcagcagcgtccctgacgctgcgcgacccgttgccaaggcgactggaaccgcggcccgaggtaactggagggcacggcgggggcggggcgctcatcccaggcggcttctgattggcctcggccgcctcgtgcgtcacagccccgcccctgcccgggagtcccgcagcggtgacttgtcaccgacgcc

SEQ ID NO: 37840 - DNA, 13 bp, Homo sapiens
  chr19:58545577-58545590
  hyper
cgggacgcccacc

SEQ ID NO: 37841 - DNA, 76 bp, Homo sapiens
  chr19:58545651-58545727
  hyper
gtcgggggaggcgggcccgggcccgggagggggcgggccgggccggggttccagagcccatcgggagtcctgaggt

SEQ ID NO: 37842 - DNA, 60 bp, Homo sapiens
  chr19:58570949-58571009
  hyper
cgccccgcccctggccccacctctgccccacaccgggcactgggccgccacctttgttga

SEQ ID NO: 37843 - DNA, 54 bp, Homo sapiens
  chr19:58609472-58609526
  hyper
cgtcctcaccgtctaccctgttggggtcgctctctgacccccgcgctgcatccc

SEQ ID NO: 37844 - DNA, 32 bp, Homo sapiens; identical to SEQ ID NO: 4715
  chr19:58609712-58609744
  hyper

SEQ ID NO: 37845 - DNA, 256 bp, Homo sapiens
  chr19:58609745-58610001
  hyper
gcgtcccgcccactccggcgcctgcgtcattttgggcaccatggcaacgaagtaaacaagcgggtaaataatagacccctgacagccagagacccggagaaacaaagacggtgagaaacggagaaacaaagacaaaaagacgcgcagaccgggagggagagaagcatgaaggcccacagacgctcgggggcagaccaagacgccctggggtccccgaaacagagatgtacagagtcggacacggaaagggagagac

SEQ ID NO: 37846 - DNA, 30 bp, Homo sapiens
  chr19:58629357-58629387
  hyper
agagtagagggctcgcgccctgcggggaga

SEQ ID NO: 37847 - DNA, 353 bp, Homo sapiens
  chr19:58661991-58662344
  hyper
caggtgaaacccacccgcggacgcgcccctcgccgccccacaaggacccggcggacctccacccgccaagacttccctccgcaggaaacggaggcagcgcagggctcagggatgcgtcggcacttacggttggcggccggcggcagccatgttccgggcgattgcgcttgcgcggctgccgggacaaggatgtgcgcgtgcgcggagtccccgagcttcccccgcccaacgctggggcggccgcgggtaccgggttattcattaccctggcgtggacttgcctcggggcggacgcgcaggcatttactttctcctatggtctcctctgatttttaacccgatgctatcattct

SEQ ID NO: 37848 - DNA, 262 bp, Homo sapiens
  chr19:58666233-58666495
  hyper
cccattcctcccagccgcagacgcggagcccacaggagtccccgcagccctagcccgtgcacccacggcggagccgaggccgcgactccgggcctgttggctggaacccgcagccgtgtctcgggccgccccggtagcggccacccctgagagcactcggccccgttctatcccgcagtggtttggggagtgcaggtcatcactcccacccgccaaggcggacgccggaccctccattgcgcatgagcgcccactgcggcgc

SEQ ID NO: 37849 - DNA, 183 bp, Homo sapiens; identical to SEQ ID NO: 13601
  chr19:58666550-58666733
  hyper

SEQ ID NO: 37850 - DNA, 703 bp, Homo sapiens
  chr19:58694552-58695255
  hyper
tagtgtggggccctgcggcctagcgtccctcaccagaggcctccccttgcctagctggaccgccgagggacatcgacgagtatcctcctcctgctgtccccggcttcgcctgccgcccctaaccggccagtcaagatggccgccgctgggtgaggcaagctggcgcgccgcgggggcgtctgggagttgtagttcgggacggcgggctgacgcacttcgccgccggccgacgggcgccattgtgcggcgcgcgccgggtgagtgccgcgcgaaacctgcgtccgtcgggggctgcgctgggcgggtccagaaccgttagttgggggcgagcgcggcctctgcattttccgccgagctcgggtaccctgagccggccgtgcctgcagtcctcccgccgctctgtgggatggggtcggtgacccggaaccccgaggggagacagtgctttcggggcgccgcggtggagagaacagatcgcctccggaagcgtggggtctgggccagggaggcgatcccctccgatgcgcgggacagaggaggctcggtgtcctctcggggaggggaaaactggtcctatccagtcctgtgggagtcctatgactcactctgggcgttttccagtttgggtggacttgtcatttcccgctgagggagccgttcctgggcggaggctgcggtagctccccagcggacaccttaagcc

SEQ ID NO: 37851 - DNA, 179 bp, Homo sapiens
  chr19:58740209-58740388
  hyper
agcaacggctaccggcgcgcggccttctgggagttgtttgttgcgcggagcgcgggcacgtccgccggccaccggaagcaccgccattggccggtgcgtgcaggtgagtctggcggcctcaaggttggctcggaggtttcactgttagccgggtgcggccggagcgcaggaccaggcca

SEQ ID NO: 37852 - DNA, 333 bp, Homo sapiens
  chr19:58951068-58951401
  hyper
caggatcctgagggccggaatcccagcgggtgagggcctggggcacactccacttacctgcgccgggcccatcagcaacgctggcaaccccattagaacctgtgggctgggcagggccataacaggaggcccagggctagccctgccgctgggccgaaccctcacacttccgctgggtgacggtcgcactcaggacctgtcttcccaaatgcaaaatgcgcgcaaggcctctgggcaccgcagggacgaaggctgggtatggagaccctggagacgcgtggcgctggctccactttcgggaacaccttggctcataaaagcagagtaattagc

SEQ ID NO: 37853 - DNA, 74 bp, Homo sapiens; identical to SEQ ID NO: 1413
  chr19:58951525-58951599
  hyper

SEQ ID NO: 37854 - DNA, 178 bp, Homo sapiens; identical to SEQ ID NO: 1414
  chr19:58951600-58951778
  hyper

SEQ ID NO: 37855 - DNA, 279 bp, Homo sapiens; identical to SEQ ID NO: 1415
  chr19:58951779-58952058
  hyper

SEQ ID NO: 37856 - DNA, 78 bp, Homo sapiens
  chr20:291085-291163
  hyper
aaggggagttgggggcgagcgccgaaatctgagtggctctttcaagcctccgttgccatagaaaccggccgcacaggc

SEQ ID NO: 37857 - DNA, 153 bp, Homo sapiens; identical to SEQ ID NO: 1417
  chr20:291220-291373
  hyper

SEQ ID NO: 37858 - DNA, 272 bp, Homo sapiens
  chr20:590327-590599
  hyper
ggccgcagcgagggacgcagcacactcacccccttgcgctggttgctgaggcagaaggtgcagatggagcgcggctggcggccgccgtcggcggcggcggggacggcgcccttggcactgcccgcggcacggaagcacggctgcccgtcgtcggccgagtcgcccagcagcagcacgttggccaggtgcgcgatgtagctggacgccaggcgcacggtctcgatcttggacagcttgcggtccaccggctcggtggggatgagcgtgcgcag

SEQ ID NO: 37859 - DNA, 108 bp, Homo sapiens
  chr20:590967-591075
  hyper
ggcccccgccttataggcgagggaggggccaatggcaaggccgccccggccgggggcggagggctccgcccggccaatggggaggcgtccgcccggccaatggggagg

SEQ ID NO: 37860 - DNA, 155 bp, Homo sapiens
  chr20:592405-592560
  hyper
cctggatccccccaccgccagcatttgaccgtgaccccagccaggctgggctttggggaggagggaaacagccagcatgggccccctccccgcagggctggtcccacacacagccccagaccaggctgctgcttcctgagccgatgaattattac

SEQ ID NO: 37861 - DNA, 274 bp, Homo sapiens; identical to SEQ ID NO: 1418
  chr20:644552-644826
  hyper

SEQ ID NO: 37862 - DNA, 369 bp, Homo sapiens
  chr20:644985-645354
  hyper
cggggtcgctgtactcctccggcgccgccggcgggtacgcgggctcggccggggccagctccaggcccggcttctggtccgcatcgtagctgctcgggggcaggcggtgcggggcgtaccctggagggggcgagaagtggaggggcggtgagaggaggcgccgaagagggtttcccgctttgagcgcgtcaccctttgcgccttccagcttggcgcccctgtggcagctccgacagtggtggtctccgacctgcacctcagctcttcctgtcaggcagcctgggttcaattccttcctccatcgacggcagtgcaaatagccgccaccccaacccacggagcatggggccagcacggttgtacagagcg

SEQ ID NO: 37863 - DNA, 139 bp, Homo sapiens; identical to SEQ ID NO: 13613
  chr20:656937-657076
  hyper

SEQ ID NO: 37864 - DNA, 36 bp, Homo sapiens
  chr20:690741-690777
  hyper
ccccacaccccctcccggccccgggcctttgtgcgc

SEQ ID NO: 37865 - DNA, 96 bp, Homo sapiens
  chr20:708614-708710
  hyper
acggactggtgcttgcgtgcggggcttttccactggttcccttccgtactcgggcttcccccgctgttgttactccctcaacgggaacacaactcc

SEQ ID NO: 37866 - DNA, 30 bp, Homo sapiens
  chr20:866071-866101
  hyper
tcaagtgtggtggaacgtcctgtgcccact

SEQ ID NO: 37867 - DNA, 128 bp, Homo sapiens
  chr20:982671-982799
  hyper
gcccccggtctgccccgcagcgcctgcccggccgccctgcccagccaccccttgtaccttgcttcttccttcggttcagggcgagcatgtccacggcgtgggcgacgagcaggagcaggcagagtggc

SEQ ID NO: 37868 - DNA, 307 bp, Homo sapiens
  chr20:982891-983198
  hyper
gggggctgctgtgggcgcgccgggcgcatccgccaggcgcgggtcggtccggccgccaggtctagtgagggcgttggcggagccggggcactgccctggcggggaggagccggcgcggcgggggcggcgcgttaaccagctcggggcccgggagcgcgcgcggggagggggcgggggtcacccgggtcggggccctcgagttcgatctgtcccgcagccggcggtcttgcgtctttcccgcccccagcactgcccccgagcacgtgcacgtgcccaccgccagccacaggtacgcacgcgcgcgcag

SEQ ID NO: 37869 - DNA, 50 bp, Homo sapiens
  chr20:1206113-1206163
  hyper
gcgccaggacaaagccggagactgcgcactaggaccggtgcgccttgctc

SEQ ID NO: 37870 - DNA, 985 bp, Homo sapiens
  chr20:1783321-1784306
  hyper
tccaggcagtaggttcgccagccattgcttgtgcgtcttcgcggagagagaggggggagatgccccggcgctccttacccggctggataagaccctttggggaacttgctgcttcgcaagtcttacttgtgaggacccggagggtttgcctttgaccccgcctgtgaccttaagaaaacccctttctaccctgcgcctgtcccacagctggaagtgataattttaagaatgaattaagcactcggtgtgtgacactgcggcactaagcactttctggactgtgttaggccccattttacagacggggaagctgaggcctccagaggcggagtaacctgctcatggttacaaagctggtcagcggcgggcaggatttgaatccagggttcccggttcctaatcctctgcttttaccacttaatttatcctgcctccaagggctgctgggaaaaaggcggatttcaaaggagaagcagctaaggaaaagctctggaaagggccaacggagcggatattcccggagcccctctgcgagccacgcgcccctctgggaagcccgcttccccctgcagacaggcgctgtgacacgcttgcgccccggtcgaacaggcgaagaggccgaggcccagagcggcgcagggcgagcctggaggctgcgccccagacctggaccagccacggacgccgctcccgccgctccctccgctccgctgcgctccgcacgctggcgccggctccccgaggccccgggcgccccggccgcacgcctgggtaaaaggtcccgaggagtccgcagaagcgcgcccacgcccgagacggccgtttccgccggcctgggaaaggggcggagaagggggtcgcccgggccgcagcgtgccggtccccgccggccgagccgtgtttggggccagtccccgcaccccgcttcttccccacctggggagcggggcgccgcggtaggggcactggagcgcacgatgcaccc

SEQ ID NO: 37871 - DNA, 155 bp, Homo sapiens
  chr20:2187759-2187914
  hyper
gaccttgccctgccccgcggcccgcgtcaccatggcaactgcaggcagccagcaccgacggcgggaaaacgaggaccggagccgcgttacagccttggccttcgagcagcccagggagagtctctgcgtcctccagcccccgcttcccttcatgt

SEQ ID NO: 37872 - DNA, 133 bp, Homo sapiens
  chr20:2539419-2539552
  hyper
ggtgtgttgtggctccgattctgggcattcgctccgcgcgctcccgctccttcgcggcccttccccttcccccgtgagggactgatgcccccctccccggggagaggcagcccgtgccctcgctctggcttcc

SEQ ID NO: 37873 - DNA, 218 bp, Homo sapiens
  chr20:2539553-2539771
  hyper
tgcctcccagcccttaccactgccccactctgcggtgggttcttcatcccagaaccgggatgaagatcgcgggtccgcgcgggggagtggccgcgggctctccactccagcgcctcgtggcacccggtgaggcggggcgcgggtggagaggtggcggggcgcgggtggagaggtgacagggcagcgggtgggacacgatcccgcgtcccctgaactcc

SEQ ID NO: 37874 - DNA, 136 bp, Homo sapiens; identical to SEQ ID NO: 13621
  chr20:2668792-2668928
  hyper

SEQ ID NO: 37875 - DNA, 16 bp, Homo sapiens
  chr20:2672984-2673000
  hyper
agtccaggcacaaggc

SEQ ID NO: 37876 - DNA, 59 bp, Homo sapiens
  chr20:2731616-2731675
  hyper
actggtggattaggtcggggccaggctatctgaaaagggcggtgcggggatcaggaaaa

SEQ ID NO: 37877 - DNA, 101 bp, Homo sapiens
  chr20:2780664-2780765
  hyper
gggaactggggctgccgagtcagcagccattgctcccagcagggagttgagggagtgtgagtgtgtatatgtgtgtgtgcactgtgagtgtgagtgtgcgc

SEQ ID NO: 37878 - DNA, 237 bp, Homo sapiens
  chr20:2780885-2781122
  hyper
tgtgtgcgcgtgagtgcgagtgtgcgtgcggggtgagtgtgcatgactgtgagtgtgcgtgggtgtgcgtgtgcccgcgtgttagggagggatcgccccacggggcaggagagccgggcagtcggcttgcgggggagcggaccgtcggtcggggaactcaccgttagctgtctccgccggcggctgtgccgggctgctatgcagggccggggtcgagcctgggaccttggtggtccc

SEQ ID NO: 37879 - DNA, 823 bp, Homo sapiens
  chr20:2781123-2781946
  hyper
ggctgcgcgaggcccagcaccgagttcctgggcgcccccagagccgggccgacggccggcgcgaaggcggccagggcgagcaggagcccccacatggcggggattgagtgccaggggcgcgcgggctacggcgggtggcgggtcggtctcttcctgccgagtgcgccgagccccccgccccttcctgccccccgcccctccgcagcctcctgcccgcccacagcccgctgcccgcctcggacctcggagaggaggagagggccgggaggagcgagcggggctgacctccaaggggccgccccaagtctcaggaccgccgactctgcccttcctctccgccgtctggggccaacccgcctcgttggcgcgctgcgcctttatagtctgcaaagccacactgaagagaccagagatcacctggtggccatcaagtcgaccaacaggaggcaaagccccttatctgagcaattcagaatgacacttccctattgtctaaagccacatctggtaccaagcttccgtcccaagaatttataagtaactagaatttctgtacgtttccggaatgagtgcacgttaagacccattgtgcaaactttgctgacatcaaggcaccaaaatatcgacaaatgtaaccatttaccatgacctaagtgactaatgtggtccaaattaccctgcagttccccgcagggagctcagtcctctcttgctgaagcgcctactgcgctctgctgcctcgtcctttccgtctaataaaactttccttttcagacctacacggttgttgataagttcttttaccacccgggagccaaccact

SEQ ID NO: 37880 - DNA, 252 bp, Homo sapiens
  chr20:2785615-2785867
  hyper
caccatcaccaagcccggccctgcccctcctctcctttcccttccctcccctactccttcgctcactcacccggctgccacgtcccgtcccggggttacataacccggagagagaagcctgagcgatagcctgcgggctggggctgcggtggaggagccaagggttgatgcactgcctgacctgccctccggctcctcgcccccagcccgtattctcctcggggagccggcagccctgggtctgcccagatc

SEQ ID NO: 37881 - DNA, 69 bp, Homo sapiens
  chr20:2820792-2820861
  hyper
ccctgcgcctcgccacgtgcccgccgccgtcccgcgcatgcgcgcacccgctcgcgccaattaccaagt

SEQ ID NO: 37882 - DNA, 138 bp, Homo sapiens
  chr20:2852976-2853114
  hyper
ttccggcctggggtgcgtgagggggactcaggggttgcccggtctggaggagagactcgccgccacctaccccgggaaccgcagactctgggtctgggataaagcgtcccctacccgcaagctcggtttgtgcgctac

SEQ ID NO: 37883 - DNA, 168 bp, Homo sapiens
  chr20:3052524-3052692
  hyper
cggattttgacgccccgcccttgaccgcggtcgaggcccccacggcgccccagcgcgtctcagccccgctgtcccgcccgaactccgaaccccggaccccagcatccttgcccggcgcaccccggccggcctcgcagggtcctccgagcgagtccccagcgccgcccc

SEQ ID NO: 37884 - DNA, 423 bp, Homo sapiens
  chr20:3052693-3053116
  hyper
gctcccgctcaccccgcccgtccccgcagtgcctcccctgcggccccgggggcaaaggccgctgcttcgggcccaatatctgctgcgcggaagagctgggctgcttcgtgggcaccgccgaagcgctgcgctgccaggaggagaactacctgccgtcgccctgccagtccggccagaaggcgtgcgggagcgggggccgctgcgcggtcttgggcctctgctgcagcccgggtgagcggggcaaggcgctccggggccagggggaggcgggcgggggtgcggccgggattcccctgactccacctcttcctccagacggctgccacgccgaccctgcctgcgacgcggaagccaccttctcccagcgctgaaacttgatggctccgaacaccctcgaagcgcgccactcgcttcccccatagc

SEQ ID NO: 37885 - DNA, 266 bp, Homo sapiens
  chr20:3063125-3063391
  hyper
gtggtggcgggggtccgcgctcccacctctctccctttccctcttcccgccagagactgagacagacgcgaggccgtgcattggcggaggtttattgtccgtgctgcaggggcgggcgcgaagagcgcgccggtggggcgagcgcggggctcagtaggcgtcgggctgggcgggctcgaagggctcgggcgccccggccagctgcaccagccgcagcagcaaggccccggccggcccgtccagctgcgtggcgttgctccggtcgc

SEQ ID NO: 37886 - DNA, 185 bp, Homo sapiens
  chr20:3063622-3063807
  hyper
cgtcgttgcagcaaacgccgaaggcggcgcagcggcccccgctcccgcacgccttctggccggactggcagggcgacggcaggtagttctcctcctggcagcgcagcgcctcagccgtgcccacgaagcagcccagctcgtccgcgcagcagatgctgggcccgaagcagcggcctttgcccccg

SEQ ID NO: 37887 - DNA, 141 bp, Homo sapiens
  chr20:3073251-3073392
  hyper
ccgtgttccaagtgacgtggcctgtcgcacccgccggggacaatgactgcggccctggggtcccacagacgttccctttgctagacttaaggaagagctaggcctgtccgcgctcccagcccccacgcagccagacacccg

SEQ ID NO: 37888 - DNA, 452 bp, Homo sapiens
  chr20:3073560-3074012
  hyper
cgcagactgctaagagcagcatgagcacggctccggcggcccccagggccccgcgggtcggcgccaccccggagcgcggtgcccggaatcacttagcgccatcagccgggcggctgggagggggaagcggccgatccgggcggctgggagggggaagcggccgatccaggcggcagcggagggggctgcagcggaggcggccccggcttgcacgctcgcccttccgcctgcccggcagggccccgtctgagccccaggccccaggcccagcggcgccgctcgccggtgaaggaaaccagcgcagagaggccgcgctgccaggcgcgtggtggtccgggggtccacgtgtgagcctcgccctaggctgccaattgagagttccacctccgcccagagagaccccacctcacccctccaacctggggcgcgcgggccggcggaggggtcctggg

SEQ ID NO: 37889 - DNA, 133 bp, Homo sapiens
  chr20:3218701-3218834
  hyper
aacgcccattgcaggcgcagttcccccgacccccgtcacgcgccccgggtcacacgggggccgacaggcaacggtctccagtcctgggaccgcgtcccggccgcctggaagccagagccgttggtccaaaagg

SEQ ID NO: 37890 - DNA, 190 bp, Homo sapiens
  chr20:3220823-3221013
  hyper
tcagccgcgctgggacggagtcctcggccactgtgccctaaccatggtagaggaacggggacaggccggggcaagcccacctctgcgaaggaagggcttctggcgcgttggggaagcctcatgcatagattgggtgagtaaggctggcccagttctcctcccggcaagataagaacgcattaggagggaa

SEQ ID NO: 37891 - DNA, 39 bp, Homo sapiens
  chr20:3229253-3229292
  hyper
ttcctcacctccctgcgcggccagcgggggcccggggtg

SEQ ID NO: 37892 - DNA, 57 bp, Homo sapiens
  chr20:3229576-3229633
  hyper
gttcctactacagctcggccgcggcaggctggggccgagaaccggcacccgtgcacg

SEQ ID NO: 37893 - DNA, 30 bp, Homo sapiens
  chr20:3388937-3388967
  hyper
agatcctagctctaccggtttctgcaggga

SEQ ID NO: 37894 - DNA, 238 bp, Homo sapiens
  chr20:3641310-3641548
  hyper
cggggaccctgagggcgaagtcatcggcccacccgggcggagatatcccctggagaacccccgccctcgcccggatcccggccgcgcgtacccacgaggcccgcgtaggcgcgcaggcagcgggcgccctggtccagcaggcagccgtcgggggcgctgggcgctggggtgcacgagacctgaaaggccaggaggcgaggcctgcgcggcgggagggcggtgagccggagagaggccc

SEQ ID NO: 37895 - DNA, 190 bp, Homo sapiens
  chr20:3641773-3641963
  hyper
cggcgcagggcccggcggcagcgggcgcggggacagcccccctgcgcagcccggcccaggcactgcgccacatactcggagcgcaaacgctggcaccgcgcgtccgccgtgcaggcttcggccgcgtccacacatcggttccctccgaccgagctcgccgaccctgggaaaggcgcggggaggctgcagg

SEQ ID NO: 37896 - DNA, 246 bp, Homo sapiens
  chr20:3662517-3662763
  hyper
gcctgcccctcagggcgcaccccgcccgcgtcctcaccttgaagcaccccggcgcctggcactggccagagcagcagcagtagtagcagcagcagcaacggggtcccccgagctctccggggcctccagcccatagctgtgagctcctcggcctctaggcagcggctcgcaactccggctccgcccaggctggattgcggccgacccgtgcccggtgcagcctcaggccgccgccttcggaccttc

SEQ ID NO: 37897 - DNA, 156 bp, Homo sapiens
  chr20:3663018-3663174
  hyper
aggttcttggaggaccgcggcgtggtgggatgaggcggtgggcaaaggccgcctctcgctgctgaagttggccccaggagcgcgatcttccgtggtctcctggggccgatctctgtcccctccttgctacccgtcctgccccgagggtgccctggc

SEQ ID NO: 37898 - DNA, 146 bp, Homo sapiens
  chr20:3713305-3713451
  hyper
ggcggcgcgaggaggcgggaggcctcagggccgggcgcacgtcgagggctgcggccgccgcagcgggcacggccaacgagctgcgggcccgggatcgcggcggctggacggggctggagctgtcgggagggcggaggtgagttctg

SEQ ID NO: 37899 - DNA, 821 bp, Homo sapiens
  chr20:3758266-3759087
  hyper
cctccctactcctggcgatcccacgcctcaccccttcctctccagctgctgcggtctccgtcgccgaggtgggtcccaggtaagctcccaggaggggcaggggagcccctcagcggcccgggacagattcccccatggctgagggcatggggaactagcctggatggagacgccgccgtcctcggagctgggcggggacctgattctgggggtgtggacagagccaagggaccgccccccaaggcccagcgccgggagatgcaaggccgggcccaaggtgttggacactgctttgggggacaggctaggtctctgcacgtggcttctgggctctggaaagcggtccattctcctgacccggatctccggagtggtaggaggcggctcagtcccgggcctgcgctcctagagttcctgtcccatctcctcccacgctcacccatcccaaggaaggagggcactcgggccccagcaggctcgtgagagcagcgggctccgccctcccaatggtctatccatcggtgggtgggtccggcgcggcgtcggggctctggcgggtacccgggcgtccccgcgcggcccgggccgccgctcaccgctgcttacgctccgcctgctggagccgccgggagaggtcttcgatccgcacattcttgagctggagcaggtgctccaggcgccttaccttcatctgcaggacctaagccgcaccgcgcaggcgtcaagcctggcggtctgctccctcctgcccggcctctgctggccgcgagcccccacccgcagccttcctagacccctcacctgcacggtctcttgagagg

SEQ ID NO: 37900 - DNA, 48 bp, Homo sapiens
  chr20:3766983-3767031
  hyper
cttgttcttcaggatcgtgctcagcgtggacggcgggatgttgaagcg

SEQ ID NO: 37901 - DNA, 154 bp, Homo sapiens
  chr20:4202578-4202732
  hyper
tggtggccgtagacacgccagagagggcggcggcgccggcgacgacggcactggcagcgcaggagacggaggaaggcgcgcttgaactcgcggctggaacaggggtagatgagcgggttcacgcagctgttgaagtagccgagccagaagatga

SEQ ID NO: 37902 - DNA, 113 bp, Homo sapiens; identical to SEQ ID NO: 13641
  chr20:4229392-4229505
  hyper

SEQ ID NO: 37903 - DNA, 827 bp, Homo sapiens
  chr20:4229735-4230562
  hyper
tcctgtgacgcggagcgcggctgtccgagagcggagctgcctggcccgggcggcggccgggctccccgaggccggccgtggagtagcaccgaagagccggggcccgctacgcgcgcggcgctctgagcgtgcccggcaagcgggcaaagcggcggctccggggccgggcggtgcaggcagcggccactgcggcgctcccaactcggcgcggggggcgggaccgaggaggggcagcgccaggaaggaggagggggcgacccgggccgagagacgggcgccacactccagggtagaagggacccttcgctcaggacaagcgattgtgtcggggtccggggggctgcggcgctggcgcgcgctcgggtcccgcagcagccacccacgcctctccgcaggtgcccaagcccgcgctctcccctagcggtgccctttgcgttccttcccgctcctctcccggaccccctcccccttggccctcagcggcgtccctcttcctcccgccctctcccccgagtctctcggtcactcgctggtgcccttgggcgcgcggtgcgttgaaggcgtgagtcccgggtcttcgggatcccggctttggccgccagagagcagcaagcgcctgggatctgcggactgcggaccggacggcgcagtgccgctgcgggttgcctcctgggactgcccgcatggatctgccgcacctcctttttctcacgccactggccagggcagggtttcagacgcctctgtccagtgcgatggcgtgaagagagcccaggaagggtcggaagcctgtgctgggcagaggctgggtacgatgggctcaggag

SEQ ID NO: 37904 - DNA, 960 bp, Homo sapiens
  chr20:4803007-4803967
  hyper
ctctcccgaaaaacacgttctaggcgccgggattccagatacctgggaaatagagtgcacgcagctgttgagaggcctcgcgcttggcttctcctatcactgaggcgcagaggtgctgtggacagcccagacccacacggcgcccgaggtgaaacagaaccctcagtctccctatgaggccactggcactctcggctgtccccagagctctccgacttagagctgaatgcaaagtaagcgctcgaaatgcagaagtagccggggccgcccacggcacctgcctcgctcggggcgagagaagacgccaggctgaggtcccagcgacctcaggcaccagctccgaaggagggcggggagaccgcaaaggggaagtgcccggagggccaacggcccccgcgcaccctgcgcccctctgaagcgcgccgcctccccgcgccggggactgggacctgcctctggggaatccgcctagaagacggcggcggactggggtcgggcactctccagggctgtcaggccctccccagccctgcacctgccgcgccgccccacctcgccaggaagtctcagagaccccggggatggggtgggagcgccttcccatcgcgggctcaaaaagaaggaaggacgcccccaggggtcgtagaaggaggactagctccaagccacaactttcttcggacccaaggcaggccggctggggctccgcgcctacacggcccctggcgggggtccgcgcgccccgggagccccgcggctcggggaggaaagaggagacaagagacaggcgaggattacggggctgacccagccggggtagggaccatcgtggaaaaactttggcgaggtggggggacgcggaaagagagcggcccgcgccctgcaccttgcgccgggcatcccgcgccagtgcctcgctcccagtgccccgcgccccgcgccccgcgccttgccttcacc

SEQ ID NO: 37905 - DNA, 30 bp, Homo sapiens
  chr20:4981307-4981337
  hyper
ccccagcctgcaggccgacatcctatcagc

SEQ ID NO: 37906 - DNA, 797 bp, Homo sapiens
  chr20:5296251-5297048
  hyper
tttggtccactcctgcgaggggaggagaacgccgagggacaggaactgcgcgccagcaaaagacaccctaacctggggtgcgcccgccagctgctttcccaaggtgaaaacctccaagaggcgagatgcaaatcccagtggcgtccacacccggaggtgtcttctctccaggtcgcccctccgtctcatgcgacaccccaatccccgcagcctctgctcagcgtgggaccaagaatggggagtcctacccctcctcggctttccagccccctaacccaagacaagagggcgcgcgcccgggctgggacaggtcccagccgcattttcgtagattgcactccccgcccgggagcgacccgttccagcagcccccttcccgccccatcaacgcggccgcactgtcggcgtctagaggcgacatcctggcaaagacaggaatcaagtcagaaattcaggctctagaagcaaaggctgcggtgcctcctggctggaagaaaacggcgggtgggtggaggatgcggtgcgcgggaatttccccacggacgcttgctgtttcctgctcacctttcaggaaggtgcccctctacctgcaccctcccctgcaatttggagctcgtccgcgagctcagctacccgctggctccctctgcccgcgcccgcacaccacagactccgcttaccgtaccctacccggtcctagagggcccagaggggatctcctgaaaccaactcgcctgcttggagccagccccgacgcatatctcgagagtggcgggaggcaaagcagccggaatgcc

SEQ ID NO: 37907 - DNA, 194 bp, Homo sapiens; identical to SEQ ID NO: 4735
  chr20:5297225-5297419
  hyper

SEQ ID NO: 37908 - DNA, 65 bp, Homo sapiens
  chr20:5297672-5297737
  hyper
cgtggcaccgcacccgggtcgcgcgcgcaggaggggagagtcctgtcttccggaggtgcccagtg

SEQ ID NO: 37909 - DNA, 180 bp, Homo sapiens
  chr20:5892057-5892237
  hyper
ggctgagctagggggcgcccgctcctggctgcccgctcctcccggccctgcggcccccgcctgccctttaaaagagcggggcctgcgccggccgcgccacaccgcggggaccaggaggcacgctggttttccggggccgctccatcgcgccttcctcctgcgcctcgcttctccggtcca

SEQ ID NO: 37910 - DNA, 495 bp, Homo sapiens
  chr20:6032710-6033205
  hyper
cgcagccctgccccccggagcgcacgcgcagcctggctctgcgctcaggccggctgaaaacgcggggcgcccggactcaccccgttcaaggaacgtgccgctgagatccaggacttcgagcgtgaccaggggcgcgccatcctctccagcgaacgccgcctcggcgatgcccccctgggctccgcgacccagcgcggtgcaggagaggttgaggagctgcagcgcggggaagcaggcgaaggcccggggctgcagcgcccgcagcggattcccggcgagcgccagggcgcggaggctgctcagcgcgggcccggtgcacggcggcagagcggccagctggttgtagctgaggtccagggtgtgcagccccgccggcccacccgggccccagcgcagcgcggcgatgcggttgtggcgcagggtcagcacctgcagctgctccaggtggccgagctcggaagtgctcagggcgcgcagcaggttgtggctggcgtc

SEQ ID NO: 37911 - DNA, 256 bp, Homo sapiens; identical to SEQ ID NO: 13649
  chr20:6033206-6033462
  hyper

SEQ ID NO: 37912 - DNA, 76 bp, Homo sapiens
  chr20:6103795-6103871
  hyper
agggcaaagggtggccgaagggctgctcggcggagagaaggcggcgagaacccggggcgcacgctcagtatctgca

SEQ ID NO: 37913 - DNA, 187 bp, Homo sapiens
  chr20:6748784-6748971
  hyper
gagagcacagccacccgcctcggcggcccgggactcggctcgactcgccggagaatgcgcccgaggacgacggggcgccagagccgcggtgctttcaactggcgagcgcgaatgggggtgcactggagtaaggcagagtgatgcgggggggcaactcgcctggcaccgagatcgccgccgtgccctt

SEQ ID NO: 37914 - DNA, 757 bp, Homo sapiens
  chr20:8112265-8113022
  hyper
actcaaggagaggagcgggagagggcaccctctttcttcctcggaaaataaaacctttgctttctttaggatgggctttctgtctcgaaagcacaacgtaaccgtttgcccgggtttcaagatcagcgcgctgcaaactctcaggcgcggccaggtttcctcaaagagcctctcaactgcgctcttctctgctgataaatgataattctcttcaaaaagctggtttgtggctggcgctggagagctccagctagagccaaaagccaggggttgcctctttggttcctcccgatgggccccttttcccagccagttgggatccaaagacgctccggagctcgagcccaaattcccaagaaaaccccaaagagcgtaaggctcctggggacccctagcacctctgcaaccagggcacggggcatgctcagagcgaatgcgggaggcaggcgttggctgcaatggggctcgggagccaggaggtgccgctgcgtccccgcttcctggcgcctgacccagcgtgcaaagttgggctgggagccgcggggggaaggaaggacccagcgagcgagggtggcggggaaggggggcgggggggaggaggagggaggagggaaaagagcggttagggggggcgccgggcgtgtgtcactcgctctctccctctgtgtatagaggatgtgctgaatggtgcgctttgaggcggcggcggcggaggagcagaatccgccgcgactggcagcctcggctgaccggctcg

SEQ ID NO: 37915 - DNA, 356 bp, Homo sapiens
  chr20:8113288-8113644
  hyper
atgagcccagatggccggggctcaacccggagtgcacgccttgcaactcaagcccgtgtgcgtgtccgacagcctcaagaagggcaccaaattcgtcaagtgggatgatgtaagtattggggcggcccgagtcggggcgctggctcgggcaccgggcagggcgggcgtcgtgggggtggggcaaggggcgcgttatgcaatgggcgcactgggagcgggcaggggcagcctcgggcgcacaggttggcatctgccaaagcggatgtccaagggcagaagctttgcgcgcgctcctgtttcatcgggcttcagtagttgccatcctttctgggtctggcaggcgccccctgagggtc

SEQ ID NO: 37916 - DNA, 30 bp, Homo sapiens
  chr20:8113912-8113942
  hyper
cagccaacaggtggtcgttgatgccaaact

SEQ ID NO: 37917 - DNA, 50 bp, Homo sapiens
  chr20:9487096-9487146
  hyper
ctccaaactggttggcgtggcacggggttggcccttggcttcgcagtgcc

SEQ ID NO: 37918 - DNA, 81 bp, Homo sapiens
  chr20:9487211-9487292
  hyper
cggactttaggtggacccggaatggaaggagggtttttgctgcccgcatgcccccagggctctttccgggaaatagaaggg

SEQ ID NO: 37919 - DNA, 180 bp, Homo sapiens
  chr20:9487540-9487720
  hyper
gggccacccatccctcggtccctgagcccaccctctccctgcaggcacagctatcccaggttccggcccatcaagttgggaaatgagacgatccatcagtgccaggctcccgggagctgcagctggctccaagtgcgtggccggaggcgtcccccatctgcacgagtccccagagtcacc

SEQ ID NO: 37920 - DNA, 159 bp, Homo sapiens
  chr20:9487788-9487947
  hyper
cgcgttgcctgctgtggctttgctgctctgggctacaaggccgggccggcttgggttgagactcccgaggctgcaggcgaggcggtgggtacaaacttccgtagatcctgctgtttctctgaagaagaagaaaaacattggccccggagaattagataa

SEQ ID NO: 37921 - DNA, 184 bp, Homo sapiens
  chr20:9488328-9488512
  hyper
cgcacctggcgggctggaccgggacagggggcggtgcgcaccggggctcccaagcagccttagcggtggagaccttccgaggggaggcgagcctgcggtttgtctcccgttaaggtggaagactggatttttcctccagttccgatctagggtgaagtcccttctcccgcgccctcatgcccag

SEQ ID NO: 37922 - DNA, 245 bp, Homo sapiens
  chr20:9489471-9489716
  hyper
gggtttggacctagccgttgcaagtaggcatgacttttatcacccatcgctatacccagagcagctgctcgaatgtgccaaggagcccaactcgggtgcaaagcgccgacgtctttcccaggttgaggacatcgcgagccagaggtgcaggcagcgaggcgcccaacagtagaatgcatcttccttcccgcgggcagaagccgtcaagtctggagtccgcagcgggcgcgcgggccagcccaggg

SEQ ID NO: 37923 - DNA, 314 bp, Homo sapiens
  chr20:9495258-9495572
  hyper
ccgtggaccgccgtgcggtcctttcctccgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccgtgagtagc

SEQ ID NO: 37924 - DNA, 4 bp, Homo sapiens
  chr20:9495573-9495577
  hyper
attt

SEQ ID NO: 37925 - DNA, 30 bp, Homo sapiens; identical to SEQ ID NO: 13658
  chr20:9496079-9496109
  hyper

SEQ ID NO: 37926 - DNA, 201 bp, Homo sapiens
  chr20:9496330-9496531
  hyper
ttcctcaaggctcttcgaagacctgggttgcccgccttctttcccacaccccggcaggctgctcccgaatgctgcatggggattccagcttgtaatgccttctgttcccctgcctgctttgaaagtaaacccccttctctccgcttccctatcggggctgcacgtagagcatctaaccgcatgttcccggaacctgggatg

SEQ ID NO: 37927 - DNA, 253 bp, Homo sapiens
  chr20:9496580-9496833
  hyper
cgccctttacagcccccgccccggggccgggcgagctgagggggcgcggggcgtctgtgttcccagctgatcacagaacaggccgatatcgcattgacccggggagctgaggtgaagggccgctgtggccacagccagtcggagctgcaagtgttctgggtggatcgcgcatatgcactcaaaatgctctttgtaaaggtaactccgagcccagcgggcagaggggccgcaggctccgcgtgggtgtgggaag

SEQ ID NO: 37928 - DNA, 5 bp, Homo sapiens
  chr20:9819319-9819324
  hyper
tgctc

SEQ ID NO: 37929 - DNA, 248 bp, Homo sapiens
  chr20:9819466-9819714
  hyper
cgctcccagcgccatgttcccggtctccccgggcgcacgctggggaactactactggctgggtaggggcaaggggggcgggggccagcgggagggggtgagaggcagagccacagctttctactctccacccaaacctcccccagctactgagcatgcccagctgcccggcttcgcccctcggaggactgtccatgagcgtacgcagctgctccgggttttcgtggcagccggcgggaggcaggctgt

SEQ ID NO: 37930 - DNA, 310 bp, Homo sapiens
  chr20:10198421-10198731
  hyper
cctgatttgagcatccgagggccccccgaggcagcctgcacgggtaccccggggtttgcgcactgagtgaacccccagattcggccgtgtcccagccgtccttgctctgaatcccccacctcctcccggccgtttggacggttccctcggggcgtctgtgcctccgtggggtacccctaagacacccagcatgaaaccccagcaccgactgcaaattccaccgaaagcagagtcatccgtttttgccctcggcaaacaactcaacttcaagcctcgagtccttgcaaacccacgctggctgggctaactc

SEQ ID NO: 37931 - DNA, 15 bp, Homo sapiens
  chr20:10198940-10198955
  hyper
cggggatgcccctac

SEQ ID NO: 37932 - DNA, 313 bp, Homo sapiens
  chr20:10199315-10199628
  hyper
tagaaggtgaaaacacgcaggtttgcaggccagcgcactgggaaccgagtcaagcgcgccgcagcccgggccccgcccccgcccccgccgtgccccgcccccacttcctcccgcccctcgctgggcggctattaaaagctgctgacgtcaaaacggacggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggta

SEQ ID NO: 37933 - DNA, 37 bp, Homo sapiens; identical to SEQ ID NO: 13664
  chr20:10200078-10200115
  hyper

SEQ ID NO: 37934 - DNA, 43 bp, Homo sapiens
  chr20:10200153-10200196
  hyper
cgcctgctccacgtcaactgcaggctggcgggaggcgggcggg

SEQ ID NO: 37935 - DNA, 78 bp, Homo sapiens
  chr20:13200556-13200634
  hyper
taaatctttctaggacgcggagaaggaaggtaggaaattggggagggggaaagggaggcgtgccgtcaagaaagagtt

SEQ ID NO: 37936 - DNA, 367 bp, Homo sapiens
  chr20:13201198-13201565
  hyper
cctgagcgcctgagccgcgggcactgcgtctctgcagcttccagccaacacctgcgcccgtgaccagacgaacgcctagagagtcggactcccctcccttcccaggctctacggggcgccgcggatccgcgaacagccgtgcccggctagcgggcggcccagcaagtgtcaagacccttcggaacgacactttggcactcctcctctcccccgactgcttcaggcaggggtcgcaggcagacgcatggcttgtccggcgccccctccgttttccatcactgcaactccagctccagtttgccaataaaggtttctaaagcagcccaggcaccaccccacccacccacagccccgagcctcagtgtgc

SEQ ID NO: 37937 - DNA, 30 bp, Homo sapiens
  chr20:13202494-13202524
  hyper
gcgcggctcgggagccgccgacgggcccga

SEQ ID NO: 37938 - DNA, 121 bp, Homo sapiens
  chr20:17206513-17206634
  hyper
tagctttgaaacagtcgtcctcatttcgttacatacagaacgttcgtgcttcctccctctcaggcaagaagcggagtccgtcgtcagcagttagcagagtccagtgcgagtgcacgtttct

SEQ ID NO: 37939 - DNA, 41 bp, Homo sapiens
  chr20:17206884-17206925
  hyper
tcctccagtcaccatcgcgggtggggcgagccgggtctcct

SEQ ID NO: 37940 - DNA, 250 bp, Homo sapiens
  chr20:17207260-17207510
  hyper
cggggcctctgagagcggcacacaccgtaattcccttcccagagcctacagattcccacaaacaatgacatcactccgccgccgctggcctgattacagctggggggattttcctgggcgcgcggcgggccaggctgagatgggggagctctccggtgctgaaaggggcgggggcgcgggctcgctgcgctgcgctgcgctgcgctgcgcccccagaaggcggaggcggccgggccgggccgggccgggg

SEQ ID NO: 37941 - DNA, 56 bp, Homo sapiens
  chr20:17207874-17207930
  hyper
tttgcaccctccctccgagtcccctgctccgccagcctgcgcgcctcctagcacca

SEQ ID NO: 37942 - DNA, 268 bp, Homo sapiens
  chr20:17208389-17208657
  hyper
caggatgccatgctccggggatgctgtccgaggtaccaagttctcgaggctgcctggggatggagggatgaagccctgaacagctaagcctggcgttggctacttggccagggaagtctcccccacccccatcccccggagaaagaatagtttcctacagacgaggctggacgtttggacactgcaattcacctcggtgtttctcccaccccgcgccgggaggacttccctcccagggacttcggtccctgctcctctccgggaacaa

SEQ ID NO: 37943 - DNA, 64 bp, Homo sapiens; identical to SEQ ID NO: 13668
  chr20:17208739-17208803
  hyper

SEQ ID NO: 37944 - DNA, 40 bp, Homo sapiens
  chr20:17209595-17209635
  hyper
gctgtggttttggcccgtggcctgccggctgttttgagag

SEQ ID NO: 37945 - DNA, 39 bp, Homo sapiens
  chr20:17919829-17919868
  hyper
gtggctgtgctgggtcgcccctgccgcctacaggcagaa

SEQ ID NO: 37946 - DNA, 289 bp, Homo sapiens
  chr20:18039647-18039936
  hyper
agctgccgggtgctgcgggggcgcgtctggtcagggatgccctggagcccaaggctcacccaacagccagcctcacctgtctgtaacctgaccctccgcgctcccagcctacagggcccgggaatcaacacagcggttttccctgttcccttccgccctgaatggcccttggggacacaaccgcctggtaacggatttctcggcgctactggcggactcgcgcggcgcagggagccggggcgcagctctgccggggctgcgggcgggaccggtgcgcggcgcctctagg

SEQ ID NO: 37947 - DNA, 57 bp, Homo sapiens; identical to SEQ ID NO: 13669
  chr20:19192824-19192881
  hyper

SEQ ID NO: 37948 - DNA, 257 bp, Homo sapiens
  chr20:19193359-19193616
  hyper
cgggtgggagcgcagcgaggacgcgcggctgctgcgcgcagggctgcctcctgccgctgtccccgccgcggccgcccgcgacaggagcggccgccgcccgccgaggccgccgcccggccgcccgaggatgcggccgtccggcgacgaggaccgcgcgcgtcgccgccgccgccgccgccgccggagggaccttctgctgagccagctctgcttcctggcctcggtggcgctgctgctctggtcgctgtcgagcctgc

SEQ ID NO: 37949 - DNA, 111 bp, Homo sapiens
  chr20:19739455-19739566
  hyper
agctttgatccccagcgcggaccccactggtgagtccagccagtgtgcagggcagatgctccgaccggagatttcctcccccgggtggaaaagcaggagggttgttgtgtc

SEQ ID NO: 37950 - DNA, 174 bp, Homo sapiens
  chr20:19739612-19739786
  hyper
cgggcggaggaggagccccggattcctgccgggaagggacggggccactttcccactttgaggcctccccgcccccttctgggcttggcctccacccttggcctgggctcccaccagctcggcgtccacccaccggcggtggcgcgcccctcgaccgcgcggggacagcaggat

SEQ ID NO: 37951 - DNA, 1028 bp, Homo sapiens
  chr20:20344402-20345430
  hyper
tcctcctgcggcaggcgaggcggggtgcaggtgtgagtggggtgggaggaaggggaaaggatcggggtcgccgcagcctttctggtcagtttcgctgggttttgtcagttccgtttgagaccgaggcgcacggactagcggccgccagcacctcacaggtggaggacacctcttgcgccccaaggtcaatgtcatcccgatgggtcccgtgccgtcctgactctccctgacctaattctttggttatgactttctcaccttctgggcttcgcctctgccagctttcgccgacgtcgcccttcccgccgcccgcccgggccttcctacccgctctcctccctccctggcccgacggtcccactgaggcaaaaacaaacagccctgagggcacttcaaggagcgtgcagtggccccgacggtactctcggggggataaaagaggtggccagccacgccgtcggcccccggccgaataatgggcgcgcagcagattgccagggggcacttgaaactcgaggggagggaaatacttgagcgcggtccctccccgcgaggacgcacgacgcagcctcgcggatcgtcccttgttcgctctctttcatgcactctccttttgtgtggaattatctaaacgggagatccctggcagctttatgctaatgcgccgaacaaaggcaacggcccgcgggcgggaggcccggaaggtgcctggggccgggccgggcggggtggcggccaggcgggctgcgcgtgtctctcgcgtgcccctgggactgacacaacaacccctcattcctgcaaatacaaagcctctcaccggctcgggtcgggcgcacccggcgcagggaggcgctggtccctccgggcggcgggcactgcagcggtaacgcacggttcctgccggttgtggctcgggggactgagggccgggagtgggggcttctgtgaagccagaagagaagtctgcagcagagtggtgatgaggggcgctgacacctcacccccaacgccgacgtctccaaacgcga

SEQ ID NO: 37952 - DNA, 10 bp, Homo sapiens
  chr20:20346166-20346176
  hyper
gggtggtgaa

SEQ ID NO: 37953 - DNA, 377 bp, Homo sapiens; identical to SEQ ID NO: 1426
  chr20:20347333-20347710
  hyper

SEQ ID NO: 37954 - DNA, 486 bp, Homo sapiens; identical to SEQ ID NO: 1427
  chr20:20347736-20348222
  hyper

SEQ ID NO: 37955 - DNA, 28 bp, Homo sapiens
  chr20:20348257-20348285
  hyper
cggctccggctcgcggattgaaccctcc

SEQ ID NO: 37956 - DNA, 1781 bp, Homo sapiens
  chr20:20348765-20350546
  hyper
ggcgcagagctgggccgagccgtcgccggcgccacgcgagtcccgcagccgccgcgcccgggcaatgggccgggggcactgagggccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgcagggcccgcgggccgcgcacttcggcaaccccgaggctgcgcaccccgcgccgctctacagtcccacgcggcccgtgagccgcgagcacgagaagcacaagtacttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctcaagatgggcacggcgttctcggctggcgccgaggcggcccgcggcccgggccccggccccccactgccccctgccgccgccctgcggcccccgggaaagcggcccccgccccctaccgccgcggagccgcccgccaaggcagtcaaggccccgggcgccaagaagcccaaggccatccgcaagctgcacttcgaggacgaggtgaccacgtcgcccgtgctggggctcaagatcaaggagggcccggtggaggcgccgcggggccgcgcggggggcgcggcgcggccgctgggcgagttcatctgccagctgtgcaaggaggagtacgccgacccgttcgcgctggcgcagcacaaatgctcgcgcatcgtgcgtgtggagtaccgctgtcccgagtgcgccaaggtcttcagctgcccggccaacctggcctcgcaccgccgctggcacaaaccgcggcccgcgcccgccgccgcccgcgcgccggagccagaagcagcagccagggctgaggcgcgggaggcacccggcggcggcagcgaccgggacacgccgagccccggcggcgtgtccgagtcgggctccgaggacgggctctacgagtgccatcactgcgccaagaagttccgccgccaggcctacctacgcaagcacctgctggcgcaccaccaggcgctgcaggccaagggcgcgccgctagcgcccccggccgaggacctactggccttgtaccccgggcccgacgagaaggcgccccaggaggcggccggcgacggcgagggggccggcgtgctgggcctgagtgcgtccgccgagtgccacctgtgcccagtgtgcggagagtcgttcgccagcaagggcgctcaggagcgccacctgcgcctgctgcacgccgcccaggtgttcccctgcaagtactgcccggccaccttctacagctcgcccggccttacgcggcacatcaacaagtgccacccatccgaaaacagacaggtgatcctcctgcaggtgcccgtgcgcccggcctgctagagcgcgccctccaccccggcccccgaactgtgccttcgcttggagacccacaaagagagtgcgccctgcactccccgaacccgagtccgcgctgggggagcc

SEQ ID NO: 37957 - DNA, 303 bp, Homo sapiens
  chr20:21080654-21080957
  hyper
gcaaattctgacctccgatggcgcctatcaattaccccgcccgcagtgaaagcgaaagcgacagtttcttctcttcgcttttttttcttttttaagaactcgaaaaaggaaatatttgcaataagcaggcggtagtagcacttcgtagctggaattatttaattgaatcttcaagtttttagggatgcccgtagaggataaaaccccagtgctcagcggagagggtgggaggggtacagggggcggaggaatctgttggtttgactgtacacctgcgggcggcggcaaaatacagccacgagc

SEQ ID NO: 37958 - DNA, 817 bp, Homo sapiens; identical to SEQ ID NO: 1430
  chr20:21081028-21081845
  hyper

SEQ ID NO: 37959 - DNA, 30 bp, Homo sapiens; identical to SEQ ID NO: 1431
  chr20:21082094-21082124
  hyper

SEQ ID NO: 37960 - DNA, 1067 bp, Homo sapiens
  chr20:21082215-21083282
  hyper
cgggccccaggttggagtagccacgctagcggctaggccgttccaccgggtagctccgcccttccttttgctcaggcagctaactttggagccgggcaagacgtgttttcccgctccttcgaatttaaccgcccagtgcctgcctcctggaaaagctgtcacgattgggcttgggcttgggcttggccttggtcaagaaaggtttcctcggctgcgccaccgtggggatggaggtgggagttggaacacagccccctagctgagtgcaggggccagaggctggcgggggcacgcgggggtggttgggggcggagtgcggcgaggggtgagggcgcgaccgccttggggcaggggcggcgatggagtagctccgggctctccacggactcgattggacagccccaggccggctttggatccttggaggcggatacgcaaggccagacctggtggcgtggccagttgggcatcgcggtatcttccccaggcctggagggcagtgctgaaggcccgcggccgaggttttgctttaagtatacttgggcctcgcaactcagctgtttgcgaacagagacctggcgaatcgccgaggagcggcgcggctccgcgtccccacttcaaggccaagtggagagtgaggacacgctgaggccccctgctacctatcatgccatcttaagcgggcaccgactccttacccagaaaagatcctggagctaaagcctgcgcctacaccagagaggggaatttaagtttcccactctcgacgtgtctggaaccttccctctagccgcatacccacaaccccctgctccctggctcctcccagtgtcaaggaaggagaaagactcccaccctgtccccaaagtctcagactaactcgctccaggtcacaggacccactaagagggcctttccagctcatgcccggaacaggggtgcagcggcgaccctctgggatctggagagagagaatttaacacggccttcctgaagtacattcacgcaaatgtgagaaagacttcaacgcacagaatcgccaaagcccttgccgtcttaaataaatc

SEQ ID NO: 37961 - DNA, 972 bp, Homo sapiens
  chr20:21083498-21084470
  hyper
cagcgaaccccagctcgccggtggccgctcaccccgctcgcctctctctccctctggactcggtgctgaagccccagtgcagctcgctcctccttctgtcagcagctggacccggaagccctgactcccggcttggcgcctgtgctgagagcggagaaggacgtcgcgaccggcaggcctggagggcgcattggtgtgcagagtgtagcggctggtctggccctgggaaccccagacccgcgaagctggagggcgcactccccggcctcagagccccaaaccggaggcgctgtccaaacgcgccaacgctgcaagcaatgtggcagggcacaccgaaatgcgtgtctcgcacacctgcccatctttccctgctcaacacgaaagcgccttgtggctctaagcgcttccttggggtggctggggctgtgcattttaattccaaagtcaagaggttgaaccatctcaaagttggcgggtggagggggcggtggcagggaactagatggctggatgcctttgcctgcggggtggcagggctgtccctaccaatagccacggctcggggctggctttgtagttatttttccaagttctgcccggtgcccatcatattgccctgaaaagcaaaagaggccgatgcaatttattccaatgggcggtttttaagaagctggcaatttgaaccggctgggtgttatttagtgcaatatgaaatcaaatgatcctatttctcaaataacagtgtctgtgaggagaagtgaatcctctgaaagggtaattgtctgctgatggtgtttcccattatacccgatcttggcctaaatggtgttcggcagcggggcggagagcgaggggtgaaatcaatgtgcgccaactcgcgctctggagacaggaaaaggtagcaccgctggcgtcctggcacgtcgagcgaacaatgccaccccacgcgtcactgatcgactcatcttgcag

SEQ ID NO: 37962 - DNA, 377 bp, Homo sapiens
  chr20:21085775-21086152
  hyper
ctgggttcagcccaccgggtcccctttcgaatgccatttcccagctgaaaatccagccagcacagcctggacgccgagccctctggagccctggtcaggacgctttaattttcaccctcccgctctgggtctgaacaacccccccgtcccccgccccccaccccaaggtgttgtttcctagggtcttctggggacatccctacctgtcgagggcctgccctcctcgggctaaaagttcagcccttcgacagagccatggaataagaggcgactctccctgtgtcccgcaagtggtttctcgaggtacccctctgaggctgcagcccccggagcagacctggctctgcatagcagcaaaagcaaccgcctacctgggc

SEQ ID NO: 37963 - DNA, 430 bp, Homo sapiens
  chr20:21086194-21086624
  hyper
cgccggccccctcacccggcgagggccctgcgctcacacttcttccaggggaaggagtggccacgcctgagcccccctaaacgacctcttcaggagaaaagagtgccggccaggagtccctccagtaacctcagtttagatcgggttttcgcgcctcccctaggaatccggctggaaaccccggagactctgcgcctagagttttgcgggcgtctctctgcctccccgcagcttccggctctcgcaggcttcatccactccctcttcccccggacctgcctgaaccccgccgagcactaggcaaggccgggctctgcgggctggggaaaagaaggggcttggggtggcccaacccgaccgccacctcggcccggcctgcggggaaaccccacaaagtcaaggcgcggggcggggtcggggggatgggatc

SEQ ID NO: 37964 - DNA, 282 bp, Homo sapiens
  chr20:21086906-21087188
  hyper
ctgaccttgggaaggcgcagacccaccgctcgccaagcctcgccccgcactgtgcacgggaagagggggctccgcgcgcagcccagtccggttagctggtcggcgtcggcggggctgccgaggtggcgcagagctcccctcccccacgccttataatttaatcacacgcgatattaaattatcaagctgctcattaatcatcacgcgagttattgggactgaacacgccgccgcgtgttttgacagcccagaaccattcgcgggggtcggggtgtgtctggg

SEQ ID NO: 37965 - DNA, 39 bp, Homo sapiens
  chr20:21372154-21372193
  hyper
ccgcgacctcgcagccgggggcgggatggtggcggcgcc

SEQ ID NO: 37966 - DNA, 437 bp, Homo sapiens
  chr20:21372294-21372731
  hyper
cgcccggcgcctgggtctcccctgcggctcgctagtcgcccggcccagcccgcagaccccgcggctggccctcccgggagccccgcgagccggccgcacgcacaggatgggcgcggaaagccccttcctctaccctcgggcgcaccctccttcctcgtccgcggcgccgcagcttctcaacctgccgctgcatctcaactccctgcaagcagcagagctgtagaataccagaaatggtcttccttccgaggctgccgttttaagttccaagtgtgaaagtaaccgaattttgctatgcttagaaatctaaaatctggacattccctgaagagtcaacttagagtccccagtttctcgatctggctccgtcccactgactgacgcctcctgcccaccccgaaaggatcctggagctgcgatctcgccagactctattc

SEQ ID NO: 37967 - DNA, 130 bp, Homo sapiens; identical to SEQ ID NO: 1436
  chr20:21376207-21376337
  hyper

SEQ ID NO: 37968 - DNA, 32 bp, Homo sapiens; identical to SEQ ID NO: 1437
  chr20:21376702-21376734
  hyper

SEQ ID NO: 37969 - DNA, 253 bp, Homo sapiens; identical to SEQ ID NO: 1438
  chr20:21376876-21377129
  hyper

SEQ ID NO: 37970 - DNA, 168 bp, Homo sapiens; identical to SEQ ID NO: 1439
  chr20:21377473-21377641
  hyper

SEQ ID NO: 37971 - DNA, 920 bp, Homo sapiens
  chr20:21377737-21378657
  hyper
cgagacgccgggcggcatgtggtaggtggcggccgccgccgccgcagctgctgccgccgccgccgcggccgccgcgttgtgacccgccatggcgtgagaaggctgcatgcccgccacggtcgccgcctgcgaggagggcccaggtggcggcgcgcggtaggcggccgcggcccccaggggcgcccccaggccgggtggcgcgccgtccatggcgccgctgaacttcttgtaggtctcctcgatggggctcaggatgtcggacacggagaagggcgtcgtgtgctttgggctcaacgacatggctcggcgggcagccaggtaggggggcctggggcgcgcgccggcaggacgcggcggccgctcgtcgccgccacctcggccgcggcagctgagcctgtgacgaggagtcggcggctcggcgagccccccgggctgcgggatctggggtttattttagtccggcgccaggtttacgacagactcggggggcggagcaacatcccaaacgagcaaacaatggtcattgacatctttttctctcgcccccccaacccccgccccataatggaggcaaaaaaaggtaaaaggggcagttgggtgtttcttggaaagatcactccccgttgcttttcccatctttgcttttcccatcctttgcttttcccatccttcgctcctccatccgcggccgttaccccagccctcgagcaccagaaatagaaactcggaggctggcgtcgaggctagacatggactccgcgcctggccccttccagatcccagttttctaaagtgacttcgcaccaaagtccggtataattgcggaatggggaacgtgctgctaagtttggggggagggtgttgcgggggcttgcttcgtcctctccagttatcagcccctcattcgctccatcacctaa

SEQ ID NO: 37972 - DNA, 730 bp, Homo sapiens
  chr20:21485930-21486660
  hyper
ctcgcggagacatctcgagtcccgcaggtgtctgagctgcgctgcgcgccccagccgggaagccttttcttatccaaccgcgccgccccgcggaaagcctgggtactgcagacgccctcaccggcccaccgacagctggttttgaagcgggggcttagaaaagtaaaggggacagtgtttggagccacgatgcctttgatgtgaggcggttccacccaacaatcaacgaatcaagctggaactgcaggccctacttttgttggggggaggaccttaaggaatgtcacccccttgtcccctaccctctgccccacgcccagcctctcagaaggcaccaggcgtgagtagagtgcgaggcgtccacaccctcgtgtcccttccattcccggacacctttgcaccctagccgaggcctcagcacggagtgagggttgcctggggtgccctgctgtgtgtggggcgttcttgcctcccgggccctgaccccacggtctgggtcggcgaggcgtctctccctggcgtctggactgtgcgcctgccccgcttccaggcgacgaacggcaggagccgggggtccggcgggacccggatccagggcgggcggaaggcgagggtctctccttcccggaacccccgccccggaaacctgcaaccaaaccgggtccctcctccgcatcgctcccgcgctcccgggccgcctccccacgcgggcacccactctccgggccct

SEQ ID NO: 37973 - DNA, 132 bp, Homo sapiens; identical to SEQ ID NO: 4760
  chr20:21486785-21486917
  hyper

SEQ ID NO: 37974 - DNA, 627 bp, Homo sapiens; identical to SEQ ID NO: 4761
  chr20:21486954-21487581
  hyper

SEQ ID NO: 37975 - DNA, 356 bp, Homo sapiens
  chr20:21488158-21488514
  hyper
gacccaaattatttccgactgcctcgcgccaatttggaccgcttagaggaggcaaaaaatgggcaaattccttggaagccctgctgtgtctccctggtactgaattttgtaagcacgcgatacaggagacattgaaaattaaagaggaagtatctccctcctccaacatggggagagacgctgttggaagaagtttctgaagtggtttcccatcgcaccaagaggccagtgggatggatccccgcgcataattcaaaggaacgcgcgcgtctttagctcttcggggttggtaaccaagtggtccggccgggcgcaagtcgccttggaaccggctgcagcccaagtctagctgggcc

SEQ ID NO: 37976 - DNA, 206 bp, Homo sapiens
  chr20:21488591-21488797
  hyper
cggggccggtcggttgcgaaatcagggggtggattttcatctacccaggagccgctaagcccgtaggggaccgagcatcacccaggccctgggtaccctgagttgcctcctgagccccaggacggtccgatggtgcagagctcccaggcagaagttagtttcctgatacacacacagcagtgagcaaagtgcgcacaagtgagcca

SEQ ID NO: 37977 - DNA, 57 bp, Homo sapiens
  chr20:21488998-21489055
  hyper
caactttcagtgtcacggggcctaggcggggcaagcgccctccgaagccatcaaaga

SEQ ID NO: 37978 - DNA, 159 bp, Homo sapiens
  chr20:21489288-21489447
  hyper
acttctgcctgactccgggattcactgccggcgataagcgcgctgaatggtgcggggtggggcggggggtggggggcgggccccttctccttcttcccctctctctgtccccgcgatcctttctctgtccctttttaatatgcacgcctctaacatctc

SEQ ID NO: 37979 - DNA, 82 bp, Homo sapiens
  chr20:21489621-21489703
  hyper
cgggcgccgggtccacctcccgggctcccggccggccacaggagcgcacacccagattgcaggcccgcggtcctggccacag

SEQ ID NO: 37980 - DNA, 588 bp, Homo sapiens
  chr20:21490175-21490763
  hyper
tcaattatccaggggcggtgtggaacgcgggaataaagtgtcatcgcgtccctgggctgctgcgcagagtgctatcgacgcacagatttggtcgcacggataatcatgtttgctttagatattgaattaaacctgatcatcaactacagggagcgagaaagtcagctgggaccgctccttttgcccggcctcctcactgccacccaaccccccagccttgatggtgcagcttcggagagaacagagatacaatttccaaatgcgccgacgttcagtccctcagcgtctgcagcacccgctgggctctgagctagagtcccaagtatttttagaaacccgcgagatagaggagaaaggctcatcctccagttggccaggcttcctaagacgctcccccgcgtggccaagtgtgcgccagcatctgccaaggagatcttcctccagcaacaagggtgggacggaatccgttccccgccggaaagatggatgcgcccttcccgggcgtgcccggggctgtgtgcccacttcccatccggggagctcaccccacccccaaacctctacttcctagcaatccacccagttcca

SEQ ID NO: 37981 - DNA, 532 bp, Homo sapiens
  chr20:21490814-21491346
  hyper
cgctggagggaaggaggcccgggatccagtccccggagagaggcctggaagcccggaaaggatgggagcgtaagggaagggagaggcatggtttgctgggattgccaaagattctcgctccctggcttcctggggccaaagatcctagggagggctgcagtatcccctccctcccccgagcccagaaccccgcgtacttcccccaagccccctaagccaaagcctcgcgcgccctgaccgttcccacccccagccttagcggtctcctaggtcagcaccagcccgcagattttgaaaaggagtggggagtggggagaaggcagccagtcttaacctcagacccccacccacccactttcttagcgtgaggtaagtcaaatgtaacaaagtgaaagtcatcgagtgtagtggcttcaacagcttctcaggctgaaggagccactcatagatttgggccagcgaggggggtttgctctcctcgcctttgcggctcccgaagtcacttttcctcccgtagccggacgctgccgcc

SEQ ID NO: 37982 - DNA, 107 bp, Homo sapiens
  chr20:21491616-21491723
  hyper
cggcgcagtaggacaaacgggagggcagggattttttctttttttcttttttaaacacaggatttttattaaaattcttatttaaaaaatcgaaagctttctgcgcc

SEQ ID NO: 37983 - DNA, 319 bp, Homo sapiens; identical to SEQ ID NO: 1445
  chr20:21492507-21492826
  hyper

SEQ ID NO: 37984 - DNA, 111 bp, Homo sapiens
  chr20:21492990-21493101
  hyper
cgctttcgcttcttgccggcgtcccccccgccgcccggggtctccttgtcattgtccggtgactcgtcggccgagggctccggggacttggagcttgagtcctgagggggc

SEQ ID NO: 37985 - DNA, 892 bp, Homo sapiens
  chr20:21493102-21493994
  hyper
ccccggcagccagaccgtgcactggggggagggggagagagaagcgcgtcaggcgtctggaggccgcgcgcagcctgcaccagactcggagcaccctggatcctccgtgcgaccctggacctccgcgcctggcagcccagccccgctgcctttgccatgacccctgccttcctctacgcctgacgaagacgtcgggacctcccagggtaaagagggaaatccgtaggagtgggggctaggggctcgcctttcaaggggctcacatagtgtgggtgagaatttggggggggaagtggcactgaagatcatcgcgggttaagggctccggcgcccttaagcggtttcctctccggcgagacgtgggcagatttttaaaagaaataccccacaatcccagcattgatcggctcggccatttaaggcaggtttttgggggctttcgtttctgctttcgggccttctagacaccccctgcactgcacaaagcgtcctctatgatcgcgcagggggcagggtgagctatttatacccgggccacccgaagcctccccaccctccacccgtacccggacgaggctcgctggctacctccagggcgccaggccagtccctcccagcggccggagtccgggggctgcggctggagccatcggtccgggttgacatcatataccagcccctgggaggtatagcccttctccctctttctccttaacttctcgcattgaaaaaaattttggagaccaagttctttcccggaactaaggaggcttgaagaggagggcagaggacatcctatacaggtgttaaaaatctttctacggatccgagtgagggggtccgggcttacatggccccttcccctttcactcccagcgtccaacccgggctg

SEQ ID NO: 37986 - DNA, 416 bp, Homo sapiens
  chr20:21494360-21494776
  hyper
cgtggcgctcccctgccccggcgggcgggggaggggggagttggggggagggactgggggaggggaggggggaattggctttaattattgggataattattatttttaaaaagagaaagaaactggggatggggaggaaaaaaatgaagcccaacccagtgcctctctctgtcttctttgaaagcacgcggaaatggacgcaggaagccgggcggcctgcgcgccgagcgccgcgggccccggccttagtttctaactccaggaggggtgccaaggcggcgtcagctcgggctccggcggccgctcggcgcgcggtggcggctggtggcgaggaaaaaatgggccattgcccgagcgatcagtccatataaggctgggctccactcacgaacctggggaggcggggagagggggag

SEQ ID NO: 37987 - DNA, 51 bp, Homo sapiens
  chr20:21494991-21495042
  hyper
agatgagaggtgtaacgtgtcaattaattgcaaagacggggcgagcctttt

SEQ ID NO: 37988 - DNA, 536 bp, Homo sapiens
  chr20:21495942-21496478
  hyper
agacccagaaagctgcgggggaggggggtcgctgggtggcccgacgatgcctcgttttctccccagttttcttctcccacgcgagttctttagtgtggtctctttttggacgccttgggtgcgttcggagtacgcgctccacgtttccaggttaagtcaggttagtgtgaagtttccagccactctcggctctgggaactgaactttcccgggacttgcacttcctcctcggcgctggggttggaaaagaccacgccgcatttgccaccccttcttctagttaaaacttttttggggggggggtgcaggggtgtagattggctacctgatgctcgttcgccccagaggagtgtcaggaaggagctttgtctgggggcggggaggggcacagaaggccacccctgcggggtccaggtctagtcttcccacaacctgggctcctccgcgcgggccaagctgagcgcgcgggcaccgggtcctcctcgcgcgcagctgcagcggacgccgccgcgccccagctgcccccgggttgccag

SEQ ID NO: 37989 - DNA, 453 bp, Homo sapiens; identical to SEQ ID NO: 4769
  chr20:21496683-21497136
  hyper

SEQ ID NO: 37990 - DNA, 1522 bp, Homo sapiens
  chr20:21497413-21498935
  hyper
tttggcagcaagtgtcgtttctcgcatatccccagagccctcttaggtgggggagtgcccgcagaggcctcccaaagcgtgttcatttcttcagctgggaaccacctcgctgaagttccatgtagttcccaacttctctcccccttccccagcatagtgaccctttcttctcaggatctaaatcagcaccgctgctattgatcaagtcccctcccctcacccgtgggagcctgcaaggtccgcagagcgcctgagagaggattgctttcctaggggaatcctggctcctggaattaatcacggggagggagtgctgccataggcgcctagagaaggaggccctcagcccagttctcaaaggtcgggtttgcctttgcgcctgccccttagcctcaatgaccagccgaatccttctgggtctcagcttgcggtgtcctcttgtcggagcacctgaggcgcccacttcccctgccctcgcaggacgcctcctggactccggcccctcctacactttcaccccagcgagtcttccagtttttatttcccctggcctgggggcagctgggcagggagggagagaattggagagagcttcggccttgcctcctccgcgatcggtgcttccgggtccacagcactcagcctctcccgggacctcgagactcatttccccatcacttctcgtccgtgtggttcccgcgtccatttccagagcgttaacatttgcaattgaaaaggcgctgggagaccgctgggaggtccgtaattgaaggggagaaactgggcttgttagtggaagatcataaaatgcaagtcccccaggagcggcctgtggacgccgggaggcctgcgcaggcccagctggcggccagggcaagtccggtgcccagagcacagtccagtgtctcctcaatttcttgggcccggcttgcgcccaaagagcctaggggccaggcgccaaacgcaccttttctgtcccaattaaacaggtgattgcatcctgaggactccccaagaggcctccccgagagtaccacagctaggccttctagagcccaggagctttggttctctgcgatcccgcacacccgcaggctgagaggccctgccccgctcccttccccctccggagggttcttcagtaagggcccaccactcccaccctgtcagcgtctgcctgcaccagtttcagctcctggtctcccccactcggcattctttagtaaattctttccaggtaccgtcttgcacccaagcgagttcaatgtcctccgttccgtcaagtttgggtttgagctttgggctcagctgccgtggtctggagacctcgtaggcactctgcaagatgcctcgttctgctgcatgcttggggaggaagttgagctgggtgctggaagttctgaacccagcatgccccgggccggaggagatttgcttggtgtctccttagcgtcccgaacaccgcgcgcccctgctggggtaacctgaacagctggacccctcaactcgatctttattatca

SEQ ID NO: 37991 - DNA, 253 bp, Homo sapiens
  chr20:21499324-21499577
  hyper
ggcaccctgctttcccggcttctgccctcccacgcctcagctttacgccccctgttgtgggggtgcgctctaaacaacagcaaaccaggcaagaaaggaagatacaggagagcaggcgaggcctcggcacaccctacggaggggagcctttcttgtgcctgtggaagaagtgggctccgtggacggcatccgaccctccccccatccctgttctgggcacctctttggagacggcgctcgcatccttccccgt

SEQ ID NO: 37992 - DNA, 247 bp, Homo sapiens
  chr20:21500104-21500351
  hyper
gttggagactcagagcgtggcatgcacttgaaatcaatggggaaggaaaatgtcacccaatctggtccctgagtgtggcgataaagacgttcaccttaaggatggcatctccaaaacagccccactttggcttcgacttccaatgcgggagcaggggctgcaggaagcagaggtgtcagctctcacgtcctggatgaaagaaataggggaatgcaccccaggagtactaccccgtgctgggaccttt

SEQ ID NO: 37993 - DNA, 701 bp, Homo sapiens
  chr20:21501444-21502145
  hyper
cgtcagtgttgccttcaggaacgttctttcagccaagcccgaccttccccggatgagggcgatttcaatacgggagatctgggtttctccaggaaacacgcgctgaaagcactctcttatctgaatttacttcttaacacgtgacaaaatcattaccacaagactttggaaaacaagcggctctcctaacgggttgcattcagcacttaaagctgggtcgggcaggctgatgtgaaaagtagttgtcggtggcgcggagaaggcacgctcttagctggagctaagggctggttccgggaaggacagggaatgcacccttgggccctcgggcacagagagggggttcctagggctctgtctctctctctccaatgtgagccccagaggttcacaaccttcccctagacgcaacgtcccctttccacccccaagagccactaaagtcgagaaggcgccagaggagctccaaagggcctcctggtagtgtgtgcgtgtgtgttgtgggaggaggttggggcggagggggcgcccctcggagacaaggaccccaccgaggttcatttctgatcctctggcgatctctactgacacaaacgagaactgtccggcgccgggcgcggcccaggcgacactcgcctcccaaactccagtcttcagtcgcctctccagagacctcagtccactgcgcgggccctcagccc

SEQ ID NO: 37994 - DNA, 257 bp, Homo sapiens; identical to SEQ ID NO: 1449
  chr20:21502443-21502700
  hyper

SEQ ID NO: 37995 - DNA, 280 bp, Homo sapiens
  chr20:21502837-21503117
  hyper
cgcacttgcccacctgctgcgtccggactacgcggcttggggatcgagccgagtcaggacccgggagagcgaggggctcataaccggggtccgccgtgaacccgagctccggcgccgctcggcggcgacgacggtgccccgagacccctctctgctggcaggccgcggtgaccgtgcccggagcgcgttcccgcgccgggcggctgtggcaggaggaccagacagtcagcgcctggcagcgagggcgacgccgggcttcctccatcgccaccgccgggct

SEQ ID NO: 37996 - DNA, 281 bp, Homo sapiens; identical to SEQ ID NO: 4775
  chr20:21503617-21503898
  hyper

SEQ ID NO: 37997 - DNA, 45 bp, Homo sapiens
  chr20:21503899-21503944
  hyper
acttcgcgggaggtcacagacctctcgccccggctccaggctcct

SEQ ID NO: 37998 - DNA, 95 bp, Homo sapiens
  chr20:21682361-21682456
  hyper
cgcggagtttcgttgtgttgttacacaagccagcttttggtttgttagttgttcgcattcccccagggtttgcagctccccgatctggctcagct

SEQ ID NO: 37999 - DNA, 39 bp, Homo sapiens
  chr20:21682946-21682985
  hyper
ccctctgttacttcccgcaagaaccgaaatgcgcacctg

SEQ ID NO: 38000 - DNA, 455 bp, Homo sapiens; identical to SEQ ID NO: 4778
  chr20:21683317-21683772
  hyper

SEQ ID NO: 38001 - DNA, 17 bp, Homo sapiens
  chr20:21683899-21683916
  hyper
cgcggactctgctaccg

SEQ ID NO: 38002 - DNA, 28 bp, Homo sapiens
  chr20:21684347-21684375
  hyper
cgtccccactccccgcacccccggagcc

SEQ ID NO: 38003 - DNA, 30 bp, Homo sapiens
  chr20:21685666-21685696
  hyper
tggttggctattaaacgtgaagatttcctg

SEQ ID NO: 38004 - DNA, 109 bp, Homo sapiens; identical to SEQ ID NO: 4780
  chr20:21686184-21686293
  hyper

SEQ ID NO: 38005 - DNA, 435 bp, Homo sapiens
  chr20:21686294-21686729
  hyper
tcaaattgattcccgcacgctgcagcctcccggtcagacgaatttctcccaatcggatgaagttcaccctgggcctggggtcgcgggcgtggagagtgtcctgggagggggcagcagcggcggcggcaggccctggagcgggcggcagcgcgctccgctgccgcgcacagcgcgtctccagcccgcggctgggccgccgcggctctcggctctcgggcgccctccctctatgcctctcacgcggcggcggcggcgcccaagctctcccggactgcgccgggcccagccccggccaccccggccaccccggcgccaggcagctggccggcccgctcgctatgggtaaggggcgggcgacaggcagggctcgggagggctgatgaggtgggtcgggtccgcctgcctcccttccctctcgtccgctttccctgggcg

SEQ ID NO: 38006 - DNA, 289 bp, Homo sapiens
  chr20:21687009-21687298
  hyper
gacccttggctaacccgccgggtgttttctccccctccggctcactcttgtctggcgcatccgcagagcagacgtatggcgaggtgaaccagctgggcggtgtgttcgtcaacggccgccccctgcccaacgccatccgcttgcgcattgtggagctggcgcagctgggcatccgaccctgtgacatcagtcggcagctccgcgtatcccacggctgcgtgagcaagatcctggcgcgctacaacgagaccggctccattctgcccggggccatcggggggagcaagcc

SEQ ID NO: 38007 - DNA, 45 bp, Homo sapiens
  chr20:21687755-21687800
  hyper
cgggcaggcttgcaggagaggactcacactcgctctcctcccggg

SEQ ID NO: 38008 - DNA, 149 bp, Homo sapiens
  chr20:21689912-21690061
  hyper
ggcctccaaccagcacggcgtgtacagcgccccgggcggcggctacctcgccccgggcccgccgtggccgcctgcgcaaggtcctcctctggcgccccccggggccggcgtagctgtgcatggcggggaactcgcggcagcaatgacct

SEQ ID NO: 38009 - DNA, 30 bp, Homo sapiens
  chr20:21693467-21693497
  hyper
atcccttcccagacccgtgcctcccctcag

SEQ ID NO: 38010 - DNA, 141 bp, Homo sapiens
  chr20:21694434-21694575
  hyper
ccacaggtcccaggacgtgctgtgcccacagtggtgagcgcatctggatccccggacctcgtgggcacaacgtagtctgccgctcacttaaagcgcaactgcctcctacgtcggaggaatccaggccgctccagggaaatc

SEQ ID NO: 38011 - DNA, 148 bp, Homo sapiens
  chr20:21748368-21748516
  hyper
ttaatgggtgtccctcggagaggccgcacccgggagaaagcgctgacgcctccgacccagctccgcgcacagcggcgcccccttctggccctcgtcccgccggagctgcgcttgcgtgaacagccctcaaatgcgtgtttgccctgct

SEQ ID NO: 38012 - DNA, 433 bp, Homo sapiens
  chr20:22557414-22557847
  hyper
gcgataaagattgggcgtttaaattggccatttggaagattacatctcttcagcgagggtctttctttcaaaactcgcactgaattaagggtcatggctactccgtacccggctctcaaaggcacggcacctttgaattaggttgcggagtggcctgggcgaggggacccggggccatcaaaggcccgagggaaggccgtggggcgacacccgtctaatgacaagtaattgaaggattcgacgccgcgcattaccagcggaacgggaggcattaattatttaaaaacgattagccttgccgtgtgtcctgcaggcgtcccatcatgttcagcgaagataaccagccacccgaggcgagccggggctcggagggcggcgggcgcgctccccagcaggcttcgggtgcggtggacacgggcgcacagcccaaggc

SEQ ID NO: 38013 - DNA, 30 bp, Homo sapiens
  chr20:22558084-22558114
  hyper
tgcctgctacccaggcgtttaaagaaaaga

SEQ ID NO: 38014 - DNA, 69 bp, Homo sapiens
  chr20:22558627-22558696
  hyper
agttgagactggactcgaacccctgcgcgccaaggggagggcgtcaccatgctccggcctcagcctctt

SEQ ID NO: 38015 - DNA, 104 bp, Homo sapiens
  chr20:22559138-22559242
  hyper
gctccctacctgcggcggccggcgggccggctggcgggcgggctgcggagcgtccagctcgcggagggaggaggccgactgctccgagccgaggcatccccgca

SEQ ID NO: 38016 - DNA, 44 bp, Homo sapiens
  chr20:22559632-22559676
  hyper
gaaagcgcgcagtggcgatttgtgagctcgttatctcggaaccc

SEQ ID NO: 38017 - DNA, 35 bp, Homo sapiens
  chr20:22559677-22559712
  hyper
ggctaggggagggatttaagcgggaggggggcgtg

SEQ ID NO: 38018 - DNA, 169 bp, Homo sapiens
  chr20:22559973-22560142
  hyper
aaacacatttcaggccgggctcacgacgtgtgtgtccttgctaggaggagagacggcctgattgctggctgtggcctccggatccccccctccccaatttctcttccttgtgttcttcgggacaatgtggcatgttaagaaagggatttggtggcgggaggggggcagt

SEQ ID NO: 38019 - DNA, 97 bp, Homo sapiens
  chr20:22560398-22560495
  hyper
agtgtttttacccaccgcaagccactgcgcgcgggagtggctcccaagtctgcctgacccgcgacgacactgatcctgccctcgcccagccagcaga

SEQ ID NO: 38020 - DNA, 283 bp, Homo sapiens
  chr20:22562603-22562886
  hyper
caggcatgggggaaccgtagccggggtagtgcatcacctgttcgtaggccttgaggtccattttgtggggttggtggtggtggtggctgtggtggtgctgctgctccgaggacatgaggttgttgatggagaacgggtggttgaaggcgtagtggtgttccggcttcaggtgggcctcaggcggcaggcccgggtggtggggcgggcccagcaggtgggccgcggcctgctgctgctgcccgggagagggcgccggctctggggggctcagcgccgcagccgg

SEQ ID NO: 38021 - DNA, 211 bp, Homo sapiens
  chr20:22567354-22567565
  hyper
cgcaggagaagggggcgctacacttccaaggagcggactttggaagcccccacctccaccacagcactattggtggccggggtcagggacaccagagagcgctcggcgggggcttccacagtgacagggcgccccctgtcggccgccaggcccgcgggaccgacccgagtcctcatttacccccgcgatcccaaccccgcagctccggcac

SEQ ID NO: 38022 - DNA, 133 bp, Homo sapiens
  chr20:22567605-22567738
  hyper
cgccttcggggggactcggcctttttggagccccaacccctaggttctgcgcgaacccaaaacggcctcctgcaccctggcgaggttctgggagctccggtagggtagggctggatgacgcctcctagagtct

SEQ ID NO: 38023 - DNA, 75 bp, Homo sapiens
  chr20:23029003-23029078
  hyper
gctggcactggtactcgcagttggctctgaagcacgggtccacgggctccacacactcgccgtccaccaggtcgt

SEQ ID NO: 38024 - DNA, 21 bp, Homo sapiens
  chr20:23029588-23029609
  hyper
cggcgccgggctccacagcca

SEQ ID NO: 38025 - DNA, 211 bp, Homo sapiens
  chr20:23029875-23030086
  hyper
ccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtg

SEQ ID NO: 38026 - DNA, 66 bp, Homo sapiens
  chr20:23030291-23030357
  hyper
cgaggcagcctctgacatgcggatcggccagggctcgagtttataagtgcccggccctccctccct

SEQ ID NO: 38027 - DNA, 30 bp, Homo sapiens; identical to SEQ ID NO: 13739
  chr20:23030745-23030775
  hyper

SEQ ID NO: 38028 - DNA, 45 bp, Homo sapiens
  chr20:23031034-23031079
  hyper
cagaccccatctcatcgggtggggaagtcgcggggacactgtcag

SEQ ID NO: 38029 - DNA, 340 bp, Homo sapiens
  chr20:23031293-23031633
  hyper
atttcgtccagagtccgaattgatacccacgtgcatagaaacgccacttgctcggcaaagggcactgaagagccaccgtcctgtggatgggcagggtggggggggggctggaggaggacatgggaatccgtcactttcgacctcttccggtggttcacttaccgggaatgcggaagagtgggtctccccctcgggtcgcccccataatggtgagaggcaaactgtttaaaaacacccttgcctctctcctctactgtcctcacaacgagcgccagggggcggcgctgtcgagctctaaacaaagccaaggaagttggagaagtttcgggctaaaaagggt

SEQ ID NO: 38030 - DNA, 102 bp, Homo sapiens
  chr20:24449601-24449703
  hyper
ctggagtctgaactccgcgcccgcttgctcctccagggcttagctggtcaggacttgaacattcgccggatccataaattgggtcatttttaacctcaaaac

SEQ ID NO: 38031 - DNA, 945 bp, Homo sapiens
  chr20:24449759-24450704
  hyper
cgggcagcaaattcctgtcctcctagtcccccgcagctatcccccgcccccagcctctgtggccctcacattgtcagacactggccgcgggccaccatctggacgcgatcccccgctagggcctccctggtctgggccaaagttggtggccaccttcgcgcgggctgcgccctccttctcttccctgccctcctcccccggggcccgcgcccgctgcctccagcacgcgcgtcggcaggctcggcaagcgaagaggagcggctcgccccagggcgcccctcgcccagcctgccggccaggcgagcgcgacgagagtctccccgcaccccttcctctcccgggggccgagagggttgggctccgccccggcgccgcagctcccgactccccgccgctcgggctgccgccgctgccccgcgcccggcgctcggggcagccgggggcgcaggcggagagcgcagggcggggagaggcgtggggagcagagcggcgctgaggggagggcagaggaggagagagcctggcagcggaggagcagaggcgggcgccgcaccgccccgcacgctcgctcgctcgggagagtcgcgggcggccgcttgggcgcacttgccgggtcaccttgtcccggaggtaagtccagacctcccggccgcgggggcgggcggaggggcccgcagtgggcggggtcgcggcaggggccgcgagctggcggcgggagctggaggctgccctgcgctggcgggtgtcctagtcctggctccgcctcggagcgcgcagacccggcggcggcgtggcgcccgcggtaagtccgggtggtcgccgcgacgagacttgggagacacggggtcgcagggcgggagggggagctgagccggcagagaaaatgcccaggaaggggtcgatgctggcctgggctgcaccttggtgccttgccaccccgggaga

SEQ ID NO: 38032 - DNA, 265 bp, Homo sapiens
  chr20:24450819-24451084
  hyper
cgggttcgggctgcccctcggagtgacccgaaggagaccagccagggctggtgagccgggcggccacggagctggggacctaggtctgtttgggagtaggaagggaaacagactaattctccgagcggagcggcaggcaaggtgcaagcgcgcttgggatggggaatcccgacgggcgaccgtggcggaagcagagactcctggagcctctttcctctagccaggacaagacctgccttcaaaagctgtctggcccctggcagcc

SEQ ID NO: 38033 - DNA, 52 bp, Homo sapiens
  chr20:24451085-24451137
  hyper
cgacagcctgcagccctgggagccacagccctggcgccgagatgggagcgag

SEQ ID NO: 38034 - DNA, 609 bp, Homo sapiens
  chr20:24451412-24452021
  hyper
gggggtttcgttgcacgcagaggcttgggcgcttggcacccagacttcaggtgcgcacagtcctcctgcgacgtcagatgcgctggcgccgcggcgctcctggctcggaccgatgcctgcgccttccctggccacgtcctggtgtttagtgcagcagacaccggccgaaggcttggctgattgggggtgtcgaggggaggggggctgggcgttacacagtggctccgttttctggttggaatcagttggtgaggcgtgcgcgcgcgagtccgtgtatctgtccgtctccctcctacagcccagcgtgtttggtctgagtccaaagaaggaggtggtgtgtgtgctgcgtagacctgcgcctgtggggtgagcagcctcatagcccccagagccggccaacttctccgtgctaggctgcgacctcaagggctgccgcgtcggggatcggaagtggtcttcaaagaggggtctaggtcgcgaaatcctggcagcagccgaagtgaaaaggagctgctaggaggcgggcggggggcagtctgatgtccgttctggcgcggacaggaagaaactgaagtcgaatttttagttgaattgcgtgctctgtgtttg

SEQ ID NO: 38035 - DNA, 361 bp, Homo sapiens
  chr20:25058359-25058720
  hyper
cggcggagttgagcacggagtctggcagcgggatgcagtggcgcaccatggccccgtacagcccgtactcggccatcacgctgctgccgccccagcgcttctcccgcttgcgccatttggccctgcggttttgaaaccagacctggttggaggcaggagaagcagaaggcacacagaagagacagtgaagaggggcgcctggaggagcggaggcggcgtcccagggctcggatcttctctcccgagcatgatcccatgctatttctgaaggaaatagctcccgagggccaaccagccgccctcagggagagcgcccaggagcccccagcagcgcccacgtgcggtccggactcacgggcat

SEQ ID NO: 38036 - DNA, 43 bp, Homo sapiens; identical to SEQ ID NO: 1451
  chr20:25061746-25061789
  hyper

SEQ ID NO: 38037 - DNA, 334 bp, Homo sapiens; identical to SEQ ID NO: 1452
  chr20:25061978-25062312
  hyper

SEQ ID NO: 38038 - DNA, 136 bp, Homo sapiens; identical to SEQ ID NO: 1453
  chr20:25062510-25062646
  hyper

SEQ ID NO: 38039 - DNA, 111 bp, Homo sapiens; identical to SEQ ID NO: 1454
  chr20:25062707-25062818
  hyper

SEQ ID NO: 38040 - DNA, 71 bp, Homo sapiens; identical to SEQ ID NO: 1455
  chr20:25062870-25062941
  hyper

SEQ ID NO: 38041 - DNA, 180 bp, Homo sapiens; identical to SEQ ID NO: 1456
  chr20:25063727-25063907
  hyper

SEQ ID NO: 38042 - DNA, 1214 bp, Homo sapiens
  chr20:25063993-25065207
  hyper
cgggaacccggcgcggctgcctgcgcgcacgcagggaccggagcccgagcctgggccctgcaaagtgggtctcccactcgctgcgcgttcgagtggggcctccgctaaacatgcagattaaacaaggggcttccgataaggataattacaggaggctgcgcattgactttccgttactaaaggaagacccaaatctcccccttgcaagctgttcccgggattaccaaaacaatcactttcttttgagatcattgtcttttgaaccactccagctcggggcagaacgctttagacgctggcgttgttttccgctccgcgaggaattttcccccagatttatctctgggtttagggaaggcgttgggcattcgggactgcgtagtcgtttgtaaatccgaatttggggtagcagttaagtgagatacctacgcttccacacagtttgtagcccgagaccagtcaggcaggcagggtagtcgattctaaggtggcccgaccggggtcgcccgcgaatggaaagcctaaggggcgagggcggacgcgggcgccgtgcctgcagccccgggtgccgaccaagtggcctcacctgggacaggtcttggggtctccctcccctaggtctccctggaaggtaggcgatcacgggagtgacagaccccgagtagatagccagtgatccaaagacaccaaaaggccaggcggtaggagcccagcctcagacactctctatagtgaccgcggcgcctcgggaaggatcgtcttaaactcattttgcaggtgagagcaactgggacttattaacccagtcacatcggacacagagacgtggcgagggcgacacagagcaggagactcaatcaaggagcccgtattggagctctaaggggactcagagatgcagaaggaacgaacttctaaggggtcttgcaattcctggactggggcgttcctaatgcatcccgggaccccaatgccagggaggggcctgcaggaccccagcggtgggcgagttgtgtcctgggtcaccttgtgtttcgcagcgtggcggtggcaggagcccagcgcgggaggacattttcatagcctcctacagtgagaaacgccccccacccgacgctgcgctcatctgtgtccccgctgttgccggggctctggtatccacttgcgcgccctatgtggtggggatccacccagagcccagcgtcaagttatac

SEQ ID NO: 38043 - DNA, 255 bp, Homo sapiens
  chr20:25065208-25065463
  hyper
ggcgcttcactcagcgtcagccaagaccagggaagcgcttcttgccgtttaggagacgtctgcaagagataaaaagctagcccacgatccacccacaatcctcgtgtccccggggtgccctcgcagttgccaaacctacgggccgcgtttaggggaagcctccgcgtcctggcggccaaaagaatgggctccttccagcttccccctaccggataccacctgcaaatctattgccagaggcgcagctcccgcgaa

SEQ ID NO: 38044 - DNA, 35 bp, Homo sapiens
  chr20:25065766-25065801
  hyper
cccgagaaggtgaaacggatcgccctgtgagtctg

SEQ ID NO: 38045 - DNA, 29 bp, Homo sapiens
  chr20:25129464-25129493
  hyper
cgcccatccccgtgcgcacgtgttcgctg

SEQ ID NO: 38046 - DNA, 180 bp, Homo sapiens
  chr20:25565489-25565669
  hyper
gactgcgcgcacaggcgggaggaaaggggcgaatctgcaaaacgagtacaacagataaaattcgcaacagacttctacaccctttcaatcaaccgtcccaagcgccacgaacgcgggtcccgctccgtggggggccgcagccacactggcaggagggaatcctgggcctcgaccagacgc

SEQ ID NO: 38047 - DNA, 392 bp, Homo sapiens
  chr20:25565825-25566217
  hyper
gtcgggaaaccgggttttcaagcgttcggcccagcgggcgctgtattttagggcgtgacccccgccccgccctcgagggcgaccggaagagcaggcaccacagcagatgcgccgagtctgcgccccgcaccgcgaggagcacccgaggccgcgctcccggagccgggtctggtgactaaggcgcgggtcgcgacgcaggggcggccccggactctcgaccccaccagccgcctgaatgtcccgccggacgcccgggccggctcacctgggaggcgcctccgccgtccgcccgcgcggggccaggagcgcggcaccacccccgtaccgccggccgctctttgtgtctggaggccgcgacgcaacactcctcccggcctcgaggcaccgccccc

SEQ ID NO: 38048 - DNA, 188 bp, Homo sapiens
  chr20:26188774-26188962
  hyper
gggcacctgggagcccgcagaggggcggctgagggagaaacctcaggcatggccgggccaccaggaaaacacggccgcgggatcccaccgccacagacacgagggcggtcccgcggcgccccgcctgggacgccggaaggccctcggcacccaccaagacctgcctcacgagcccctggtcccgccac

SEQ ID NO: 38049 - DNA, 68 bp, Homo sapiens
  chr20:26189330-26189398
  hyper
cgctcggccaccaccgcggtggccggcggaaccctcgctctccccccgtcaccccgtcgagggggaag

SEQ ID NO: 38050 - DNA, 23 bp, Homo sapiens
  chr20:26189578-26189601
  hyper
gaggggcccgcagaggcgctcag

SEQ ID NO: 38051 - DNA, 368 bp, Homo sapiens
  chr20:26189956-26190324
  hyper
cgtgggaggggcgcgtctcgtctcactcaaccgcctcgaaccccacaccgacgagctccctcaggacccacgcgcggacaccgaggcgccgaccggaggagggggcgctgggggtgggaacgacacaccaccgctcggcctcgggaacctgagggacaacccggagcgctccaggagcaccgcaaaggcccagggggagccaacgctcgcgcaaactccccgggagggcagcacgacgggccggcgggacagcacccccaccgctgcggaggggggccgcccgcaagtcgacaaccacaggaggcgagagcgaggggtgcctgccgcgtcagaggaccccccgacccaccccgcgaggcagaaggcgg

SEQ ID NO: 38052 - DNA, 136 bp, Homo sapiens; identical to SEQ ID NO: 13761
  chr20:30063113-30063249
  hyper

SEQ ID NO: 38053 - DNA, 275 bp, Homo sapiens
  chr20:30063250-30063525
  hyper
ttggcaggaataggggggcttcgaaaccgcgtccctagggtgagggtcttcagacctgggacccggagggctggatagccctggacaaagacccctccaaccccaggatgggggattcacacccgggatgccggctgagaaagctcggacccagactccaggaatggcacagcgttcccgggccctgtggtctgccctccccgtcccctgccaggaccctgtcctgtcacctaacctggggcctgaccggcggcagctcccgtccccaaaagcag

SEQ ID NO: 38054 - DNA, 32 bp, Homo sapiens
  chr20:30193960-30193992
  hyper
gtgggtctcccccaacgcgcctcgccggatct

SEQ ID NO: 38055 - DNA, 56 bp, Homo sapiens
  chr20:30556169-30556225
  hyper
gctcgtgttcttctccgacggtgccacggacctgtggctggcggcctcctactacc

SEQ ID NO: 38056 - DNA, 221 bp, Homo sapiens
  chr20:30582773-30582994
  hyper
gtgacttgccccctgcgcctgtgggcggctcggggctggtgcgacagagcgagaggaaccagcgcgcgggagcctgagcaccgcgtccttcccgcaggtacctgcgcgccctgtacctggggctgcagagccgctggcgcggggagcggctgcggcgccacttctactggcagatgctgttcgagagcgccgacgtgagcatgctgcgcttgctggagacc

SEQ ID NO: 38057 - DNA, 374 bp, Homo sapiens
  chr20:30639105-30639479
  hyper
ccagggtggttccttcgggcagggaactttgcatggccatggtggttccttcgagagaggaactttgcatggtgtctgaatggagcaggcctgcggaagagaaaccgctgaccacagacctgcctggaagtctcgggccgcggagttggggagggccgggccagaagggaggggtcggagtggtggggaaaagagatcacgatgcttccggggtagggtaaggcctttccagggtgggttggaatctttgaagactgtggcaggaatcccttgataggtggggttaggatctctgaagggcagggttggaatctttggaccggcggtatagacccctgggtattaaaactcttaggcggcgggaggttagatcg

SEQ ID NO: 38058 - DNA, 473 bp, Homo sapiens
  chr20:30639783-30640256
  hyper
ttagggaaagtggagcggaagggatgggggttcgcatccttggtggacgcgttagaagcctcctatggatggtgctaatattttttttctcttcgtggagggtttgggatccttcttgcaggagacggaggttatgaccctcggggagccggttaggatcctggggtggcgtctgaatcttcggggaggtgttaggacacttggggcggagttagcctcgctcagggcgcggctaaggcgcccagatggcctgcgggcgccaccacgtccctggtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatcc

SEQ ID NO: 38059 - DNA, 186 bp, Homo sapiens
  chr20:30640257-30640443
  hyper
ggctgcccgcgagacgaggagcgggcgcccaggtgagtgccgcgcacaggggaccgggaatacccggcccgcgaggggtcccaggaggcggagggagcccaggagcctggggagggctggctacgggtgcggctgggggcagcgaggggagacggaacgtcgggggagccgcgggtagcccggggg

SEQ ID NO: 38060 - DNA, 45 bp, Homo sapiens
  chr20:30640724-30640769
  hyper
aagggggtagttgggcggaggcgtgacgtgcgagccacacccagg

SEQ ID NO: 38061 - DNA, 325 bp, Homo sapiens
  chr20:30777885-30778210
  hyper
tggaggccgcttccccgcgcccaggggaagggaaggcggtcccggggcccgctgcggggtggagggacccgcgccccccagcttctcgggcccgggccgcggggaccgtgcgcgcgtccccctcccgggcaaggccgggcggcgggcgcgccgcggcttctggggtccccgccctcttgtccgccatcgcctgcgggagcctctggcctggaggggctcggggcgcgctggcgactgcgggctcggcgacaggggcggctggtggcgggaggacagtgggaggaaggctccgccccacgcgcccccctctcggatgtgattcgcc

SEQ ID NO: 38062 - DNA, 33 bp, Homo sapiens
  chr20:31797604-31797637
  hyper
tgaagtaggccaaggcgacgaggaagagccacc

SEQ ID NO: 38063 - DNA, 49 bp, Homo sapiens
  chr20:32803885-32803934
  hyper
cgtagtcctctgccacgaccgcagcgccaacgccagagacggagttggc

SEQ ID NO: 38064 - DNA, 192 bp, Homo sapiens
  chr20:32803954-32804146
  hyper
cgctccgcgtcccctggcaccttctcttgagtggcaggcaagcaagcaagcaagcgggcggggtcagcgccccaagaagggaaagagcgcgagggccagctaacgccgccgccgccgtcgccgctgagtcagcgcgaagcgccctctccgagtaggtgccgcgcgggcgggcgctggcgccagcagtctcat

SEQ ID NO: 38065 - DNA, 30 bp, Homo sapiens
  chr20:32899446-32899476
  hyper
attaactggaggcttcgagatgggatagag

SEQ ID NO: 38066 - DNA, 261 bp, Homo sapiens
  chr20:33146323-33146584
  hyper
tgcgggagaagctcccgcgctgcccatgacgtcacgggactgtgacgcgcccagaagccccgcccctcgcgtcccggtccgcggacccaggctctctgcgccgtgacgtcacgggtccgggcgggcgggttgtgcgtcggcccaatgggagcggcgcactggcctcccctttaaggaatgttgtgacctgacgtcaccgggcgagttacctcccgcagccgcagccgccgtgctcagcgcgagccccggagcccttgagcg

SEQ ID NO: 38067 - DNA, 24 bp, Homo sapiens
  chr20:34188608-34188632
  hyper
ttctttttcttctttcgggtgagc

SEQ ID NO: 38068 - DNA, 342 bp, Homo sapiens; identical to SEQ ID NO: 1461
  chr20:34188747-34189089
  hyper

SEQ ID NO: 38069 - DNA, 326 bp, Homo sapiens; identical to SEQ ID NO: 1462
  chr20:34189166-34189492
  hyper

SEQ ID NO: 38070 - DNA, 375 bp, Homo sapiens; identical to SEQ ID NO: 1463
  chr20:34189679-34190054
  hyper

SEQ ID NO: 38071 - DNA, 217 bp, Homo sapiens
  chr20:35491258-35491475
  hyper
cgcgggctgggccggctgccccgtacggacccccgccgggcccccggccgcggactcggcgtcgctgctcagcgccagctccaggcccagcaggcgcgcctcctccgacgcgcagtccgacacctccgagctgctatccgtgaggctggggggcggcggtggcggtcgcggccccgcacccgagcgcggacggcccttggcacggaccccggtgcgg

SEQ ID NO: 38072 - DNA, 323 bp, Homo sapiens
  chr20:36012930-36013253
  hyper
ggtgacttgggtgtccggggggtgggggggcggccgtacacactgtgaagcgtccgcgccgccgccgctggctttggggtggagcaagcgcaaaagacacggggtgtggttaatgggttctaattggacgcttaagcccaagaagaagaagggcggcgcgggaccgggcctgttgctgccttggcgcccagtcctttttcgttgcctgggtccgcccagagatgagtcgggacgcgcggcccacgtgcggcggaggggcagctgggtcgctcggggaacggggcaccggatggccccggttgggcccgcgccaggatgcgccc

SEQ ID NO: 38073 - DNA, 440 bp, Homo sapiens
  chr20:36531551-36531991
  hyper
cgtgcgctcgctccccgaagccggggctgggccggagccgggcgagggctgggagctgggccgggtccggggacagcgggcgaggggcagctgccggagccgggcagccaggccgctcagggcaggggacagctggcgccggttctgcggtctccggggcccagatgtgaggcggcggcgcccccggcccgagagcgcacgatgggggccccgctcgccgtagcgctgggcgccctccactacctggcacttttcctgcaactcggcggcgccacgcggcccgccggccacgcgccctgggacaaccacgtctccggccacggtgagttcggtcgccgcccccgcggacttccccaccaaaccccaacccgggccgcgccactccaacttggccgccccggggctcgaaccggcgccagtcgtggcgggcatcccggggc

SEQ ID NO: 38074 - DNA, 332 bp, Homo sapiens
  chr20:36888856-36889188
  hyper
tgaaagggggcagagcgaggtggtccaggccttggcgcgttaccatggtgacgggctgccagcggcgggcggcgcggctcctctcctgggcgcggggtctgtgggtccgcgggtccgtctgtctggggcagccctcggtcccgcctagccctggagccaggggatagggcaggcccggggcaccgaccccggcgtcatctcggaggagcggccggggaggacagggagagagactgagagagagacagagagggactgaggctggagacggcgagagacataagggagccgcgggcggcgcgggtcgggccaccagacggggggcggcagca

SEQ ID NO: 38075 - DNA, 30 bp, Homo sapiens
  chr20:37274701-37274731
  hyper
ctggtcgcccaggtgcgaaaactgaacgac

SEQ ID NO: 38076 - DNA, 847 bp, Homo sapiens
  chr20:37302554-37303401
  hyper
aggggcgccgtggtgcggcatgaggctggagcctgatcactcggggtcttactggccacggtgaggagtcagggtttcatgcgcccctgcagtcagaaagcatggcccaaccccagtgccctaagtccggaaacattcaaagctggacccagggtagcgggatccggggcctctggggacccgagagggacgttaagttcagggcttcagggtgcagccctggggtcggtacccccagcctccaacccagagctggcagcgctcgcccccttctccgcgcgggccctcagctcagctccctcttcgctccccgtgtccccgcgagcgggagggaggggatgctaggacgccctgtcggcgtcgtcgccgctttccgccattgtttagtcgtgatgctctcattttctctgaatcaacaattttctgctcggctccgcgccgaccggcgaacgcggggcttttcctcgcccgcctgatgacagcagagcggcgcggagcagctggtccggaaggaagcgccaggcgcctgcccggtcccaggcgtccgctgccgcccacccacaccagaccccgcccccgcgcgtcaagccccgcccatccataccaagtcccgcccccacaccctcacccacacaccaggccgtccccaccccgcccccagagccccggggcgccccgcccgctagccgcgcacgcgcagtgagcacggcgacccccggtggtcgggtgtctccgcaggccgaacacgctgctcgcccagctgcggatcattaccgcccttttgttctccgtcgcgcgctcgccccacgctaggaatgcaaactgtaggcgccgccagccccccctt

SEQ ID NO: 38077 - DNA, 837 bp, Homo sapiens
  chr20:37351679-37352516
  hyper
ttttccgtccgcccccgcccccacttccagtcacagccgctacttctccattcaggctgggactgccaggtggagccctgcggtttactgctcaggaggagcccggccaggacatcagctggggacttacgcagggacccattcagagcagcggaccctcacggagactactacaaagggactaacacaggcacgaacgcaggcaaccccattcgggaacacatacgtaatccaacacactagctctggcacacacactggaatgcgcgcaaaaccacacagacacagaacacacgcggttaccaaacctcattctcagaggccacactgatccaacctcaagcagagtctgatacagcatcggtctttgtctctgggtctctcccttactcgcgctcacacacccgtaccccaatcaacacaaacagcccaagctttcacagcctggaggcggccgtcggagcagggccccagcgcaccgcgagcctctgcttcctccgccttgcagcgccgcgagcccttctttcctccgcgcctggccccgtctgcgcccctctcggcgtgggcattcgcagacccgctaggaggctgacgagaggtgtcctcatagagtcctgccttcttccagacccccaaacgaaaagaaagagaaaagccaacctttcgcctccattctgcacgcatttggagagcggctggtggcgagcgatccgcacaatcgcttccctcgcggcgtccctggacgggcggagagaacccgggtgactgagcctgaggctgagcttccttgggagcgatccatgccagccacttctaccttcaagggggactcgcggc

SEQ ID NO: 38078 - DNA, 1113 bp, Homo sapiens
  chr20:37352606-37353719
  hyper
cggggcgcccagaccagtccttagccagaggatctggggctgcacagctcccggaccctggagggggtggtccgggggtgggagactgcgagcatcagcccacgccggccccctcccaccctgcggcggcgaggtgggaagggccaggatgcgagcttagcacctcccctagaaatgcagcacttcgcccccccacctcccctgccctcggcgctccctctttcacgcgctccctcccgcctccttcccaagggcgcccttcttctgcccccagctcacgtctgaatccctcggcgccccctttctcttctcctagccccttcctcacgtcccctgcctccgggtatttcctctctccaatcccccacccccgcaccgcctgattccgaggggcgggagcgcattgggctgcgcacgggtgggggcgccgcgccagcttcgcgtagctgctctgacgccgctgccgccgccgccgccgccgccgccctccgcagcccagctcgcgccccgcggcagctccgcagtgcactagccaccaccgccgccgccgccgctccgccagacctgctgccagcttgcccggtccagccctgagagagcctcgaacgccagctgcgagggtcatgagccagagagccccggggcgccgcgcggagagcaagcggagatagcgactttgcgccccccagccctcgccttcttgcatcgcgttccccgcatcctcgggtccttctgtcctttccgctgtccccaccgccgccatggccaccttgctccgcagcaagctgtccaacgtggccacgtccgtgtccaacaagtcccaggccaagatgagcggcatgttcgccaggatgggttttcaggcggccacggatgaggaggcggtgggcttcgcgcattgcgacgacctcgactttgagcaccgccagggcctgcagatggacatcctgaaagccgagggagagccctgcggggacgagggcgctgaagcgcccgtcgagggagacatccattatcagcgaggcagcggagctcctctgccgccctccggctccaaggaccaggtgggaggtggtggcgaattcgggggccacgacaagcccaaaatcacgg

SEQ ID NO: 38079 - DNA, 1026 bp, Homo sapiens; identical to SEQ ID NO: 1468
  chr20:37353806-37354832
  hyper

SEQ ID NO: 38080 - DNA, 239 bp, Homo sapiens; identical to SEQ ID NO: 1469
  chr20:37354993-37355232
  hyper

SEQ ID NO: 38081 - DNA, 541 bp, Homo sapiens; identical to SEQ ID NO: 1470
  chr20:37355502-37356043
  hyper

SEQ ID NO: 38082 - DNA, 660 bp, Homo sapiens
  chr20:37356168-37356828
  hyper
cgccgttgtgtgctgctacaccggcaagatcctcatcgcgtgcctgtacgaggagaatgaagacggcgaggtggtgcgcgtgcgggactcgtacgtggccatagccaacgcctgctgcgccccgcgcttcccaacgctgggcggccgagtggtgaacgtagcgcagatcatcgagctggtgatgacgtgcatcctgtacgtggtggtgagtggcaacctcatgtacaacagcttcccggggctgcccgtgtcgcagaagtcctggtccattatcgccacggccgtgctgctgccttgcgccttccttaagaacctcaaggccgtgtccaagttcagtctgctgtgcactctggcccacttcgtcatcaatatcctggtcatagcctactgtctatcgcgggcgcgcgactgggcctgggagaaggtcaagttctacatcgacgtcaagaagttccccatctccattggcatcatcgtgttcagctacacgtctcagatcttcctgccttcgctggagggcaatatgcagcagcccagcgagttccactgcatgatgaactggacgcacatcgcagcctgcgtgctcaagggcctcttcgcgctcgtcgcctacctcacctgggccgacgagaccaaggaggtcatcacggataacctgcc

SEQ ID NO: 38083 - DNA, 1027 bp, Homo sapiens
  chr20:37357215-37358242
  hyper
cgtgtccggcttcgtgcactccctcgagggcctcatcgaagcctaccgaaccaacgcggaggactagggcgcaagggcgagcccccgccgcgcttctgcgctctctcccttctcccctcaccccgcccccaccagcccagtgcgccctgccgccgcgcttgggaggccaagctttaaacatctctggttcctagtttctgattattcggggatgggggggatgggaggggacagggattcacgatccatcgcgtctgcgtttctgttgtcctttcttttccacaacaccctggttttggggggaggcggggtgcatttgcgggcagggttctctgtccttccaagtggggccccgacactttggttccagtcatcgagggggttgggaagggagggagagggggcgcagctcgcaggcgtggcaacttgaccttgggggaatatttcacatccatccagagctcggaatctacagcgtccagccatttccagcaagagcgcttcccattccggagacgtttcaaccctgcagcgggaaaggctgactgggaaatccattttgggtgggcaatttccttcaacgaagccggaaggcgagaagccgcggcggggccagcttgcctgccggttttcaggaatctaaactctcatcttgtgcaatttatcaggtgtggaactgttctactgtgcgtgtggtgtgctcgtggtgaataagatgaaatgtatatcagaaaaaaatctatctctaatttagagtgcggtacataattatatccgcaaataaagaagagacaaaggcttgcgcggcccggtgtcgggtttgtgtgttcgtaccagccgggatcccctggcgctgggaggcgtgggaactggctcccgccggctgaaaccggagatggtgagcagctgtggttaaagggtccggggagggctctagggagtacaaagattagttggcggcgaggaggctcctcaggtgtgaggaggaagctgaagacggagagtgctgtagcggccccctcagctg

SEQ ID NO: 38084 - DNA, 104 bp, Homo sapiens
  chr20:37359606-37359710
  hyper
catctctgtccttcccgtctttaaaaggtcgaaggagacactaggcaggctccggatagcggcgccaactctgcgggctcgcctggatccgctccactaatcct

SEQ ID NO: 38085 - DNA, 241 bp, Homo sapiens
  chr20:37434112-37434353
  hyper
tggaggagggggcagcgttaggaaaactattccgaagcctggccacgtcccaaccggtttcaacttcctgcagctcagaagaggggtccccacccgagagcgccgggaccctgtcccgcgctgcctcccaagccggatggggttgagcgcgcccaccccagtcccaggagctcaggccccgccttgggggaggagccgagaggcggcgcggaggctcgcggccgagcagagccagctctgt

SEQ ID NO: 38086 - DNA, 234 bp, Homo sapiens; identical to SEQ ID NO: 1474
  chr20:37434488-37434722
  hyper

SEQ ID NO: 38087 - DNA, 158 bp, Homo sapiens; identical to SEQ ID NO: 1475
  chr20:37434736-37434894
  hyper

SEQ ID NO: 38088 - DNA, 440 bp, Homo sapiens; identical to SEQ ID NO: 1476
  chr20:37434930-37435370
  hyper

SEQ ID NO: 38089 - DNA, 229 bp, Homo sapiens; identical to SEQ ID NO: 1477
  chr20:37435487-37435716
  hyper

SEQ ID NO: 38090 - DNA, 199 bp, Homo sapiens
  chr20:37435717-37435916
  hyper
gaggtacaggcgccctttcccgcagggctctccctggaaagggcctgccgatggcggcctcagtccgcaggggtacttccctgtgtaccctgccatttcctgcggctggtgaagcaccggagaaaaaccgtccatctaggaggcctcctccaaggctggtaataaagcttcttagcccagccagcgactagctgtctac

SEQ ID NO: 38091 - DNA, 287 bp, Homo sapiens
  chr20:39316048-39316335
  hyper
tcgcctctcgcctgccgggacgccagagtccctctcctttcctcgttgctctcttcctggcgcggactactctccgggcagcaaagcagctgtcccggcttaacgcgcaaagttcagaaagccaggagtctccagatggccttggtgacttctcgggactatgcctcgccgcccttcagcctggagagaagttactccgggacctcccaccctctcgtctctctctccggctctgctcgagtctaggaggcggcgctggcgtgcgctactctcgccttagccaaggt

SEQ ID NO: 38092 - DNA, 51 bp, Homo sapiens
  chr20:39316983-39317034
  hyper
cgcttggtgatgatggtgatggtgcgggtgagcgtgcgggcccagctcgtc

SEQ ID NO: 38093 - DNA, 556 bp, Homo sapiens
  chr20:39317035-39317591
  hyper
tgggccacgccggcgcccgggtacgcgtggtgcgggtgagggtggtggtgatggtggtggtggtgagcgccgcgaaagctgtcgaagctttgcagcggctgtggcactgggtgcgagccgatgagcgcttccaccgcgtcctcgggcgtcaggttgagcgcctcggggttcatctgctggtagttgctcgccatccagtacagatcctcgaggtgtgtcttctgttcggtcgggctgaagctgggcgacgagggcacggagctacacggagtgctgagcggtgtggaggacaccgagccggctggctgcaggcgtgtgcagggcctgcccggacgctccgcgcgccccagtggctccttcttcacgtcgaacttgagcaggtcgaagtcgttgacatactccatggccagcgggctggtgggcagctctggccccatgctcagctccgcggccatcgctgaagcgaggcgcagccgccgctgccgcccgggaaactttgcggccggccggagcgcgccgagccaagcgcgggggggaagagcggagaagagctggg

SEQ ID NO: 38094 - DNA, 217 bp, Homo sapiens
  chr20:39318987-39319204
  hyper
cgatgtacaggtcctcgggtcccgtcttcgtactcagccgcgagcctcgagccgcgagctccgctctggtcgccccgttgaaattccgtgccccagcgttcgggggtgcccgtcggctgctccctgggccggaaggtcctgggcggaggaaggccggtagccaaaagtggaagcgccacagtgaagcggcccagggccaccgggtgagaaacctccc

SEQ ID NO: 38095 - DNA, 152 bp, Homo sapiens
  chr20:39319514-39319666
  hyper
cgcgtgagccacaccggtgcagacgcgcctagattatttttaaatgttagaaggtaaaatatttgcctccaattaatctgaaaactctctattctcttgcgccctcggagaggctggggtacggcgtggtattgggccgcctatttttaata

SEQ ID NO: 38096 - DNA, 40 bp, Homo sapiens
  chr20:39994691-39994731
  hyper
tatctcctacctggccgggccaggggagagaagggaggcc

SEQ ID NO: 38097 - DNA, 20 bp, Homo sapiens
  chr20:39994762-39994782
  hyper
cggaccgcctttcctcctct

SEQ ID NO: 38098 - DNA, 544 bp, Homo sapiens
  chr20:39995002-39995546
  hyper
gggtgcccggggcctcgacgccccccgcgggtgcgggcaggtgggagcggcgacgcgcgcgggcccatccctccctcttcccgcccgccgcccgcccgcgcttacttgtgcggccccgggcgcagccgcgggcgccatcccgtcgtgtagagactgtagcgggaggcaccgggcggcgcaggccgcgccaggagcggggtgcccctggcctgcgcccccgagagcagcgccgcgacggcgcacagccagacgagcaggcggcggcggcccatagcggcccccgcgcctctgcccggccccgcgcggtgccccccgccgggtgtccgcctgcagcgccgcgccgcccccgccgctggtcggcccgggtcccgccccgagggtcccggggtccccttcggcccccgagctcgctggcccggccgcctggcgcttcgcggcggctgcgtcccgcggagtggccggcgctgctagcggctggggccgcggaggggaggcgggaggcgggctctttgcggattagcataaacttggggccgcgccgctc

SEQ ID NO: 38099 - DNA, 313 bp, Homo sapiens
  chr20:39995547-39995860
  hyper
ccgccgccagcccctcgccccagctccgagcggacggccgaggagccgcctgcgaacaggaggttccaaagggagcagccccaggtggcaggggcgcaggccgccgcgccctgggaggccccccgagcacaccagccactctgtcgcctgcgggcacggggcgagacgcagagaagcggacccctgaggccagcctgggcgtggactttccaggagtcgtccaccctcaggatacgcttgtcttcagagtccgtgtgaacccgggaactgctctccagggctctggagccgagatggccgtgactgggggcac

SEQ ID NO: 38100 - DNA, 624 bp, Homo sapiens
  chr20:41817292-41817916
  hyper
tacaccaaaagcaatcggtgctaagaaactttaaggtgattttgaacttggaagtacacctgcagcactcccttctcttccctccgccgctactcttgggggggggggggctcgggggtggaagctgcctgcggtggggcttggtgatgtgtaagaccctggactgtggtgccctccagcacccgccaacgtgcctttaggagcacggcaggcaccacccccccgcccccgctccccctactctggggaactacctctgctcaccgccttcccgtggccaaacccaaatatgagttccccgaacttttcaggagcggacgcgctcacgggtcaaatccactcccctccaagggccttaacacgggcgcccagctacctcggagaaaagccagcgggtagggcggaggtattgctctcggtcatcaacgcaaacatcccctcgggtgcctacagcggcctgcttaggggagcagcgtgttcagagcaaatggagagcttcctgtatctccgaggaaaaaagaaaagccgccgccccggcagcctcggcctgctggggacctgtcctccccactaaaagcgcgcgctgcccgaggagctgcccgggagagaacgctccaccccggg

SEQ ID NO: 38101 - DNA, 742 bp, Homo sapiens
  chr20:41818007-41818749
  hyper
cgcggaaagttactccagcccggggggccggcaggaaactgaagcggggaacttcgccaaacgcgggctgccgagggacgcgaggggccgggctcgctggccggggcgcgcggggacactgcttcccgcgcctgcaagctgagacccgggttccggccatggggacccgcgcccccgcgagcccacacaactttctcctccgagggccccgcggctgggggcccgcgcgcatccaggagggagcggggagcccaggggagccgggcgggcgcactcacctgcggcgctctgagcccgggcgccgggcagtggcggcagctgcagcctcaggagcaggctgagggcgagcgcggcgaggctcgccatccgggcggcggcgggcagctcagccccttcccgcgggggccggggccgggactggggcgggcgcggggtggccccgcatcgccggcgcggccgctggctgtgcgcgcggctggctccgctcgggctcccggagccggcgctcctgcgttccaagccgaggcgcggcgcgaactgaggcgggaggctgggcgggggcgggacgcggggggcggggggcggtgtcccccgagtcctaacgccgccgccgttgccgccgccgccgccgccgccgcccgcccgggcgctccgcctcggccgtgcacacaccctcacgcgcacgcccgcgcctggcacacgcccgcggctggcacacgcgggctcccccgcgcaccctctc

SEQ ID NO: 38102 - DNA, 383 bp, Homo sapiens
  chr20:41818804-41819187
  hyper
cgcacccacacgccgggcagggtcctcgcctcttcgccccgcgccgcgccgcgcagccaagcatcgtctgccctgtgggggcgcaggtacgggggcggtgcggggaggaggaagctgcagcagccgtttgaactcggggtggggaacaggtgaatgggggttcggtggcgagaagagggagggagggagcagccctcgcaactcaagataaggggccaggtgaattgcgaaagcgggtgggggcgtctgcccaaagctggggcaggcggctgctggccagggtctcgggcacaccctgagatgagaatttcatctaagagcgcgcgcgcgcacacacacacaacccactcacactcttctgggcgcatcgctgaccgcgccac

SEQ ID NO: 38103 - DNA, 30 bp, Homo sapiens
  chr20:42019069-42019099
  hyper
cctctgaggcgggggcggtggggggcgctg

SEQ ID NO: 38104 - DNA, 640 bp, Homo sapiens
  chr20:42136058-42136698
  hyper
cggtccctgcgcccccgctgcgctctgctagctgtgatgcaggggttcgggggcaggaaaaatctcgacccgccacgcccgtgcggcaaacctgtcctaggttgagggggcatgaggcgcgcacaaccagggcctcgaaggcaggcaagagggcgcgggcgccacagaagcctgggcctgcgcctgggccgggcagatgtgcccggcgctcgggccccgcgctctgcgtcctgcagggaggcggacccgccccccgaacgcgcaggcgcgcggcgcccggctcggaccgtagctaggcgctgggcggccaccggctggccaggcaggtaagcaaccagcggtgcgtgggctcagaccttgcgtcccctgggcgccgcgccaccccgctccgtccagggcggcgagggctcaggtctgcggccccggcgtctcgctccttccgagcgcctccggcggggggcgcgggctggggaggaggttcgggaaaacgccggggaaagcggtctgggcggagcgcgcagggggccaggcgggtgcgggactccaggcccagccgaccctgcggcgtggcttcgggctgcgatcaggaggggcgaggagggtggaggctgcgtgtttggagatacgcaatcaattaaga

SEQ ID NO: 38105 - DNA, 62 bp, Homo sapiens
  chr20:42543184-42543246
  hyper
ggcttctctcctcaccgtgggtggcgaaaggcgggacggaaaagcgccgtctggacaggcgc

SEQ ID NO: 38106 - DNA, 1043 bp, Homo sapiens
  chr20:42543491-42544534
  hyper
actgcccgcgggagccgccgccgccgccgccgcgcccgccatggacgtccgcctgtacccctcggcgcccgcggtgggcgcgcggcccggggccgagccggccggcctggcgcacctggactattaccacggcggcaaggtaggcgggggcgggcgggggtccccggcgggcggggccggagtcacctggcagctcgggactcaggcgctcccggggtcacacggggccgcgcacatcagccccgccgacgggcacgggcggctcacatcgatcccctcgcggccacgctcacgccctgagttgttgggatcgcgggcagaagtcatcccgacagccacccgtgcgacgacacagtggcccctcactcgcgtccccctgacagcctcgcagtcattcacaagccgtcacagtgacccacagccacacgcaggcggccaggcactgcttacacggtcccgccgtcccacgcaagtcaccctgacagtcacttatacacaacgacacgcaaccactcacccgcaaacagcctcaccgccacagacgagtcacccacagacgctccgatgccccacacaccgtgacatgcccccacccgctgtcacacccaggcacaacgggggacagtcacacaaagaagtcgcccgacagtcacactctcgcagccacaacgcctcacccaggcgcacgctgtcacacacagccacccccctggacggtgagcctcagacacagatcgtcctgacggccacacagtcacacgcggtcacacccagggacggccacacctcggtcatccacactcgcgcgtcgaggtttaacttctcagcgccgcagcacactaattgggcagtttactaattggccgtcactgcctggcggggcctcggattccgagtaggctgcggccaatcgaggcctgtgtcctcccgggagcggtgagccggcgtccctccaggctggggctgtagtgccggacaccctccctcctccatgtttccaggatctatccccccaccccagccaggtcccagctgcgctgcgc

SEQ ID NO: 38107 - DNA, 288 bp, Homo sapiens
  chr20:42544727-42545015
  hyper
cgtcggtcccgggccggctggagccaagcgcgggttttcgtcactcggagcccggattgaacagcgcgcgtgggtttcccgcagccctggcgcagacgcgtgggctccgtggcgatgcggggtgagtgcgcgtccagtggctggatcggcgccccccagggtctctccccaacctcgcaggcttttcgtcaggcccctggtagtggggatgaggcaggagagaggcgtcccggcgcggatcccggggcctcccgggctgggcctccctgagtgcgccctcaggcccca

SEQ ID NO: 38108 - DNA, 170 bp, Homo sapiens; identical to SEQ ID NO: 13811
  chr20:42587835-42588005
  hyper

SEQ ID NO: 38109 - DNA, 30 bp, Homo sapiens
  chr20:42876029-42876059
  hyper
cgctggagagcgatgcggccaagccagcgg

SEQ ID NO: 38110 - DNA, 35 bp, Homo sapiens
  chr20:42876632-42876667
  hyper
ctgcccctctgtctgcgggccgccttctggctagg

SEQ ID NO: 38111 - DNA, 61 bp, Homo sapiens
  chr20:43017338-43017399
  hyper
gaggagcccaggaagcgcaaagcgcagcactgcggagagtcttggccgcctcctccgggac

SEQ ID NO: 38112 - DNA, 57 bp, Homo sapiens
  chr20:43438029-43438086
  hyper
ctggctgaggttgtgcgcaggcctgggaggaggaggttcaagccgctggctggtggc

SEQ ID NO: 38113 - DNA, 885 bp, Homo sapiens
  chr20:43438334-43439219
  hyper
cgccgggcaggggtcttgggcagggatcctctggatgtggccaagacaaagatggagaggtaaggtctgcgcgccacctccaatggcggggggcgcgtcggagccccaggggtgggacggccaaagcccagggcttgaagagtgggcacattcaggagactcagggagggtggcaggtcggctccagggacgaggcaaggggcctccaataggcgcgggtgaggagggagatgggtcctggcgacccaaagggcccacctgcgggaaaggtgaatgcagacaatctcggggtccctgggggagaaggccagaaggtagcgcatcctggagaccctggggtcccgtgggtgcggaaggagaccctgggggcgccttcccaggggattgggggtggggaggagggcgcacgggtcggggagggggctaccggacctggatcccgggacaccccgggggtctggggggcgggccgcgcgcttacctgcgtcctcgtcgtcgaaggagttcatgcacgggaagtagatggcgagcgcctcgaaggaggcggacagactgaggcggctctgcgagcgctccatgcccgcgccggcgccgggcgcctcggccgcggcggcggcggcggcggcgggcggcttgggcagcttggccgccccattcttgacgcggagtacggcgcgcggcgtggtggcggcggcccggggccgggccgaggctccgctgcggggctggcgggcgcggcggggccggcgggcgggccaggagctggcggcgcgcggagcccgaggcgcgctgtgctgctggcggcggcggcggcggcggcggtggcggcggcggtggcggcgcagcgcgctctggtccgcggcgccccccgccggcagcgcgagg

SEQ ID NO: 38114 - DNA, 305 bp, Homo sapiens
  chr20:43439247-43439552
  hyper
cgtgccgccgggggagggggcgccgctgcggggcgtgggagcccggagggcgcgggctgcggcctcttctagcagcccccgggcccggcaggtgcgcgcggggaggcaggcgccgggcgaggttgtctgggccctggtccgagggctgttcccgaccccgcctcggcccccaccctcagccggccgacttgcggagaggccggcgtccagtccctcacccagacaggcctctcccagagacactggcgcgctcggaggggatgcgctcaaagggtcccgcccaggcgggtcggcactcggcctcc

SEQ ID NO: 38115 - DNA, 102 bp, Homo sapiens
  chr20:43726528-43726630
  hyper
ggcgccagcaggaggcgcgacgacacctcgaagctgaaccaggcgatgcagaagtactcgaggcgtcgcagcaccgggtcgtcgcgcacgccttccgggctg

SEQ ID NO: 38116 - DNA, 24 bp, Homo sapiens
  chr20:43726764-43726788
  hyper
cgagtagcccgggttctccatggt

SEQ ID NO: 38117 - DNA, 30 bp, Homo sapiens
  chr20:43922213-43922243
  hyper
cctgacgccgcagtccgcctaatggtccgg

SEQ ID NO: 38118 - DNA, 371 bp, Homo sapiens
  chr20:44452668-44453039
  hyper
ctttcatcagagattcgatctcctcgtccgtcacgtgctccccggaggccctgaaaatctcagccagctcctccgggtcgatgtagccgtctgcattccttcaggtccgagggacagggcagggctcagggccggggcgagctgccctggccaccacactcgacgccccgcttccgcactcccaacacggggaagcttccagcgctgccggccgggttctgactgctaagcccctccctcggctcccgggcccccagcgcacctgtcgaagatgcggaagcactcggccagctcctcctcgctcttccctttcgcgtcctctttcatctggcgcaccatcatgaccaagaactcctcgaagtcgatggtgc

SEQ ID NO: 38119 - DNA, 78 bp, Homo sapiens
  chr20:44519124-44519202
  hyper
ctgtagagccctggccggctgcggcccaccaggcggtcccggggaatgcgaaactgctcaatgcgcagatatggttcc

SEQ ID NO: 38120 - DNA, 30 bp, Homo sapiens; identical to SEQ ID NO: 13818
  chr20:44540105-44540135
  hyper

SEQ ID NO: 38121 - DNA, 364 bp, Homo sapiens
  chr20:44540444-44540808
  hyper
acgttgccacggcaacgactgcacgcgcattcttggagggtggcttgcggtctcataggcctcgcgcccggggaggagaggaggtggccgaccagaccgtgggctcccgggtctcccggctccctcaggtcctaaatctctcccattagagattctgcctggagcccccatgttagcgttctccttcatcggctctcctccccacgccggcttcagtgcaccacgcggctcggcgagggactgggaacgggatagggacgcgccccaactcactcagcggtggagctggggggcggcgcggtcacgtgggatggcgggcagctcaggggatccgggcgacggggtctggcgggcagggttgttc

SEQ ID NO: 38122 - DNA, 348 bp, Homo sapiens
  chr20:44639148-44639496
  hyper
gcgggcggtgattgacgacgcctttgcccgcgccttcgcactgtggagcgcggtgacgccgctcaccttcactcgcgtgtacagccgggacgcagacatcgtcatccagtttggtgtcgcgggtgagaacgtgaggagggaaaatccaagagacctgggcggggtcagggaagggaggaccacggagagcgtggaggcagcagtggccccggcttcctcttgcctgcccgcgctgccctggcttatacggcccctcctgccagacagtgcacagggccagggcgccaggctgggagagcttcgcgcaggcgggatttcagcccgcacttatttcggagcccttgcctt

SEQ ID NO: 38123 - DNA, 15 bp, Homo sapiens
  chr20:44639731-44639746
  hyper
ctcccactcatcacc

SEQ ID NO: 38124 - DNA, 8 bp, Homo sapiens
  chr20:44639846-44639854
  hyper
cgctccta

SEQ ID NO: 38125 - DNA, 4 bp, Homo sapiens
  chr20:44640284-44640288
  hyper
actc

SEQ ID NO: 38126 - DNA, 25 bp, Homo sapiens
  chr20:44640312-44640337
  hyper
cgacggctaccgctggtgcgccacc

SEQ ID NO: 38127 - DNA, 33 bp, Homo sapiens
  chr20:44640787-44640820
  hyper
tgatggggggcaactcggcgggggagctgtgcg

SEQ ID NO: 38128 - DNA, 261 bp, Homo sapiens
  chr20:44650230-44650491
  hyper
gattcaggaacccttcgcacagcgggcactaggaccctgcgcggcgccgcgtctcgcggggggcgggcgggcggagggggttgggggatccgctctttctccctcctagagcctggttgcagccacttgtgcgatcccggaccttgccgcggccgcctggctcctttccgcgccatgagccgcaggttcacggtcacctcgctgccccccgcagggcccgccagaagccctgacccagagtcccgccggcattcggtcgca

SEQ ID NO: 38129 - DNA, 58 bp, Homo sapiens
  chr20:44657782-44657840
  hyper
tgctgagagggggcgcgcgcgggtgtgagcgtgtgtccgtgtgcgagtgtgtgtgcgc

SEQ ID NO: 38130 - DNA, 34 bp, Homo sapiens
  chr20:44658183-44658217
  hyper
tccattggaatgctccgggcgctgtccaaggtgc

SEQ ID NO: 38131 - DNA, 171 bp, Homo sapiens
  chr20:44659126-44659297
  hyper
ctcagccatccatcacggctgtcagccacccccaccccccactctccagcggcgctgcgtcccctgcgcactagcgcgcctcccgcgcctgctgtctgcgctcagcgccttcaaacgttcccctgggcactgcttgaccctatgagcctagactcccgcagatccctctgg

SEQ ID NO: 38132 - DNA, 30 bp, Homo sapiens
  chr20:44660307-44660337
  hyper
cccagccccaggccccggggaggcttctta

SEQ ID NO: 38133 - DNA, 30 bp, Homo sapiens
  chr20:44660605-44660635
  hyper
cgttcagggaggggacgaaatcagccctgg

SEQ ID NO: 38134 - DNA, 107 bp, Homo sapiens
  chr20:44660842-44660949
  hyper
ggtcgccatggagaccggcgcggggccacctagttgcagggtctcgggccaggaagcccctattcctgtcccctgagcgccacccgcccccgcgaaggaggaggcgc

SEQ ID NO: 38135 - DNA, 30 bp, Homo sapiens
  chr20:44685865-44685895
  hyper
gaagaaatcccgggacgccaagcttgtttt

SEQ ID NO: 38136 - DNA, 193 bp, Homo sapiens
  chr20:44686422-44686615
  hyper
cgccgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcc

SEQ ID NO: 38137 - DNA, 166 bp, Homo sapiens
  chr20:44686627-44686793
  hyper
cgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacg

SEQ ID NO: 38138 - DNA, 129 bp, Homo sapiens
  chr20:44687107-44687236
  hyper
ctgcggctgcagagacgcgagcaacctcttctcatcggctcttatgcaagttggggccaggataggggaggggtgctcctcaagaggaagaaaccgagaggcccgcgccccaccgaggaagccccgccc

SEQ ID NO: 38139 - DNA, 30 bp, Homo sapiens
  chr20:44747259-44747289
  hyper
cactggctgcccaagcgtgcctagacggcc

SEQ ID NO: 38140 - DNA, 77 bp, Homo sapiens
  chr20:44803049-44803126
  hyper
gcaggaaagggggtccgcgggggaaacgcgttgtcctggggccccggcgtgtgctgggcgggtgagcagccgcgccc

SEQ ID NO: 38141 - DNA, 638 bp, Homo sapiens
  chr20:44803172-44803810
  hyper
cggtggccggcgtagagcgcggccaggggccggaagcgcggaccccagctgctgagataggcgaagtcctgctcggagcccgacgagccgctgtgcagggagctgagcgaggcggccggcgagtccgcgccctcgaaggcgtaggtctggaaggcgtcgtagggcggcaccgacaggtccccgtccgccagtgccaccttgcggctgatgaagtccctgaacactgagaagtctggctcggggctcggcggcccctgcggcagcgagtggcgctcggagggcaggtgggcctgcggggggctgcccgcgcccccgcccgagcccccgcccgctcccccgcccgcgctgccgcccccgtcgccgcccttgagctcgccgaagtcgtagaggctccgcagcgccgacatgtcgtaggcttcggtgtcctgctcgccgccgccttcgtcgttgtatttgatgacgttgtcccgcatgtcttcatcctcgtccgagctcaggtggctcttgtggtggcgcctgagggtgaggatcagcagcaccagcactgcgagggggacagagggggcaactgagggccaagcccctcccagggcattagaaggaccctctaccccatctcctcccgcctcccacccagc

SEQ ID NO: 38142 - DNA, 45 bp, Homo sapiens
  chr20:44879746-44879791
  hyper
cgcgtttgacgcggccggctcccagcgcgccgtcctgccgagctc

SEQ ID NO: 38143 - DNA, 127 bp, Homo sapiens; identical to SEQ ID NO: 13829
  chr20:44880040-44880167
  hyper

SEQ ID NO: 38144 - DNA, 26 bp, Homo sapiens
  chr20:44880275-44880301
  hyper
cgggttggggccggcagatcctgcca

SEQ ID NO: 38145 - DNA, 157 bp, Homo sapiens; identical to SEQ ID NO: 13830
  chr20:44936314-44936471
  hyper

SEQ ID NO: 38146 - DNA, 92 bp, Homo sapiens
  chr20:44936608-44936700
  hyper
cgaggttgtggggacgggtgggagctgcgggcttcgggccgagaggcggctcggctccgcgccggggaaagtttggacgtgggaaactccct

SEQ ID NO: 38147 - DNA, 263 bp, Homo sapiens
  chr20:44937023-44937286
  hyper
agcgagagggggagccgcggcggcgtgtgcgcgcgtgtgtgtgagcgagagagcgagagagcgagagagcgagggagtgagcgagcgagcgggagcgagggagtgtgcgtgtctgactggggggaagtgtgcaagggacggatcccttccttcctcccgcagcctctggtggagactcggagaatgcagggcccgccgggcaggagccgcgcagcgccaagccgcaggcggccgccggcccggacccccgcagccggggaacc

SEQ ID NO: 38148 - DNA, 93 bp, Homo sapiens
  chr20:44937550-44937643
  hyper
actactgcgggaggccgccttcagaggagcaggggcgcaggccagggtaggagcaggcttctcgaacagtggccgccccggcttgctgcccag

SEQ ID NO: 38149 - DNA, 177 bp, Homo sapiens
  chr20:44941484-44941661
  hyper
aggggacggggaggccgcccttggctgggggcgccaggacggggaggggcgagcctgcgggagccacaggcgccgaggccgtgcgcccttaagcacctccacctcatggcgttaatcctcgcagaccccgcagccagactgcctgggttcaaatcccatcaccgccacttgccagct

SEQ ID NO: 38150 - DNA, 205 bp, Homo sapiens
  chr20:45141834-45142039
  hyper
ctagctacttggatgcgtaaacctttcaccttcaccaagcgccttcttcgggcaaatcagggccctagagagagctcgcccgtggcctgcaggtcaggagcccaatcctgccctggctgcctcgcctcccgaccacaggaaaccctccctccaaagacagggagagcgcgcgtccaccctccgcagacccgaggcccgctccgcc

SEQ ID NO: 38151 - DNA, 77 bp, Homo sapiens
  chr20:45142151-45142228
  hyper
cgggaccagggattcacgggctgcaggaccctcacccggaagagcctggcgaaccggaagggcgtccaggtaaaaaa

SEQ ID NO: 38152 - DNA, 128 bp, Homo sapiens; identical to SEQ ID NO: 1483
  chr20:45279854-45279982
  hyper

SEQ ID NO: 38153 - DNA, 263 bp, Homo sapiens
  chr20:45280039-45280302
  hyper
cgctgctgccagcgccgccatcagcgcgatcgcctggcggtacgggccggcccgggactgccccgcctggccccggcgccggcttaaagcctgggggagggtcggggaggggactgcgctggggaacccgccctctccctgctcctcctggaggaaaagggtggtgcctgcgcccctgggaccgggtgaaagaggcccgggaacgttggagaaagttaggcactagaattagcaaacgggaccccagccgcagggcagtgtgg

SEQ ID NO: 38154 - DNA, 386 bp, Homo sapiens
  chr20:45338398-45338784
  hyper
tgcctgctggaagcccgaccccttcccagggtgtagacaccgcccccacgctcccctaagagtgcgcgccccctggctcccccagggccgccccggccggataccgcctctcgggtggccagcccgagactgcaggcctgcggcgggggctgggacggggctcggtcgcgcttccttccatcttcctttctgccccggaaaagtggcccctcacttgctgcagcgcccactcgggcccaggcactctcccgggcgccctgatccgacagccccaggcaagtgcagctgttcctggtctgcagatgaagaaatggaggctccgaaagaagcaaagcagttcatcgattcgctgagcgcggttgtgccccaggcgctgttgtgggcct

SEQ ID NO: 38155 - DNA, 1382 bp, Homo sapiens
  chr20:45523196-45524578
  hyper
ggaggtgcggggtgtcggtgggtggggaggaggctgggccctggcctccaggaccggcgagagtgagcgcgctctgctcggctgcaggctcaggaagcggcgcggcggcacgtgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtgagtaccgccagcggcgcccaccccaggccgcccgccgggattcgccgggcggggggagttgttcaccgggaccccctcgccctgcgcctctttctggcactcgccaagcggggcctccgcagctgtcgggacgttctggggcgcacgggcctcccagggccaggaaggcacaagggcagaggggacagcagcagagcccccctctggaaaggctctcccaggctcggggccccagtttccccatgcgctttggggcaacgaccctgaagtttgctctcccgcgcgcgggacaagtgcatggcgcgcaggcggtgtagacgcggctgggtccttggcgttttgttcgattatggtcccggcggttcgcgataaggggcgctcccccagtccgcaaactcaagccctcaggtagtgtttatgggataaccaagaagcagagccaaccgctggaatcccggcttggggctggaacggcccgctgagactttgccttctagctattgatatatttcttttcaaaagtccgtttgcgctcggcccgctctggttcaggtctggggctttgaaccggggcagggaatcctggcgcctgctgcgggtagagttgaaacttagaaaagtttacatccgaagggtgtttagaaggcggcaaggatttcgttgtaatgggagaaagtgggaaatggaattgttttttagtcatgaagtctggaggttaaacggccgtgctggcccaggctccttcaatatattcctgcctgcctcccccccagcaataaatagtttataagctcaaggaatactaggaaagcgtgactggtgaacgtactcctatcgcaaaagactcagtgcgcttttctcagctgttgaactggaagcgccttttgcagtgcgaggttcctgcttccccgaagccgaggctgagagttgacagcgtgcaccctgccgc

SEQ ID NO: 38156 - DNA, 128 bp, Homo sapiens
  chr20:46413326-46413454
  hyper
accggcagcttctggcgcgcaggagccagatcctgttcagccgcgtttccctggaacagaacgcggtgcccggcacgagggggtgctccagaaatgcttgtagaacgaatgaacgaactactataagg

SEQ ID NO: 38157 - DNA, 279 bp, Homo sapiens
  chr20:46414635-46414914
  hyper
ccccggccccggccccgaagtccagctccggacggggcagtgaacgcagagctggggtcccggcggctctcgacctcccgatgcctccggactcggctggccgcgctcccggcgccgagcgcgcaccctcgccgggacacacagacgcacactcactcgacacactctcgctcctgctcgccctcggcggagagttgaaacagatgtgggattcgcccaggagctggaaacgagggagggaagcgagccagagccttgtgtgcacgtgtgtgtgcgtaa

SEQ ID NO: 38158 - DNA, 30 bp, Homo sapiens
  chr20:46415157-46415187
  hyper
cggtctgcaaacactcgactgcctttgccg

SEQ ID NO: 38159 - DNA, 42 bp, Homo sapiens
  chr20:46415427-46415469
  hyper
gtctaccgtggtttccgctgtccctcgcgccacagaagaggc

SEQ ID NO: 38160 - DNA, 218 bp, Homo sapiens; identical to SEQ ID NO: 4822
  chr20:47443719-47443937
  hyper

SEQ ID NO: 38161 - DNA, 297 bp, Homo sapiens; identical to SEQ ID NO: 4823
  chr20:47443944-47444241
  hyper

SEQ ID NO: 38162 - DNA, 186 bp, Homo sapiens; identical to SEQ ID NO: 4824
  chr20:47444242-47444428
  hyper

SEQ ID NO: 38163 - DNA, 129 bp, Homo sapiens; identical to SEQ ID NO: 4825
  chr20:47444452-47444581
  hyper

SEQ ID NO: 38164 - DNA, 184 bp, Homo sapiens; identical to SEQ ID NO: 4826
  chr20:47444609-47444793
  hyper

SEQ ID NO: 38165 - DNA, 295 bp, Homo sapiens; identical to SEQ ID NO: 4827
  chr20:47444920-47445215
  hyper

SEQ ID NO: 38166 - DNA, 163 bp, Homo sapiens
  chr20:47934824-47934987
  hyper
cacaagatctgtctccgttggcgtcccggtacctagcttgagcccgaccatgggcatgcgtggcgtggcgcgaatcctgtccctgtcgctcgtcctggccgcggtggccacgggggcctgggagcgggggccgctgggcgtgctcttgccctggcagggctcc

SEQ ID NO: 38167 - DNA, 1064 bp, Homo sapiens
  chr20:47934988-47936052
  hyper
ccgcgctgggccgctgctgtcctggccgtgacccgatgtttgtcgcccgcgggcccccgcgctgcttctgcgaccaagcgtgcggcgcggcgcggcgcgggactgctgcgcagactatacgcgggtctgcccaggtgcacccggggaaaggcaaggcactagcggaacgctcggagcggaggggagctggggcgggggatgagcggaggaagggagcccagcacctagggggctctgggcttggaggggtcacacgagccgagggcggggcgcggcgcttggggactggaagggtgcgccgcggggcagacgggacgtgcagggggtcgcgcgggcaaggagggacgcagacactcaggacctaaaggggaagcactggctgtggagctgcgagccgagaaagacgcgcaggttatgaacctgggtgcgttcatctcgggggacctgaaggagagggactcgtggagagttgaggggtgtttcggaggaggggcgcaaggactgctcacaggacttgaagggcggcaggaaggtggaggattcggcccaggtgcgggacgcaggcggtggaagggaaatgagcacaagaggcgcaggcaggaaggagagcgcctggtgcgagagaggaaggagcgcacccagtaagcggtgtcgggggggtcgtgaagcttggagggcctcgaggggagggaggcgcttgggttgaggtagggcgccagatttcgcaaatcaaaatacagcacacccagttaaactcgaatttcagataaacaaatctttctagagaaaaatatgtcctaaatatcgcatgggatatacttatactaaaaaattatttgttgtttttctgaaattgaaatctaactcggagtcctgtattttatctgagagccccagctggggacgggcgcggggccaagagagctgcgagggaggaggggttgcaagcttctttcgggcggaggggtcacaaggcgaatggagaaggtgacaaggagcatggagaaaccaagaaaagggctaacgcttggagagcaaggatggaaagacgctcaaagcggagg

SEQ ID NO: 38168 - DNA, 138 bp, Homo sapiens
  chr20:48099124-48099262
  hyper
gggtgcagggggccccgcgggcgcgcgtcacggccgtcttctcacctccatcccgacggctgcgaggcagaaagcgaaagcggacgcgggtcagcaaacggggagctgggcatgctgtccccccgccccccacctctc

SEQ ID NO: 38169 - DNA, 30 bp, Homo sapiens; identical to SEQ ID NO: 13849
  chr20:48099543-48099573
  hyper

SEQ ID NO: 38170 - DNA, 30 bp, Homo sapiens
  chr20:48100342-48100372
  hyper
gcctgcctcccaccccgctcccctccagcc

SEQ ID NO: 38171 - DNA, 53 bp, Homo sapiens
  chr20:48184239-48184292
  hyper
ccacccacaaaccctcggtcctcacctgaaaccccctcctaggtccctgccgt

SEQ ID NO: 38172 - DNA, 327 bp, Homo sapiens
  chr20:48184328-48184655
  hyper
cgattcgccccgggggacctaccggaccccgcaccttcccaccttgcaccttcttggcagggggagcacggcctggccccctcacccacgtgcggggccccgggactcccacctccgagggtctcgccttgcccgggatactggagcgggactcgggccgggccggccgcgggctccgagacccttgggctgcagcccgggcgggagccgccccctttgtctggcggggccgagcggagcaggacactcaccgcgtgcggcggcggctcagtagcagcagcagcaacagtgcggccaggaggccgaggagcgcggcccaagccatcg

SEQ ID NO: 38173 - DNA, 109 bp, Homo sapiens
  chr20:48788910-48789019
  hyper
gggctctttgccttccgatccaagctccgccctctgcagctctgctctgtgtatcccagagctgaccctgcggcgcctttcccaggctcgcgtccggtgagttcctatt

SEQ ID NO: 38174 - DNA, 129 bp, Homo sapiens
  chr20:49435030-49435159
  hyper
cggccatcttgatctcgtccttccctcgagatggtttttattccgcagaggagccaggagtggaccacaaggtggcactctcgggcaccgatgcagggagccgttcagcggggacgctagactatattt

SEQ ID NO: 38175 - DNA, 30 bp, Homo sapiens
  chr20:49575750-49575780
  hyper
ccaagtgctgcatggcgaggcactggctgg

SEQ ID NO: 38176 - DNA, 33 bp, Homo sapiens
  chr20:49576086-49576119
  hyper
gaccaactgcgcggacggcggggtgctcggtgt

SEQ ID NO: 38177 - DNA, 11 bp, Homo sapiens
  chr20:49639123-49639134
  hyper
cggcggcgaac

SEQ ID NO: 38178 - DNA, 50 bp, Homo sapiens
  chr20:49639135-49639185
  hyper
tcccggacttcgcatcccggtgaccccttgggatgaaccgaagccggacc

SEQ ID NO: 38179 - DNA, 317 bp, Homo sapiens
  chr20:49639217-49639534
  hyper
cgccacgcaccagcggtgactcccgagtcctctgtcgccctggcctccccgcaggcgggtttcgaggcccccgcagggagttcagggccacggccacgtgcagccgcccccgagcccgagtttgcaggctcggggtccggttcgcgctttggtggcgcccggcgaggctgcagcgcgcaaagttcccacctcaagttcccgtcgcggcgtccccgcctcggagttggcccggccgcggcttccgttccccccggctgcccacgggtccggggcgaggacgcgagaggggcctggaagtcgcccggggagcccgctct

SEQ ID NO: 38180 - DNA, 83 bp, Homo sapiens; identical to SEQ ID NO: 13853
  chr20:49639774-49639857
  hyper

SEQ ID NO: 38181 - DNA, 115 bp, Homo sapiens
  chr20:49639882-49639997
  hyper
cggccagttcctgagcccgcgtccgggactgctcgcgctacgccctccctcccgttgccttcttccccgtctgctctcccaggagcgaccaccctgcggccccttcgcctgcacg

SEQ ID NO: 38182 - DNA, 131 bp, Homo sapiens
  chr20:49640094-49640225
  hyper
cgcggtgcaagtgctccggtggtcccgggtccgcgcccctagcagcaccgccccagggtctacatgtgctagatattaaaaccccactctccgctgccccggggccgcgctccacgcgcttacacatcctg

SEQ ID NO: 38183 - DNA, 45 bp, Homo sapiens
  chr20:49708478-49708523
  hyper
gatctccacccctaccgcccttcatggtttcgggagaaagctgct

SEQ ID NO: 38184 - DNA, 118 bp, Homo sapiens
  chr20:49836918-49837036
  hyper
ccgtcctgcaggtggcgcgcctgagcccgtgcacggcagcctctccggaaggtgaagcacgctgccgcactgggggcctgcctggggctctgaaagcccattacgctgttctccttgg

SEQ ID NO: 38185 - DNA, 270 bp, Homo sapiens
  chr20:50157750-50158020
  hyper
gacaggcttcctccacgagccagtcagcacaagcccttcctacacactagatggaggcaagcccagagtgcgtctggaagctactaacaggcctgccactgagccttcaacaagcattggctgggctgggctgggctgtcaaaatcaggaagcctggttgggttttttgttttttccaagacaacctgctaaccagaaatacacagtgaggttgggcgtgtggccgcttccccctcctcctcctcctccctctaacgaatgctcctgtta

SEQ ID NO: 38186 - DNA, 65 bp, Homo sapiens
  chr20:50158354-50158419
  hyper
tcaacacaaagtccccgtcaaccactgctcacaggaggtgatgggagctgcgtggcctcacttca

SEQ ID NO: 38187 - DNA, 30 bp, Homo sapiens
  chr20:50179106-50179136
  hyper
acagaccccatgatgcggaggggatggcag

SEQ ID NO: 38188 - DNA, 48 bp, Homo sapiens
  chr20:50417842-50417890
  hyper
cgctggccgcggaagcgtgggccaggtcagccgcgggagttcgctctg

SEQ ID NO: 38189 - DNA, 809 bp, Homo sapiens; identical to SEQ ID NO: 1485
  chr20:50720392-50721201
  hyper

SEQ ID NO: 38190 - DNA, 437 bp, Homo sapiens; identical to SEQ ID NO: 1486
  chr20:50721234-50721671
  hyper

SEQ ID NO: 38191 - DNA, 48 bp, Homo sapiens
  chr20:50721988-50722036
  hyper
gggcagcccgcgccacctgggagctcgttagaaatgcagactctcggg

SEQ ID NO: 38192 - DNA, 120 bp, Homo sapiens
  chr20:50722096-50722216
  hyper
atgcacattaaagtttgagaaaccgtgtctgcattttaacgagatccccaggtgattcgtttgcccattaaaatttcagaagcgcagctctcctccaactttaatgtgcgcacgagtcac

SEQ ID NO: 38193 - DNA, 30 bp, Homo sapiens
  chr20:50722730-50722760
  hyper
ggttgagctaattagcgttcatgctcagac

SEQ ID NO: 38194 - DNA, 118 bp, Homo sapiens
  chr20:51589821-51589939
  hyper
cgaagtagaggatgccgaggagaaaacagcaggcacccaagcgggcggcaggtaagagaaacggctccgcttcggggctgccctgtgcgccgagctcctcgcccgccctccttgcccc

SEQ ID NO: 38195 - DNA, 115 bp, Homo sapiens
  chr20:52789445-52789560
  hyper
acaggatcagcagcccgtagccttctttgcggtagtcgcgataggccttccacggtttgatctccagccgctgcgggtacgcgctctcggtgcggtacagcgcttccagcaggca

SEQ ID NO: 38196 - DNA, 96 bp, Homo sapiens
  chr20:52789853-52789949
  hyper
ggtttaccagggtgtcgtgctgtttcttgagaccccctttccagagaatctgcagcaggctgcccagcagtggccagctggtggggcccggcaggg

SEQ ID NO: 38197 - DNA, 100 bp, Homo sapiens
  chr20:52790081-52790181
  hyper
cggcaagcgagcggctcttgctgatgggggagctcatggcagcgggggacaccggagcgcgggaaggcaggaggatggggtggggcgaggttggtacgag

SEQ ID NO: 38198 - DNA, 39 bp, Homo sapiens
  chr20:52790612-52790651
  hyper
cggctggccagactccgagggacgcgggacccaggggag

SEQ ID NO: 38199 - DNA, 329 bp, Homo sapiens
  chr20:53091752-53092081
  hyper
ctccccagacacacacgcaaaatcggcccttctcggggaaagggcaggggctgaagggggaggcggggtgggcggcggctggaaaaaagtgaaatttcctctcctcctaaaataagtcattggagcgaggagagcgagcgctatctcagtaggctgtgggcgaggtgcgggggtggcgggggcacgctccgggtccgccaggaggggagggatcggaaggggaagcggggagggaaaggtgggtgggaggcgcggggagcgttccagggcggctgctcacgggtggccgcagcccagtgctgggactcgcgcggctcctcctcttagcc

SEQ ID NO: 38200 - DNA, 92 bp, Homo sapiens
  chr20:53092141-53092233
  hyper
tccttctcggccgggaggaggcagggctggatccctcagccgccgccgctcctcctcctggcaggccggccgcggagtcagctgacgccggc

SEQ ID NO: 38201 - DNA, 100 bp, Homo sapiens; identical to SEQ ID NO: 13865
  chr20:53092234-53092334
  hyper

SEQ ID NO: 38202 - DNA, 198 bp, Homo sapiens
  chr20:53092335-53092533
  hyper
ccttctaaagcctcgcccagcgccgccgaagcagcttcacctctccaactttctcccaccgactgcttgtcttgaccctgccctccaccctccccagagccacttcgggtgcgcgctcttgggtaaagggggggtcaccggctgtctgggatggcttccaattttaatgacatagtgaagcaagggtacgtgaggatc

SEQ ID NO: 38203 - DNA, 182 bp, Homo sapiens
  chr20:53092686-53092868
  hyper
cgcgtctccggggctgtcactgtaaggccagcgtctaggtatgtaatggatctatctttatctcttggatgacttggctttctgatggtggccgcgtgttgggcttcagtagcccctggagcccatctactcgaaataaatatttctcggtagccatggaagttggagctgagaagcccggg

SEQ ID NO: 38204 - DNA, 337 bp, Homo sapiens
  chr20:53092912-53093249
  hyper
cgccgccaacttaacttttccgggggatggatcggctggttgagaaagaggacacgcatactcggtgtgaacgaggtcacgaaccctctgaccccagggagagatttctgccaagcgtaaggtgtctttggatccccccacctctgtcccaggtgtcgtgtcaaaggcggtgcgggctggcctctggtcggggccaacttgggtagatacttgaatctggattttccgtggttcgaagccggggtggtggatttctgttgctggaatacaccctggaggtccacggaagggttatttacgtggaacctgatacctggcatagcgcaagtgctcccta

SEQ ID NO: 38205 - DNA, 686 bp, Homo sapiens
  chr20:54578078-54578764
  hyper
tcatcaagccaaacacggagcaccaggtcgctaaacagcagctacagcttccgtcagctcttcccctactctcatcaacctcaaagtctgtctttccccagctatttgcaattctctgaaaggacatgagcccgggaagggagaactggctcccaagcgctttcctacaggagctcagcgcagttgccaaattccttttcctcccctcctccgcaacttttctctaagtaccggagaagggcttgctgcctactccgaggcagcggcagtgccagcggtgcctggcacacgaacagtggaacctgcaggcgagatctgacccccggctctgcccccgccctccgcggccacctgcccgatctctgaagagtgtggaagcccggggctctcttgggagagaagcttctctacctgggagaaacaaatcaaacatttatcctgttccgcaaaggtacccagggagcagcctcagcggcacccgcagaggagtctgagcaagggcaccaagatctggccaagagataacgacgtccagggaccaggtgcccttcggctcccgccgacctgttgctcgaaacttgccctgagctctcgctgccgggctctgggctcccaagcctctcccccgccgccgcagcagcctcttttaggggcccggaagaaatgggagccggggctggtgagag

SEQ ID NO: 38206 - DNA, 442 bp, Homo sapiens
  chr20:54580080-54580522
  hyper
gctgggttggcttatcgcgcaacccgcgggctccgagaaaagggggagaaggcgtctggtgaccccatctgagcagctctctcctgacgtttaacgcaccccaaagcaagcggggcgcacagcactggtgattggcaaggttcgaggcccctcagcccctgaaagcccgtggcgtaaaggatgcgtgcccagagaggagcccacggccctgcgctggccccagctccgcgcccactctctcctgctcgatctgagtccgcagaggaggcggctggtcccctcacccctcccagcgcggaactctgccgccgagtgccctccaagcggagcgcggcgctgccaggccgggtcgcgaaaaaggataagccgccgcggacccgcgctgcgcgctgccccgaacctggggaccggcgggcgtcccgaccgcgcctggccgggagcc

SEQ ID NO: 38207 - DNA, 52 bp, Homo sapiens
  chr20:54580621-54580673
  hyper
cgctccgggaagatgagcctcagaagccgcaggggcgcgccttccccccaca

SEQ ID NO: 38208 - DNA, 65 bp, Homo sapiens; identical to SEQ ID NO: 13872
  chr20:54919287-54919352
  hyper

SEQ ID NO: 38209 - DNA, 413 bp, Homo sapiens; identical to SEQ ID NO: 1487
  chr20:55199898-55200311
  hyper

SEQ ID NO: 38210 - DNA, 742 bp, Homo sapiens
  chr20:55200615-55201357
  hyper
cgtacggatgggctccgggatgttagtggagaggtgacaggagtctaccatcccacggccaagcgtgtgaggcctccggcgggcgggggtcccccccggggcagggcagggggagagtcaggcatgtctctaacgggctccctagtagaaccgctaggaaagtggccttcaaccctaggcacctttgtggctttcaggtagttgggcgactaaaaattcacttttgcctgctgtgaaatgggacaggtggttgtcaggttagagactgtgcccacgaagtctcgtttggcgggccgggactgacgtggacccgggccctcctcggaagcttgggaacctgtgagcccctcagctcctcgcctcactttgcctgtttgaaaaaaggagttgtttgagaggaagagttaaggctcaaaaggttctaaacgaagagcatgcggcctgacgcggagcgcaaagaagcgagcagtgaactgaatctggtgggactgagaccagaggcgtctgtatgcggcggccgcttcgcgccctattaaagcaatctgttatttacgataatcatttttgtaattattttggagtggctgtgacttgatgtctgtggtgccccagggcatgcccttactggacatagatacttcagggtgccctttgacgccagtgtcggtccagtgggtgccagtgccgcgaagggagggtggcgggcgtgaatgccccctcctcctgggtttgccgcaggccc

SEQ ID NO: 38211 - DNA, 2 bp, Homo sapiens
  chr20:55201450-55201452
  hyper
gg

SEQ ID NO: 38212 - DNA, 489 bp, Homo sapiens
  chr20:55201580-55202069
  hyper
cgtctggggtgggggcaggggtggcggatgactcaggcctggggccgggagccctgtttccaaaggcaccacctcgcgcctctttggaagtggcgcgctgttggggcgctcccgctgttgcagaggcctggtttgcggtttcataggggcgtgggtccagggcttccagggagtaagtgagtttaggctccctagggggcggtagaggggaacccccgacaaccttccatcctcttctccaggcggctgcgaggcctccggggttccagaggggtccccttctgccggtgccggctgtcttgagcgcggccacgcagtccgcgtcttcacgtgggcaaggggcggggacgttggagggaggctgtcttggatgctggagccttcggttcccggctctgctgagcagaaaagttgaagtcaaggaagggttgaggcttcctcacaagggcgcgcgcgtgcctgggtgccggcccagaagccgagaatgtg

SEQ ID NO: 38213 - DNA, 749 bp, Homo sapiens
  chr20:55202358-55203107
  hyper
gggcagctttggctagtgttgctgtgggaaaggagagccagggcctgggatgggggatgagcaccttcttgcccattccgggccccagcgtgcaggaggtaaacttgccagcacagacaagacagcttgttcaagctgcacctcaggccgggtcagagaataaaaccgagggctagaaggcccagaatgtcggacagcccagcggcacccgtcagggagtcccaggcgcccgaaagaggcgccgcacctctggcgagtctaggacccatcttcctggacctgtgctctggagtgcctgcgggcctgggtctaatttctgcttctggcaggtgtccccctcccccgccgctaataccaggagcgctgcttctgcggtaacttattttacccccagaagcctgttttgggaccgaagtgtcagggtcctgtgtgtctttttatgcactgttctccttagtgcaaagccctgcagatatgcttggccgaaaagtctcagtggtttcaacttccagattttgttcccgcgtccggtcggaaaatcacctgggatttggctgctgtctaaggccgggggaaagtttcccttggaggacgcctattattattattttcttttaggcccacctgggtctaaataaatgctaaagttcaaacgaacccgagaaggaacagcgaggcagtggatgccgccattccgtggatgggagagtcatgtctactgcaggtgcggacaccgtactgataggcat

SEQ ID NO: 38214 - DNA, 896 bp, Homo sapiens
  chr20:55204104-55205000
  hyper
gtgacagaaggaaggcgcgtcgggggacccaggcctcgcaggtcttcggctgtcaacgaggcaccgcccactgactccgcgcttcgtccctcacagcgtggggctcggcgctgcgccaggcccgggtgcggggcggagctaggctgggactggctgggggccgccccgcccggcgcctgggcctccgcgccggcccccggggaggagttatgataatttccttctcattaaggcgctcgggtcccccggctatcgccaggacacactgttcgggcgcggctttccccgtccgcggagcggtcttgacactcgcggcggcagcatctacgctcgcagagccgccgatgcgtgtccagtgacccggacagcaaggcccgcgcgcggcgggggcggcggcagacgcctggtcaccgtgaccccgattttggatttaccgcttgggggctggggggatcctggatttaactggcgactgttttgggggacgccggacgccatgttgtggaaaataaccgataatgtcaagtacgaagaggactgcgaggtgagctggggctccggggtgcagccccgccccgccgaggacagtccgggaggcaggggccactggaccgaggtcggggacgagggcataggagccctggcctctcggtgggacgggatccacttctccggacaccccttagtccatttctgcggggcccctttcctgtatagggccttttcctaaatagcctcccctcgggaacgaggcctggaaagagaatggcaaatcccacccacacagcttaccgggcgctttcctaagcggcaaacagccctgcttcccgttttctcggaaaagtgccccgtctgcaaccctcagacgtggcttttacgcacgaagtctctgtcca

SEQ ID NO: 38215 - DNA, 123 bp, Homo sapiens
  chr20:55205304-55205427
  hyper
cgggagcgcggagctcgggctacggactcgcgggagttcactgcgcctccgggccctggagggctgcccctgcccgcaggcccgggcgcttccgccaggaggcgacagcgccatgttcctcca

SEQ ID NO: 38216 - DNA, 15 bp, Homo sapiens
  chr20:55205765-55205780
  hyper
ggggcgggggaggtg

SEQ ID NO: 38217 - DNA, 137 bp, Homo sapiens
  chr20:55206293-55206430
  hyper
cgggtcccccacctctcctccgccgggcagcacctctacagccccgcgccacccctctcccacactggagtcgccgaatatcagccgccaccctactttccccctccctaccagcagctggcctactcccagtcggc

SEQ ID NO: 38218 - DNA, 42 bp, Homo sapiens
  chr20:55405254-55405296
  hyper
cacccccacaccttccggtttccaccccgggctcatttgtct

SEQ ID NO: 38219 - DNA, 30 bp, Homo sapiens
  chr20:55499420-55499450
  hyper
ttaaggagagtatcacgtttatactttaaa

SEQ ID NO: 38220 - DNA, 511 bp, Homo sapiens
  chr20:55499791-55500302
  hyper
aaaggggggggaacccgattagttccaaataagcgtctcttaatcacccttatgaaggcgtaatttgcaaaacactcctaggaagtaacatctttttcatttcaggggaaaaaaaaagtgcattgataaaaaataagtagaacattttaattaaaactcataaagttgtggacatctggttgggattgttcgccgcggcggtgattagcggatccgtgcacctagataatgaagcctggtcgcggttattggcagaagggcccgggcgcgctgtgagaacgctgcaggctcactttgtagtgcggggcctacgcctattagattccaatcagtttcgcctaaaaaggggaggagggcggagtgggaggggggcccagagttaaacacaggaaacaagcgttgagtgtgtgccaataaaaatggtcacaaatcagggctgctgatgtcataaccctgggggtcgggggtcagggggagtgaatgcgcctgaaagggaccgcctgtctgcggc

SEQ ID NO: 38221 - DNA, 230 bp, Homo sapiens
  chr20:55500440-55500670
  hyper
cggctcttttgcatgcaggcccgcctgaatggggcgcctggaggctgcattgaggccgggctgtgtaaactgtagggtgcctcgccgactcggagccgcagagactggcggcgggtcaacttggaccactttgcattcacgctttgaataggcggagcgggaggcgtcctttcccgcggccgcctttcagccgagagagtgacagattggaggtcagcggctggcgggac

SEQ ID NO: 38222 - DNA, 50 bp, Homo sapiens; identical to SEQ ID NO: 13885
  chr20:55500671-55500721
  hyper

SEQ ID NO: 38223 - DNA, 63 bp, Homo sapiens
  chr20:55501052-55501115
  hyper
cgtaggagcttgccggtctccgaccgctgctggcctgcgaagccggcacgtttacaaggctca

SEQ ID NO: 38224 - DNA, 87 bp, Homo sapiens
  chr20:55588889-55588976
  hyper
tcaaaagcaattttccgaaagtgcctgcctcgacaagcaagccaccggcccgcgcagtccggggctacagagcgctcaagacctttc

SEQ ID NO: 38225 - DNA, 56 bp, Homo sapiens
  chr20:55839612-55839668
  hyper
tcgcgtcgccggggtcgtcgcggctccagtcggaaaccgggacccccagccgcccc

SEQ ID NO: 38226 - DNA, 87 bp, Homo sapiens
  chr20:55839692-55839779
  hyper
cgcaacccaatcgccaaaacctgtggtttgcgcgccacacgtggtaaatgctgaaaatagattctgccggcccgggacctaccacta

SEQ ID NO: 38227 - DNA, 672 bp, Homo sapiens
  chr20:55840929-55841601
  hyper
catgaacatgggtgccgagttgtgcttgccctggaggtgcgggcgcgggcggtggggcaagcccaaaatggagaggatctcgcgctgcatctcccgccgctcctggctgcggaggcgccggtggatgaagctcgagtgcacctcgttgtccaggctgaagtcggccagggcggagcgcagcaggaacaggggtgcccagagcgccacgaagctgtgcggcgccgcagctcgcagtgagcgcacgtgcatcgcgccggctctacgcgctacccgggctccgggctccgggcccgcaccgccccaggtggcagagggggcaggcggccgtccgcgccgctcggtcacttgctgcagacgggccccgctgcgcccgcgccagacatggcccctccccggccggccgcgctctgcccggacccccgccccctgctcggtgctggccccgggcccctcgccccgcactcgcccgggcgcaccgcagggcttggaaagcagccccggcgaacgaaaaggcgagtgaggaggcgggcgcgggtgggaggagcagccagcaagcctaggagtccagagagccaacgccggggaggcagcgaggaggcaggcgggcgggcgagcgctccttcttcccgctcctctggcgctctcgccctcgggcggcggcaacccaccctc

SEQ ID NO: 38228 - DNA, 232 bp, Homo sapiens
  chr20:55842055-55842287
  hyper
cggtgacccttgagccggtcttgcccctcagtccctgtatccttttaagccagccacgctgacccctccgcgcctccctgaagccgttgccagcctgtctctgcgctcgccattccctccgcctggacctctccccactcaccacctcccgcccccatcagacgctgctttctcctcccagagacctccaagacctgccaagctgaggttgtttcctcgcctcgcccctcgc

SEQ ID NO: 38229 - DNA, 774 bp, Homo sapiens
  chr20:56803351-56804125
  hyper
cccgcacggtcatgtcgccgcggcagtttgccactcggaacatctcccccgtctcctccagccgcacccgcaggacgaagacgtcaggggccaagtcgggcaaggcactcgcggccttcgggtcacagacgagccgctggctccggccgcgggcacaggccaggggctgcgcggggagggcccgcgagtccgccgagcccaccctgggcccgccgcacccctgagccccggcccgcgcaccgctcctgcgtcccgcattggggtgcaggcgagaggcgcccccagttggccccgccgcccgcgctccgcccgcccccgccgccgcccgccgcatcccccaggcgcggccgcgcgtcatccgcggctcgagtgcggtggccacgcgtcatcgccgcccccgccctgacgccccaaggcgggcccatgcgccccccgccccactgtgacgcccaggccccgccaggaccgccccctccagacgcaaggcgaggcccctccctgcctgccgcccgagcctccagggagaccgatgggcgggcggccccccaaggtcccgcagtcctttcccgctccgcgatgaacaaagccgcagtttcacgcggccgcgggagacggttcttaaataatggaacaggacataagtgcttcccagagcaaccgggagatttattgataaatacagagacatcgccgggcagccacgctccgacaacccgcactgggcccccgtcccgagctcaggccacgtccccacctcctcgaagcctccaagct

SEQ ID NO: 38230 - DNA, 15 bp, Homo sapiens
  chr20:57089445-57089460
  hyper
ctacaggccaggccc

SEQ ID NO: 38231 - DNA, 280 bp, Homo sapiens
  chr20:57224800-57225080
  hyper
tcctcacagtgaactcgcccagccctgctcgcggctctctcgattttatgtgggtttcgttggatgcattttgttatttgcctcaatggatgtttcacattaatttttagttgcacaacgaacgcgcgggaacattctccgtgagagaaaaagcacgggtggggggcggttaccggtgcttcccccggtcgcctgggggtcccgcacgcgccccgcgggtgccgctgtctggctggggtccctgggtgagccgcgggcaccggcttcgcgtctccccggg

SEQ ID NO: 38232 - DNA, 195 bp, Homo sapiens
  chr20:57225218-57225413
  hyper
cgcagcccggcccgcagcctcgccccgcaaggggaagccggccctgcacaggcccggggcccggaaggcgccgccgcacagctctgcgcccccgacccgctccggccgcgcgctgggccaggcccttggcctcaagcctcccgggcggctccgggccggacccgggtctccgtcgcgggacgccagcctgtttgt

SEQ ID NO: 38233 - DNA, 300 bp, Homo sapiens
  chr20:57875589-57875889
  hyper
agcccctctggggggcggggaggcgacgggggtggtgcagaagccagaaaagcccgagccacagccggccagctccgcgcagggatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctcc

SEQ ID NO: 38234 - DNA, 47 bp, Homo sapiens
  chr20:58152512-58152559
  hyper
ccgccggcgcctccccgcggccccggctccgctccgcggccctccgg

SEQ ID NO: 38235 - DNA, 238 bp, Homo sapiens
  chr20:58179141-58179379
  hyper
ttcggagcgagggttcggagggtccggggtgccctagcaggcccaggccaggtggttgcggggaggaagcctcaggtcgctcccctccggtgccggggtgggcgcgtcgggacccactggcctcccagtcccaggagaggaaggaccagggaaaccagctgtctgcagctgctggggaaattaggggctctcagggttccctttcctccgggaggggaggaaacgggactaggaagct

SEQ ID NO: 38236 - DNA, 102 bp, Homo sapiens
  chr20:58179793-58179895
  hyper
gaatgggaataaacacgaataaataacaaagcgaggccgcgcacgccgggatgcgcctggctgcagccggcgaggctattgtctccccgccctgaagccagc

SEQ ID NO: 38237 - DNA, 190 bp, Homo sapiens; identical to SEQ ID NO: 13892
  chr20:58180213-58180403
  hyper

SEQ ID NO: 38238 - DNA, 106 bp, Homo sapiens; identical to SEQ ID NO: 13893
  chr20:58180470-58180576
  hyper

SEQ ID NO: 38239 - DNA, 53 bp, Homo sapiens
  chr20:58508817-58508870
  hyper
catcccccccacccccgccaacgctcgccggggtcgcccgaggcctgagccaa

SEQ ID NO: 38240 - DNA, 30 bp, Homo sapiens
  chr20:58514777-58514807
  hyper
cgcaggatgatgggccgcaggcgggggtcg

SEQ ID NO: 38241 - DNA, 94 bp, Homo sapiens
  chr20:59804316-59804410
  hyper
gaaaccccctgcaggcgcggctgcacctcaagcccggcggggcgaggacgctgagctgcagacagcgccacctagcgtccgagagccacggcgc

SEQ ID NO: 38242 - DNA, 101 bp, Homo sapiens
  chr20:59826877-59826978
  hyper
cacccctgagctgcccgacctgggttcaagcccgggtcaggggagttagcaaggagacacctgaaaaataaaaggacagaatggaagtgcacactcccacc

SEQ ID NO: 38243 - DNA, 68 bp, Homo sapiens; identical to SEQ ID NO: 4843
  chr20:59828340-59828408
  hyper

SEQ ID NO: 38244 - DNA, 147 bp, Homo sapiens; identical to SEQ ID NO: 13897
  chr20:59829066-59829213
  hyper

SEQ ID NO: 38245 - DNA, 30 bp, Homo sapiens
  chr20:60794906-60794936
  hyper
gagcgcggccagcaccgcggtccaggctgc

SEQ ID NO: 38246 - DNA, 451 bp, Homo sapiens
  chr20:61339658-61340109
  hyper
cccaggagtgggggtcggcccaaccagctgcgcagccgcccagccctgccagcggggagcttcctccctccctgccctccggatacaccctcaccccaactgagcgagcccagggttgggggaggtgcatagttcccttcctagccggtgcgagaaattgcggagaacagggaagagggtggcaggaagggtctggtgcacgatacccgccgcgcccgctcggaatcctggttccctggagcgctcaccccagcccgccctgccccggggagcgcgagggggcgacccgccaggctgcacccgggcggggcggggatggcggcgggggctgcctccctcctccgccgccaccccccactgctgggcgcgccgcgcggccgccggctccgtggagacgcgcagagccgggagggcgcgggcgcggcgggaggtgtgcggggctggggtgcgc

SEQ ID NO: 38247 - DNA, 579 bp, Homo sapiens
  chr20:61340110-61340689
  hyper
gagagcgcgagggaggagattctgagcgagggaggggagcgcgcccgggcagcagtgcgtgcgctcctcccggcgccacaagctcgccccgcgcagcccgagccgggctgggcgctgtcctcgggggcctggggaaccgcgcggtttggagatcggaggcacctggaacccgtggcaagcgccgagccgggagacagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcccgttcatcggtccccgcctgagacgcgcccactcctgcccggacttccagccccggaggcgccggacagagccgcggactccagcgcccaccatgcgcctcaacagctccgcgccgggaaccccgggcacgccggccgccgaccccttccagcgggcgcaggccggactggaggaggcgctgctggccccgggcttcggcaacgcttcgggcaacgcgtcgg

SEQ ID NO: 38248 - DNA, 79 bp, Homo sapiens; identical to SEQ ID NO: 13900
  chr20:61447684-61447763
  hyper

SEQ ID NO: 38249 - DNA, 30 bp, Homo sapiens
  chr20:61448109-61448139
  hyper
aaggagagaaaagagcgtctttctctcttg

SEQ ID NO: 38250 - DNA, 139 bp, Homo sapiens
  chr20:61560322-61560461
  hyper
aaaaaaatggctttccgctgttataagcctccttcctaagactcagggtccgcagcagaataccctgacccaaaataaaaatactatgacaaaaatactccaggaggcagccggctttacttcgtttaaagccggattt

SEQ ID NO: 38251 - DNA, 427 bp, Homo sapiens
  chr20:61560528-61560955
  hyper
cggcccgtcctctccaagaaccggaagccggacagcgtcaggacgttttattcttctcacctgggattcagagaggcagcggccaaggacagggcccccgccgaggccaccgggcagcgtccaggtctcggcctttgggaggggagcagcgggggaggggcacggggaggggcgagggcggggcgcgcctgggcctcggcgctgggctcctcctctgcccgctccgggggacacccacaggattcttgcagacctctgccgaggcaggatggaggcctgcagggatgcaccgcgggcccgcgacccgggcggccggaacatagttctttctggccggagatcggcccggtcgtgagtcgtgtctgtgccaggccccccacgctgtgctccagggcctcagtgcccggcgcgccgggggctgtatcgc

SEQ ID NO: 38252 - DNA, 375 bp, Homo sapiens
  chr20:61585299-61585674
  hyper
ttcatccaggcctgccgggcagggccagctccccagggattcagggcctcctcactggcggctggtttgagtggctccgccttcactacgtccctcccaggctcgatgtttaaaaaggagcccttgccgcagccttcactacgtccctcccaggctcgatgtttaaaaaggagcccttgccgcagccttcactacgtccctcccaggctcgatgtttaaaaaggagcccttgccacagctcttcaacttcctttgcaggcccttattgggtagcgccaaggattctggaggggcctgtgggtcaaggctgccacacgcacgccttttcctagcccgccctcctgcagccacatcacaaaggctgggccaggcgag

SEQ ID NO: 38253 - DNA, 30 bp, Homo sapiens
  chr20:61636897-61636927
  hyper
ccctgcagtttagcacgaagggccggctgg

SEQ ID NO: 38254 - DNA, 368 bp, Homo sapiens; identical to SEQ ID NO: 13904
  chr20:61637281-61637649
  hyper

SEQ ID NO: 38255 - DNA, 222 bp, Homo sapiens
  chr20:61637735-61637957
  hyper
cgtgcatgcgccgccgctcgcgcgcgttgatgctgagccgcagagaccgctgctctcgcggccgccgccgcccgtccgccgcgctccctggcccgcgccgccgccgccgctgctcgaaggcgtcgtcctcgtccccgctctgttcgccgctgctctccgccgcctgagctggggcgcgaggtgcaggcgccgcggggaggtcgccgcccgggcccggagtgc

SEQ ID NO: 38256 - DNA, 250 bp, Homo sapiens; identical to SEQ ID NO: 1492
  chr20:61638220-61638470
  hyper

SEQ ID NO: 38257 - DNA, 264 bp, Homo sapiens
  chr20:61638534-61638798
  hyper
cgactccccggccgccgcctccggccgccccggggattccgccaccaaacgcacgcgtcccaggtgggcacccgcctcggtccgtctttgagtctgaccctagcgcaagagtccctggcgacacgcaggggccagagcgggggggcgcgccgcaatagcagcagcgccagcgccaacaccctgtcccgctgaggggccgcttcgggtcggggtcagggtcgtgggcgctctggtgcagccgcggcgcagcgtgtacccggagcc

SEQ ID NO: 38258 - DNA, 48 bp, Homo sapiens
  chr20:61639020-61639068
  hyper
cgcgtgaggcttggtgggctttcccggagcctccgaacccctggggtc

SEQ ID NO: 38259 - DNA, 77 bp, Homo sapiens
  chr20:61664493-61664570
  hyper
cagcaactgagagggcgtcccggcagggtatgaatggccagcaggacgctgaggctgcgtggcgtttccaccgtgct

SEQ ID NO: 38260 - DNA, 27 bp, Homo sapiens
  chr20:61703439-61703466
  hyper
gcgcctctgaccctccgctccgggctc

SEQ ID NO: 38261 - DNA, 53 bp, Homo sapiens; identical to SEQ ID NO: 1494
  chr20:61703709-61703762
  hyper

SEQ ID NO: 38262 - DNA, 190 bp, Homo sapiens; identical to SEQ ID NO: 1495
  chr20:61703845-61704035
  hyper

SEQ ID NO: 38263 - DNA, 180 bp, Homo sapiens; identical to SEQ ID NO: 13910
  chr20:61733260-61733440
  hyper

SEQ ID NO: 38264 - DNA, 394 bp, Homo sapiens
  chr20:61733694-61734088
  hyper
gtgcctcggtctctgcgcccggctctccctccggtccgcaagaggaggaaggcccgcggcgtgccgaggtcagcggcgcggagccaccaggcgagacggtcacggacgcctgaaccgaggtcaccgaggccacggggccgggaggccctcagcagagcccgggggctccgcacctcaaggccggccaggaagaaacagcagcaggagcccagggcgccccggggagcccccgacacgcgggccgagcgcccagagcggcccaggccctcgcgaggagaccggcctccccagggcggggcttccgactcgggcgcccgtgagccccggaggcggcgcgaaggggcagagtccgcgtttctaaccagcccccgggtgggcggtggcccgcgcggca

SEQ ID NO: 38265 - DNA, 65 bp, Homo sapiens
  chr20:61734101-61734166
  hyper
cgccgtgggctggggccggcctgggctttcagggcgagggctttccgcgccggccccagcccacc

SEQ ID NO: 38266 - DNA, 30 bp, Homo sapiens
  chr20:61734471-61734501
  hyper
gccaatcagagctgccgcttctgatggagg

SEQ ID NO: 38267 - DNA, 208 bp, Homo sapiens
  chr20:61747797-61748005
  hyper
aagttccctggagttcgttgcagtggaatccatggcccaggtgagcacagctgcagggagctgcgcggggggagccgcagagctgggcacttgcgaattaagtcccggtgaccggtgactgccgaggctctggcaggcggagggcggggtgcggagatgccgttcagaacctcggacagcgccgcggcccatccggccagccagaagc

SEQ ID NO: 38268 - DNA, 418 bp, Homo sapiens
  chr20:61806420-61806838
  hyper
tcccgctcccgcccccgccggagccacctgacccgtagcgaagttgccggccccgctgcgcgccggcctttgtgcgcaccgaggcggccgccgggaaccgggagcccgagctggcccggcagcgccgccgcccccaccttcgcgccccttttcactcccccactgtccccggagctggcaaataaacaaatccacaaacaaattatccgtgtgctccggagaggcggcggcgtgggcggcggcggagagaaggcgccgggcaaggcgagactaggcccccgcggagcgggggaagcacagaccccagcccgggcccggcagcagtaagttgacttttatgaaacctacgaagctcgcggggccaccgaaaaggtccccaccggagcggactctgcggggcgggcggggcagaggctgc

SEQ ID NO: 38269 - DNA, 334 bp, Homo sapiens
  chr20:61807183-61807517
  hyper
ggagccggtcctgtacggaaaagagacccaaagaaagatttggggtccccgaagccaaggtaccgatggggggtgctaaggagtctttccccttagaatgggaacaagctccaaggagctggaatcccgaggcgtcctggacccgtccaggaagctaagggtgggggacgggaggggagggggccgggagccggcctccctggccccaacccttggtgagaagagggctgggggtataaagtccgaaagtgaggcggaggtttcagggttccgtttcaacaccatggacagcggatgcctcagactgggagcctaggaccgccctggggactgc

SEQ ID NO: 38270 - DNA, 143 bp, Homo sapiens
  chr20:61807775-61807918
  hyper
gacacttgcgaagggcgaggaattgcggctgggaagggtcaggttgaagccgcaccaaagggggaggggcgtcctgatggttgaggaccggcggagtcggtgcgggcagaaccaacccgagttcctgccgcccttcctaaccg

SEQ ID NO: 38271 - DNA, 223 bp, Homo sapiens
  chr20:61808158-61808381
  hyper
cctagagggccagatcgggggcgccccaaggaccctatcgagctggcagtgactgcagtcgggccgtggagtgtcgcctgtgattccgtggtccctacgggcaagagctcccatcccggtctgaaactgtgagaaccgcaagctccgatgggggcggggaaggacgacctttaattcccaccccactgtacggagcccagcagggccatccgcaggaggccgg

SEQ ID NO: 38272 - DNA, 222 bp, Homo sapiens; identical to SEQ ID NO: 1497
  chr20:61808666-61808888
  hyper

SEQ ID NO: 38273 - DNA, 117 bp, Homo sapiens; identical to SEQ ID NO: 1498
  chr20:61808889-61809006
  hyper

SEQ ID NO: 38274 - DNA, 339 bp, Homo sapiens; identical to SEQ ID NO: 1499
  chr20:61809218-61809557
  hyper

SEQ ID NO: 38275 - DNA, 74 bp, Homo sapiens; identical to SEQ ID NO: 1500
  chr20:61809558-61809632
  hyper

SEQ ID NO: 38276 - DNA, 295 bp, Homo sapiens; identical to SEQ ID NO: 1501
  chr20:61809840-61810135
  hyper

SEQ ID NO: 38277 - DNA, 1 bp, Homo sapiens
  chr20:61810159-61810160
  hyper
c

SEQ ID NO: 38278 - DNA, 122 bp, Homo sapiens
  chr20:61862355-61862477
  hyper
agtgtgctcttctgccggcgtgctccccctgatggcctctcgacgtccagccgcttgtgtgttctgccaatgggctcctctccgtgtccagggcttaggtgcctgcccgctaggtctcaggg

SEQ ID NO: 38279 - DNA, 412 bp, Homo sapiens
  chr20:61884691-61885103
  hyper
cctgcaggaaggacacgatgcctccgccgtccctaggtccgcccgcaagcctgtgcccctaagccgagcacaggacacccaagctgcacagccacggactccgagggtttcgctgctcaaaactctgaaacagccccttctggcccttctagcttcaagaggaggaggggggcgcgcggtccagctgcgctccgcagcccacaaagcatcgtttcctttttaagacgggagacccagggccaattagcatcgaagcaaagcagcttccccagcctggacaggcgaggcctttgtttagccccctcccccgagggcaccgggctccgggaaagaatccgccccccaggcgtcccagggagcttcggactccggggcagaatggaaacttggccgagggagccccgaccaatcc

SEQ ID NO: 38280 - DNA, 96 bp, Homo sapiens
  chr20:61885195-61885291
  hyper
cgggggcgggcggggccggtttgctcgcgggtgggcaggacgttctcaccccccgccccctacactcgcaaactcgcaggcacagcctccgtcatc

SEQ ID NO: 38281 - DNA, 259 bp, Homo sapiens
  chr20:61885292-61885551
  hyper
ccccacccgaatctcagaatcggaacttggccgctcactcggcgcccggggccggctgcgggaaacgctcgcacagacagagacaggcgcgcacccgggggcgcacccggggccacacacgcctccccaggcgatggggtccaggcggccccgcccgaaggcttccgtccggccagcccatccagccgctgccccgcacctgtccccgccgctccggacccgcggccgccccccgcgcacgcacaccggggacgggacc

SEQ ID NO: 38282 - DNA, 344 bp, Homo sapiens
  chr20:61885860-61886204
  hyper
cgcccgctccccacgcgccgcagcctggaccccgccccctccgcatcccgttcccccctcctccccgcaacccccggcccagccccagccccgggtaacagctgcgctgcgtctcccctcccacccccgcctgcggcccctgggggcttcgcgccggccggagagggggaccgttcttaaaggggcgatggcgcggcctctcgggtagcgaggggcggcgccgcggccccaggacagacctgcagctgaggggagcccgccctggacgcggcagggatgaccggcgtccgccccctcctgcaggatgacctgcccagcacctgctcccgccgtgcgccctccgg

SEQ ID NO: 38283 - DNA, 20 bp, Homo sapiens
  chr20:61886256-61886276
  hyper
cgaggcgttttctctgagag

SEQ ID NO: 38284 - DNA, 30 bp, Homo sapiens
  chr20:61886725-61886755
  hyper
atcagggcaggtggccgggccagggctgcc

SEQ ID NO: 38285 - DNA, 167 bp, Homo sapiens
  chr20:62102801-62102968
  hyper
ccgcagcccctcccccgggcctcgctctgccaaggaggggtcctgagcccgggatgtgcacgggggcggccggcggctgcagagatgggacagcgcaggagctgagcgcaggagctgagggggttcgcggggccagggaggggcgtcggcgccgagggggcaggaca

SEQ ID NO: 38286 - DNA, 325 bp, Homo sapiens
  chr20:62103301-62103626
  hyper
cgacctgagcggccccgaccccggaatccttcctgcccgcgcgctgtacaatcgctctccggtctcggcccagcactcccgccggggagcgccggccccggacccagacccaggggcagggagccaaacccgccgcagccagcctggccggggtcgccgatggggtcgccgatgggggtcgccatgggggtcgccacgggggccccgccggccactcacacgtaggcgtggtagatgaacgcccagccgcgcggccgctccagcacgttgtagaggaaattctgcagcttgcggtagaaggcgttgcgcttggggggcttcccgg

SEQ ID NO: 38287 - DNA, 180 bp, Homo sapiens
  chr20:62103667-62103847
  hyper
cgcttgggggcctcggagccggcgatcagcagcgccccgtcccgggtggagtcgggcgcgccggggtccagccccacgaagcccaccttcagcttcttctccccgctcgggccggggtatacgccgccgttgcgcgacttctgcaccatggtgcctggcgggaggcgccccgggtcgggc

SEQ ID NO: 38288 - DNA, 280 bp, Homo sapiens
  chr20:62119339-62119619
  hyper
ccccccagcagcaggcgcacacggctctggggtcgctcagtttattggtaaaacgggcactgagcgtggcgagcgctgggcgcggaagcctggggcgggggcgcctttcctcttgaagaacttccactggaccttgatggcgagcatccagtcgctgaccgagggcctctggcaagcggaggtgcagacatgcgcctggcgggggtgcggggcgccggaccggcgcgcggggcgggggcggggcgggggcccgggcccggggttcggagcgcggcaccgc

SEQ ID NO: 38289 - DNA, 150 bp, Homo sapiens
  chr20:62119922-62120072
  hyper
ggcctcgcgggagtcctgcctgggcggctgctccacggtctgcggggcggccacggggcgggggcagccctaacgctgccactgggcgaccgcgggccttcctcactcgcggggcctccctcactttcggggcctcgtctgcacacaggg

SEQ ID NO: 38290 - DNA, 34 bp, Homo sapiens
  chr20:62283802-62283836
  hyper
cctcgcgcccgaggtcgcccggcagctcccctgc

SEQ ID NO: 38291 - DNA, 191 bp, Homo sapiens
  chr20:62369082-62369273
  hyper
tccgcgcacccagctcggcacgcgcgcctgcaccgggccttggacccgaggctgacgaccccgccccccgccccccacctctacccccaaggcccgaggacgctgtagcccccaggaagagggcgcggaggcagcgggcgaggctgcagggcagtgcgacggcggcggaagcggtgagtgccaggctgtcc

SEQ ID NO: 38292 - DNA, 290 bp, Homo sapiens
  chr20:62461349-62461639
  hyper
tcacaatcttgccaccgtaatccactccaaatgcatcgttgagattgcagcacggaaagcgagagaggaaattcgctgcgaatctcaaactttcttttgtttatatttcttcgctgtcagaaaatatccgttcttcgccccatctggtctgtaccctggctcctcggtccagccctattgtgtgtgcttcgttaaacctacaaacagtgaatctgtcagcggggccaggggaaccccaactagcaggagccctccctctggcgcagagaattccccgtttgccttaggga

SEQ ID NO: 38293 - DNA, 50 bp, Homo sapiens
  chr20:62463147-62463197
  hyper
cgcgcggttgcactgcgcgcgtctcgcaaacttggcgactcccccagccc

SEQ ID NO: 38294 - DNA, 130 bp, Homo sapiens
  chr20:62463622-62463752
  hyper
gcattcctggccggcctgcgcaggggtaaaggccacctcgcttcctctccccgggcgcggcgggaagggaggtgagcctgtggccggcagccgcgcgagggagtcgagcccggcccggccaaccaatggg

SEQ ID NO: 38295 - DNA, 87 bp, Homo sapiens
  chr20:62600722-62600809
  hyper
ggggagagggggctccgccgcgctgcgcgcaggagacgccagcagcgggtccgccgcgtaggccgttcggcccgggaccccggccca

SEQ ID NO: 38296 - DNA, 82 bp, Homo sapiens
  chr20:62673837-62673919
  hyper
ctggacgcgggttcccgggtcgccttccggcctcgctcccgtcgggaggtcccgacacgggcttcctcgcagcctccccgcc

SEQ ID NO: 38297 - DNA, 15 bp, Homo sapiens
  chr20:62680421-62680436
  hyper
cgcggcccgggaccc

SEQ ID NO: 38298 - DNA, 41 bp, Homo sapiens
  chr20:62714767-62714808
  hyper
tcgcacactctcagtcgccgtcaccgcgggaagatggtgcc

SEQ ID NO: 38299 - DNA, 274 bp, Homo sapiens
  chr20:62715272-62715546
  hyper
gagcgactgcgtccacgggcgcgggtcgggcatgcggtaccccggttccaccgacccgcacgggaaggtggaggccgccgcgcccacgtcctccagcaggtcgccgaagagcagatggcggtggcgctgcgcagggagcatggccgccagtccctgcggcgtcagggcccagcccggcttggggggctctgtcgcgggcgcccccttggcacgctcctcaccctgcgccgtgcctggcgcgctcttcccgcttcgctcccgcgggcccttgcgc

SEQ ID NO: 38300 - DNA, 749 bp, Homo sapiens
  chr20:62733381-62734130
  hyper
ggcttttctgagcctcggtttccttccgtgtgcaaaggggaccgcagaaccctctttgtggggttgtgggggaaggctggggcgcccgggagggtcccgggtcgcgtccgacctcaggaaggcggggcttcagcagcggcctcggaccctccctccagggggcgctgtgggctcacgcgggcccagccttgggccccggggcgctgcggcgggaaccgcggtgactagcggggtcttaaagcgggtggcggggccgggctctcctgggaccaggagcccagagcgtggagacgtggcgggctgagccgctcagtgcggcccctgccccgcgcccaccccgccccgtgtcaggaggtccgcggagcgggaggacccgcctcccggggagagctcgcccgcccctccctcccggctggccgcggggcggtctgcagaccctttggccgtgccggatctgcctggtccccggggagaagacgctgaggatcccattgctggtctgtggatggggacaggagacgcccgaggtaagaaggggtccgggttctttggaggaatcctggttggcgccttctctgcagcagagacgcccggctggggccggagggcaaactgggggcagggtgggagacctcggccctgagggctgtaggggctcttgcctgggcgctccttaagctcccccgccccctccgccccccaccccgcggtgctcactctcagtcctgccttgcgcacattcccacgcc

SEQ ID NO: 38301 - DNA, 132 bp, Homo sapiens
  chr20:62734172-62734304
  hyper
cgcctcacacctggctctgccgcgggcttggagcgggtgtctgggaaacacagtctcacttgtctcctcaaggggctccggggcaccgtaacagcgtgcagagcgcagtcaggctgccgtgctgctgctttg

SEQ ID NO: 38302 - DNA, 30 bp, Homo sapiens
  chr20:62793356-62793386
  hyper
gagctcagaagcttccgtgtgcggagaaca

SEQ ID NO: 38303 - DNA, 101 bp, Homo sapiens; identical to SEQ ID NO: 13928
  chr20:62947884-62947985
  hyper

SEQ ID NO: 38304 - DNA, 315 bp, Homo sapiens
  chr20:62948007-62948322
  hyper
cgggggttggggcgcgggggttggggaggcgggggcgcccgggccgcgcttcccttcgcgggtgactcagcagccgccttcctcagcggggcggggcgcggcgggggcgcggggaggctgtgggcacgcggcttccccgcgccggggtgcaggtcctcgccgccgcccccgcgaggaagtgcgaggctggacgctgggaggcgcgcgtgggccgggagattccttctcgcctgccggctaccagccggcccgcccacgccgccgagatcccgactccacgttccctccccacggaggagtcggggcagcgcacgg

SEQ ID NO: 38305 - DNA, 291 bp, Homo sapiens
  chr21:15588524-15588815
  hyper
ggaggccgacaggaccgtgtttgttgggaatttagaggcccgagttcgggaagagattctgtacgagctgttccttcaggtaccgtctctgggaaggggcggcggaggggcggagcacgtcgggccggaaacatagcgcgcacctggaccacccggagcccggcccccttccgtcccatcctgagcaggggttttaatttcgtttcctcttggcgcacctgtctccaggtgagcggctggggagtgaaatgagggcgcgttccccatccccatccgcgctgcagagtcctg

SEQ ID NO: 38306 - DNA, 152 bp, Homo sapiens
  chr21:16438562-16438714
  hyper
aattaccaggggaagcgagtgttgttgctgaaattgtttttgcttgacacaaaaaagctaaagtacagcttagtctcacccgaaattctgaaacggcatgcccgtgttaaaacacttattacataagacaaatgagccgatgaggcactcca

SEQ ID NO: 38307 - DNA, 61 bp, Homo sapiens
  chr21:18985496-18985557
  hyper
ggcctgtgggacccccgcccggccgccctacgtgcgtcagcgccttcgggggtcgcgcggg

SEQ ID NO: 38308 - DNA, 30 bp, Homo sapiens
  chr21:19617785-19617815
  hyper
cttctctaacacacacgcagaaaagtttaa

SEQ ID NO: 38309 - DNA, 53 bp, Homo sapiens
  chr21:22370172-22370225
  hyper
agctgcggggcacaccgcccgcctccagatcccccattcacgttgagccgggg

SEQ ID NO: 38310 - DNA, 111 bp, Homo sapiens
  chr21:22370236-22370347
  hyper
cggtcgcctgcagtatcagtatcagcatcagcatcagcatcagcatctgcatgagcatcagctcagctcagctcagctcagcatcagctcagctgtcctgaggcagccggc

SEQ ID NO: 38311 - DNA, 128 bp, Homo sapiens
  chr21:22370348-22370476
  hyper
gctgtgaaggagctccaggctgcccccatccccacgcccttctcggctcagggcgtgcatgaacctgcggatggccggcgggcgagtggcgccttcgcgatcgcggccgcccctctaggcggaggcac

SEQ ID NO: 38312 - DNA, 175 bp, Homo sapiens
  chr21:22370552-22370727
  hyper
cgtgcagcgcggagggatacgcctcggccgcacctcccctcgccgcgcccccgcccccgccgccctccccgcccggctctgctgccgccgcggcggccgctgctgctgctgcttctgccgccgctgccgccgccgctgcctggatatagtgcggcaagagcggagcttgcagtca

SEQ ID NO: 38313 - DNA, 434 bp, Homo sapiens
  chr21:26934367-26934801
  hyper
gggttgcagaaaaggcgcctggtcggttatgagtcacaagtgagttataaaagggtcgcacgttcgcaggcgcgggcttcctgtgcgcggccgagcccgggcccagcgccgcctgcagcctcgggaagggagcggatagcggagccccgagccgcccgcagagcaagcgcggggaaccaaggagacgctcctggcactgcaggtacgccgacttcagtctcgcgctcccgcccgcctttcctctcttgaacgtggcagggacgccgggggacttcggtgcgagggtcaccgccgggttaactggcgaggcaaggcgggggcagcgcgcacgtggccgtggagcccggcctggtcccgcgcgcgcctgcgggtgccccctggggactcagtggtgtcgcctcgcccgggaccagagattgcgctggatggattcc

SEQ ID NO: 38314 - DNA, 30 bp, Homo sapiens
  chr21:27011446-27011476
  hyper
tgcttttttttttctcgagttcgaggcgga

SEQ ID NO: 38315 - DNA, 52 bp, Homo sapiens
  chr21:27012069-27012121
  hyper
ctcctgcgctcctgccgccgggaccctcgacctcctcagagcagccggctgc

SEQ ID NO: 38316 - DNA, 28 bp, Homo sapiens
  chr21:27012148-27012176
  hyper
cgccaccgcctcctcctgctgctgctgc

SEQ ID NO: 38317 - DNA, 548 bp, Homo sapiens
  chr21:27012177-27012725
  hyper
ctacctggtggtcgccctgggctgtaagttgctcgggttcctctacccttcctgcctggaccagcctgcccccaccctccagccccccacggggcgctggctgacagtgtctgggcggctctgggccgaggtcgccgcggggcgtctgaccttgcgcccaggcgagcgggaaacccagggtgcccgcgagcggacgctgggagcaagggagcgcgaggtcgtgggtttcttgtgaattgcgtctgattttgtcagttctagatacagaaaattaagggttcccactagcaggttctcatctgtttgcaaagttggggtaagttttcagacagagggacgtgattcgaatgcaaaactcactacccactggtaagatgctaagaccccaagaaagatggcatcactgggaggcgggcgccggccacactttgagtccccggggagggggcagcgtccgcgtggtctgggctctgtagcgtcccagctgagccggcgatatgcagcgcacttgtggggcggaggtggagggaattcgtggctgctgagcc

SEQ ID NO: 38318 - DNA, 235 bp, Homo sapiens; identical to SEQ ID NO: 13934
  chr21:27944913-27945148
  hyper

SEQ ID NO: 38319 - DNA, 26 bp, Homo sapiens
  chr21:27945604-27945630
  hyper
cgggcagggggcgggggtggccccga

SEQ ID NO: 38320 - DNA, 1300 bp, Homo sapiens
  chr21:28216633-28217933
  hyper
cggtctccgctttcccagtcggccggggctcgtcgtccacgaccccgcacgtgccgccgacgtcgccctgccgattccgccgcaggaggtggaactgtagtggtgccggcggcttctcccctggggcggcggtggcgaggcgctcgctggcggcgggcagcggctggatgaaatacgcctcccccagcaggtagaaggcgccgcgcacgccctcgcagaggctgagggcggcagccgagctgggatcgccattcacggtgccggagtagaagcagtgcgccaggtcggtttccggaagcggcgtctcggacccggatttgcgccccacgttctggagcgtgaagccgggcgccaaaaagctgctgtcgggccgcagctccagatccagctgctggtcaaaggcgtgcaggcggaggcgcgtggtcccgtgtcccggggcgcgctccagctccggcaccactagctcctcgtcctcctcggaggggcgcccgagtgcgtccgacacggccagtagcgccgcggcgagcagcagcagcgtgggtactggcccaaagctccgagaccccggagcccgctccgcgttccccatgtcgctgcccagcttgcgccttccgaacccctcgggcacagctcgctgcattggagccccaggagacaccgctcgtagcagcgcacggagcgagggacctttagttcgggtcgggagagcaaagcctcgttggcctgctctggattgttaaaattaacaatttctattattcgttggaagggcgcgcagagccggctacagccgaagctcccggagtcactaaaaggaggcgctgcagttctgccggcgcgcgggaagtttttcttccagcgcaaagttggagacactgagaggcaggcgcaggcagagtggctctgctgggacaagaagcgctctggggcgcctccggggctgaggcaacgcggagattggtgcctggcgcccctcttcggcctccgccttggctgcgatgttgctcactctgctcagggctctcccctctccgtccggtagcgcaccctggctttgcaatagcccctggctcggagccgctttccagcgagtgcaagaaccgggcagccgagcggtccttttatagtggaccagtgaaacccccacccccaccccactcctcccctttggcccttttccatcccaaagacgccgcccccggctccgttggtgctaaaccgcgctccgcgctgcgggctcgggagggggagggggcagcctccgcgctggctccacgccactgctcgtcaatctaggggc

SEQ ID NO: 38321 - DNA, 81 bp, Homo sapiens; identical to SEQ ID NO: 13938
  chr21:28218267-28218348
  hyper

SEQ ID NO: 38322 - DNA, 99 bp, Homo sapiens
  chr21:28218619-28218718
  hyper
caagccctaggccagcgtcgcagaaacggccaggaaccccactttcctacccgggggccagcagcgatcgctggggctagcaagcgtgcagagggggaa

SEQ ID NO: 38323 - DNA, 174 bp, Homo sapiens
  chr21:28218958-28219132
  hyper
cgcaaccctcacactcgcgcgcccccgcgttagtgctcgaactggtctccgcctttccgccccactcccgtccggtctcttggttggctccaagtagatctgggtcctttcctcgctcctccccagatcttccccacttcagttggccccagccagaagcgtcccttctagttc

SEQ ID NO: 38324 - DNA, 44 bp, Homo sapiens
  chr21:28338515-28338559
  hyper
cgccagggggtgcgggtggccgggaggctcggctcgctcctgca

SEQ ID NO: 38325 - DNA, 210 bp, Homo sapiens
  chr21:28339246-28339456
  hyper
gagaggggaaaaagccgtaaaaattaaaacaaaaatgcaggggggcagcctgaggcgagctggtgaagcggcgtgtctgtgtcccttcggctgcggtctcctcctgcccgccgtcatccccagtcggcagctgcgagcgccgagagcagcgcgagcgctgtgaagatgcgaggaggtggaacaatgaatttatagcggcatgccatcctg

SEQ ID NO: 38326 - DNA, 31 bp, Homo sapiens
  chr21:28339876-28339907
  hyper
tcccctttgcacacccgtgcgctctggcctc

SEQ ID NO: 38327 - DNA, 141 bp, Homo sapiens
  chr21:28339908-28340049
  hyper
cagaccgtgcaactccatccaccagccagagcttttcagcttcccgtgcgtcccctaaccaccgcgttcccttcgcttcctcccctccgtcccggcacccggtttcctccctccccattctccagcctcttgatgctttga

SEQ ID NO: 38328 - DNA, 286 bp, Homo sapiens; identical to SEQ ID NO: 4860
  chr21:28340062-28340348
  hyper

SEQ ID NO: 38329 - DNA, 230 bp, Homo sapiens
  chr21:31311404-31311634
  hyper
ccagagtaggggtgccggtccctgcgaacctggatccccgcactctagcccgcgttcctggagcccagattgaaaaacccgccaactgtacctcccggggaaggccggcaccctccaggagggaagcagtgacgcggctcccccttttttgtgtagcctcccatgagcactgacctccaccttccccagctccggctcctgcgccgccgcgcgctgcctcgcccgggacc

SEQ ID NO: 38330 - DNA, 220 bp, Homo sapiens
  chr21:31311700-31311920
  hyper
cgatcctgagtacttgcggggcggtctgagggaggatatagcagaggaaatagaggagtgcccagctggtgtccctggtccagagcccgggctgggcgaggagtgtgccgtgctccatcttcctagcttcttaattcatgccgagatacagccgctgccggacgcccgagagatgcacccaacttgggccgggtccccgcctcatcctctctggatgctc

SEQ ID NO: 38331 - DNA, 102 bp, Homo sapiens; identical to SEQ ID NO: 4862
  chr21:31312079-31312181
  hyper

SEQ ID NO: 38332 - DNA, 17 bp, Homo sapiens
  chr21:31312413-31312430
  hyper
agatactcgcgcgcgcg

SEQ ID NO: 38333 - DNA, 207 bp, Homo sapiens; identical to SEQ ID NO: 13945
  chr21:32716260-32716467
  hyper

SEQ ID NO: 38334 - DNA, 152 bp, Homo sapiens
  chr21:33245337-33245489
  hyper
ggatttgaaagtgcacgggctgcggagtggagctcgcatctgttcccgccgcccgcgagcggattaaatttctgcaaattcaaactgaatggggctttcttctgctgccttccagagggcgccggcagcccgccgcgcgcttctctccggcg

SEQ ID NO: 38335 - DNA, 30 bp, Homo sapiens
  chr21:34392013-34392043
  hyper
ctggttctcaagagccgggtgtaaggaagg

SEQ ID NO: 38336 - DNA, 638 bp, Homo sapiens; identical to SEQ ID NO: 1502
  chr21:34392436-34393074
  hyper

SEQ ID NO: 38337 - DNA, 1394 bp, Homo sapiens
  chr21:34395373-34396767
  hyper
aggccggccccgacacgcacccggtcttttgtgggagagaaacacaaagaagagggaaaaacacggaggaggccaacagcaccaggacgcgggggccaaccaggaactcccggagccggggcccattagcctctgcaaatgagcactccattccccaggaaggggccccagctgcgcgcgctggtgggaaccgcagtgcctgggacccgcccaggtcgcccaccccgggcgccgggcgcaggacccggacaagtcctggggacgcctccaggacgcaccagggcaagcttgggcaccgggatctaatttctagttattcctgggacggggtggggaggcataggagacacaccgagaggtactcagcatccgattggcaccagggccaagggagcccaggggcgacacagacctccccgacctcccaagctactccggcgacgggaggatgttgagggaagcctgccaggtgaagaaggggccagcagcagcacagagcttccgactttgccttccaggctctagactcgcgccatgccaagacgggcccctcgactttcacccctgactcccaactccagccactggaccgagcgcgcaaagaacctgagaccgcttgctctcaccgccgcaagtcggtcgcaggacagacaccagtgggcagcaacaaaaaaagaaaccgggttccgggacacgtgccggcggctggactaacctcagcggctgcaaccaaggagcgcgcacgttgcgcctgctggtgtttattagctacactggcaggcgcacaactccgcgccccgactggtggccccacagcgcgcaccacacatggcctcgctgctgttggcggggtaggcccgaaggaggcatctacaaatgcccgagccctttctgatccccacccccccgctccctgcgtcgtccgagtgacagattctactaattgaacggttatgggtcatccttgtaaccgttggacgacataacaccacgcttcagttcttcatgttttaaatacatatttaacggatggctgcagagccagctgggaaacacgcggattgaaaaataatgctccagaaggcacgagactggggcgaaggcgagagcgggctgggcttctagcggagaccgcagagggagacatatctcagaactaggggcaataacgtgggtttctctttgtatttgtttattttgtaactttgctacttgaagaccaattatttactatgctaatttgtttgcttgtttttaaaaccgtacttgcacagtaaaagttccccaacaacggaagtaacccgacgttcctcacactccctaggagactgtgtgcgtgtgtgcccgcgcgtgcgctcacagtgtcaagtgctagcatccgagatctgcagaaa

SEQ ID NO: 38338 - DNA, 104 bp, Homo sapiens
  chr21:34396987-34397091
  hyper
tacctcagctacctccgtgaggtgcttctccagttcgggcttaattcctcatcgtcaagagttttcaggtttcagagccagcctgcaatcggtaaaacatgtcc

SEQ ID NO: 38339 - DNA, 291 bp, Homo sapiens
  chr21:34397481-34397772
  hyper
ccctccctccttgcccgccctctacccctcaagtccctgcccccagctgggggcgctaccggctgccgtcggagctgcagccacggccatctcctagacgcgcgagtagagcaccaagatagtggggactttgtgcctgggcatcgtttacatttggggcgccaaatgcccacgtgttgatgaaaccagtgagatgggaacaggcggcgggaaaccagacagaggaagagctagggaggagaccccagccccggatcctgggtcgccagggttttccgcgcgcatcccaaa

SEQ ID NO: 38340 - DNA, 141 bp, Homo sapiens; identical to SEQ ID NO: 13950
  chr21:34397990-34398131
  hyper

SEQ ID NO: 38341 - DNA, 67 bp, Homo sapiens; identical to SEQ ID NO: 13951
  chr21:34398132-34398199
  hyper

SEQ ID NO: 38342 - DNA, 22 bp, Homo sapiens
  chr21:34398200-34398222
  hyper
ctgccaccgggctataaaaacc

SEQ ID NO: 38343 - DNA, 640 bp, Homo sapiens
  chr21:34398223-34398863
  hyper
gccgagcccctaaaggtgcggatgcttattatagatcgacgcgacaccagcgcccggtgccaggttctcccctgaggcttttcggagcgagctcctcaaatcgcatccagagtaagtgtccccgccccacagcagccgcagcctagatcccagggacagactctcctcaactcggctgtgacccagaatgctccgatacagggggtctggatccctactctgcgggccatttctccagagcgactttgctcttctgtcctccccacactcaccgctgcatctccctcaccaaaagcgagaagtcggagcgacaacagctctttctgcccaagccccagtcagctggtgagctccccgtggtctccagatgcagcacatggactctgggccccgcgccggctctgggtgcatgtgcgtgtgcgtgtgtttgctgcgtggtgtcgatggagataaggtggatccgtttgaggaaccaaatcattagttctctatctagatctccattctccccaaagaaaggccctcacttcccactcgtttattccagcccgggggctcagttttcccacacctaactgaaagcccgaagcctctagaatgccacccgcaccccgagggtcaccaacgctccctgaaataa

SEQ ID NO: 38344 - DNA, 97 bp, Homo sapiens
  chr21:34399162-34399259
  hyper
ctggggccatggactcggacgccagcctggtgtccagccgcccgtcgtcgccagagcccgatgacctttttctgccggcccggagtaagggcagcag

SEQ ID NO: 38345 - DNA, 664 bp, Homo sapiens; identical to SEQ ID NO: 1505
  chr21:34399441-34400105
  hyper

SEQ ID NO: 38346 - DNA, 27 bp, Homo sapiens
  chr21:34400231-34400258
  hyper
cgcgaggaggggcgcaggaccatggac

SEQ ID NO: 38347 - DNA, 327 bp, Homo sapiens
  chr21:34401144-34401471
  hyper
atgatgaggtaagtgcgcaatgctaagctgtttgctcacgtgactgccagccccatcggagtctaagccggctttcctctattttggtttatttttgccacgtttaacacaaatggtaaactcctccacgtgcttcctgcgttccgtgcaagccgcctcggcgctgcctgcgttgcaaactgggctttgtagcgtctgccgtgtaacacccttcctctgatcgcaccgcccctcgcagagagtgtatcatctgttttatttttgtaaaaacaaagtgctaaataatatttattacttgtttggttgcaaaaacggaataaatgactg

SEQ ID NO: 38348 - DNA, 90 bp, Homo sapiens
  chr21:34442167-34442257
  hyper
gcagcctgaccagtgcgaccagtcctccttcaacagccccgcttgccttgaaaaggcgcccttactccgctcagggggcctgtcccgcgc

SEQ ID NO: 38349 - DNA, 76 bp, Homo sapiens
  chr21:34442594-34442670
  hyper
gggaccatgctgcggccacagcggcccggagacttgcagctcggggcctccctctacgagctggtgggctacaggc

SEQ ID NO: 38350 - DNA, 862 bp, Homo sapiens
  chr21:34442730-34443592
  hyper
cgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttgggg

SEQ ID NO: 38351 - DNA, 470 bp, Homo sapiens
  chr21:34443893-34444363
  hyper
atcaaaggaggctgccggaactcaagaggcagaaaaagaccagttaggcggtgcagacggtctgggacgtggcagacggacggaccctcggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttagaaagcaacttagaactcgagattcacctttcgtttccctttccccaaaagtagcgtaaccaacatttaagcttgcttaaaaacgaaaaccaaccgccttgcatccagtgttcccgatttactaaaataggtaaccaggcgtctcacagtcgccgtcctgtcaagagcgctaatgaacgttctcattaacacgcaggagtac

SEQ ID NO: 38352 - DNA, 154 bp, Homo sapiens; identical to SEQ ID NO: 1508
  chr21:34444444-34444598
  hyper

SEQ ID NO: 38353 - DNA, 326 bp, Homo sapiens
  chr21:34481940-34482266
  hyper
aggacaagctgggcccgggcggattctcaccccaccaccccaactccaggcttgggtccatctgccgccagtggtgacttgggtggcgccctccgcagcagacagccgtgcgccctcggcgacccggtccctgcgctccggcgcccgcaggtcctcgctcccggcttctgcacctcccgctccgggacatctggctgagccgcgcctccctctccccgcagcctccgccggccccgcctcccctcaccacccttcccttgtttggggcggtaaggtcagaagcgttcaacaattcaacgtgggaagtctctcggaggaagtgccag

SEQ ID NO: 38354 - DNA, 30 bp, Homo sapiens
  chr21:34499655-34499685
  hyper
tgctggggttgaagccgcttgtttgagttt

SEQ ID NO: 38355 - DNA, 148 bp, Homo sapiens
  chr21:35574488-35574636
  hyper
tggggaagagctgagcgaaaccgccccggggtccaggcgttttgccacgagtcgccgtgcgacaagttggggtctcccttgttctcccacctctctgcaccaaaagctcttgaagcaaattaaagaaagcaggcgatgcttgtatcat

SEQ ID NO: 38356 - DNA, 96 bp, Homo sapiens; identical to SEQ ID NO: 1509
  chr21:36041933-36042029
  hyper

SEQ ID NO: 38357 - DNA, 79 bp, Homo sapiens; identical to SEQ ID NO: 1510
  chr21:36042091-36042170
  hyper

SEQ ID NO: 38358 - DNA, 983 bp, Homo sapiens
  chr21:36042171-36043154
  hyper
cggagggcccgctgggggacaacatagaagcggagggcccggcgggcgacagcgtagaggcggagggccgggtgggggacagcgtagacgcggaaggtccggcgggggacagcgtagacgcggagggcccgctgggggacaacatacaagccgagggcccggcgggggacagcgtagacgcggagggccgggtgggggacagcgtagacgcggaaggtccggcgggggacagcgtagacgcggagggccgggtgggggacagcgtagaggcgggggacccggcgggggacggcgtagaagcgggggtcccggcgggggacagcgtagaagccgaaggcccggcgggggacagcatggacgccgagggtccggcaggaagggcgcgccgggtctcgggtgagccgcagcaatcgggggacggcagcctctcgccccaggccgaggcaattgaggtcgcagccggggagagtgcggggcgcagccccggtgagctcgcctgggacgcagcggaggaggcggaggtcccgggggtaaaggggtccgaagaagcggcccccggggacgcaagggcagacgctggcgaggacagggtaggggatgggccacagcaggagccgggggaggacgaagagagacgagagcggagcccggaggggccaagggaggaggaagcagcggggggcgaagaggaatcccccgacagcagcccacatggggaggcctccaggggcgccgcggagcctgaggcccagctcagcaaccacctggccgaggagggccccgccgagggtagcggcgaggccgcgcgcgtgaacggccgccgggaggacggagaggcgtccgagccccgggccctggggcaggagcacgacatcaccctcttcgtcaaggtaaagctcgcttccctcaattcttaggacgacccccttccattcgaggtcttggtcatctcagatcccagagggacgcgcagggaggaaccc

SEQ ID NO: 38359 - DNA, 51 bp, Homo sapiens
  chr21:38063644-38063695
  hyper
cagcttttaagggatcgctgtggctacagcaggaaacgttcctgctccatg

SEQ ID NO: 38360 - DNA, 525 bp, Homo sapiens
  chr21:38064998-38065523
  hyper
cgttggaccttcttccgcaatcgggaccactccaggtctccccggagaaggctgagtctccagcgcgtggattcagatcaggactctgtctaagtaggcgagagctggggataccgctgggggctttggcgaagctaagaaagcactggcttcttattctcaccagacatctcaacacccacgtgcgctgggtcccgcagtctctcgcccgccccacgcgggtcccagccctggtccttactccccgcgcgggaagaatctggggagggtgggggcggagaggcggctgatcggagagtgggagggaggatgggagatgggcagaggctgcccgcatcagggccaggacagacgtccgcgcggccccaggcactcacttgagtgtcacgcaagtcaccccaacaccgcacaagacagtggcggggtgcgcaccgaggcccctacctggggggtgtgcgcgcactgaacgaccccttctccaggtgcgcgagccgctccggcggccgtgcacactgcgcccccttc

SEQ ID NO: 38361 - DNA, 262 bp, Homo sapiens; identical to SEQ ID NO: 4877
  chr21:38065799-38066061
  hyper

SEQ ID NO: 38362 - DNA, 112 bp, Homo sapiens
  chr21:38066820-38066932
  hyper
ggagcgagatgaggtcgtcgctggacgctgggctcccttgtcgttgtccttttccccagaatccatggtcaggcctagggagccacccctgggtgctcgagatgagtcccca

SEQ ID NO: 38363 - DNA, 30 bp, Homo sapiens
  chr21:38067379-38067409
  hyper
ccttacccccacaagcggcccaggaggtgg

SEQ ID NO: 38364 - DNA, 30 bp, Homo sapiens
  chr21:38067871-38067901
  hyper
aaaggagtgaaaaatcgaggaattctttca

SEQ ID NO: 38365 - DNA, 3 bp, Homo sapiens
  chr21:38068227-38068230
  hyper
tcc

SEQ ID NO: 38366 - DNA, 93 bp, Homo sapiens
  chr21:38068646-38068739
  hyper
cgcgaggctggtccgggctttctgagctgggcgttcggctttaggcccaatacctggaccaggaatttcttctccccgcgccagaagggaaag

SEQ ID NO: 38367 - DNA, 460 bp, Homo sapiens
  chr21:38069133-38069593
  hyper
gatgtgcttgggggagccgagtacacaacgtctgcttgggcagctgctgggcaggcgttgggcctggaggtatctcacacccacgtatcttccagtcttcaaacacggcattgctctgcctcccgtagcgcgcttcgaacctgcctcgcggacacgtgaacagaggctgtccctgggaagataagtgcgctttcccgtaaaatccgggaaatttgccttgaggaaagtttccgttcttgttacttgtcgggtttctcccacttccacttagccatgtttctgcgatctgggtaatccctttcaagcccaggaggaattctcccgggtccataattgagggtcggaagccgtgggggtgagaaacgcattaaatcctcccgaagcccaggaggtgccagagcgggctcagggggccgcctgcggaagctgcggcaggggctgggtccgtagcctctaaccc

SEQ ID NO: 38368 - DNA, 13 bp, Homo sapiens
  chr21:38069793-38069806
  hyper
tgtgcgtccggct

SEQ ID NO: 38369 - DNA, 68 bp, Homo sapiens
  chr21:38069853-38069921
  hyper
cgatgtggactccgcaaggggctagggacaggcagggggagagcccgggtttgcgcacaccttccagc

SEQ ID NO: 38370 - DNA, 143 bp, Homo sapiens
  chr21:38070572-38070715
  hyper
catgggccccacctgcgccacctgcgcccaccctgtgaccctggctcagcgaccttggcccttaatcgcccaacgccgattcctcaaaattccggctgcgctgaatcgggctgcttttgccgccgccccggcagttgggccct

SEQ ID NO: 38371 - DNA, 376 bp, Homo sapiens
  chr21:38072027-38072403
  hyper
tgcccggagccgaggcgcgatgaaggagaagtccaagaatgcggccaagaccaggagggagaaggaaaatggcgagttttacgagcttgccaagctgctcccgctgccgtcggccatcacttcgcagctggacaaagcgtccatcatccgcctcaccacgagctacctgaagatgcgcgccgtcttccccgaaggtgaggcctcaggtgggcggccggggacgctggggagcccggcggccccggcccaggcgggaagcgcaagccagcccgcccagaggggttgccgcggcctggcgtccagagctggggcgtctgagggaggttgcgtgagggtcttcggcttcggcgctggcttggggcgaggggccagggcc

SEQ ID NO: 38372 - DNA, 265 bp, Homo sapiens
  chr21:38072905-38073170
  hyper
agggtcagcttcaggcgctgcgagtcagcggggatcacggtgaggcccaagcactgcaggctgaggccacagagcgaacacttgtgctgagccgggccctctcgtgaggctggggtgcgggaagtccgggcaggagagacccgcccccgccgttgctgagctgagacccggctgaaagagaggggtccgattaattcgaaaatggcagacagagctgagcgctgccgttcttttcaggattgaaaatgtgccagtgggccagggg

SEQ ID NO: 38373 - DNA, 287 bp, Homo sapiens
  chr21:38073239-38073526
  hyper
cgcccacgccggttgccgctggtgacagtggctgcccggccaggcacctccgagcagcaggtctgagcgtttttggcgtcccaagcgttccgggccgcgtcttccagagcctctgctcccagcggggtcgctgcggcctggcccgaaggatttgactctttgctgggaggcgcgctgctcagggttctggtgggtcctctgggcccaggagctgggagggctgcgccggcctctggagccccgggagccagtgccgaggtagggagacaacttccgccgcagggcgc

SEQ ID NO: 38374 - DNA, 245 bp, Homo sapiens
  chr21:38073615-38073860
  hyper
cggaaagctcgaccttttgcgttcgcctctgccaagcctgttatttgtgctggccgctgggtctggagctgcgcttctcggcccctccccggtggagcgcagagggctggtctgcaagcgcggcctccagccccgcggctccccggcccaggagccaggcgcgggctgacccgggagcacccggcagcggagggggctggaagcggaccctaggcctctcctgtgccacccggccctaccgcgcg

SEQ ID NO: 38375 - DNA, 30 bp, Homo sapiens
  chr21:38075927-38075957
  hyper
gaggacaggagaccacggctgactttggac

SEQ ID NO: 38376 - DNA, 35 bp, Homo sapiens; identical to SEQ ID NO: 13975
  chr21:38076386-38076421
  hyper

SEQ ID NO: 38377 - DNA, 25 bp, Homo sapiens
  chr21:38077206-38077231
  hyper
ggggagaacacgagggctccgacgc

SEQ ID NO: 38378 - DNA, 15 bp, Homo sapiens
  chr21:38077617-38077632
  hyper
cgaagtggtttgcaa

SEQ ID NO: 38379 - DNA, 72 bp, Homo sapiens
  chr21:38078415-38078487
  hyper
ccccaggaccagcttcggaagaggagggatcgcttggaggccgtgcagtgtgaggaacggcaggcagggtgt

SEQ ID NO: 38380 - DNA, 35 bp, Homo sapiens
  chr21:38078760-38078795
  hyper
gggagccgctaaccccgaggcgcctagcacagact

SEQ ID NO: 38381 - DNA, 155 bp, Homo sapiens
  chr21:38079908-38080063
  hyper
taggtttttagttgccgaatagggaagggtttgcgaagccgctgccctgggccgaggtgcattttacgcttccagaggtcgaggcctccagagaccgcgatgcccagggcgttcccggggaggctgagagacccagggtgctctgggtgactgca

SEQ ID NO: 38382 - DNA, 213 bp, Homo sapiens; identical to SEQ ID NO: 4879
  chr21:38080174-38080387
  hyper

SEQ ID NO: 38383 - DNA, 193 bp, Homo sapiens
  chr21:38080550-38080743
  hyper
ggctttcctgcttcctcggactgtgcaggggaagcctggggtctcgcggggcgcagcagtcaggtcgagggtgcagcaggaggggagtcctgacgggcaggtccctctttcccctggtgcgcaacactggttggtagcttttgcggaggtggtgaagaagggcaggaggcctgttgagcggaggagtccgggg

SEQ ID NO: 38384 - DNA, 230 bp, Homo sapiens
  chr21:38081665-38081895
  hyper
gggggctggggatggggtggtccccactgcggagggatggacgcttagcatgtcggatgcggcctgcggccaaccctaccctaaccctacgtctgcccccacaccccgccgaaggccccaggactccccaggccacctgagacctacgccaggggcgcctcccgagcgtggtcaagtgctttccaatctcacttccctcagcaggttccacccagcgcttgctctgtgcc

SEQ ID NO: 38385 - DNA, 490 bp, Homo sapiens
  chr21:38082684-38083174
  hyper
cgggtcggccgggtagccctgagcacagctcgccacttccaggtgggctgttggcgctggctggggacacatcccgatctttcaaatgccctttacagagcctcatcaacgacccgattcattcccccctcctgtcatttgtctctgccatcgaaaaatgcctaccgagagctgctctgcatttccgccctctattttgtgttttactttaaaataataataaaaaaaatgttggctgcaggacgccatgacttaggtcagcgagtcagccgctagctctgcatttccaaaaagcagatcttttcacaactctcttgccccaagtgccctggtgtggtttattttttaaaatgcatgcctgcggaagagaagacccggggaatattcgaaaccccgagcttttacaacataaagcgcatggtgtggccgcggcgagtaatggcgctctgggagccctgcccaggcggcctctgctcgccctcctccactt

SEQ ID NO: 38386 - DNA, 784 bp, Homo sapiens
  chr21:38119754-38120538
  hyper
ttccctgctttgtaacgcggctcctggaacatttcaggtcgcgtcctgagattggacagcacggcctagactaaggcgggggagggcgacagcgaccccgcgggtgcagcgcgtgggcggccgaggggtggtggctgcgcccggggcttgggggtggggtggctgcggccgcgccccttgctgccctctaacgtgtcgcctgtccccgcagcgcccgccgccgccgtgcgcaggttcggcgaggacaccgcgcccccgagcttcccgagctgcggccactaccgcgaggagcccgcgctgggcccggccaaagccgcccgccaggccgcccgggacggggcgcggctggcgctggcccgcgcggcacccgagtgctgcgcgcccccgacccccgaggccccgggcgcgccggcgcagctgcccttcgtgctgctcaactaccaccgcgtgctggcccggcgcggaccgctggggggcgccgcacccgccgcctccggcctggcctgcgctcccggcggccccgaggcggcgaccggcgcgctgcggctccggcacccgagccccgccgccacctccccgcccggcgcgcccctgccgcactacctgggcgcctcggtcatcatcaccaacgggaggtgacccgctggccgcccgcgccaggagcctggacccggcctcccggggctgcggcgccaccgagcccggcaaatgcgcacgacctacattaatttatgcagagacagctgtttgaattggaccccgccgccgacttgcggatttccac

SEQ ID NO: 38387 - DNA, 24 bp, Homo sapiens
  chr21:38120553-38120577
  hyper
cgccggtgccgagggccgaggagc

SEQ ID NO: 38388 - DNA, 89 bp, Homo sapiens
  chr21:38378464-38378553
  hyper
cggggaccacagagggacggagaagccgggactcctcacatcccacatccggcaggggaagcccagcaggtgagcgcaggtccccccag

SEQ ID NO: 38389 - DNA, 56 bp, Homo sapiens
  chr21:38378983-38379039
  hyper
gcgcgggtaggtgagcgcgttagcccgagtggatctaggcgcgctcgtaggccggc

SEQ ID NO: 38390 - DNA, 30 bp, Homo sapiens
  chr21:38379523-38379553
  hyper
tactttctcggtagccgtttctgttgtccc

SEQ ID NO: 38391 - DNA, 271 bp, Homo sapiens
  chr21:38593435-38593706
  hyper
cgcgcgaggcccgggcgcccgagcggcgattccctcccctatcaccagctccagggtggtgccccccggctgtggagcccagaccccggccgtccagcagcgtatagacgagcccatgtctgcgatgtaactgcaccgcgctggggatccacctcccgccagggtgagggcgccgtcctccagcgtatgctaggcaggcgcgccccgccctcctggtcacgtgaccacgcctacagccgaagaggatgggaaaatgcggccctgttcctga

SEQ ID NO: 38392 - DNA, 111 bp, Homo sapiens
  chr21:39047670-39047781
  hyper
gccgggctgggcagccgacgcaccgctaggtggcgcacgcgctcgctgcgtctttcagggctgcaggtacggtgcgggtttctggtgcgctgaccgcgctggggatgagca

SEQ ID NO: 38393 - DNA, 238 bp, Homo sapiens
  chr21:39286637-39286875
  hyper
gtgaggcttcaccctcggcgcctgggctctggccttggtgctgaatccggaacccgctgaggaaccaccacctcggcggcccccaggcaactttcgggaggtttcaggggcacccggccagctctgggcgccctctcgagcgtcgccgtcagggagttgggcacaaccgatgccctgggacccgccacagggcacgcggctggcgtattcctttgcctggagccgggaaagttttgtc

SEQ ID NO: 38394 - DNA, 37 bp, Homo sapiens; identical to SEQ ID NO: 13985
  chr21:39288011-39288048
  hyper

SEQ ID NO: 38395 - DNA, 30 bp, Homo sapiens; identical to SEQ ID NO: 13986
  chr21:39288362-39288392
  hyper

SEQ ID NO: 38396 - DNA, 95 bp, Homo sapiens
  chr21:39288790-39288885
  hyper
cgcacagcgccggcgcggtccgggaggaaggggcgggggcgagcaggacagagccacagacccagagacgcccaccccgccgcccatgccagcta

SEQ ID NO: 38397 - DNA, 130 bp, Homo sapiens
  chr21:39289195-39289325
  hyper
cgtgagaggcagccccggcgcgggagccggagcctgcaccgcccagagggggcgcagcgagcggccgggacggaggggaggggccctatccctgagctttgcttgcacctggtggcgccccagcctgctg

SEQ ID NO: 38398 - DNA, 82 bp, Homo sapiens
  chr21:40032153-40032235
  hyper
aaataacctcttggtcggggccccagatgaagtccccgcggtgtgctctcctggcccttgtcaatttcggggtgccccctcc

SEQ ID NO: 38399 - DNA, 46 bp, Homo sapiens
  chr21:40032796-40032842
  hyper
gggtgtgggtgtgctcgcgtgtccgtgcgcgcgccctcggggccaa

SEQ ID NO: 38400 - DNA, 105 bp, Homo sapiens
  chr21:40033106-40033211
  hyper
tgtgggagggggagccgcgggggtgcgcgctcctcctaactcggggtcgcttttagcgagaagtgatatttttccagcctcattgaaaaccgttgcaaacattga

SEQ ID NO: 38401 - DNA, 30 bp, Homo sapiens
  chr21:40984793-40984823
  hyper
atcagatttcctgtgcgcatcgccgcgcgc

SEQ ID NO: 38402 - DNA, 395 bp, Homo sapiens
  chr21:42688823-42689218
  hyper
tggtgagtgcgcccccgcctcggggcgagggtaggggcggggaaggaggaccccaggggaagcgtcgctccccaaccctgcctgggacccgccacgcttagcaaaagcgggagggctggttcttggcgccgaggctggtcttagacctgggatcaggaatgcgggaagcgattccagagggggcgaacagcgggggtttccagcagggttccccgaccctgtttccccgcgctcgccaggcctgttcccgccgccccagccggggtgcatgggattagggaggaacctggaatgtaacactgtaacattttacttggaaagtagattggtggggagcgcaggcacagccccgcacccccaccccccacccgggctctccacgcttctccttccgg

SEQ ID NO: 38403 - DNA, 82 bp, Homo sapiens
  chr21:42878710-42878792
  hyper
cttgtaactgggctgcgtagcctttgtaattttccatgattcgggaggttctcgcggctgggagctccgtgaggtcaggcat

SEQ ID NO: 38404 - DNA, 42 bp, Homo sapiens
  chr21:42880442-42880484
  hyper
gtaggcggccggccccgtcttggcctccggggaacccactgt

SEQ ID NO: 38405 - DNA, 30 bp, Homo sapiens
  chr21:44073368-44073398
  hyper
gcagggagagaggagcgaggggagttttcc

SEQ ID NO: 38406 - DNA, 102 bp, Homo sapiens
  chr21:44494676-44494778
  hyper
cgggaagggactctccgtctggcacaggccctgtctggcctggggcgcgcatgctccgccgccgaatcttccagaaagccgtggacccgaggccccggcaga

SEQ ID NO: 38407 - DNA, 57 bp, Homo sapiens; identical to SEQ ID NO: 1513
  chr21:44494940-44494997
  hyper

SEQ ID NO: 38408 - DNA, 611 bp, Homo sapiens
  chr21:44494998-44495609
  hyper
ggttcagctggcatcgcctggccggttccgttcgctccttaaaccacaagacccccttggggtcacgacgttcccggggcacccctgcactcgcgcgccagcactcccggaggggcctggggaaggccacgcgcacggagagcgggaaactcctctaggtttccaggtgggagatccagaccctactgagacccggaaaccgccggccactccgcctccggaagcgacactttgggacaaagctggggacaagtaagcccagaagatcctcgggaagccgagaatttcgcgctccgctctcccacccacgctccgcctcccgcttgcatcctacagctcagctgcggtctcgcctggggctcagggaagtgaggtcccaggaaaacctccatcccccgaacgcaacctgggcagagccccgcgtccctcccccagcgggcacccacctcgcgtgccgcccgcgcaacgacagcgtttaccgccaccccacacggtccgccaaaaagggcgatttgcaaacagccatttcccatccacaatgcagcgaactcaatgctgggcaccgaaacgtgcatctcccccggattcccaccccgcgtccctgctccacg

SEQ ID NO: 38409 - DNA, 194 bp, Homo sapiens
  chr21:44495838-44496032
  hyper
gtccagagaggggagcgagtctcggtggggccggatctcacctggacggatacatggaaaagaggggcgagcggctgccccgactgcggcgaggcggagacggcgaccccggggtggcggcctcgcggggacccacggcgaggggagcaggcgggcggtgattggcggagaggcgggggcggaggccggcgccg

SEQ ID NO: 38410 - DNA, 346 bp, Homo sapiens
  chr21:44496398-44496744
  hyper
ctgatgagcttgaaacgtgcgtcctggtgggtggggggccctgcgcgtcctcgaggaccgaccccgagggcgtgtgtcgcgggcccgggagggggcgccgcgccggggcgggactcgatggccgcgctctgtggccgccggacgccgtgcgcagcgccccgcgtgaccgcgcccagagccgggtccgaaccccgagccgaggcgcagaacagtcgccttgcgcggctccggtgcggcccacggccaggggctgccgggcgctctcggggacggggccgactccgcgcagggtggtagcaggggcgccccgcggggctccttcgccaggtcccggaggccgcgggcg

SEQ ID NO: 38411 - DNA, 86 bp, Homo sapiens
  chr21:44847520-44847606
  hyper
ggggcccgggggcctcgcgggctcgcgcgtggggctggcggcgcggatgccctggggcgctgcagaccccgagaggccgcttgccc

SEQ ID NO: 38412 - DNA, 236 bp, Homo sapiens
  chr21:44847607-44847843
  hyper
cggggacgtcagccgcttttgctgttaaaatctgaaatgttcagcaagttagaaacttgaaacctaaggaagcgtgaccggccgctctggaagcccccgccgcgcggccggtcccggccccggccctcagcggcgctggcgtctgcgcgtcccggggctgcccccgcagcatgtggggctgggaccctcttcccgcgcgggccccgggcggacgctgcgggcggtgacggagccag

SEQ ID NO: 38413 - DNA, 691 bp, Homo sapiens
  chr21:45148316-45149007
  hyper
tgctctcccctggaacgcctggaactagggtggtcaggctggggtggaggagctcccctggaatgttccagagcttcccccactcctgccgttctgagtcaccctgcctccccggaggaggaggaggatcagctgagccgccgcgctcacgtagtgtctggctgtctgcctgtctgcctcgctgtgagcagagtgggatgctgccgataaggcgcgcacgtgggccctgggaggagcccgaggcagccactcccgcacgtgggcaggaggagggctgctcacaccaccggccgagggaggaggactgcgggctgcgcctgggcaggggatgagcttgtgtcgcgggcggcagggggaagggagtcggagagctcctgcggtccagccggatgactgatgaggttgaaagcacttccgctgcggcccccgcaggaagttcccaggaggaagttgcgaccctttctaagccatcccactggcctggactctgctgggattattttgaccccccagggcagagtgtagccatctgactggctttctctctcggcaggagacggggcgcacgcctgcaggtgggggagccccaatacgtcacacggatgagcggggcaaagcccagccccccaccccgcacccgcccgcccgcaatcctgccccctggctgcggcctccgcggctcttcccaccc

SEQ ID NO: 38414 - DNA, 51 bp, Homo sapiens; identical to SEQ ID NO: 14000
  chr21:45875681-45875732
  hyper

SEQ ID NO: 38415 - DNA, 38 bp, Homo sapiens
  chr21:46126390-46126428
  hyper
cgcgtacacacccacgcgcacacaccgctgtccccagc

SEQ ID NO: 38416 - DNA, 158 bp, Homo sapiens
  chr21:46126566-46126724
  hyper
cgagcagctccgggcctcaggggtcgccccgccaccgttttcctttcccagatgctgggacgggggcagggaggggctccccaggctgaacccgactaggtcaccctagaagcgaggcgagcttctcttctgtttttcttcggcgcccctgagcccct

SEQ ID NO: 38417 - DNA, 289 bp, Homo sapiens
  chr21:46127234-46127523
  hyper
gagaggacacagggtcggaagggtgaggggtagtggcagaggcggaggccgaggccacgcagctgcggggcgcagggaggggcagaggaggggcgttcagatgggaacctagtccagacccgtcggggccctcgtgtgcggctcgttatcctggaaccagagaggctggagacccttggcttgtctggagcggaaccgtagtgtccaatagagtgtgtggggctcagccctaaagctaaacattctttatttcctgatgaccatgggggcggagcgggggaaaagccct

SEQ ID NO: 38418 - DNA, 28 bp, Homo sapiens
  chr21:46127878-46127906
  hyper
ctagcctgtgccccccgattccccccct

SEQ ID NO: 38419 - DNA, 30 bp, Homo sapiens; identical to SEQ ID NO: 14004
  chr21:46128279-46128309
  hyper

SEQ ID NO: 38420 - DNA, 212 bp, Homo sapiens
  chr21:46128884-46129096
  hyper
cactgagcagggtcccgcgtgaccggtccccaccgctgacggttcctggggtaacactcaggacagggagaggcaatggaaagagacgtggccgccctcgcatcctgcagctcccgcactcccagcctcccagcctcccacccagccccccagagcccaccagtgaccccgcccactgggtcctcagatggctcccacgggatctcctgcct

SEQ ID NO: 38421 - DNA, 258 bp, Homo sapiens
  chr21:46129376-46129634
  hyper
atgagtcctagaaagcgagagacgagaggggaatgagcgccgaaaatcaaagcaggttcccctcctgacaactccagagaaggcgcatgggccccgtggcagacccgaacccccagcctcgcgaccgcctgtgacctgcgggtcaaccacccgccgcggctccacgccgtgggcacagactcagggagcaggatgagaaagctgagacggcgcagccacggcccggtgccttcacgcgcacagcgacacagccccagc

SEQ ID NO: 38422 - DNA, 30 bp, Homo sapiens
  chr21:46130412-46130442
  hyper
gatctgagtgccatccgagcagagagctgt

SEQ ID NO: 38423 - DNA, 30 bp, Homo sapiens
  chr21:46132288-46132318
  hyper
cctctggagggaagtcggtccttaaaggga

SEQ ID NO: 38424 - DNA, 34 bp, Homo sapiens
  chr21:46143070-46143104
  hyper
atcggtgcaagcattcgaccgagttttcttagct

SEQ ID NO: 38425 - DNA, 217 bp, Homo sapiens
  chr21:46351695-46351912
  hyper
ggcgcaggcgacccccgacgggcagccgctcaccttctcctggccccgggcttcaggaaaactgcctggaggtggccggggtctccctagcggaggctgggcggcgggcttcgcgcctgcctcagtctcccaatccgtggcccgggggatggagcccgctgcgcgcagaggctgcggcaggtcccagccaggtgccctggaacgtggctcctccttc

SEQ ID NO: 38426 - DNA, 56 bp, Homo sapiens
  chr21:46352791-46352847
  hyper
gggttcggtgcgggacggcccaggccgccaggacccccaagcgcagctcagtctgc

SEQ ID NO: 38427 - DNA, 436 bp, Homo sapiens
  chr21:46438321-46438757
  hyper
gaagccccccgagggcgaggccgggcgaggccagggggccggggccagaggcggtcgcggcgggggtgggtgtcctggagcaggagcggcagcgggaaacgaagacacgcgcttcttcctactggggggatggctgggaagtaagaccggccgggccgccgagcccgctgcgaggggcttcgcgtggcggccgcacctgagcccgagcgcgcccttgagaggcggcgcccacgggggcagagacccacggtccacgcgcagacccggagaacccgcgatgtcgccgcacgcagcgccgctgtgaaggacggaggcggggcggggccctgggacagggagcgggtgggggcggggtggggggagggcccgtccgggcctgcgcgggaagccctgggttggccttggtgctctgtgatgcccacgctgggtgcaaatg

SEQ ID NO: 38428 - DNA, 8 bp, Homo sapiens
  chr21:46438964-46438972
  hyper
ctggaggt

SEQ ID NO: 38429 - DNA, 15 bp, Homo sapiens
  chr21:46439007-46439022
  hyper
cgtctgtcccaggcc

SEQ ID NO: 38430 - DNA, 134 bp, Homo sapiens
  chr21:46706841-46706975
  hyper
tgcggagcgcccgcccggcactgactcccggctccgcacacccaggcctggacccgtgtcacttgcaggggcctccggagccagcccacgctcagcctgagcaacccggcccccttcctgggctcccgaggctg

SEQ ID NO: 38431 - DNA, 378 bp, Homo sapiens
  chr21:46825344-46825722
  hyper
cctggtcctgctgctcggggtccgcgcggcctccgcggagccaggtaagacccgggcgggacgggaaggttcgcgccggtgcccgccggcctcgccgccctggctggggtccccgcccggctccctcacccccgccccggccgctctgggttcagccccggccctgcccacgcgcgcaggaggcgccggagccggacggagcggggcggggtggccggagtcccgcccattcattctccccgcggggtccgggccgggaggggtgcgcggtgcgagcggccggagtccccgcgcggggaccgaacctccgcggccggcggggtcgtcggtgccgggagggctcggggcggggccgcggggtctcgggagacgcggcct

SEQ ID NO: 38432 - DNA, 63 bp, Homo sapiens
  chr21:47010090-47010153
  hyper
aaaaagtcctccttccgtttcccgcactggtaggaaagctggggagagagaaggagtctcacc

SEQ ID NO: 38433 - DNA, 87 bp, Homo sapiens
  chr21:47010408-47010495
  hyper
gccccgggagttcgaagggtgctggggccgaggggaaggctctggtcggcggcgtcagcggcagctcccagacgacctaggactgca

SEQ ID NO: 38434 - DNA, 79 bp, Homo sapiens
  chr21:47010703-47010782
  hyper
gctcctgctccagggcgaacccgggggtcctctcccatggctctgtgggggaccccggggaggtcgccctggcacggga

SEQ ID NO: 38435 - DNA, 128 bp, Homo sapiens
  chr21:47062752-47062880
  hyper
gggcgctgcggccccagcctccgggccggggccaggcccacagagaacgggaagcgggcgctgcagggggaccttcggggttgcggcacggctgggaattcaacggccattcccgtcccgtcgggccc

SEQ ID NO: 38436 - DNA, 945 bp, Homo sapiens
  chr21:47063432-47064377
  hyper
ttccagagaactttccgggctcggattggccgcgccggttgatgttccgccctttcattggcccgcggcgcccgctttcgcgagcctgcccttgggcgggggcggggccggcggcggcgcgcggcgctagattggttagcggcgcagaggggcgggcccgcgccgcgcgcagcgctcgggctggagcgcctgaagccgcgaccgccgcctcagccgcctcagccgcggtcgccgccgcttcggctgacttaggctccgccgccgcctcctcacccgcctcgccccgaccccgcccgggcctcccggcctctccccgccggcccgcgggctcgccgtccggcgcagggcaggtgagtgagcggtggcgggcggggtcggggtcgggcgcccttgcgggttacggggacccagtccccgacggaggccgagtgacggggcgaccccgggccgcggcaaacttcgcccgagccggggcgggcgggggtcccgggctgggtcgcgccgtccccgaccgccgccggcgcctgcggcggcccggggcagcgaggggactcgcgctccctcaaggtgcggtcgccaggcctggcccgcccgcctccgccccctccccaaattcggaagttgcggcgggaagccgagaacgtctcggatgtgggtcagaaaacgtctggactacttgaggcttcagtttcaaaacggcacaaatttcatctcttgattgagaagagatctggggaacaccccggagcggccgcggcggctggagggcggcggggcggggcgcggggcctcctccccctggacggccgccgggagagcgcggcctcacccctcggtgaccctgcggagagccgcgcgcgggcggtggggcgcgcgcaggtctctcttgttgctcgctgtgttttattttaattttgggggtggttagaacgtgtttcttattgt

SEQ ID NO: 38437 - DNA, 74 bp, Homo sapiens
  chr21:47392726-47392800
  hyper
cggcaaccccacccgagggctcccactgctgcccacagacatctcagggtctcccgggccgggtcagcggcgcc

SEQ ID NO: 38438 - DNA, 30 bp, Homo sapiens
  chr21:47393095-47393125
  hyper
gggaaaggcttaacccgtccagccccgcag

SEQ ID NO: 38439 - DNA, 324 bp, Homo sapiens
  chr21:47517989-47518313
  hyper
ggggtataaagggggcggcgccggccgcggttccctccctgctgcttactcggcgcccgcgcctcgggccgtcgggagcggagcctcctcgggaccaggtgagcgcctcccggaccccgcaccctggaagccgctcggcccgcggggggtgaccccgagtcctgggaaggcggcggcggcggctccgtccctcgggtccccgggaagggggactccagccccagggacggcggggggctcggcgggttcggggctcctcctcgcggggctggggccgcgcctgcccctgtggctccgcgtctctgggtccgaccctcgggcgcg

SEQ ID NO: 38440 - DNA, 465 bp, Homo sapiens
  chr21:47518349-47518814
  hyper
cggagccggcctgggcggggtgggggggtccctgtctgcgcccgagctcggtgctgggacccccgctcccgagacgaccccggcaccgcacgccccgccaggccccgcgtctgcgagcggttcgggtccggctccggcccgcggggaagacgccccggctggctgggacctccgggggcgcagggcctctccccgggccggacggaaggggcggcggggcggggggaggaggggctttcggtgcccgagggcgggactgggcggggaggggacgcgggtggccccgacgccccatcgctgcgcccctcccggcctggagcccaccagggccccgccaggcccaggagaagctgcagacggaggcggctccccagggcggcgggacccgggctgacagcgacccgcagcccctgccgggccgcccacacccgccctgggactccgccggggcgctggtggaaccgc

SEQ ID NO: 38441 - DNA, 121 bp, Homo sapiens
  chr21:47717212-47717333
  hyper
ctcccactcccctcccgaggccccgcttattctcccggcctgtggcggttcgtgcactcgctgagctcaggttctggtgaaggtgcccggagccgggtcccgccttcggcctgagctagag

SEQ ID NO: 38442 - DNA, 300 bp, Homo sapiens
  chr21:48087199-48087499
  hyper
gcgcccgggaaggtgcggccaccctcacgcggaaggcggccagcggatcccggtgcgcgcagctcccagcgctggggttccagcgccccgcctcttcctatagcaaccagcgggacctgccgtcccccggggcaccccgaggggtctgcgcccgcttctttccgaaacgggaaggcgctgggggctcggcagccagagggacgggttcagggagcgtccggtgagcctaagacgcgcctttgccggggttgccgggtgtctgcctctcacttaggtattaggaaccgtggcacaaatctg

SEQ ID NO: 38443 - DNA, 267 bp, Homo sapiens
  chr21:48087715-48087982
  hyper
cctccgtgtgtccttcgagccacaaaaagcccagaccctaacccgctcctttctcccgccgcgtccatgcagaactccgccgttcctgggaggggaagcccgcgaggcgtcgggagaggcacgtcctccgtgagcaaagagctcctccgagcgcgcggcggggacgctgggccgacaggggaccgcgggggcagggcggagaggacccgccctcgagtcggcccagccctaacactcaggaccgcctccagccggaggtctgcgccc

SEQ ID NO: 38444 - DNA, 15 bp, Homo sapiens
  chr22:17081921-17081936
  hyper
attccttttcctccc

SEQ ID NO: 38445 - DNA, 33 bp, Homo sapiens
  chr22:17082347-17082380
  hyper
ggagcgggcgggggccgtcgaggaggcgttgtg

SEQ ID NO: 38446 - DNA, 108 bp, Homo sapiens
  chr22:17082786-17082894
  hyper
cgctccatgttgccgcctctcccggtacctgctgctgctcccggggcttcgggaaatgcgagagtctgagccggggaggaggaacccgagcagcggcggcggcggccg

SEQ ID NO: 38447 - DNA, 74 bp, Homo sapiens
  chr22:17082988-17083062
  hyper
cgcagccaccaccccccgaggagcctggagccccggccccgagccccccagccgcagacaaaagacctcggggc

SEQ ID NO: 38448 - DNA, 204 bp, Homo sapiens
  chr22:17083207-17083411
  hyper
ggcgggatgggggcggggcgggcccgcgggcggcggcagctcccggccccggccccacgcccctcggtagccgcccgcgcccggcctcccccgctccgcgccgcccgcccgggctcccgtcggcgcccggcttcgcacactttacttttcagtcgggccttttcagtgggtcttctccgcgactcttcttttggagaaatttct

SEQ ID NO: 38449 - DNA, 29 bp, Homo sapiens
  chr22:17083524-17083553
  hyper
cggagctgtcaaaacgcccgggccaggtg

SEQ ID NO: 38450 - DNA, 209 bp, Homo sapiens
  chr22:17083858-17084067
  hyper
tgcagatgtaaatgtcgtttccctcgtaagtcttagctgtaaggggcttgggaatagggtcgcctgcctttgaccgaccgtactgtagggctggacaccggcttattagaggaccagaaatgtcttcttacagaacggttatttgacggctttgcttgtaaattaagacaccgttttagtgccagcgagctgctcggcttctgtggctc

SEQ ID NO: 38451 - DNA, 15 bp, Homo sapiens
  chr22:17090840-17090855
  hyper
cggccaagagcggat

SEQ ID NO: 38452 - DNA, 190 bp, Homo sapiens
  chr22:17600944-17601134
  hyper
agcgccatggtgagacggaagcccgtggtgccgaagggcgcgcgtagctcgatgaggtctaggatggacgtgcccaggatcagcaccaccttgggagtgaaggcgatggagtagataagccaggccaggtaggcgaaggcgaactcgcccgctgccgcggccgcccccaggccgccccccgcgccgccgg

SEQ ID NO: 38453 - DNA, 183 bp, Homo sapiens
  chr22:17601259-17601442
  hyper
cgacggccccggctgttcttggcgaagaagatggcccagcccaccaccaccaccaggtcagtggcgatccaggagcaccagtacaggtcggtgacggcgatgaggtacaggtccagcaggccgccctgcgccagcagcagcaccacggacagcgcctggtagccccagcggcacctgggactg

SEQ ID NO: 38454 - DNA, 133 bp, Homo sapiens
  chr22:17602410-17602543
  hyper
ggcgggggtgcagtgcgtcacagtcgggtcgggagccctgtggcctggaggaagcgggaggaggcgcgggcagccgccagggcgaggcgacccggtgcggggggactcccatggagcgcggactcctaaggaa

SEQ ID NO: 38455 - DNA, 15 bp, Homo sapiens
  chr22:17849412-17849427
  hyper
ttagcagtactccac

SEQ ID NO: 38456 - DNA, 376 bp, Homo sapiens
  chr22:17849501-17849877
  hyper
cggggcgtgggggtctcctcccctccgagcacagtccccggcttcccgatttcctctgccccatccccccgccttccaagcacattgtgctcactcttccaggcagctctttcagcggccgggcagtagcagggttccgagcccgtcttctccggggcggtcacacgtgtccattccctggggttggggatcgctcttcccgcttggctgctgattggtgcctccccctaccccacccttcccgccgctctccagcctccatcctacttcgttccagctcaatcagccccaccgccttcttccctcggagaaaaaagccacttcagagctccttgggcgccgttctcggctggaataaaagcgttaagaaacaggt

SEQ ID NO: 38457 - DNA, 580 bp, Homo sapiens
  chr22:17850114-17850694
  hyper
caaagtcctggagggcggagggcgcctcgtgagagttctcgggggtgcggcccgcgccccctgggtcctgcggatctgggcccgggggcgcgcgccccgcccctccccctccctggcggtgcagctgtccgggcgggggtggggcgggggccggggcccgcgtgggattaactaggaccggggcgggagtcgaccgcggccggcggggagggctagccccgctctggcgggcgggcgcgtggcaggggctcccggaggccccgagctcccgggaggcgctccggccaacttcgggccggtggggaccgggcctgggcgcggggctctgaaggtgtggaaggaaagtttgggactccgttattcttccacagcgtccttcctcccgtaatatccagcctctttatcgcggggctcgggagcccttggagttgatctcgccaccattatccccccgggcgagcgcggaggacgggctggccattctggccaggccggaggtgttttccagcccggggctttgtgataactgggccgaaacccgagggtcctggagcgcggcgggtggcgggagcttgcggag

SEQ ID NO: 38458 - DNA, 78 bp, Homo sapiens
  chr22:17850953-17851031
  hyper
tttggaagagcaaatcgttgttgttgcctccccagccccacggatcttactttgtgccattttcgggttgattttaac

SEQ ID NO: 38459 - DNA, 30 bp, Homo sapiens
  chr22:18986543-18986573
  hyper
tcttttgaaattactcggcacccccattgt

SEQ ID NO: 38460 - DNA, 740 bp, Homo sapiens
  chr22:19016854-19017594
  hyper
gagacccggccctgccggggttccctgcgccccagaccggaacccccagggctttggtcgttcccacagccgtcccgcgggccccctccacggtgcgtcgcctgggccccagcggtcgctaggctgcagcctggggctcccggccatcccgggcgctggcggcggtggaggcagcagggcggatggcggagcccggccgcccgtgggcccaggcgcgtagtgcgtacagagccagcgaggtgctgcggcgcggcacgggccgccggcgggatccggggccgcaatccaatgggccgggccaggaagacgcccgagccccgggccggatggctcgcctgcgcggccagctccgggccgaagcggcttcgcggtccgaggtgccgcggctgctgaagctggtggagcgtgcgggggccggggcggccgggcgcgggcgagaggaccggcgcgcacagccgcgggctccgtgtgctcggtatgcggggagccccgcggcggggccacctacccggcgggggtcctggaggtgagcgagcggcggctgcaggagggcctggcggcagtgcgcgaggagctgggcgccgggattgaggcgctgcgcgcggagcttcgagcggagctggatgccctgcgcgcgctgctgccgccgccgccgtccccgcctgcccgccgcgagccccgcgccgtcccccgcgccgcgccccgcggcccgaccctgccgcggacgctcggcaccgtga

SEQ ID NO: 38461 - DNA, 148 bp, Homo sapiens
  chr22:19510799-19510947
  hyper
agccaagacccccagcgtcttggaggggaagcgaaatcctcagtctgacacccgctctgcctatggaaacagcgccgcgcacagaaaaggaaacttcattccgtctgttaagggcagggccgggctagtggcaggagaaggtcagctg

SEQ ID NO: 38462 - DNA, 315 bp, Homo sapiens; identical to SEQ ID NO: 1517
  chr22:19511141-19511456
  hyper

SEQ ID NO: 38463 - DNA, 335 bp, Homo sapiens; identical to SEQ ID NO: 1518
  chr22:19511541-19511876
  hyper

SEQ ID NO: 38464 - DNA, 67 bp, Homo sapiens; identical to SEQ ID NO: 1519
  chr22:19512252-19512319
  hyper

SEQ ID NO: 38465 - DNA, 27 bp, Homo sapiens
  chr22:19512376-19512403
  hyper
cgtagaggccctcgtaggggggctctc

SEQ ID NO: 38466 - DNA, 150 bp, Homo sapiens
  chr22:19706215-19706365
  hyper
ggcctggggtccgagcgtgcccccgggcctgggggggtcgccgcgatggactcgctggcagcgccccaggaccgcctggtggagcagctgctgtcgccgcggacccaggcccagaggcggctcaaggtgcgtgtgtggagagggcggaac

SEQ ID NO: 38467 - DNA, 331 bp, Homo sapiens
  chr22:19706366-19706697
  hyper
tgggtctgtgaccccgcgggctccgggactcggcatggggtccccgtccccgcgcgccacggcccgccagcgcctaggctcagcccttccctccgcagcggcctcgcaggtccgcggccccacggtggggcgacgtgccctgtccaggcctcacctcacgcgactccaaaacgcggcggagaatgcggccgtgggacccctccaggggccccaagggtctgcgggggctgggcgcctgggcgcgcgggcgggggaggctcggcgccgcggtctataaataggcgctgctccgccaccgccgctgccgccgcccccgcggctggatccgggc

SEQ ID NO: 38468 - DNA, 17 bp, Homo sapiens
  chr22:19711723-19711740
  hyper
gcgcccccagcgctgcg

SEQ ID NO: 38469 - DNA, 145 bp, Homo sapiens; identical to SEQ ID NO: 14032
  chr22:19742613-19742758
  hyper

SEQ ID NO: 38470 - DNA, 204 bp, Homo sapiens
  chr22:19742788-19742992
  hyper
cgcggttcttctctcggcttggcggctggggtccgacgaaggggcagaggccacaactcagcggccccgcgggcagccccggcacgcggccccacccgcccgcctcccaggctcggggtctcggctcgtccacggccacgagggtcgcccggaatgtcgcgttcgccggtgctgtgggccaagcactttcgtgggatggaggga

SEQ ID NO: 38471 - DNA, 311 bp, Homo sapiens
  chr22:19748598-19748909
  hyper
cctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggtcagggcgcccctccccacgccgcgaccctccccacgtgctgccgccagggctgcgggcctccgcctgatccgcgcgagcggggccgaaagccgggtcgggggcg

SEQ ID NO: 38472 - DNA, 32 bp, Homo sapiens
  chr22:19748960-19748992
  hyper
cgccgtcccggctccggcgacagccgcccggc

SEQ ID NO: 38473 - DNA, 1439 bp, Homo sapiens
  chr22:20790689-20792128
  hyper
ctgcattcctggggccggggaggcccgggagtccgcggcggcggcatcgatgcgaagcagatggcgggccaggccggcccccgccccggaggcggggctcgcagcggggaggggtctgcgcgcctccggaccagagttcggaaaccccgcgctgccccctcgcagccccttgtctctggcgccgagcccctggactcggcttgccccgggtccgtggctcaggcgccccgacgcgacccagctcggagcccggcggccgcctctgcggctgccagcccgtgcggcgtctccaatccgcgccaaggcgcccccacacgcccgctcctcacccctgcgtggagatgcccttgaccttgtggcctttggccagcccaccggctcccccgaccccagctcctaactcctggcgtccggggctcacctctctgccctccgtgcaaactcccggactcgcccccccaccggccgggcctgtcgcctgcctgtcccacactggcttccccagccggcgccccacatttgcgcggccccttcttgcacccagaatccccacctggttgtcgccagggttcccacatcctccggtcccctgtgcctgtcatagtccttccgcctcccgcttctggtccacttcgagcgccggctcctcgacgctcgcctgggtcaccaccctcccacccgcgcccgctctaagacgcgaatctgtctttccaagtctggcttgctccaggacctccccggctagcaccgctcctcctcccctgaccttcctcctcactcccactcccggctccagtcggactagtgcggggctttagcacatgcagttcctttggcttgaatgcccttccccagcttttccccgtggacttcacaactcggtcaagggtccctttttccaggtctttcctgatatcccggacaacgcgtgtcatcccctgggtgcccacggcactccatcctcccctcaggtgacttctcgtccagggttccctgggatgcactgtcgtggcccatggccgaggctgggcctggaacggagccgcgctggctagggagccgaaggggcccacacttggcgtaggaaggttccggtagccccctcccaatgcccggcgccgccacaccactgcccagagcgtccctctcgccccctcccccagccaggccggctcctacccgggagcacggcacacgttgcggccgcgagggttcagttcctgaggcgccacggtgtccggcagcatccagagcagcagcagcagcagcagcgacggcagcagcggtgacggcggccccccggctccccggcgccgcgccggcccggccccccggggccctgcgccctccatgaggcgcggggcaggcgcggggcgggcacgggcgcgggtgcggccgcagcgagagcggccggaagcggagtgcgaggccgggcgggg

SEQ ID NO: 38474 - DNA, 90 bp, Homo sapiens
  chr22:20792481-20792571
  hyper
cgcaagcccacccccgctcccagcgcctcggaaccggccaagggagtggggcccgcagacagcccaggtcgaggccgaaagccaactcca

SEQ ID NO: 38475 - DNA, 146 bp, Homo sapiens
  chr22:21311370-21311516
  hyper
ctgtagcccatgtaccgcgtgacgtgagagcggagcccgggtctgcccgggcgcgggcccgcggccacggcgtttggatcccagatcccagcccccgcgctcagtccgggcttcctgaccggcgctctccgcgtcccttctcgcgc

SEQ ID NO: 38476 - DNA, 32 bp, Homo sapiens
  chr22:21319163-21319195
  hyper
aaaaaagaccctgcccgcgccccagctgggca

SEQ ID NO: 38477 - DNA, 213 bp, Homo sapiens
  chr22:21319645-21319858
  hyper
gccagaggcactggccggggtccgaagctcacctcgtccttctctcgtcccacaacggccccttcccggctcgccgcggggccccactgtgtgccagtcccccttctcgggctgcaaggtctggcgggggcaacgggacggagccggcgaggctgctggcatcggcttcccagagagagggaactgcacgtgcagaggcggggagagtggaca

SEQ ID NO: 38478 - DNA, 249 bp, Homo sapiens
  chr22:21333767-21334016
  hyper
aggccggtaagaactcgctggcggcaaggctacgaactacctaaaaggacgtatggagcagggcctgggcggggttaggaggggatcctgtgacgtctcgttccctcccccggctcacgtgggtgccacccacctgcccggcccacaggctacggagaaggcttcgacgacgtcatcatccagggggatctggaggagctgaagtttgtggctttttacactaagtgagagcaccggggtgcagcttgg

SEQ ID NO: 38479 - DNA, 81 bp, Homo sapiens
  chr22:21368301-21368382
  hyper
ctcccacaacccctgcgggagaagcccccaaggggaggagacgggcctggcccctgccccgagcaccttccgtctctaggt

SEQ ID NO: 38480 - DNA, 262 bp, Homo sapiens
  chr22:21368435-21368697
  hyper
cgtccacaggccgccgtcgcctcttcctcctgctttttatcctccccagacctctggcaggaaccgctcatcgttacgcccctttcgcagcctcagaccctgaggcggagaccgcttggcgcctcacttagagcgcgacccggggatgtgggcggagtctgcggctgcgctgaccaatcgagtgtggcgtccatcgactggcgtctgccacggcaattagcgacgcgctcccccgcggcggtcgccccggcaacccagtgct

SEQ ID NO: 38481 - DNA, 30 bp, Homo sapiens
  chr22:21386579-21386609
  hyper
acagacagacagtggcggctacatacaccc

SEQ ID NO: 38482 - DNA, 71 bp, Homo sapiens
  chr22:21386912-21386983
  hyper
ccgcgcggccccacccgctgccacacacccagatatttcaccctgcccactctgcccgacctcgcaaggtc

SEQ ID NO: 38483 - DNA, 201 bp, Homo sapiens
  chr22:21400082-21400283
  hyper
acaacaccgggttgccggggcgaccgccgcgggagagcgcgtcgctattggctgtggggggtgcctgttgctggacggcacattcggttggtcagcgcagccgcagactccgcccacaatcccgggccgcgctctgggcgcggggtcaagctgtctccgactcagtgtctgagactgcgagagggtcgtaaccatgagggg

SEQ ID NO: 38484 - DNA, 166 bp, Homo sapiens; identical to SEQ ID NO: 4902
  chr22:22862697-22862863
  hyper

SEQ ID NO: 38485 - DNA, 88 bp, Homo sapiens; identical to SEQ ID NO: 4903
  chr22:22863219-22863307
  hyper

SEQ ID NO: 38486 - DNA, 88 bp, Homo sapiens
  chr22:23908151-23908239
  hyper
agtgactgggaagatcggtggtatcaacgcaaactacagcccggcagcttccaggcaaactcacttctcaggacgcctgtcctgctgt

SEQ ID NO: 38487 - DNA, 279 bp, Homo sapiens
  chr22:23908636-23908915
  hyper
cgcccccctggtccccgccccgccgagcgtgcccggccgggtctgcagccgtcagcgccaagcgcggccccgcggctccgccgagagatcgataactaatttcaccgcggtagccgccccagtttttccccgataattgcgcgccggcagctgtgagcgaggcccccagcgcggcgcgaagcccctcccgcgccgatcaattgacaccgccaccgggcggcaggaaaactcatttttctttctctccccggctccgggtgggcgcgagctgagctctgc

SEQ ID NO: 38488 - DNA, 460 bp, Homo sapiens
  chr22:24180534-24180994
  hyper
atacggtcataaggacgcccccgaagagaaacatgaagacgaagtcggccgtgcggccgcggaaggagccctcttccagcatgcggcagtagcggaacctacggcgtcggtataggaagtgccaccaggcggggcctcagtttccccgtcccggcctctctcccagcccggccggcctgccctccacccagcccgtgtccgcagggcgcaggatacacgaagagcatgttgaagaagaagctgaatcccaggggcccgaagaagaggaagttggtgacgagcctccagacctacgggggacgggcggtcaggtgcggggtgggtgggtcgggcccacaggtgcgcggcgcggggcggcctcacctggaacttccggaacacaaggtgcgggttgaagtagagttgaaaggggctgaggagctccagctgctgtggaaccaggggccagtcaagagctgcc

SEQ ID NO: 38489 - DNA, 625 bp, Homo sapiens
  chr22:24181054-24181679
  hyper
cgacgtccggtccgcccggccgcttaccaccgcggcggtggtgaggacacaggctgcggtgtaagcccgcgtcaccgccggcacctgcaggaactcggccgctagtccctgccacgccattgaaccttctcaagcacgcgtggcccagccagcaacgcgctctttaacccgcctcccagccccgccttcggccaatccgcatccgaggcgctgcgcgccccaggctgaaaagagagcccctgagcccgacagccaatggaaggaagaagagggaaattaggggcggaaagggagagtgggcgggtagaggctggtggccaatgggcaggcgccaaggttgagcacgtggcggttgttgtggctgcggtggtggcgcgggagaacgtgtggccaatgaggaactggtcatttcgcggctttctaggagaggaccagtagcgtggacccacgacaccacgggggcggggctaagatcgtatgggttacaggagcgaagacccgagcaggcgaggcaaaactggaaagggcggggcgcgtgggcggggcgcggagtgtggcggctcagaccgtgctggctcactaactgacgacctagccacaacgttgtcctcgctgccagcccaag

SEQ ID NO: 38490 - DNA, 270 bp, Homo sapiens
  chr22:24551644-24551914
  hyper
cacaactccagggggcgccattcacataggcaccgcctgcagaggggggatataaccctcacacacagttggccaatgccatcccggcctgccgcactcctggccacccctacaccatgctctctggggccccacagcttcctgcagtgagagctgcacccactttgcccggcagcggtccacagcccgccaccagcggccagtccagggaaccggagaggattggccggcaaaagtcagttgcgctcctgggcccgcttccagtagagt

SEQ ID NO: 38491 - DNA, 419 bp, Homo sapiens
  chr22:24552189-24552608
  hyper
ggccgccccccgcctcggcgcaccaggcgcagcaggaagcccgtgggctgtggtttccccggcgcccccgcggaggaaatcggccggcggcggggtgctgcgcccccatgcccagggcgggctggcacccggttcagcgtcaggtgggcggccaagccggcttgggcggcggcgcgcgggggcggcaggcgctggtgaagcccgcacacgcgccagcgcatccagccctaccaagccccgggctgggagctggctcgtgggggcgtgcgctgcgcgaaagcgaaagccgcccgccagagcaactttgcggcggaaggcgccgacgaggagctgtgccgtgccgctcttggggatggtgagctggccgcccggccgggtgggcagcgcgtccgggcgcggtgcttcgctagctataaata

SEQ ID NO: 38492 - DNA, 220 bp, Homo sapiens
  chr22:24820224-24820444
  hyper
tgtcccaaactgcaccggaaggcgcgcaggggtaggcggggagggaaggcaagtgcggcggccggcgcggcgcggggtgcggagccgcaggtagcgggcggggagcgtccgtccgtcagtccgtccgtccgtccatgcgccgcagaccggccccgcgcgctcgcatgaaccttcgcgagctcctccagcagggatggaccgggggcgcagaggcgcttcc

SEQ ID NO: 38493 - DNA, 369 bp, Homo sapiens
  chr22:25678246-25678615
  hyper
cttcatcattacctgcggggacaggtgggacacatgcatttccggggtcatcccagacctcctggaggatgctgattgatgctgtcccgtttgagaactactgtgtccaggtagcagaggcctccccgatgccccttgagtagtgggcacggggcccagggcttctctggatgagctgggcgggcatgagaacgcatggagctgggggcaggaggtcggagcagcgaacgaggaggagaaggagtaggcggaggccgaaggagaggtgggggaggaagaagaggaggaggaggagtcccttgtggccaccccgaagggagggagggctaccgtagagacttggtcgagaggcgcgggacaagcctggcc

SEQ ID NO: 38494 - DNA, 253 bp, Homo sapiens; identical to SEQ ID NO: 4905
  chr22:25678616-25678869
  hyper

SEQ ID NO: 38495 - DNA, 208 bp, Homo sapiens; identical to SEQ ID NO: 4906
  chr22:25679042-25679250
  hyper

SEQ ID NO: 38496 - DNA, 198 bp, Homo sapiens; identical to SEQ ID NO: 4907
  chr22:25679267-25679465
  hyper

SEQ ID NO: 38497 - DNA, 780 bp, Homo sapiens
  chr22:25816871-25817651
  hyper
tcctttgtggccacccggaggggagagacttggttgggaggcgccaaccgagctggccgctgggactctgcacccaggtgcgccaacccttgggcgcacgctccccgcagaccctcgctgaaggagcggtgggcggcgcgccgcgaccctggcgggctacagattacaccgcttgcagggcgctgctggggcgcgcagagcggggctgccccagggtggctcccccaggttggggcgcggcgggcggcggccgcgggcgcgcgtcccatccgggtcccgagtaaccgccaccgccgctgccaaagctcgccaacatggtggacctggaggccgtggtggccgatgtcagttacctgatggccatggagaagagcaaggcgaccccggccgaccacgcctgcaagaggaccgtcctgcccgaacccacgtaccacctgccccggcccgcgccggtccccgacgccgccgccccctgcggccgccagcgaccccctgcgtccgggagaatcgggagctgagccgtcgctgtcccggagcgggtgacacagcggagcgggcgatgcggggccggcctcctggctccagtctctgaaatggggcatcggagggcgggtggggggcactccgggagagagcgctccaaagtgcctggcgccgcgccctgcgcgcagctagcaccccagcaaggggctggttatgacttggctggaccagttccatccctgtcgccccctcccccagccctgtcctctcctgtcccatccccgtggttctacctgt

SEQ ID NO: 38498 - DNA, 30 bp, Homo sapiens; identical to SEQ ID NO: 14049
  chr22:26564863-26564893
  hyper

SEQ ID NO: 38499 - DNA, 177 bp, Homo sapiens; identical to SEQ ID NO: 14050
  chr22:26565184-26565361
  hyper

SEQ ID NO: 38500 - DNA, 131 bp, Homo sapiens; identical to SEQ ID NO: 14051
  chr22:26565502-26565633
  hyper

SEQ ID NO: 38501 - DNA, 64 bp, Homo sapiens
  chr22:26565935-26565999
  hyper
ggcgcttccctgcttcggctgcgggctccctttcggtcttccccggctgcggggctgattctcc

SEQ ID NO: 38502 - DNA, 448 bp, Homo sapiens
  chr22:27053580-27054028
  hyper
agccctctgcactagcgccgcaggaccgcggacccgaggtaagacgtcgccccatcctagaagccttccttcccaagtgtccttgtcccctaacggggaacagcctaattccccaaggctggggtcgagggtaggtcccagagtcccagggctgggttcagggatgcaacgccgcctgaagtgtcccgcattggatggatgaagaggctttacagcctgtaattctcaaacacagccaagactctggctgggatggggggtgaggtcaggcaaggggaggatgctttaggagtccagtgcgaatggggatcttgcaatcatgattatgagggggaacaaagaccctttccttccgacgacacaagacacaatttgggaggtggacccgcggaccttctcggtccaccaggttagcaattaactggccaagccacgggcagagccagag

SEQ ID NO: 38503 - DNA, 66 bp, Homo sapiens
  chr22:27069172-27069238
  hyper
ggctctctgttcccacggacgtcactgcctcagccagcctcccccagagcccgccagccgctaagc

SEQ ID NO: 38504 - DNA, 30 bp, Homo sapiens
  chr22:27695238-27695268
  hyper
tcagatgcgcgccctcggtccaccccctct

SEQ ID NO: 38505 - DNA, 30 bp, Homo sapiens
  chr22:28196522-28196552
  hyper
cccaaacatacttggcggggggcagagggg

SEQ ID NO: 38506 - DNA, 37 bp, Homo sapiens
  chr22:28196966-28197003
  hyper
ccgcccgcagcctcccggagtccgtggcagagctgct

SEQ ID NO: 38507 - DNA, 278 bp, Homo sapiens
  chr22:28197276-28197554
  hyper
agggtcggggaaaggcgcggctcctctgctcggcagcgggtgcgctgcgttcggcgcgcagcttcgcggccacgtccgccgcctgccgcttctgttctccgccgttgggtgtctgagttcgccggagtctccgcgcaccgttgcaggcgcgggagggcagcgagacgaggggttgggtcgctccaaggctccggttccctgcctccgcgctgaggtgcttcgcgagtccctctcggacctgagggaggggggcgtacgcgggtcggggggccacgccg

SEQ ID NO: 38508 - DNA, 346 bp, Homo sapiens
  chr22:28198055-28198401
  hyper
cacccccaactggagcgagacccaccgggtgggcagggggcggggaggtgggcggtgagcggtacggggcgctcagacaatgaggtcgccaggcaaagaccctagactcgccacggaaagtcgctaagtgtctactgcacttcggctccggggtgaacactccgttctccgctagcggcgcccaagttagccggccctgggattttcttggagggtaaagcagacggggaacctcgaagttagggttctcctcgagagacctgggcgcttgctcactcctccgtcactagggcgttcacaattgttccccttccccactgcctggggttcccggttctcaccggcc

SEQ ID NO: 38509 - DNA, 260 bp, Homo sapiens
  chr22:28838179-28838439
  hyper
ccttttccccatgatcgattcacacacgctggtgcacgctgacacgcacagacacacgcccgtgcacaatggccagcgcaggcaatcgcacgggcccacgaggcctcaggagccccgcaggctgaaggcccggctatggccagccccaggcgctcaggcaggaggcctctcggcccgccgccccggaaccagctgctgggctggtgtgctggggctgctcgccccccagcggggccctggggaaacggctgccagcggct

SEQ ID NO: 38510 - DNA, 50 bp, Homo sapiens
  chr22:28838794-28838844
  hyper
agacctgaaggtaaccgccccgtgttacccttccccgggttgggctttgg

SEQ ID NO: 38511 - DNA, 813 bp, Homo sapiens
  chr22:29075406-29076219
  hyper
atccacacacactctcgcggaaactgagccaggcaggcggcggaccaggtcccgccgcctcacggctcgcggctgggatcgaacccggactgcgagacgccttccgcctcgcaggcgctcctctgccgctgaggcccggcccggctcccaccgccggagtttcacaaagaaagtctcccggcccgagcccctcacgcactcaccggcgccgacgccggcggcgactctggctcccgccgccttcggctccttgcgggggtcggcccttgggtcggctcgggcgccggcggcggcgactgctccatccccacggggcccgggccgcgtccgcctcgagctaacggtcccgccagctaggcgcgcgcgccggttccgcgcgccatgttcccgccgtgctgcgcgccgccgcggcgcccctcactgcccccaaaccgcgcgcgcgcccccgcgggcccacacatgcaccgcgcacgcgcgcgttcgccgcgccccctccccgcgcgccccgcctcgcgccctctggagctggccgctgttcccagtgtctcgcccacccccgccgggcccgtcggactcggcgggtgagcgcgcggttcccggctccgcaccgccgcctgcctctctgcagaccaccccggacccgacccctcggccatttccccacactgccgctttcgcttcccccacgacgcggggcctgggacgacggtctgggccaagaggaacttccccgcaagaagtgtcgagttaaggacgctactaagggggcgggatcgccatcgtggaggtgtgcaagcacgtgcctgcgtcccg

SEQ ID NO: 38512 - DNA, 64 bp, Homo sapiens
  chr22:29426589-29426653
  hyper
cccggtggggaggggcgcggccggtggcgaggagggcactttcccgggtcggagaaggccggat

SEQ ID NO: 38513 - DNA, 30 bp, Homo sapiens
  chr22:29709206-29709236
  hyper
gaagttgggcgatcccgtccaatccaggtc

SEQ ID NO: 38514 - DNA, 71 bp, Homo sapiens
  chr22:29875904-29875975
  hyper
tcccctttcttattccgaacacactcgcaggctcttccgacgcgcacccgggggtcctcactggcccactc

SEQ ID NO: 38515 - DNA, 109 bp, Homo sapiens
  chr22:29876004-29876113
  hyper
cgagggtctcctctgacgcagcgtcgattccccttccctcctcggtcccctgccccgcccctctcactgcggcggagccggtcggccggggggccgcaggggaggaggc

SEQ ID NO: 38516 - DNA, 669 bp, Homo sapiens
  chr22:29876916-29877585
  hyper
gctgcaggaggagtgcggctacctgcggcgccaccaccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgaggtacgcaggcgcgcgggtggggggaggggcgcccctgctgaccccgcagcgaacttttgggctgcgtgacccaagggggcgctgccggactgcgcgtggagtggcgcgctgctcaccttccctctgcaaagtgcatgcccctagttaaatcgcagttttactctgggtctcttgtgggacgccccaactctgggttgtccttcggttccccctttccaggttctttacggctgtacttcaactctgggccccctgctgctctctaccccaagcttaggcgaccccactctgagatccctcccccgtcaagaaaaaaacaagtttcctctacaggaaaaaagtggtgcaggattctggtctgcaagcgctggagactcttagcccttctaagtagcaaggcttccccgccaatgctgccatgccctctcctacaccccgcaagaaactctat

SEQ ID NO: 38517 - DNA, 461 bp, Homo sapiens
  chr22:30115986-30116447
  hyper
gcggcacagaacgagcgagcgagcgagcggagaggcggctacagcctgagcgccgggccggtagcggccgcgccggcgagcggactagcgggcggcgagcagcgcggagcgcgcggggcaccgaggagcgggcgcggcgggcaccgcgcgaggcagccggagctctcggaaaggccagagcggcgccgcccccgctgcccctgcggggccccggctgggagcccgacgagggagcgggcggcatggcccggcggcccggggcgcgggggcgctaggcccccggaggggcgtccccagcctcgccgctgccgccgccgccctccgcagccgcgcgccccgcccgctccagccgcccccggggccgccaccggcccatgagccccggcctcaaagtttgcggcgggcgggcgggcgcggagcctccaagatgccgttccacccggtgacggcggcgttgatgt

SEQ ID NO: 38518 - DNA, 412 bp, Homo sapiens
  chr22:30116727-30117139
  hyper
ggcccagcccctgcccgcgtggtccccagcgctgcggaaacttgccgggccccgcagcggggtcacggggccgcgcagtcggcggtgacggtgcggcaacgcggcggactggggcgggggtccgcgctgagcccccagcgccggcccggccggagcacccgcatcctgatcccctccgcggcgcccgcccgcggctctctgctcgcattgacattccgctcgtgtcgctttaaaaattcaatctgctcgggcagcagcagaaggggagagggcgactgccctgctcttgcccgctgcggggccgcccccgtccccacctgcggccgtagccccttccctgcagccctgcggggacccccagcccggcgcgccgggaaggcggcccgggaggcggtggcgacaacaagtggcc

SEQ ID NO: 38519 - DNA, 462 bp, Homo sapiens
  chr22:30938045-30938507
  hyper
gtgggcggggacgcccggctcagaccccgtccccagcctggacctgggccccaccctgcccacaccgcgaccctccccatccgtctcgcgaccctaccagaaagtccactccagcttttccttcacctcggcacggctctgaaaggatcggtcccctccggcccgcacccacccccaagaggggccttcagctttggggctcagaggcacgacctcttggggagggttaaaaggcagacacccccccacccccgcgcctccactccccgactccttcgccgcctccagcctctcgccagtgggaagcgggagtagccgcgcggccggagtccggaggcgaggggaggtcggccgcaacttccccaggccaccttaagaggacgatgtagccagctcgcagcgctgacctcagaaaaacaagtttgcgcaaagtggagcggggacccggcctctgggcagccc

SEQ ID NO: 38520 - DNA, 116 bp, Homo sapiens
  chr22:30938542-30938658
  hyper
cggcgtagccgcggcccatggagcccgcgggccggtccccggccgcctcgggccgctgctctgcctgctgctccccgcgtcctgcgcctggtcaggagtggcgggtgaggaggagc

SEQ ID NO: 38521 - DNA, 30 bp, Homo sapiens
  chr22:31003156-31003186
  hyper
ctctgcagacttagccgtgcattgcaggca

SEQ ID NO: 38522 - DNA, 102 bp, Homo sapiens
  chr22:31198526-31198628
  hyper
cccttagtgtcgtgtcgggttccaggccacgctcgggcattttaagaggctgaggtgcgccttccgctgcccgcctgcgtcccgccacggagagctcgcctt

SEQ ID NO: 38523 - DNA, 550 bp, Homo sapiens
  chr22:31218396-31218946
  hyper
cgctcaggctgggctcggctcccgcggcgcggacggggttaacgcgctcatgtaccgggtggcgggcggcagtggtgcattgtggtaacgcggcgccgggacccacgagtgtccgccgcctccgccgggcggcccaccgagctgtgcacgcgtccgtgcaagcccccgggacccggcgccatgtagcgccccgccgattggaggctgccccgccgcgggaaatgaagggacgcggctgctgggacacggcctccgtgcgctccttctgcagctccggctgcctgaataaatttaagaagggttagtgcttgccgggcttccacccggagggaggccaggctccccgcgcatgcacgcccggtgcctggctttgctgcgtgatcgatccacgggagcctctgatgtcactccctcgcggcgtggggagcgcggggagcctcggggaacccctgtccccgcaccccgccggcgtgcgctcccggcttgcttcacgcgcggggcattttggagagggggctgcggctagagacttgtccgtctaattaaccta

SEQ ID NO: 38524 - DNA, 855 bp, Homo sapiens
  chr22:31480651-31481506
  hyper
tcagggttcttcagccgccacctccctctcttaagcgaggctcgggcggcgctggaaaagagttttggagagaagctggagcagtggttgaatctctgggaaaggacagatgagaacctgccccggtctcgggatcggtgcctctcgaagtctttccgaccccgggagcggctcctccagcacccggcgcccgccattactgcgccccgcgcgccggcccggcccccgctggcctcgtggcaagaacgggggcgtcccgagccgggctcctccccgcggggccgggccatataaggaaaagctaggcccgctccgcccgccctgcgccccagcgtctggccgatttggggacgcgggcagtcgcttccggccccggctcccgcacattcttgaggattgggccggggatgggaggaatggggacgcctggggacttgcacgccgcgtgcccctccaccacccgccgggacgccctctgcctcggtcccgagttcgagttcgacctccgccactcagctgggtgtcctggggaccttggtttcttccctttagatccggacactgaagcaggcggtagcgggtgtcttcctacctggctaccccttcggcgcctagcgcgaggcagggtgggcgaggcgagggcggcgccctgcgagggagggcggtcgcagaacctgcgggccttcagcgccccctggcgaggcttccctccaccgccggcgggacccccatgggcaaccgggggagctgggactgaaagcctggagagccccctccgttgtgctgttggggagactgaggcccagtgagacctcagggcctgccaggcgttcccaacagcgagggcagagagta

SEQ ID NO: 38525 - DNA, 378 bp, Homo sapiens
  chr22:32571939-32572317
  hyper
cggggactagccctgcgcgcccggggagggggaggcgctggcgctgtgacggccgcggggagggccaccttcccagcacacgcacacatacgcccccggccctcagccgctccggctgccgctgcccgccgacagctgacctccaggcaccgcagcgcccgggaacagccatctgggaaccgcgaccgcgcactgacacacgcagtggccgccgccgccgccgctccgccaagcgctgcctgtagcacctgcacggtggtttggaggggaaggtctgggcaggcgaacgttccacgagggcgtcccagaggcatctgcagcctccgctctcctgttctgctctggcgcccaccagcccctgaccgagtccagagggtc

SEQ ID NO: 38526 - DNA, 97 bp, Homo sapiens
  chr22:33197642-33197739
  hyper
tccccgggggcccagcgctatatcactcggccgcccaggcagcggcgcagagcgggcagcaggcaggcggcgggcgctcagacggcttctcctcctc

SEQ ID NO: 38527 - DNA, 331 bp, Homo sapiens
  chr22:33197949-33198280
  hyper
ggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcggtaagcgctcctggtgccccgcccgagccccacgctgcagccaggactgcagcgctgcttagggaggcagggcgagccccactcctttcctctgccccaggagaggggcagacggggttggggcggagtggagaaactcgatgtccttgggcgggggcgctggcatagctga

SEQ ID NO: 38528 - DNA, 198 bp, Homo sapiens; identical to SEQ ID NO: 1521
  chr22:33453877-33454075
  hyper

SEQ ID NO: 38529 - DNA, 66 bp, Homo sapiens; identical to SEQ ID NO: 1522
  chr22:33454193-33454259
  hyper

SEQ ID NO: 38530 - DNA, 146 bp, Homo sapiens
  chr22:33454345-33454491
  hyper
gggtcccgggagctcagcctctgcccctcaacgcgcgcgagcgcccccgcccggcggcccggcctccccgcgccgcggcgccccattggctcgggcaacgaggcccccggacggccccgcccacccgcgcccactccctcgcccac

SEQ ID NO: 38531 - DNA, 13 bp, Homo sapiens
  chr22:33454492-33454505
  hyper
cctctccccaacg

SEQ ID NO: 38532 - DNA, 30 bp, Homo sapiens; identical to SEQ ID NO: 14075
  chr22:35420285-35420315
  hyper

SEQ ID NO: 38533 - DNA, 30 bp, Homo sapiens; identical to SEQ ID NO: 14076
  chr22:36553195-36553225
  hyper

SEQ ID NO: 38534 - DNA, 30 bp, Homo sapiens
  chr22:36726916-36726946
  hyper
tctagccgtggtaggcgcctgaacccactg

SEQ ID NO: 38535 - DNA, 589 bp, Homo sapiens
  chr22:37099177-37099766
  hyper
gggtctcggcgctttcgtttcagaccagacttcccagtattctgtaagcccttgagctcagctgcacaggtgcgggggtctcgctttccatggttttgcccgggcagcggcggcggcggcggcggcggcggcagggcgggcaggcgcggcggcggcggcggcagcaggacgagcagcggcggcggttattgttgttggtggcgggggtagtgttggcgaagtgggggagagagggggtttctcctggagaatcgaggcggatttccctccccctatctgcaaagctcctggaaacgagggagccggcgtcttgctgcagggtgggccgcgcgcctgccccccactcgctaccggctgggcgcccgcggaggcgctcccacctactgcattacgggtggtgctgaaccggacagctccctgcgccgcccgctccgcgcgctccccggctggctcccagggccgcccgccaggaggggggcgctggccagagtcctccctccccggggcagcaaggccagcgcagagcgggggccgcctttcctctttttacccctctcccaaatcctaaaatgagcgctctcctgggctc

SEQ ID NO: 38536 - DNA, 57 bp, Homo sapiens
  chr22:37212414-37212471
  hyper
gcactgaggatgccccgtgcgggcttaggcagagctgtgcgccggctccagaaggtc

SEQ ID NO: 38537 - DNA, 92 bp, Homo sapiens
  chr22:37212682-37212774
  hyper
tccgaccctggtcttcgcccttggtcccggaccctgagtcctcccagccaccgggccttcagcaccctcaagtttctgtaacttaggcgggg

SEQ ID NO: 38538 - DNA, 93 bp, Homo sapiens
  chr22:37212813-37212906
  hyper
cggacagagtttgggaactgccaaggacgcccccgccccgacctcgccggcgcccagcgggaagtgtgggcagaagcgcgctggggaggatcc

SEQ ID NO: 38539 - DNA, 117 bp, Homo sapiens
  chr22:37213161-37213278
  hyper
ccgggcctggcatggcgccaggggcccggactctgagcgcagcgggagcggctcagtccagccgcgccgctgagcagcgccggccgccggcaagaaggcgcgcggacctgctaccac

SEQ ID NO: 38540 - DNA, 209 bp, Homo sapiens
  chr22:37730661-37730870
  hyper
gacgcggaggctgcccgcggcggccccgcctgggcgctccgggctggcccggacctgcggcgtcggcccaggagcatctggaaagggggcgcgggcggggatcggtaggaccgcctatgctcagggactgtcacccaccccctcccccaagccaaggagtagcggggaaggggggcgagtgcacccaggtattggggggagcatcaaat

SEQ ID NO: 38541 - DNA, 325 bp, Homo sapiens
  chr22:37730926-37731251
  hyper
cgagtcacccccgccccacccccacacactatgcacccatttcacagatggcaggtcctagctcagagggttagggcaggcccagaaccgcatcgccatcgcccgttcgcaggcctgattgagaggctggaaacgaggatgggcagggagtgaggacctgtaggctctgccggagaacttgggcgtgggcggagcggggcatccaggaagaagcccccaccccagccttggatagggtagtatacgatagggggcgtaaagaagggtcatgggctccggtggtcgcaggtcccaccggcaaccgccagggcgggggcagcaggag

SEQ ID NO: 38542 - DNA, 87 bp, Homo sapiens
  chr22:37816102-37816189
  hyper
agttccggaggctggcggggtgggccgcgggggacgggggcctcgaagagccgcggacggcggaggacggtgcggaggtggggagcg

SEQ ID NO: 38543 - DNA, 367 bp, Homo sapiens
  chr22:38220642-38221009
  hyper
ctgggccgcagggcccgggcgcgggacgtggcgcgggcccctgcgggagggcacctgcccgccccgctgaccaggcgccctccgcaggtacctggccgtgcggcacccgctgcgctcgcgcgccctgcgcacgccgcgtaacgcccgcgccgcagtggggctggtgtggctgctggcggcgctcttctcggcgccctacctcagctactacggcaccgtgcgctacggcgcgctggagctctgcgtgcccgcctgggaggacgcgcgccgccgcgccctggacgtggccaccttcgctgccggctacctgctgcccgtggctgtggtgagcctggcctacgggcgcacgctgcgcttcctgtgggcc

SEQ ID NO: 38544 - DNA, 60 bp, Homo sapiens; identical to SEQ ID NO: 14080
  chr22:38221288-38221348
  hyper

SEQ ID NO: 38545 - DNA, 175 bp, Homo sapiens
  chr22:38476957-38477132
  hyper
gcgcgcccaccatgccgtaggagaggccgaaggcgacgcagaaggcgacgagggcgccgtaggagcgcgcgcgtgcgctgctcaggtctgtgagcccattggccagcagggccaggctgaacagatacgggacgtgcggccgcagacgcgccaggcccgccagggcgccgcacgc

SEQ ID NO: 38546 - DNA, 510 bp, Homo sapiens
  chr22:38477296-38477806
  hyper
cggtgcacactgccaagtccagcaggcgccggcggggccggaccctgggggatgcctcgcgcagctgcagccccgcaccgtcagcctccgcctcgcccggagcgtccccggcgcggtcgccggcgctgtccctgcgcggtcgcgggcccggcccgggcggcggcctcatgacagccccgcaggcgcagcagtgcagcaggagcccgccgagcagcaggaagccgccgcgccagccgaagcgctccagcagctgctggccgagcggcgacagcgcggacaggaacacggggctgcccgccgccgccagcccgttggccagaggccgccgccgctcgaagtacagccccagcatgatgagcgacggctggaagttgagggccaggcccaggcctgcgggcgaggcggtgctgtgccggggtccccggagagcccctccctggcccccacaggagggaggggccaggcccgggaacccagcagatccgggaacccagccgagggacttcgaag

SEQ ID NO: 38547 - DNA, 35 bp, Homo sapiens
  chr22:38478441-38478476
  hyper
ggggccctctgagctcgcagggcagccccctgggc

SEQ ID NO: 38548 - DNA, 288 bp, Homo sapiens
  chr22:38850818-38851106
  hyper
gctcccggggagtcacgggaccgcgcgcgcggcgccgggcagccgggacccggctccggatcaggtgcggagcgggcggggccggagcggcgggcccgggacacacagacacgcacgcggcgggacaaactgacggacagcgcccggggtgggcgagcgcggcttaccgctgggcggagggtccgacgagagtccgggaggcggcgagcgggcgctacatcccaaggcgcgatccggcgggcggcgtcccgggcgcggaaaggggagtcccggcgccccctgcccgcg

SEQ ID NO: 38549 - DNA, 100 bp, Homo sapiens
  chr22:38965918-38966018
  hyper
aaggtcggagcggaacgctcaaagtcactagcccagggaccccaaaaaaggagcgagaaagggaagcgcgccttctcaaaacgagcgtcccctcagagtc

SEQ ID NO: 38550 - DNA, 158 bp, Homo sapiens
  chr22:39473204-39473362
  hyper
ggcctcctacaccagcgcctgagcaggaagcgggaggggccatgactacgaggccctgggaggtcactttagggagggctgtcctaaaaccagaagcttggagcagaaagtgaaaccctggtgctccagacaaagatcttagtcgggactagccggcc

SEQ ID NO: 38551 - DNA, 157 bp, Homo sapiens
  chr22:39784321-39784478
  hyper
ggaggagcaagtgggcgtggcctgggcatggcccgtcggtcaaggtactggccctgcccacgcccgggagaggggcgggcgagagagatgctaagccaatcggattgcggtcatcgggggcgagcggagtctgcaagaggtccgaggagtagcgggt

SEQ ID NO: 38552 - DNA, 66 bp, Homo sapiens
  chr22:39853091-39853157
  hyper
gtctgcggtgcgaggcgcccccggcccggcgcggcggcggagcccggctggcgggggaggggaggg

SEQ ID NO: 38553 - DNA, 197 bp, Homo sapiens
  chr22:39853393-39853590
  hyper
gggccgcgctgcctgcgatgccgggcgcccgccgcagccgctgccgccggagcccgggatggggcgagaggctgcggcggacgccagcatctccccgccggggaccccgggggccgcggagccgccgccgccgctgctgccgccgttgctgagacccagcgggcgatgggtgagttgaccccggcgtcctggggggc

SEQ ID NO: 38554 - DNA, 1 bp, Homo sapiens
  chr22:39853591-39853592
  hyper
c

SEQ ID NO: 38555 - DNA, 134 bp, Homo sapiens
  chr22:39854212-39854346
  hyper
agtgagttctggaaccgggagtggggaggggagtgcgcctgggtgtgtgtatggtggggttcctgagctggggtgcagcaggaagggatgccgcgcggccagacctagtggtctgaggtcggatgacccccagc

SEQ ID NO: 38556 - DNA, 30 bp, Homo sapiens; identical to SEQ ID NO: 14086
  chr22:39942115-39942145
  hyper

SEQ ID NO: 38557 - DNA, 303 bp, Homo sapiens
  chr22:39953480-39953783
  hyper
gcctcccccctccagcgtcccgcgcctgcagctttccccgaagacatttggtgtcagtataaggacggcttttcctcgcacgcagcgcggctcggtctcgccgccgccgcacgtccccgcaccgccaggcgctcgggctcctccgcagcccccgccgcgcgcagaccccgcgcttcgagccctgagccggaggcgcgagcagagccgaggcaggcgagagaccggcctcagccccgcgctccccgccgcgctggtctctcccgggcacttgccccgctgctcggtccccgcagcacccgcgcc

SEQ ID NO: 38558 - DNA, 137 bp, Homo sapiens; identical to SEQ ID NO: 14087
  chr22:39954439-39954576
  hyper

SEQ ID NO: 38559 - DNA, 30 bp, Homo sapiens
  chr22:40060586-40060616
  hyper
ccctccccttcccttcggccccgccacttg

SEQ ID NO: 38560 - DNA, 211 bp, Homo sapiens
  chr22:40081794-40082005
  hyper
cagccccagcagctccgcgggcagcctgcagaccacgctcgaggacagcctgaccctgagcgacagcccccggcgtgccctggggccgcccgcgcctgctccaggaccccgggccggcctgtcccccgccgctcgccgccgcctgagcctgcgcggccggggcctcttcagcctgcgggggctgcgggcgcatcagcgcagccacagcagc

SEQ ID NO: 38561 - DNA, 349 bp, Homo sapiens
  chr22:42306171-42306520
  hyper
agagtgacgccgcgccgagcacccaagctcaggactggacaaggggtcccggccggggactgggacggggaccgggccggggcgggccgggggcggggcccgctggggcgagggagccgattggccgagcggcgggcgcgcggaactgggaatttggcgcttggagctgcggccccgcgcttcgcagtccgggagctcgtgcgcccaggtgccctgacgctgcccgcacccgccactcacctgcggccttgagcgcggcggccttgaacgtggcgtacttggcgtagtctggctgcagcgtcaggctgccgccgccctgcagccgcgggccgcgcgggggccccggggc

SEQ ID NO: 38562 - DNA, 142 bp, Homo sapiens
  chr22:42307095-42307237
  hyper
cgcagaggccgcggctcatttccaccggggaagcctctatgccccagccgagggaccgcctctcggcctctcacgcccctccgcgtgctccgccgccgctcagccccgcccgccaccgactcacctgcgctgttgtgggggg

SEQ ID NO: 38563 - DNA, 706 bp, Homo sapiens
  chr22:42310042-42310748
  hyper
tgctgggagaaccagcgcttcgagagcggcgggaaggatcagcgggcagggagagcagtccgaggagcaggcgggggtccctgggcggcgcgtgctcacctggtcactgtgcgccgcgcgcgcgggctgtgcgccctctccagtcccaggcgcgccccgatgccggccagcaccagcagcgctgcgacgccgcacacagcgtagacggccgtatggctgcgctcgcggccggggtcccggggcgctgcggtgtcgcgggcgcgggcgggcggccggcctgtctggacccaggccggcgtgtcgtagttggaacagcggctctggtcgaggcgccgcggcccgtcgtggcagcagaagcggtagccgcacgtgccgcagcagaagctgtaggctccggagctgcagttgaagggcgggtcccactggcccatcacgtcgtagtagccgcggcagcggtcgcccccctccggggctgtcgtgccgggcgccgcgggaccctgcgcctcgggggctcccgcgcggcccgacggcggccgcgccagcagcaacgcgagccgaagcgcgagcgcgagccggaggccgggaggacggcggccgccgagcagtccccgcgccccggcccgcgccatcgggcccgcgcctcccgctactgcgcccggtgcatggccgggcgccgcggctccctccggctcggctcctccgctcc

SEQ ID NO: 38564 - DNA, 231 bp, Homo sapiens
  chr22:42311356-42311587
  hyper
cctgtaccttacaggcgcggaggtcaaagcagcccggaattgccccgggacgggcagggccaccctctcacctccttcccgtcccctctgtccgttctgatcataacataaggagggccccttcccctctcggcgcctcgattttcccacctgtcaaatgggaaggacttcccctggcagcgccgcttcagagggccaaggatttaccccacggcgcgagcccagttccag

SEQ ID NO: 38565 - DNA, 65 bp, Homo sapiens
  chr22:42315616-42315681
  hyper
aaagccctcagtgtacgtgcgaatccggagcggacaccgagaccttagcgcgggaaccaagagag

SEQ ID NO: 38566 - DNA, 451 bp, Homo sapiens
  chr22:42353573-42354024
  hyper
gtgatgcttgggcctcgggctctgtgaagcctgaaggtctccctctgggtgggcgggacagggagcacctctgctggccctcaccacgctgtgtctccgcagccaaggccgccgcgatgccgcacttcctggactggttcgtgccggtctacttggtcatctcggtcctcattctggtgggcttcggcgcctgcatctactacttcgagccgggcctgcaggaggcgcacaagtggcgcatgcagcgccccctggtggaccgcgacctccgcaagacgctaatggtgcgcgacaacctggccttcggcggcccggaggtctgagccgacttgcaaaggggataggcgggcggcaccgggcgccctcccccagcccgccccgcccgcccagcccggagacccccaaggcagagggaggccggcctgttggccctccacgctatccctctgca

SEQ ID NO: 38567 - DNA, 75 bp, Homo sapiens; identical to SEQ ID NO: 14093
  chr22:42679405-42679480
  hyper

SEQ ID NO: 38568 - DNA, 268 bp, Homo sapiens
  chr22:42679916-42680184
  hyper
cgaggcgggggaggaggggaaagggaaaaaaggagaaggaaaaggaaaggggggcagtttctcggctctcagcctcctcgcggctcctcctgcccaagccggcaagtgaagtcacagggccggggcggtgacatcagctgagcctctgacatcacggcccctgccgatctcacctctgcagggtggagatggaggagcagcggggaggagggatggatggatggaggagggaggggagcacccgatcccccctcgccttcaactgcgg

SEQ ID NO: 38569 - DNA, 59 bp, Homo sapiens
  chr22:42696044-42696103
  hyper
cagcctggttcctttcgttccttcgttccttcgctggtagaagccgctgggcctggggc

SEQ ID NO: 38570 - DNA, 163 bp, Homo sapiens
  chr22:42896542-42896705
  hyper
gtggcctgactggggcggggcggggcggggcggaacagcctagaagcagggcctggaactgcaggatacactcccctcctgctacctaggcaggcgtgagggtgtgacggccgcgcattcgccagacgagagcgatggctgagaacgccgcaccaggtcgcct

SEQ ID NO: 38571 - DNA, 63 bp, Homo sapiens
  chr22:43116061-43116124
  hyper
tgggaccaggtgccccggcagatcctctcccaagcccagttccgctcccgctcagtcctcaac

SEQ ID NO: 38572 - DNA, 85 bp, Homo sapiens
  chr22:43738565-43738650
  hyper
tctctcccttatcatcggtgggaccatccctcttgattccccctgatccaccggcctcctcctccttccccgggcggtgcgggcc

SEQ ID NO: 38573 - DNA, 500 bp, Homo sapiens
  chr22:43739010-43739510
  hyper
ggggagggggcgccccgggccggccctagaagttactttgcaaagaggcagggggcgcggggccgcgcggggcgagctcgggatccgcggggaagaagccctccgggaccgcgcctcggccgcccgagccccccgcgcccgccgccccccacctcggtcgggggcttacctgggagcccgctgcccccggccagccgcccgcgtgtgcccagggccagcagcacgcacaagtgccagcgcacggccgccgcgcccatgctcaatgcgggccccgctgggcgtgcgggcgtgcggggcgcggggacccgaccgaccggccgctcccgcaggcgctgctcgctgctcgccgctccgccaccgctcgggctcccgagccgcccagccagcccggctgatgagctgacagcgcgcgctcattggcccgtggcgtcggaggggcggggcgtcgcccagggccggccaatgggcgccggcctccggccctccgaggaagagggggg

SEQ ID NO: 38574 - DNA, 50 bp, Homo sapiens
  chr22:43739731-43739781
  hyper
gcgaaccggggatcccgtgaggtcgcccgccatccgtgggcagtgaaacg

SEQ ID NO: 38575 - DNA, 336 bp, Homo sapiens
  chr22:43739825-43740161
  hyper
cgtttcttgagcacctactggggaccgagtgcgggcgaggcagcagcgaaggaaccgggaggggaaacctcgtgaagatcacttgaaaattgacgttcaaaacaaacgaactttttagcactcgtcaaaggacagtggcccgtcagtgtgcttgtcacggggcggccgcaggacctgcgtctggaaccgggcgggcgcccgggacggacaatgccgcttggcggtcggtcccgcgggaggcccccgcacggggctaacctcggccggcgaagttcgctgcccggaatgcgaggccgaggcctccccctgtgacagaccgggcggggccaggaggag

SEQ ID NO: 38576 - DNA, 71 bp, Homo sapiens
  chr22:43808336-43808407
  hyper
gccccgcctgcctagcgggcggcggcgggagggggctccgccagggcgcgggactccggctggggccgcgg

SEQ ID NO: 38577 - DNA, 234 bp, Homo sapiens; identical to SEQ ID NO: 4916
  chr22:44258285-44258519
  hyper

SEQ ID NO: 38578 - DNA, 72 bp, Homo sapiens
  chr22:44263900-44263972
  hyper
gtccgcggtgctgaacgcacagcttcccctttatccccctgcccttccatcctggcacgctgggtgaccaca

SEQ ID NO: 38579 - DNA, 355 bp, Homo sapiens
  chr22:44287444-44287799
  hyper
taaatgaggctgtgccgggggtagagggcgcagagcacagcgccaggcaccagcgtctctgggctcgatccgctttcattaagctgtccccgccccttttcgcccccgcggtccgggactcaccgaccgacttgccgcagacgatgctgactgcgttgagcgccccagacgaggaaccgtagatgcggcgggcgccctggaggaggcgcggggctcgctggcgcaggcattcggtggcgcccacgtggtgggcgcccaggtagccggcgccggagaaggacaggttccatctgccctcctcctctaagaagcccatggcgggtggaccgggcggggtgatcgggacgaggaaggg

SEQ ID NO: 38580 - DNA, 37 bp, Homo sapiens
  chr22:44319869-44319906
  hyper
cgctgcctgagcgagcacgccccgcacctcctccgcg

SEQ ID NO: 38581 - DNA, 82 bp, Homo sapiens
  chr22:44320125-44320207
  hyper
ggcagatgcttcctgcgggggcgctgttcctgggcccgggaagggggcgttggaaccccgagcggtccgggccgaagcctgg

SEQ ID NO: 38582 - DNA, 193 bp, Homo sapiens
  chr22:44420487-44420680
  hyper
aggacccgtaaacaacggccgggacctggcgcgtggggccgcggtggcctccggagtctgccaaacgcgcgtgcgggcgcctgcgcggcggggacctcgggccaccgtgcggggcccgcgcctgctctgcctgccgggtgttcagctcttccctgggccagcggcatagccagccgcgcggggtgaccgttca

SEQ ID NO: 38583 - DNA, 139 bp, Homo sapiens; identical to SEQ ID NO: 14101
  chr22:44726839-44726978
  hyper

SEQ ID NO: 38584 - DNA, 884 bp, Homo sapiens
  chr22:44727367-44728251
  hyper
agctcacctcgtgcccgccgcccgctcgttcctcgcttcgtagccgggagccggcgcccgcgggagccgcctgctggggtgcgggggctgcccacgcccccgcgatgcccctgccgccgccgcaacagttgtccgggttctgggggctgcggggacgcggggactccgggctccctgatcggcgctcggaaggcgcccgctcctaggcgcgccgggcgcggcgcggagctggggccggggccggggctggggctggggccggggctgcagctccggctcggcgtccggctcggggtccggctgggggtccggcggccggccgcatgccccgtcgccgcccgcggctactcggcggcccgcgccgcccggccgcccgccggccccgagccccgcgccgcgcccgccgccgccgccgccgcgctcatgctcgccgggccccgcgctcgccgccgccgccgccgccgccgccgctgcccacttcactctttggcgctcgctccgcgccgcgccctctgctgccccctcgcccgggctcgccgagctcccgccgccctgcccgccgcgtcctgcgccctcctctctctcccttcctctctcctcccttcctctctctctctccctctctctctcttgcgtcctcctctcattttttttttttctttcgcggtctcttttctccccctctggctctttctctctcccctcctgctgtttgcggtggcttctcactttctctctttttacttcctttccgtccgttctttcacgccttcctcctcattttccttccttctacttttcccttccctctttccgctttcctgccccgtttccttcctccctcccttcctccttccttccttcctctgcgttcttcctctctc

SEQ ID NO: 38585 - DNA, 57 bp, Homo sapiens
  chr22:45016369-45016426
  hyper
tttccgacaaccacacggcgccggctgcacacgtcctgtttgcgtggttgctaggag

SEQ ID NO: 38586 - DNA, 178 bp, Homo sapiens
  chr22:45403002-45403180
  hyper
actgaaaagggttagcgcatttgtcccaagccttcggtccagcccggcggcccagaccaggcgcgggccgcggcactgccatcttcctttcagcaagcccggccccccccaaaacccgccactcgcgcacgccccctcccatcactttttaactttaaagactcgacacgaacgcccg

SEQ ID NO: 38587 - DNA, 30 bp, Homo sapiens
  chr22:45403911-45403941
  hyper
ttccccgggagctggcgtcaggttccaaga

SEQ ID NO: 38588 - DNA, 478 bp, Homo sapiens
  chr22:45404239-45404717
  hyper
ccgcctccgagaacccggctctttctttccaggaaaggggaggggtggggaactttgagaactggagacagacccctctgggagtctgagcgtgcgtcgcccaggctggcactttttagggcgccgccaaagtgcccagccaccctcccgccccatcccagggggggccgcgatcccatcgcttacttgtttgtcgctgagcgcggcgatccgcggctgcctttcgtggagctgcttcttgaggtcgccgttctgcggaaacacggaggagcgggctcaggcaggccacccggggtcaggtgcaccccagcaccgcgggccgcggcaccccccgcccggagccccacgggcggggccggccgcagcgcaccccaagtttcccgggccgcgtcctgcacgcgcggcggccgggcagtgccgcgcggggccgcttacctgtggctgccgcctcatcggggcagctcgcggggcggggcgg

SEQ ID NO: 38589 - DNA, 17 bp, Homo sapiens
  chr22:45404994-45405011
  hyper
caggttcgcccggggcg

SEQ ID NO: 38590 - DNA, 386 bp, Homo sapiens
  chr22:45405046-45405432
  hyper
cgcactcccctccccgggaccggctcacgaaggggccccctccaggcaccctcccagtcatgcagaccctacatcgcttaagagaagactccaggctcgggtcccacgcgtcctcgatcccgcaaactgtgcaggacagcgccaggggcaggcggaggggagcccagaagggggtccgcgcgtgtgctcactccctcgccccccgcccccgggcaggctccagcctggaagacccagagacccggaagagaggatgctgggctcgggtcccccgaccccctcaccccgcaacacactccccggccccgggcccggcccccggccacctacctggtggcgcgcgagttccacggcgagcgcctcgggccggctctgcagctccatcc

SEQ ID NO: 38591 - DNA, 151 bp, Homo sapiens
  chr22:45405476-45405627
  hyper
cgggaagttgcgcggctccgcgggggccagagcgggcgcgggcggacgcggcctccgggctgggttgggggggacacgagccccctcccccacggccgaaagggaagggggctggcgaaggggaagacaggcttccgggcgccgcggcgcc

SEQ ID NO: 38592 - DNA, 81 bp, Homo sapiens
  chr22:45405628-45405709
  hyper
agccctcggctgccccaactcctcaggctgcccggcaagttgcgccgggtccccgggctgccggcgcggcccggagcatgg

SEQ ID NO: 38593 - DNA, 346 bp, Homo sapiens
  chr22:45406039-45406385
  hyper
cggtcgccggctccggggactgctcgggccgggcgctcggagaggacgactgcggagtcatcctctccgtccccgggccaacccggggaacgcggcgcccccaccccctgcgccgtgtaacgccgggatcaggacactttccgctgggaggctgcgagtccgtgtttccatttctcctcaccctggtcctcggctccctcctttcccccctcctccgcctccctctgatattttatttaaattcttccgtcccctcctgtccataccagcgccgcgacttgggggattaaattagtcgcgtcgccacattcccccgccgcctgatggcctccgtgttgtttaaaca

SEQ ID NO: 38594 - DNA, 48 bp, Homo sapiens
  chr22:45680744-45680792
  hyper
cgcgcgaggaggccgcggattggccagcccaggcgggggcggggcgcg

SEQ ID NO: 38595 - DNA, 76 bp, Homo sapiens
  chr22:45809534-45809610
  hyper
gcgagacgcggcaagcgcggagccgttccttagcaacgagttgttgacatttccgagagagcgggagcgtctgtac

SEQ ID NO: 38596 - DNA, 34 bp, Homo sapiens
  chr22:45899024-45899058
  hyper
cggggactcggagtccgtgcgttgccctgcgcgg

SEQ ID NO: 38597 - DNA, 600 bp, Homo sapiens
  chr22:46262452-46263052
  hyper
ccactccctctgccccgcgcggggccgagctccacggcacgtgctttggcttggaccgggaaggcccgcagtcccacagtgcccggggaggacggtccgcgccttccacgacttcgcgccgcccgcgtggctgcagcgccgtggcccggggacgcgaggccacagcccgggagcgaggagcgcgggaggaccggcctgcctgtgcccggcaaagggggcccttccgaggcgggctcccttccccgccgctcccgtaagcgcgggagccagaggaccccagacccgccgcggcccaccccaagccccgatcaagtcctgcagcgcgggagggacccctgcaggcgcggggccagacgggcgacaaagcggcggactgcgagggccctgaggaagccggcggcgcggggtcaggagcaacctgctattcgtagggtcaggagcccacgcgtccccactgcggagggcggggtcgcagccaggcctccccgtttctagctgtgcggcctggggcgaggtgcttgacctctcggggcctcagtttccttctctatgaagcggagctgatcggccgcgtcccggggctgctgtgacagtccaagg

SEQ ID NO: 38598 - DNA, 113 bp, Homo sapiens
  chr22:46263511-46263624
  hyper
cgcgtccggccaagcgccgcctccggcctctgcccgcggcccggcgcgccctcctccccagcgcgcccctatcctgcacgcatccgcggccccgggccctttccgcagcccca

SEQ ID NO: 38599 - DNA, 105 bp, Homo sapiens
  chr22:46263743-46263848
  hyper
cgcgcctgtcccctccctgtcccctccttccagctctggaaacagcagcaccggaagccccctgccccagactcactgcccacccccggccgagctggctgccag

SEQ ID NO: 38600 - DNA, 58 bp, Homo sapiens
  chr22:46367066-46367124
  hyper
gctgccccctctggccgcgtcaggcgaccccggacgtggcccgcgtgtaaaggagggg

SEQ ID NO: 38601 - DNA, 22 bp, Homo sapiens
  chr22:46368102-46368124
  hyper
cgacagtagaagcatggtgggc

SEQ ID NO: 38602 - DNA, 30 bp, Homo sapiens
  chr22:46373796-46373826
  hyper
tggcttcctctgcagcgcccagctgtgttc

SEQ ID NO: 38603 - DNA, 132 bp, Homo sapiens
  chr22:46440571-46440703
  hyper
tcttcctcccctccccggcctgcttttcctccttctttccctctttgttgccaacctcggagccgcgactgaaacccagcccagcgtgtccgcgaagcccggaaacttccagctccgcgactgtgcagaaag

SEQ ID NO: 38604 - DNA, 44 bp, Homo sapiens
  chr22:46512635-46512679
  hyper
ttcccgctctcctggcgtgtgtgtgtttgcgggggaggtgtggg

SEQ ID NO: 38605 - DNA, 98 bp, Homo sapiens
  chr22:46658645-46658743
  hyper
tcacgcgcgcggggccgtctgtggggcactcggtgcgggccacgaagccctgctggggccgcgggcctggcgcggcggagcgcggggagacgcgggcc

SEQ ID NO: 38606 - DNA, 207 bp, Homo sapiens
  chr22:46932741-46932948
  hyper
gtgcgcgcccgcaggcggcggctcagcgccgtcggggcactgcgggccaccaagcggacttgcagcggcagcgggcgccccgcgcccgagacgcgccgacgtcctgccagccgcccatcgcggcccacgtccagcagctcccgcggcgcccggggcgtgcaagcggcgcccaccgcgtaggtacagccgggccggagggcgaaggcg

SEQ ID NO: 38607 - DNA, 309 bp, Homo sapiens; identical to SEQ ID NO: 4918
  chr22:48885529-48885838
  hyper

SEQ ID NO: 38608 - DNA, 115 bp, Homo sapiens
  chr22:48885907-48886022
  hyper
ggagcgccctccccgtgcctcagcccgggacaaggggggaggcggcggccgagcccggagaggagctcttcaggcaggagcccagcctgggctcggaggagcagctggagcttcc

SEQ ID NO: 38609 - DNA, 756 bp, Homo sapiens
  chr22:48886204-48886960
  hyper
gggcgtgagctgagggctggggtagggggtgaccgccgcgggctccctgttgcctggagtgaagggtggggggtggcctgtgcccctgccgaggctccaggcgggtggaatgaggggtggttggagtcccgggtgcagactccagcctcggcgctggggagggtgctcagcatcccggggcacgttcgcggctggtggggtaagtgggggccgctcagcgtcccgggcacaggctctggccccagatggcgcgggctggtcggcttcagctccgggagctccgggcttcttgtcttcagcgggagaataggacgggtgctggggagcacctgtcatggagaattgccatgggcgcgggaggtgatggaaaaatatggattctttacaaaaaaaaaaaaaaaaggccagcaccgaacctccctccacagacaccacctcctccagagccccgggcctccaagctcccagtccgatctgatccttccgctgtcgccaaaatgagagcacagtggcccagggagacccgggcagccgcgggatcggcctccggagtcctgggacagcccagctcgccaggatcgcaagggaaacccggggaccagagcaggaattttcctacttgcttcagcgcggttatgcatttccctagaaatgctgtggcaccgagcggggaggggtcgccaagcctgggggtctcaacccgagctgcccaggcagacgaggccaccgtgggtgcgccggcgcccctgggaactc

SEQ ID NO: 38610 - DNA, 82 bp, Homo sapiens
  chr22:48970842-48970924
  hyper
tccaggcagatgtgccgttttcagaagccgcgggaccagcctcctccgagccctcccagccgctggtcgggcccggctgggg

SEQ ID NO: 38611 - DNA, 148 bp, Homo sapiens; identical to SEQ ID NO: 1524
  chr22:48971532-48971680
  hyper

SEQ ID NO: 38612 - DNA, 201 bp, Homo sapiens; identical to SEQ ID NO: 1525
  chr22:48971758-48971959
  hyper

SEQ ID NO: 38613 - DNA, 176 bp, Homo sapiens; identical to SEQ ID NO: 1526
  chr22:48971960-48972136
  hyper

SEQ ID NO: 38614 - DNA, 79 bp, Homo sapiens
  chr22:48972387-48972466
  hyper
ttgtccccgggcgcgcggaccggtcctccgcgctctgcccggctcgcggcggctccggcgcccgacccggcttccagca

SEQ ID NO: 38615 - DNA, 120 bp, Homo sapiens
  chr22:50242347-50242467
  hyper
gttgacctaggaccccgcccctgcccgccctgcgccgcgcccctcccgggccggccttgaccgagcagctccacgcgggcccggggctcgtccacccgacaggagcggggggctgcagcc

SEQ ID NO: 38616 - DNA, 775 bp, Homo sapiens
  chr22:50242748-50243523
  hyper
cgcccggggacagtgcgcgtcccctcgcccgcggcgcccgccctgcccgtcccaccgaggtcccccgggagcgtctgggcccacggcttcggggggtttctccgagacctgggcgctgttctgggggagcaggggcccgggccaccaaggttcgtgcggaccgtggggtgtcccacgcccaggccgggggatcccagagccccgcttccctcaagggcgccgcgccccggactgcaggtggagacggggaccggccccgcggggtcgccgacaggcgcggggcgggacagggtgggaggcggcggggcgcagagtcctccggtcgccggcgcgatccgggcaccttcctggaggcggcgggagcgcggtcgcggcgcctccggggtggggtccaggttggaggctccggggcgcaccgccctagccccaccccggccgggtccccgcgctgcctctgcggagagggaggaaggaaggaaggcagggagggaggggacggccggcaggcgtggggtccgcggcgtcagggctccttcctcccgtccgctccatcctgcaacccgtagcccgggcggggtctcgctgccccctccccgaacacagccgccttttcctccctccccaaccccgagcgcctcccttcccgaatgcgggagtccatagtgcacgggaagcctcttcccctccccaccgaggctgcccgacgccccttccaccctccgaccccccgcaaccatccctcaaatgccccggcggccagcagggctggggtggg

SEQ ID NO: 38617 - DNA, 154 bp, Homo sapiens
  chr22:50421887-50422041
  hyper
gagaccttgagccctcgcgccctcgcgccctcgctccgggttcctgcgcgtggagggggcaggacgccccgcccttattcccgccgccagggggctccacggaggccgcccctcatccacagcagctgcgggtcctgcccggccctccagggcc

SEQ ID NO: 38618 - DNA, 53 bp, Homo sapiens
  chr22:50453483-50453536
  hyper
ccgcgcaggtttccacggagacgcgcgtggctccgggtcgtcgtcctggtccc

SEQ ID NO: 38619 - DNA, 212 bp, Homo sapiens; identical to SEQ ID NO: 4922
  chr22:50496971-50497183
  hyper

SEQ ID NO: 38620 - DNA, 86 bp, Homo sapiens
  chr22:50497213-50497299
  hyper
cggggtgaccgtatcagcgccccccgtcctgcggcggaacttgggagggccttggtatccgcagaaccactcgtggggtcccacgc

SEQ ID NO: 38621 - DNA, 30 bp, Homo sapiens
  chr22:50609166-50609196
  hyper
acctcctggagcagtcggcggacatggcga

SEQ ID NO: 38622 - DNA, 91 bp, Homo sapiens
  chr22:50623624-50623715
  hyper
ccccctggaggcctccggacgatcggaagtgactgagcgtccgggtccgtgaggccgggggtcggcccgccctaagactcccacctggtcc

SEQ ID NO: 38623 - DNA, 137 bp, Homo sapiens
  chr22:50623741-50623878
  hyper
cggggcccctggggcccgaccttcccggggtgccccaacctgcggcaaggccgaggtcccgctgaggcatgagtcccgggtcggggaccgctctgggccgacccccggaggacggactaggccgatccccagaggga

SEQ ID NO: 38624 - DNA, 44 bp, Homo sapiens
  chr22:50987052-50987096
  hyper
accctcaaggggaggcgccgggggaggggggcagccctgccggc

SEQ ID NO: 38625 - DNA, 114 bp, Homo sapiens
  chr22:51042291-51042405
  hyper
cacggacaccgggcccggcggggcgcagtcgccagtgcgcccgggttgcgactgcgaagggaaccggcctgcggaaccccctgcgccaggggggacttcgccctcctcagatcc

SEQ ID NO: 38626 - DNA, 109 bp, Homo sapiens; identical to SEQ ID NO: 1528
  chr22:51042457-51042566
  hyper

SEQ ID NO: 38627 - DNA, 38 bp, Homo sapiens
  chr22:51111972-51112010
  hyper
agctcccccctcctccgcccactcatcaccccctcccg

SEQ ID NO: 38628 - DNA, 148 bp, Homo sapiens
  chr22:51112026-51112174
  hyper
cgtaaaactaaaattcacttcccagtcgcaggtggagactagtagcgccccctcccctaggcccttccccgtaggtcgcgcccccatcccgccgtcgctaaggtgacggggagggggcgacaggcgttggatccggaccggccagggg

SEQ ID NO: 38629 - DNA, 158 bp, Homo sapiens
  chrX:2846239-2846397
  hyper
gtggggacatggaggcggcacaaggccaaggcgccgggggatggccagagggaagtaacggccgcgcttgtggtggagatggggacgggacagagaagtcttggggggtgaccggggtaggcacggcggtgctggggggagggcgcccaatgaagccc

SEQ ID NO: 38630 - DNA, 42 bp, Homo sapiens
  chrX:2846814-2846856
  hyper
gggcagagcggggggcgcggttcggggcgggtcttagggagc

SEQ ID NO: 38631 - DNA, 53 bp, Homo sapiens
  chrX:2847143-2847196
  hyper
cgccggacacaaccacgccctttacaggggcccaggctcgcccggggcgcccc

SEQ ID NO: 38632 - DNA, 289 bp, Homo sapiens
  chrX:3263410-3263699
  hyper
cggagttttctctctcgccagagcccgggctttccccgcccctgcctgcgcgcctgacctcggcgctgggctggttccaagggcagccgcgccagtccccagcgtcctgtgcctgcgggcggacttggcccgggcgttccataggactcttcagccccaactccctgtccggcctcccaccccggcaccaacctcccgggagacccaggaaactcgcccccagacaaccctaatcccggggactcggggtcgggtctctccgccgcggagaaagcggcctggcgccagc

SEQ ID NO: 38633 - DNA, 45 bp, Homo sapiens
  chrX:3264124-3264169
  hyper
aagaggctcctcaagcgtcctttcccccaccgattgcaagagcag

SEQ ID NO: 38634 - DNA, 238 bp, Homo sapiens
  chrX:3264775-3265013
  hyper
cccaccccggggagacggggcgcgggcccgagccaagggaccctggccgcgccgctctgcgctcagccttcctctcgcgtcttcattgcgcctgggcccgggtgggcatgcctcgcccactccagctgcaagaaccgcaggcggctcggggaaggagggctctttgtcagagagaagtccaggaccccaggagggaagggcgagatgcagggagcgcggtgggagccgcagtagagtc

SEQ ID NO: 38635 - DNA, 29 bp, Homo sapiens
  chrX:3265150-3265179
  hyper
cgggctggccccgccggcatcccactagc

SEQ ID NO: 38636 - DNA, 25 bp, Homo sapiens
  chrX:6143655-6143680
  hyper
ctggcaattctgcttcgtcaggata

SEQ ID NO: 38637 - DNA, 145 bp, Homo sapiens
  chrX:6143800-6143945
  hyper
gagatgggagctcacgcacaccaccccctttcaagaaaatataatgcaacgcgctccgatgtaaaccctacgggcaacggatgccttcaaaaagcataagataagagcaacaacaacaacaacaaaccaccgccccccccaaaaa

SEQ ID NO: 38638 - DNA, 39 bp, Homo sapiens
  chrX:6144250-6144289
  hyper
ctgcaccccctcccccgccatccccgagatagcagcagc

SEQ ID NO: 38639 - DNA, 92 bp, Homo sapiens
  chrX:6144913-6145005
  hyper
tccctacctcatccccgctcgcgcttccgcaggtcaggccacgcgggtgccagcgcgggctgtgggcgccccagccgcggccttggggaggg

SEQ ID NO: 38640 - DNA, 477 bp, Homo sapiens
  chrX:6145243-6145720
  hyper
gggaagagggggtggcggttgcgttttccagggctgtagaggtggtgcgcctattggaaccgactcctcagcctcctcccccgtccccacctcggggactggcggaccgtgcgccccgcaggcttaacactccccccgacaccctcgctccgagaaggggtgttctcagtgggcaccgactagggctccagatcccccgagacccagaccagggctccggtagtctgtcctcgcagcttccaacttttccgctccttcggaaaagcgggcagttcagagatggttcccagggcggcagctgcaagcccccccgcgcccccctcaaaggttcagactacactcaaaggctccgaaagaagcaaaaccaccagctctaccctccttctgcggcttgcctcacccttcccacccgcctcgaaacccacacacacgggaaaggggtgcatggagcccgctccccggtttacagaagcagcc

SEQ ID NO: 38641 - DNA, 15 bp, Homo sapiens
  chrX:6145835-6145850
  hyper
cgtcatcttatccga

SEQ ID NO: 38642 - DNA, 47 bp, Homo sapiens
  chrX:8698504-8698551
  hyper
gccagcttcaccagccggttcaagatcatccccgagggtaaggggaa

SEQ ID NO: 38643 - DNA, 304 bp, Homo sapiens
  chrX:8698754-8699058
  hyper
agagtttccctgaagcgagaaattgggaacttggaacaggtgggcacctagggatagaggcgagaagaagaaggagagaaggatgagagaagagaaaaataagcggaggatttcagagctcgcacgctcgacagggctggtacaggcagcagctgcactcgctcgcgctgagtccggaacctgctctcgtgcgcccacccgcacccggagcctcgcgcaagtcccgcgggggtccgcgccacagggcagagtcccggcaacccgctggagccaagcgcgcggctcccggagcctcccacacaag

SEQ ID NO: 38644 - DNA, 89 bp, Homo sapiens
  chrX:8699110-8699199
  hyper
cggggtttgggggacggttcccccgggactcgttgaggagtatccgaatacggccccgccaaatcccctgtccccggcacttcttccct

SEQ ID NO: 38645 - DNA, 70 bp, Homo sapiens
  chrX:8699504-8699574
  hyper
ctttgcgggagtcgccgcccgcccggagtctcgcgcactccaattcccgggaaaccgccacatccacaca

SEQ ID NO: 38646 - DNA, 80 bp, Homo sapiens
  chrX:8700319-8700399
  hyper
gcagggcccatgggccggtctcgtcagctgcgagcccgggcgctccgggggagggcgacgccgagcggctttccacgccg

SEQ ID NO: 38647 - DNA, 80 bp, Homo sapiens
  chrX:13707316-13707396
  hyper
tgctgtgcaggtccccgaccctctctctgtcctcattgcgcccagacgggccggcccagagctcccgggtcgtctttcgt

SEQ ID NO: 38648 - DNA, 114 bp, Homo sapiens
  chrX:13955908-13956022
  hyper
cagattttaaccctccggagctgagccttttgccgttgctagtcgttcccccgttgcattggaacccgctcagcacaccgcctccacctgcacccgggccgcattttaatagtt

SEQ ID NO: 38649 - DNA, 241 bp, Homo sapiens
  chrX:13956288-13956529
  hyper
aataaagcactagcccgggacgcgccgtctgttctctctgcaacccctcccgggtacccagctcttaggctcccgcgagccgcacgtgcgggggtgcagcctggccgcagccggagcggggaccaccccccccacaggatacaacagggaagcgcacctgggcgttccggacacctgcgccgcgcccctcccacctccagcgtcccggcttcgtcgcagaggtggccgaggaggcgccacc

SEQ ID NO: 38650 - DNA, 326 bp, Homo sapiens
  chrX:13956748-13957074
  hyper
ggctgcgctgcgctgcgcggggctggccgctggctcctagctcccggccggggtgggagcgcggcgcggctccgcctgcactgggggccggccgcgcggagaggggccctgacgtcagcgccgggggctttgtgcgcccggagctagggcccgattgggggcagcgggcgcgcggagtctgcaggcaaagctcgcggcttcctctgggacccccccgggcgagcgccgagggtcgcgggaaccggaaaagccagcgagggggatgggtagagaggggagtgggcttctaggatcgcggaggcggcgatccgcgtcccagatgaaaa

SEQ ID NO: 38651 - DNA, 125 bp, Homo sapiens
  chrX:15756104-15756229
  hyper
agcagggctcagaggcgtggcccaggctagagggaagagcccagggggagcgcagaggcggggctaggagggagcaggggtgaatgggggcgtggcccgggcgagaggggcgtggctgtagctaa

SEQ ID NO: 38652 - DNA, 195 bp, Homo sapiens
  chrX:16729945-16730140
  hyper
cctaaccatctagtacggggaaaacgcgggggtcgttgtttaaggggtgcactgggaccggggagaggacagaaaggccatgttaccggcgctgatcaccagcctcgcagacccccgctcggggcttcacttccgccaacgccatctcagggctctcctggctcccgagggccgggagaagtggggatccgggtg

SEQ ID NO: 38653 - DNA, 161 bp, Homo sapiens
  chrX:16730152-16730313
  hyper
cgggcggaggcgggaagaagcgcgtcccggggacgcgcgggacaggctccaaccgcactgggcacgggccagcgttccccagtccccgcgccacacccggcagccgaggtctgcgagcgcggggctggcggccggacccgactcagcgctgggcagggagc

SEQ ID NO: 38654 - DNA, 30 bp, Homo sapiens
  chrX:16730872-16730902
  hyper
gaactccacgcttcccggggaaccccggct

SEQ ID NO: 38655 - DNA, 30 bp, Homo sapiens
  chrX:33744540-33744570
  hyper
agggcacagcctctgcggagagtagcaggg

SEQ ID NO: 38656 - DNA, 33 bp, Homo sapiens
  chrX:40017591-40017624
  hyper
gcccggctgcgcaggcggcgctgcccccggcgg

SEQ ID NO: 38657 - DNA, 69 bp, Homo sapiens
  chrX:40017828-40017897
  hyper
acgacctctggttcccggactcccgcgatggtcaacgtgttatcgcttctcccgcgcaccccagaactc

SEQ ID NO: 38658 - DNA, 44 bp, Homo sapiens
  chrX:40031390-40031434
  hyper
aggggagtcaagctgcggccaatgcaagacgagcagggtagact

SEQ ID NO: 38659 - DNA, 53 bp, Homo sapiens
  chrX:40034521-40034574
  hyper
ggctggccccgcgcgcgtaagcgcggcactcagcagctcgacgcaaagccagg

SEQ ID NO: 38660 - DNA, 176 bp, Homo sapiens
  chrX:91035629-91035805
  hyper
ttctttttcttaaagcgcgtagcgataaaacggctcttttttttcgagaaaagtaatgtaccttttaaaagaggttcatcggaaaatgtgactttttaaaagcgagcagccgcaaacgggtgtattttttagactttagaagagcggagcggcagtccgcccgggttgcggctggg

SEQ ID NO: 38661 - DNA, 136 bp, Homo sapiens
  chrX:91037072-91037208
  hyper
gcggcgagtccgacccgcaagcacgagcagccctgccccgcgcgctccctgcgcgcagccgccctcgtgtcccttcggcctctcctgggtcccggctcgcagccccccccttccagtccctcgctcctcagaggcg

SEQ ID NO: 38662 - DNA, 37 bp, Homo sapiens
  chrX:103087260-103087297
  hyper
gggacccggtgtagccgcctcccgccctccatgtggc

SEQ ID NO: 38663 - DNA, 30 bp, Homo sapiens
  chrY:4869647-4869677
  hyper
ttaaaagaggttcatcggaaaatgtgactt

SEQ ID NO: 38664 - DNA, 80 bp, Homo sapiens
  AC211950.2_11234-25326:40-120
  hyper
cggtgattggaataacgttcgcctttaaacttctcaagagatttagggtgggttttagtaagcggggccggttagctcag

SEQ ID NO: 38665 - DNA, 18 bp, Homo sapiens
  AC211950.2_11234-25326:180-198
  hyper
aagcggcttttttttaat

SEQ ID NO: 38666 - DNA, 373 bp, Homo sapiens
  AC211950.2_11234-25326:13516-13889
  hyper
ttatcaggagcctgccggtactttgggccgccaaatccctggcaggacaagattgagggcggagcttctcagatactgccttgggcaaacttctacgagcctgagagtgtgaagaatacggatttccaaaataggtcatgagggagacctctctcctcacttcccaatttcgccttcttcatctctcggaattagagagcacgttccagttggagaagcaccacctggaactgcctggcttgcgggcacagctattccagcccgctctagagttgtgatcctcacctgctccctgcaggcaaggccacccggaagtagcggggcagcttctcccagccccagaacttcacgccatacgcgcctcatcttcaat

SEQ ID NO: 38667 - DNA, 60 bp, Homo sapiens
  AC231386.2_19255-24791:4032-4092
  hyper
gaccgggggcgaaggcgacaggggtctgtggaagagacctgtcggcggagagcggtccac

SEQ ID NO: 38668 - DNA, 200 bp, Homo sapiens
  AC241442.1_28021-33880:358-558
  hyper
gccgctgggcctgagcgtgcagtcggtcgggtgggcgagggcgccgccctggtggcggaagcgcctcctccagggctcccccgaacggcggcgccgggaccccgctctccttgggctctttgcctcagaccccacgtggcgatgacccggcctcggtgtgcgcgtcggtgcggaggccggcccttcgagctgggtcccga

SEQ ID NO: 38669 - DNA, 420 bp, Homo sapiens
  AC241851.2_88-34049:15124-15544
  hyper
cggcttcttgcccccaccgcccgggctttttgcgccgcggctttttgctgctatttgtccctgccaccgcggcgttttgcccccgcagccgcggctccttgccccctacgcggcttcctgcctccgccaccgtggctttttatcaccccagccgctttttgaaccccccgccgcgggtttttgccgccgcggcttcttgcccccctcgccgcggctttttacccccacagcggcggctttctgcccctgcctctgagggtttttgcggctttatgtccccgctgtcgtggctttttgccgccgcggcttttggccccctccgccgcggctttttgcggcttttggcacccaacgccgcggctttttggggcttttggtccccgccaccggggcttttttcccccaccgccgcaggttttt

SEQ ID NO: 38670 - DNA, 35 bp, Homo sapiens
  AC241851.2_88-34049:15844-15879
  hyper
ttgcctagacgctggcgccccgggctctgctcctg

SEQ ID NO: 38671 - DNA, 123 bp, Homo sapiens
  AEKP01168736.1_1-4752:1196-1319
  hyper
tcagagggtcagctgcgccccggccagagcaggagctgcgggaagaccctggagagcagggctgggagtggggatctggcagtgtggggccaagaaaaagggctggggcggaaatccagagac

SEQ ID NO: 38672 - DNA, 141 bp, Homo sapiens
  AEKP01168736.1_1-4752:1629-1770
  hyper
ggggcgcgtgcaggtcggagccggcaggtgaggagccagggtctaagctagggcccggggtccaaaggaaaggctttcagatctgagctccgcggctctggcggcggtggagctgggagcccgcggtggccggctggggac

SEQ ID NO: 38673 - DNA, 801 bp, Homo sapiens
  AEKP01168736.1_1-4752:1830-2631
  hyper
ctcggcgatgcgggtgcacctgggcgggctggccggcgcggctgcgctgaccggggcgctcagctttgtgctcctggcggccgccatcggcacggacttctggtatatcattgacaccgagcggctggagaggactggcccgggggcgcaggacctgctggggtccatcaatcgcagccagcccgagcctctgagctcccactccggcctctggcggacctgccggggtaagggtgcaccccgtggctgggagctgtggctgcgaacgccccctgcgcggtgccctgctcccttgggacctgttgcttggcgcgcactcctcccccaagtccctaaaatacaatgtctagggactcggggggaaggtgagcagaaggccgggactgcgaaaacccttccgagaggcacccggctgcgatcccaactgctctagctctccccgcgccctccccgggtggggcacttagggtgagcatgggggcaaagccgcagacgagggtgctgcacagaactccggggtcctgcacccatggattcctccgtcctatccagtgcagagcccgtgcacaccgctgatgaaccccttcaggctggagaacgtgacagtcagcgaatcgagccggcaacttctcagtgagtccggggagggtgaggatggagggagcgccccggtcctagccgtgagttctggagcctttcccaaaacagccgggcttcggggcctgcggagagggcggctggggtggcctctgacagcccagcctgagaatggagtgggcttaagaccggggggcagggtct

SEQ ID NO: 38674 - DNA, 30 bp, Homo sapiens
  AEKP01171767.1_199-12179:11068-11098
  hyper
cacaccgcgctgaaccgtggtggcctcaat

SEQ ID NO: 38675 - DNA, 86 bp, Homo sapiens
  AEKP01197830.1_1-1408:113-199
  hyper
cccggcccgacaccccgcggctttgggctcccacggggccgcgcgcctcttcccagccgggccccccatcccggggcagagggccc

SEQ ID NO: 38676 - DNA, 43 bp, Homo sapiens
  AEKP01197830.1_1-1408:476-519
  hyper
tcagaaaagctggagcggggccgcagcccggccctgccccccg

SEQ ID NO: 38677 - DNA, 32 bp, Homo sapiens
  GL000258.1:893217-893249
  hyper
agattaacctggacccgcgtggaggattcagc

SEQ ID NO: 38678 - DNA, 82 bp, Homo sapiens; identical to SEQ ID NO: 14151
  JH159140.1:144237-144319
  hyper

SEQ ID NO: 38679 - DNA, 170 bp, Homo sapiens
  JH636052.4:1361659-1361829
  hyper
ccgtgttgacaaagtcgctggaaatcactgtcagagatgtagcttttaggatagtattgtccaggatctgctaggctctatccactgcaggccttggtggggggggagggggggcctgcgaagcacaggaaaacttgtcttttcgttgtaacttccgcttcgttactaca

SEQ ID NO: 38680 - DNA, 24 bp, Homo sapiens
  JH636052.4:1362108-1362132
  hyper
gacttgctcctacagcgcgggaaa

SEQ ID NO: 38681 - DNA, 24 bp, Homo sapiens
  JH636052.4:1362192-1362216
  hyper
tgatgtcaccgacagtgcctttcc

SEQ ID NO: 38682 - DNA, 30 bp, Homo sapiens
  JH636052.4:2280989-2281019
  hyper
aagaataacccttgccgtctattttttcat

SEQ ID NO: 38683 - DNA, 76 bp, Homo sapiens
  JH636052.4:2302666-2302742
  hyper
aggaaacgccctcgtccgcgacccgagccgccgcctcgaggctcaggggaagctgaacgctcggtgggctcctggg

SEQ ID NO: 38684 - DNA, 211 bp, Homo sapiens
  JH636052.4:5118718-5118929
  hyper
ctgcgagggtcaggacggggcgaaggccattccgctgcccttccagcttcggaatcacccaatgcacgggtttcaaccgtagccagcaagatgcgcctctcaggttttccgaggctttggagcctgcacaattgttctacaaaaggcagtagctccgccgaacgttggatcgtcccttggtctggtgataccagaacgagagttgactgtg

SEQ ID NO: 38685 - DNA, 218 bp, Homo sapiens
  JH636058.1:413209-413427
  hyper
tggacaccaggcactcggcggcgaagtagtccaggcacgccacggcggccgacatgctgggaccgcccggccgccggcgagcgccgtccgaacgcggccggccgcgggcgacggagttcccgggagcgtccgtcccgcagcctcggagcgagaagcaggaggccgggtgctcgccgcctgccgcctgctgccgccgccgccgccgcagccgccgctgc

SEQ ID NO: 38686 - DNA, 169 bp, Homo sapiens
  NW_001838403.1_1-2251:175-344
  hyper
agaggcctggggagccgcgcgaagccggcgagcaaacagctggaaattattaccagttaatgcgctccgtgtggccgcagccgcctgttggccccggaaggcgggccctggcgctcctgcccgtcccggaggagaggcctgtcctcgggggctccgcaggcgcgggtca

SEQ ID NO: 38687 - DNA, 30 bp, Homo sapiens
  chr1:865434-865464
  hypo
ccccgggagatggaacggcccggtccagcc

SEQ ID NO: 38688 - DNA, 48 bp, Homo sapiens
  chr1:898728-898776
  hypo
ctcagacctggctaccgtggagtcctacgaccccgtgactaacacgtg

SEQ ID NO: 38689 - DNA, 572 bp, Homo sapiens; identical to SEQ ID NO: 14155
  chr1:913532-914104
  hypo

SEQ ID NO: 38690 - DNA, 90 bp, Homo sapiens
  chr1:918405-918495
  hypo
catgagggccgcgggcgactgcccgggcgggtgaggctgtcctgtgtgaacgtgccacgcggctgtgccgtttcccgtgggtggcgatgt

SEQ ID NO: 38691 - DNA, 47 bp, Homo sapiens
  chr1:942338-942385
  hypo
gccctgcacctggcccgggcctcggaccccgacggggctcacccacc

SEQ ID NO: 38692 - DNA, 30 bp, Homo sapiens
  chr1:957607-957637
  hypo
aaagacctggtggcccgggagagcctgctg

SEQ ID NO: 38693 - DNA, 356 bp, Homo sapiens
  chr1:986529-986885
  hypo
tagataggcaatgggcgggtggggcgggtgcgtgcaggtgcctgggccctgggtctgcaccgtgggtgggctctgcacagccacttacctggcgtccccgcaggttccgcacaccgtcctcaacctgaaggagccgctctacgtagggggcgctcccgacttcagcaagctggcccgtgctgctgccgtgtcctctggcttcgacggtgccatccagctggtatgtgggggcggggcgtcccagcagggcctccggggcgggcggggtggcaggcgggacaaggccctcaccctgccctgcaggtctccctcggaggccgccagctgctgaccccggagcacgtgctgcggcaggt

SEQ ID NO: 38694 - DNA, 30 bp, Homo sapiens
  chr1:1045970-1046000
  hypo
cggcactcagcctctcggctgtggggacac

SEQ ID NO: 38695 - DNA, 70 bp, Homo sapiens
  chr1:1050115-1050185
  hypo
actgaacatcccaggcggccgcccctaccctggggctcaaaaccggctccctctgcgagggtttcccagg

SEQ ID NO: 38696 - DNA, 160 bp, Homo sapiens
  chr1:1067634-1067794
  hypo
ctcctgcctgagacccgccgccatcgccgccgcgagccctgcgttgggcattggggccaggcacctgccaggagggcctcttccgaggtggggtgtcacctgggatgtgtccgctggcaaatgggagaaacaccagggcggctgccggggaggtcgatgt

SEQ ID NO: 38697 - DNA, 30 bp, Homo sapiens
  chr1:1080521-1080551
  hypo
cctcctggctgacaccgtggcccctcctgg

SEQ ID NO: 38698 - DNA, 144 bp, Homo sapiens
  chr1:1080794-1080938
  hypo
acctgacctcatggccgacctgacctgaccgcacggctgacccaaccccatctcatgactgaccccacctgactttatggctcaccccagtgaccccatggccaaccccacctgacctcatggccgacccgatctgacctcatg

SEQ ID NO: 38699 - DNA, 30 bp, Homo sapiens
  chr1:1083645-1083675
  hypo
gcgtccctgggttgccgcacgtatatccct

SEQ ID NO: 38700 - DNA, 30 bp, Homo sapiens
  chr1:1102634-1102664
  hypo
ccctcccacacagcccgctcaccggacccc

SEQ ID NO: 38701 - DNA, 159 bp, Homo sapiens
  chr1:1145553-1145712
  hypo
ctgacaccatggaggcgaacaggcacctccgcctcccgagggacacagatgtcgcttagacgcccggggtgtcttccctgcgggaagcctgcagggctgctcccgccttgttcccgagctgtggcctcgggcgtgactggcgctcgggagcaggctctg

SEQ ID NO: 38702 - DNA, 164 bp, Homo sapiens
  chr1:1146693-1146857
  hypo
tgcagcccacagtgccggtcggagactcccgtctgccaaggtttttattgtggtcccgcggggcaggaggtatgcatggcatacgtaagcagagagccggaggcagccatcggcacctagaacggtgcagagttggcccaggagcgtggcggggcaggcggcct

SEQ ID NO: 38703 - DNA, 126 bp, Homo sapiens
  chr1:1168843-1168969
  hypo
gttcctggacctcagcgagcctgagccgggcccggccgcacgctgacccccgtgctgtccccgaccggctcacggggctgggctccgatcttccgtgtctcttatcagtggcgtttctcacgtctg

SEQ ID NO: 38704 - DNA, 33 bp, Homo sapiens
  chr1:1173925-1173958
  hypo
ggccccaggacgcggcgccgagctctgccccca

SEQ ID NO: 38705 - DNA, 18 bp, Homo sapiens
  chr1:1218784-1218802
  hypo
atggggcttctgggccgg

SEQ ID NO: 38706 - DNA, 42 bp, Homo sapiens
  chr1:1234718-1234760
  hypo
acttacctgcagcagcgtctggagggccggagcaggaggggg

SEQ ID NO: 38707 - DNA, 103 bp, Homo sapiens
  chr1:1235178-1235281
  hypo
tggtgtgcagggagccggctgcgcggcctcacccgctgctggatggcggcgtgctttcgctccatctcacgcttttccaccgcagagtcgatcaccagctggt

SEQ ID NO: 38708 - DNA, 177 bp, Homo sapiens
  chr1:1235901-1236078
  hypo
tccagtgccaggtggcggaagcacttcctggtgagggtgagggccccggtggcttcctccacctcgtggggccggtgcctcggggcctgggcgttcctcaccagggacagctccaggtcctcccgcaccttgtcaaactgcttctttgtctccttgaacttccgcacatccctggag

SEQ ID NO: 38709 - DNA, 205 bp, Homo sapiens
  chr1:1238277-1238482
  hypo
aggtggcagggaggccgcgctcaccatgtggtagttcaccacctcctgtaggctgtcagcgaacctctgcagacattcctggaggagcagatgggaacccgtgctgagatggcaaatccgggcccaggtcacccagccacgccctctgagcccctgggcggtgcagacaccggcctgcttctggcctggacgccctcaaggggct

SEQ ID NO: 38710 - DNA, 292 bp, Homo sapiens
  chr1:1245060-1245352
  hypo
ctgcctggatatggtcgccatgcaggaagccgcccagcacctcctcggcacacacgacttcagcgccttccagtccgctggcagcccggtgccgagccccgtgcgaacgctgcgccgggtctccgtttccccaggccaagccagccccttggtcacccccgaggagagcaggtgaggaagggcccctgggctgtggccctgccctcaagtcacgtgctgattttagctccagcacctcccccagttttaaggcaaggtgaggcgggaggcaggcagccgggagtcctcagga

SEQ ID NO: 38711 - DNA, 22 bp, Homo sapiens
  chr1:1253533-1253555
  hypo
gccaccgcgcctggccaaggca

SEQ ID NO: 38712 - DNA, 1115 bp, Homo sapiens
  chr1:1267070-1268185
  hypo
agatcaacaacaagtcggatctgctgcccgggctgcgcctgggctacgacctctttgatacgtgctcggagcctgtggtggccatgaagcccagcctcatgttcctggccaaggcaggcagccgcgacatcgccgcctactgcaactacacgcagtaccagccccgtgtgctggctgtcatcgggccccactcgtcagagctcgccatggtcaccggcaagttcttcagcttcttcctcatgccccaggtgggcgccccccaccatcacccacccccacccagccctgcccgtgggagcccctgtgtcaggagatgcctcttggcccttgcaggtcagctacggtgctagcatggagctgctgagcgcccgggagaccttcccctccttcttccgcaccgtgcccagcgaccgtgtgcagctgacggccgccgcggagctgctgcaggagttcggctggaactgggtggccgccctgggcagcgacgacgagtacggccggcagggcctgagcatcttctcggccctggccgcggcacgcggcatctgcatcgcgcacgagggcctggtgccgctgccccgtgccgatgactcgcggctggggaaggtgcaggacgtcctgcaccaggtgaaccagagcagcgtgcaggtggtgctgctgttcgcctccgtgcacgccgcccacgccctcttcaactacagcatcagcagcaggctctcgcccaaggtgtgggtggccagcgaggcctggctgacctctgacctggtcatggggctgcccggcatggcccagatgggcacggtgcttggcttcctccagaggggtgcccagctgcacgagttcccccagtacgtgaagacgcacctggccctggccaccgacccggccttctgctctgccctgggcgagagggagcagggtctggaggaggacgtggtgggccagcgctgcccgcagtgtgactgcatcacgctgcagaacgtgagcgcagggctaaatcaccaccagacgttctctgtctacgcagctgtgtatagcgtggcccaggccctgcacaacactcttcagtgcaacgcctcaggctgccccgcgcaggaccccgtgaagccctggca

SEQ ID NO: 38713 - DNA, 88 bp, Homo sapiens
  chr1:1309067-1309155
  hypo
gagagacctcacacccggcaaatggagctccagacccgcaggaaaggctgagtcctctgagaatttattactacggatcacagcagca

SEQ ID NO: 38714 - DNA, 84 bp, Homo sapiens
  chr1:1341728-1341812
  hypo
cggggtaagaaaaaaaaaccggggtacgttagatgctaggttcatgaggctgagacgggagtggtgaggcgcagtaatgaggcg

SEQ ID NO: 38715 - DNA, 46 bp, Homo sapiens
  chr1:1363856-1363902
  hypo
ccttggtctcaccagcgcgtcctagctgtgccgagctcacacccac

SEQ ID NO: 38716 - DNA, 30 bp, Homo sapiens
  chr1:1483034-1483064
  hypo
aggctcagagcaaggcgagaggacaggagc

SEQ ID NO: 38717 - DNA, 89 bp, Homo sapiens
  chr1:1563170-1563259
  hypo
cgggccctgtgtgagcgcggctgtgacgtcaacctgcccgtgagtgctgctccctggcctgggtgccccctgcccgtgagtgcttgtcc

SEQ ID NO: 38718 - DNA, 103 bp, Homo sapiens
  chr1:1563663-1563766
  hypo
agattctggctcgggcgcggcagctggtggacgccaagaaggaggacggcttcacggcgctgcatctggctgccctcaacaaccaccgcgaggtggcccagat

SEQ ID NO: 38719 - DNA, 62 bp, Homo sapiens
  chr1:1625749-1625811
  hypo
taaatattacttttacgttttgttaaacttccacttgtttttgtttccgttgcatgaacctt

SEQ ID NO: 38720 - DNA, 24 bp, Homo sapiens
  chr1:1671766-1671790
  hypo
tctttttttttgagacgggagtct

SEQ ID NO: 38721 - DNA, 20 bp, Homo sapiens
  chr1:1839158-1839178
  hypo
ttttgttttttgagacggag

SEQ ID NO: 38722 - DNA, 140 bp, Homo sapiens
  chr1:1856211-1856351
  hypo
acctgtcctccagggcgcctgagtctcgctcaggcccagcttagctgaacccacgtccccacctgtgtcctccctgccctcaccccctctccttagagcaccctttctccatgcaacgcccgtctcgggctctgcctcca

SEQ ID NO: 38723 - DNA, 30 bp, Homo sapiens
  chr1:1861852-1861882
  hypo
gtggaggacaagccccggggggggctcaca

SEQ ID NO: 38724 - DNA, 30 bp, Homo sapiens; identical to SEQ ID NO: 14168
  chr1:1874744-1874774
  hypo

SEQ ID NO: 38725 - DNA, 410 bp, Homo sapiens
  chr1:1914707-1915117
  hypo
gtgtgaaaggggacacggagcgggatttcccagcctcaaagcttctgcccacaagctacgcatcagtttccaagggaacggtgtcgctgcactgaagaagccagcggccccacagtggggctggcagccatcacgtgtcccatgagaggacacccgagggactggtcatcacccccaggggcatcgagcacgggcgctgtgcgggacagcccctggcctgcaatcctcagaaccgcaacgtccgcctgtcacagaagaaccgaggctccttctgactgggggaggcgaggggccaccctcgacacaacgccacatgggcttcaggcacggctctgggatgcggggccgaggggcacagggggtcttgctgccattctgcagctcttctgtaagttcggaattgtttcaaa

SEQ ID NO: 38726 - DNA, 69 bp, Homo sapiens
  chr1:1974645-1974714
  hypo
cattgccatggtgaccgtggttctggtgctgcctcctcagacgcaccagcctcgcgccgcgtctgaaat

SEQ ID NO: 38727 - DNA, 30 bp, Homo sapiens
  chr1:1986234-1986264
  hypo
ttgggtgaacttgaacgagtgcccgaccag

SEQ ID NO: 38728 - DNA, 177 bp, Homo sapiens
  chr1:2013405-2013582
  hypo
gcagtcctcttttttcggaaatgtgttcagttctcttgcattgcataatttgttcatattaaagcaggcttgatccgggctgccgtggttccgatcgactccgaataggacaccacacagtcgtgccaagaaggcgcctaagtgtctttccacacggccatccgagggcggacgtgg

SEQ ID NO: 38729 - DNA, 327 bp, Homo sapiens
  chr1:2066352-2066679
  hypo
caggcaggggacagacggacccggcctgcgttggcctggggtgacttcacggctccactgtcagcaagcggccgtcccgtggtggatcctgtccgccctgcgaggacacctggctccatccacacctgggcctctgtctccagccgccgaggccgtgacaccatgaggatcatgtgaggaggggcagagagaggcctccgggaggccgtcattccagccctgccttccctgcctgggaggacgctgcggccgccaccacctggacgggagtggcctgtcgcagctgcaccctgcgtgggctcgtggctgccacgctgtttctttaca

SEQ ID NO: 38730 - DNA, 299 bp, Homo sapiens
  chr1:2125216-2125515
  hypo
ggtgccctcctgccccgtgaagcagccggtaggaacggcccgggccccacaggtccggcggaaagggtgtccaggaaaaggtcttgggtccgacagtgaagacttcagtgggctccgggccgcacctgggctcctgcaacacagagttgttgggccttgcccagcgatggctcccgccctggaaaccccttcatcgctaagatgggcccagtgggcacacctgtcctgggaaggcgggcagtgaaggcacctcgtgatccaggatcagctccgggctcaccgtgcgcagtagctcggcc

SEQ ID NO: 38731 - DNA, 88 bp, Homo sapiens
  chr1:2141596-2141684
  hypo
tcgtgcccagacctgcgagtgtgcctgcccgtgtcagacagaggcgagttgggacttcacacctgaaatcaagcgggagggtaggaat

SEQ ID NO: 38732 - DNA, 36 bp, Homo sapiens
  chr1:2170934-2170970
  hypo
ccatgtgggtgtagccgttggcggcacctttgtacg

SEQ ID NO: 38733 - DNA, 228 bp, Homo sapiens
  chr1:2263131-2263359
  hypo
gggaacagtcaaagacgactttgcaggatcctgcctgagagttgtaacaaaggcgcgcgtttctcccgcatgcgccgtccttcttatgtaaccactgccgctcctctcccgcggctgcgcctctcccgccgctgcgcctctccctcgtgcggctctcccgcccctgcgcctctccctcgtgcgcctctcccgcccctgcgcctctccctcgtgcgcctctcccgcccc

SEQ ID NO: 38734 - DNA, 575 bp, Homo sapiens
  chr1:2267155-2267730
  hypo
gtgctggtcactctgcgagcaacccagcagctcctccacagtgtgcggggccaggcgagggctggtgggacgggtccccagggcacatcagcgggggcctcctcgcctccatagcccagcccagcccagcgcgcagctgcccccaatttgtagacagagtcccgatttgaggtggcagctgttgctggactccgagccccgagccccagcttcctcctggtagaaccggccggttacggccctgcatgtgctgtgcccgtagcactgccaggcccaggatggtgagatgtgacggccacaaaccccccacggtgtccccgcctgcacgtgccgcggtgtgcacctggtcccactcctgtcctccagctcacagagtcccctcaagccactgccctgaaccctggccaccagccgtcttcctctgagaggccccgcacccctcctgcctctctgcttctgcatgcccacagcctggtccgcccggcgggtctgggagttgtggtgatcgaagcagatggaccggctccagctccacccacttcatgccagcccaggcaagtcgcagggcagctgtt

SEQ ID NO: 38735 - DNA, 30 bp, Homo sapiens
  chr1:2268713-2268743
  hypo
atggttctgccccagcggcccatcaagatg

SEQ ID NO: 38736 - DNA, 154 bp, Homo sapiens
  chr1:2275666-2275820
  hypo
cacctgagggctgggcgtggccaggcacaaggggctggcgggcctgggagggatctgcagggcaggttgagacatggttctgaagccaggcagctgctccccagaagctccggtgagcacactcgacaaggtggtgcggcgagctggctccgag

SEQ ID NO: 38737 - DNA, 111 bp, Homo sapiens
  chr1:2276089-2276200
  hypo
cttccctgggggcctcgtccctgcgctgcacagatggggcccggccgccccagtgggaagggaaagggggagcgctgtgccaactcacaggctctacgagccacaacagct

SEQ ID NO: 38738 - DNA, 62 bp, Homo sapiens
  chr1:2304327-2304389
  hypo
ttgggttttcctgcccgtggaatgttcccgcacgtcttcccgctggtcgggatttaggccct

SEQ ID NO: 38739 - DNA, 49 bp, Homo sapiens; identical to SEQ ID NO: 14177
  chr1:2307845-2307894
  hypo

SEQ ID NO: 38740 - DNA, 553 bp, Homo sapiens
  chr1:2308105-2308658
  hypo
ccccctccctgggtgcgcagcaatcaggtcagggcttggcatcctcggtacccaccgctggtgtccgggtgggagggctgagccaggcaagctttcatgcagcacttggtcagtccaagcacatttgagtgatcaattcaactgatccaatagcccggtcttgtctaattcacgttatcaatcacacctttgacaattcggctgtttctgtttcatgtaccccaagcaggaacgagcaagagcttattaaatagggtgcaggggaggctcctgatcctcctgctgacggcacagactgggacactgagagtcctggagcagctgcctcccacccgggcctcagggagcacccaggcacagtccaggccgatgcccagcgtggagagttacgtgcggggcctcagccacacacaggctgggaccgaggaatgggcattttgccacctgctcaccctcctcctccctgctgggccactgcctggcacccaggtgagcacaggtgtgcggtacgggacacgggaaggtggtggtggtcacacgacctttggggaag

SEQ ID NO: 38741 - DNA, 30 bp, Homo sapiens
  chr1:2309850-2309880
  hypo
ggcagtaggcccaaacgtggaggctatagg

SEQ ID NO: 38742 - DNA, 30 bp, Homo sapiens
  chr1:2310214-2310244
  hypo
cgggtcctgggaggtcgagcagtaagctgt

SEQ ID NO: 38743 - DNA, 33 bp, Homo sapiens
  chr1:2331363-2331396
  hypo
gtggtgcacagagaccgccgggactctaatgcc

SEQ ID NO: 38744 - DNA, 30 bp, Homo sapiens
  chr1:2336335-2336365
  hypo
aacatcaaatggaggcgggaaataggctgg

SEQ ID NO: 38745 - DNA, 174 bp, Homo sapiens
  chr1:2338063-2338237
  hypo
gaaggtggggcagagcgtcaaggtgggtgcaccttacaggtccttgtgaagtgcccaggacacccccagcccccatgtgtggcccccgcacgcacctgcggtgagacaggccgcggtgcagcctccactccttcctggctcgctgccgctgcctgaaaccgtacagctgcagcc

SEQ ID NO: 38746 - DNA, 348 bp, Homo sapiens; identical to SEQ ID NO: 14181
  chr1:2359972-2360320
  hypo

SEQ ID NO: 38747 - DNA, 62 bp, Homo sapiens
  chr1:2382732-2382794
  hypo
atgtgtgtgcctccccggcccccgaagatcatacgcagtagcgtctccgagggatgccacta

SEQ ID NO: 38748 - DNA, 195 bp, Homo sapiens
  chr1:2396998-2397193
  hypo
tcctcacctgctgcccgccgcctgccgcccgccacctgccacccgccgggccaaatgctctcaaagacagaattctgcttaaatgcccagaaaagagatttaggagatcagaatcttaagcaaattaacatgtgcagcgggcggcttttaatcaccgcctttaatcgcaggccgcggtgacggaaatcatctcct

SEQ ID NO: 38749 - DNA, 187 bp, Homo sapiens
  chr1:2428198-2428385
  hypo
tgctatgctgctgggcgccgggcgaggtcgaggactggcagtctgatgcccggtcaccggcgccacagcggcgtccagctggcaggtgtcgtccttcagcgagaccaaggcccaccagattctgcagcagaagccggcgcagtacctacgcttcaaccagcagcagctctcccgcatctacccctcc

SEQ ID NO: 38750 - DNA, 30 bp, Homo sapiens
  chr1:2430463-2430493
  hypo
ggagcggtgctgggccgggccctccccatg

SEQ ID NO: 38751 - DNA, 30 bp, Homo sapiens
  chr1:2437269-2437299
  hypo
ttaccaggtgcccgtcggagcctgcgccag

SEQ ID NO: 38752 - DNA, 136 bp, Homo sapiens
  chr1:2468656-2468792
  hypo
tgcatgtgcccaggaatgctcacgcctgctcagatgtcctcagctgggccacccgtccccaccctgccccgctgccctaactcccagagtacccgcattggccgagcactgctctgtgccacgtgagccctgggcc

SEQ ID NO: 38753 - DNA, 30 bp, Homo sapiens; identical to SEQ ID NO: 14185
  chr1:2507045-2507075
  hypo

SEQ ID NO: 38754 - DNA, 81 bp, Homo sapiens
  chr1:2519808-2519889
  hypo
gcgacctggtgtcttcgcaggtacaacagcctgagcatcctcccagcagctctggggaagcccgtgcgtgatgtggctgcc

SEQ ID NO: 38755 - DNA, 51 bp, Homo sapiens
  chr1:2527420-2527471
  hypo
ctgccctgacctctgcgagccacataccttctcctgcgccttcttcttgga

SEQ ID NO: 38756 - DNA, 66 bp, Homo sapiens; identical to SEQ ID NO: 14186
  chr1:2537084-2537150
  hypo

SEQ ID NO: 38757 - DNA, 125 bp, Homo sapiens
  chr1:2537758-2537883
  hypo
ctgtgagttcatcagcgccagctgccgctccagctcccactcgagtcctggggagacagtgccccgcactggagactggcgggccctggggccccagcccggccccttgtcggtgaatctggcct

SEQ ID NO: 38758 - DNA, 47 bp, Homo sapiens
  chr1:2702425-2702472
  hypo
tggtgtgaaccctgccgtcggccccgcctggccgtgcccgcaggatg

SEQ ID NO: 38759 - DNA, 113 bp, Homo sapiens; identical to SEQ ID NO: 14188
  chr1:2708372-2708485
  hypo

SEQ ID NO: 38760 - DNA, 503 bp, Homo sapiens
  chr1:2716736-2717239
  hypo
agagccgccaggagtcgctggccaccggtctcctgctggccggcactgtgcccagcctccgggtgccccgagaggtagtcctggagggcactgagcagcgcggggaggtggggccgctggtgggtgcgaatgaaagctaccgtccggtcggcgctggaggcgaaggcctggagataggcggccacaccatccgctgcctgcaccccggacaggacccaggcgagggcgcgggtcagccgcagctccaggacttgctgtgcatgagagtccagcagggcgctgcagcgttgcaccacttcttcgtgacgcccgcgggccagcagacctgccagcaggtgcaggatggcggcggggtggtccgggcagagggcgccgaggaaggcagaggccagcgaccctgtcagggagaccactgccatgccgtcccagtggatggcggggatctggctgtccccgcggcaccaggactccagggtggccaccaccgccgccccccgagcctg

SEQ ID NO: 38761 - DNA, 163 bp, Homo sapiens
  chr1:2725529-2725692
  hypo
aggagctggggctgccggcctcgcaggtgtggttggggtgggtggggctgccgtgggcctggctccatggctctgtgcaggtggcagccggcgccgcgtgtcgccacccacacaggaaaggcgagattggtggcagaggccgtgtccgcgtcatcatgggagc

SEQ ID NO: 38762 - DNA, 92 bp, Homo sapiens
  chr1:2725899-2725991
  hypo
gggctggccctggcccgcttagcctggactcaggtgcctgtggccggctgctcgtgccttcccatcctggggcaacccggggagtggcagtg

SEQ ID NO: 38763 - DNA, 30 bp, Homo sapiens
  chr1:2733570-2733600
  hypo
cagtgcccacggctgcggcatttactgaga

SEQ ID NO: 38764 - DNA, 90 bp, Homo sapiens
  chr1:2733660-2733750
  hypo
ctttggaaacaaaagccatcattctattattttgtttttagtcatggtatttccatttacaaatatagtaactttcgatcgctgcaaaaa

SEQ ID NO: 38765 - DNA, 30 bp, Homo sapiens
  chr1:2770901-2770931
  hypo
gaggaggaggggcagcgtcctaatgcgccg

SEQ ID NO: 38766 - DNA, 36 bp, Homo sapiens
  chr1:2826189-2826225
  hypo
gggccctggatcctgcggagccggaagccagctgta

SEQ ID NO: 38767 - DNA, 36 bp, Homo sapiens
  chr1:2827849-2827885
  hypo
gccaacacagataggcggtccactgtcccagtggga

SEQ ID NO: 38768 - DNA, 30 bp, Homo sapiens
  chr1:2830021-2830051
  hypo
agaaaaaatgaccctcggcaatgtcccgtt

SEQ ID NO: 38769 - DNA, 161 bp, Homo sapiens
  chr1:2833818-2833979
  hypo
ccctaaataataaatcgacgtcgtgtgtcgtggttctcgtacctgcgtgaatatttaaaacatgcaaacatgtgggagatgcatttgctgggaacaaaaggaacacacatatttaacccctgaaataaataaataaggcgaaggtgcgcagctggagacag

SEQ ID NO: 38770 - DNA, 30 bp, Homo sapiens
  chr1:2836432-2836462
  hypo
gggaggtctttgcagcggcccgtcctgtcc

SEQ ID NO: 38771 - DNA, 34 bp, Homo sapiens
  chr1:2840699-2840733
  hypo
cacaggaggatgagacggacggaagccaccacgc

SEQ ID NO: 38772 - DNA, 30 bp, Homo sapiens
  chr1:2846793-2846823
  hypo
gcgcacacatgtgcacgcaggtcccagcat

SEQ ID NO: 38773 - DNA, 43 bp, Homo sapiens
  chr1:2889049-2889092
  hypo
gggccccaagagactcggggtctgggaccgacattcataggaa

SEQ ID NO: 38774 - DNA, 30 bp, Homo sapiens
  chr1:2918482-2918512
  hypo
caaactaaaggacagcgcccaccttctcgg

SEQ ID NO: 38775 - DNA, 30 bp, Homo sapiens
  chr1:2939161-2939191
  hypo
cactaccctgttccacgggctggatgaccg

SEQ ID NO: 38776 - DNA, 45 bp, Homo sapiens
  chr1:3015491-3015536
  hypo
ctgcttctcagtgcccgttgagtggctgagcggcctcactgagga

SEQ ID NO: 38777 - DNA, 141 bp, Homo sapiens
  chr1:3035035-3035176
  hypo
gaagtggttggattccgggtagtgtggccaggggccttccccggcatgatggcatccgcccccagctcatggcccaggtctccatgaagatgaacaaaacaccaccaggagagggggaggcaaagccgggaaagaaccagg

SEQ ID NO: 38778 - DNA, 30 bp, Homo sapiens
  chr1:3063272-3063302
  hypo
ctgcacatgtgtgctcggtgtgggttgtgt

SEQ ID NO: 38779 - DNA, 30 bp, Homo sapiens
  chr1:3070343-3070373
  hypo
ttgagaagcgtggaacgcaaagtaatatag

SEQ ID NO: 38780 - DNA, 121 bp, Homo sapiens
  chr1:3078720-3078841
  hypo
ggcgttcaatatgcccgggccactgcggaaccatcacccctctctgtgcccaggattttcccgtcaccccccaggaaaaccccgtgcccggtaaatagtgactctgcgtccctcctcccga

SEQ ID NO: 38781 - DNA, 160 bp, Homo sapiens
  chr1:3102636-3102796
  hypo
acactgggtggggcacgtgctgcagaggttgacgctgcgttgtctcctttaggtgacggtgacgttgtaaataatatgtatgagcccaaccgggacctgctggccagccacagcgcggaggacgaggccgaggacagtgccatgtcgcccatccccgtgg

SEQ ID NO: 38782 - DNA, 136 bp, Homo sapiens
  chr1:3111327-3111463
  hypo
gtattctcagtcccacgttttatcatctaaacgccaaaactcgttcctggcctgccctttctctccaaggttcccagatgcacgctccactgcccacaccacccccacggttgagtgggctcggccccgggacgtg

SEQ ID NO: 38783 - DNA, 35 bp, Homo sapiens
  chr1:3129231-3129266
  hypo
tcctcccggccccctcgctgcggtcctctctgcca

SEQ ID NO: 38784 - DNA, 30 bp, Homo sapiens
  chr1:3179577-3179607
  hypo
cggcggatgaggcatcgcaggggcaccagc

SEQ ID NO: 38785 - DNA, 70 bp, Homo sapiens
  chr1:3183016-3183086
  hypo
gagactggggaggaccgagcggttcgcatttgcaaagctcttaatcagtgaactgcgttggaggcattgc

SEQ ID NO: 38786 - DNA, 60 bp, Homo sapiens
  chr1:3184625-3184685
  hypo
tcaaaccatgacccccgaatctaacagggtgcccgtttgcacacacgtgggagcgtacgg

SEQ ID NO: 38787 - DNA, 172 bp, Homo sapiens
  chr1:3217156-3217328
  hypo
ctggagcctcggaaccgcggtgcaactggggtgcgtttgtgccagggaaaatggattctgccggtgtctgactctaccaagatccacgcatcattgttagcatttcctttcatttctctttgttattatttgtcttttccaccttgtaccatccccccgaaccccatttatg

SEQ ID NO: 38788 - DNA, 30 bp, Homo sapiens
  chr1:3294711-3294741
  hypo
aggtgcacatggctgcgaccttggacacca

SEQ ID NO: 38789 - DNA, 172 bp, Homo sapiens
  chr1:3321998-3322170
  hypo
agaaccaggccaaggcgggtgtccaggcagggcacgcgccaacggcatccgtctccccaggtgttcacggaccccagcaaccttcagcggcacatccgctcgcagcacgtgggcgctcgggcccacgcctgccccgactgcgggaagaccttcgccacgtcctccggcctca

SEQ ID NO: 38790 - DNA, 186 bp, Homo sapiens
  chr1:3325403-3325589
  hypo
gaggatgtgagagcacgagggtgggcacgtgagctggtgcgtgtgtgtgtgagagcgcatgagggtgggcgtgtgagccagtgcttgtgttggcacgcatgagagtgaggggcgtgtgagccagtgcatgtgttggcacgtgtgagagcatgtgagggttggcgtgtgagccggggcatgtcagtg

SEQ ID NO: 38791 - DNA, 30 bp, Homo sapiens
  chr1:3327976-3328006
  hypo
ttctccaacctgtgccggcacaagcggatg

SEQ ID NO: 38792 - DNA, 146 bp, Homo sapiens
  chr1:3342175-3342321
  hypo
tcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccaggtgggcc

SEQ ID NO: 38793 - DNA, 30 bp, Homo sapiens
  chr1:3350102-3350132
  hypo
cccgccctgcccacgcgctcacctgcctgt

SEQ ID NO: 38794 - DNA, 33 bp, Homo sapiens
  chr1:3372809-3372842
  hypo
tgaagcagtgagaagcggcgtgccagggtcccc

SEQ ID NO: 38795 - DNA, 36 bp, Homo sapiens
  chr1:3408534-3408570
  hypo
atgcatgcactattgcgcagacgcactggctacatt

SEQ ID NO: 38796 - DNA, 255 bp, Homo sapiens
  chr1:3411032-3411287
  hypo
caggcggctccgtagcgcccagggggacaggctggggacagggcagggtgggcagtccttcggcaccagccttgcccagccctatggcagcccagggcacctccctgaggggatgctggggtcccgctggccccgcacactcacccagctcgcagtgccgccccgtccagcccaggccacaggagcagctgccgttgctggcgtggcacaggcccccatttctgcaggagcaggtgtgctcgcagcccacgccaa

SEQ ID NO: 38797 - DNA, 30 bp, Homo sapiens
  chr1:3417138-3417168
  hypo
atatgtgtgcgtgtgcgcactcaggagggt

SEQ ID NO: 38798 - DNA, 109 bp, Homo sapiens
  chr1:3463596-3463705
  hypo
ctgggggggggccagcggcagtagaagccccccacggtgtcccggcaccgacccgcacagcccccgttggcgttggcacactcacccacatctgcgaggggagaagcag

SEQ ID NO: 38799 - DNA, 69 bp, Homo sapiens
  chr1:3466914-3466983
  hypo
gaaaggagcccatctcgagaggtcacacagtgtaggatagggcgtaccagctggcgggtctggggtctc

SEQ ID NO: 38800 - DNA, 346 bp, Homo sapiens
  chr1:3467198-3467544
  hypo
gcctccggggtgctccgtgccggatctggccccatgccaggggcctaactcagcagcagtgactgcaatgtcacaagtgcccagcagccacccaaccggggcagggctccgaagacccagcccttgcagccgatccagcaagcacaggctgcagagtgagaacccgaggggagcaagagggggcccacacccccaccgcccgtgcactcaccctgggggagccagtgtcccccgtgtgctagtccattggcaggagaccctaacgggtgtgacagtggggctctcagatcagccgccaggtgtggacagggccaggatccgaggctccagccggccagggctgggc

SEQ ID NO: 38801 - DNA, 30 bp, Homo sapiens
  chr1:3470143-3470173
  hypo
caggagcaggatttacgaggccctgcctgc

SEQ ID NO: 38802 - DNA, 30 bp, Homo sapiens
  chr1:3601838-3601868
  hypo
ccctgagctccatatcggggtctggtccga

SEQ ID NO: 38803 - DNA, 94 bp, Homo sapiens
  chr1:3607472-3607566
  hypo
ctgtacgtcggtgaccccgcacggcacctcgccacggtaggtgtgacgcgccattcataggatctcttcggggactttgcgggggattttgctg

SEQ ID NO: 38804 - DNA, 57 bp, Homo sapiens
  chr1:3644717-3644774
  hypo
ccccgcccttggtgccggtgtgaagaagcggcggcatggagacgaggacacgtacta

SEQ ID NO: 38805 - DNA, 15 bp, Homo sapiens
  chr1:3659628-3659643
  hypo
tctctttagggaagc

SEQ ID NO: 38806 - DNA, 30 bp, Homo sapiens
  chr1:3661766-3661796
  hypo
tcaccccattcactccgttcctgccagcag

SEQ ID NO: 38807 - DNA, 30 bp, Homo sapiens
  chr1:3678034-3678064
  hypo
cggttgttttcaaagcgtccaaagctgcta

SEQ ID NO: 38808 - DNA, 68 bp, Homo sapiens
  chr1:3680032-3680100
  hypo
caacaggtagggcctcggcggggggcactgggctttggccactcagtggttcccggcccaggagctgg

SEQ ID NO: 38809 - DNA, 30 bp, Homo sapiens
  chr1:3680304-3680334
  hypo
caagaaacccagctgcgaaagatcaatacg

SEQ ID NO: 38810 - DNA, 149 bp, Homo sapiens
  chr1:3683695-3683844
  hypo
cctggccgccggccatcttttaggaaaaagtggatgggtgccacacatactcaggttgggcgaaatgaccccacctcttttttctccccggctgtccccagcaagtgtcggaactggagagaaagctcaccaagcgggactgtgtcatc

SEQ ID NO: 38811 - DNA, 85 bp, Homo sapiens
  chr1:3684064-3684149
  hypo
caggcctctgcccaccgcccaccgaggtagaaccggggtctgtgtacgctggggctcgggctggttctgccgtgtacaccagcat

SEQ ID NO: 38812 - DNA, 30 bp, Homo sapiens
  chr1:3786550-3786580
  hypo
gagggctgcagggcccgccccagggcttgt

SEQ ID NO: 38813 - DNA, 193 bp, Homo sapiens
  chr1:4082814-4083007
  hypo
gtttttggccccaaacgtcagtggcgctgagcagagcaaccctgatttagcgactccttgttggtcctggctcccagtgtgttggggacgtgatgcgggtgactctgctgtgggctcacaggctctgctggttccatggacagaaataaagtggaacttcatgctgctggaactcgggcggttgtgctgcgtt

SEQ ID NO: 38814 - DNA, 151 bp, Homo sapiens; identical to SEQ ID NO: 14198
  chr1:4111083-4111234
  hypo

SEQ ID NO: 38815 - DNA, 175 bp, Homo sapiens
  chr1:4212772-4212947
  hypo
gtgtttcagaatggacgcagaaccagagacagaaaatctctcctctgagctgcttggtgtcattcccccaggatgccaggaaagcctgagcccagtgctccagtgacaggccccctccccaatccaggagcgatagcagacacgaggggtgatggggatgcgacagcccgtggca

SEQ ID NO: 38816 - DNA, 30 bp, Homo sapiens
  chr1:4279385-4279415
  hypo
ggaggcagggtggatcgtgccttcctgtgt

SEQ ID NO: 38817 - DNA, 152 bp, Homo sapiens
  chr1:4402113-4402265
  hypo
actgctgtgtgtccccgcggattcaggcggctctgatcccacctgataggtagacaagaacgcacttggcaactagtagccactcacctggtacccgggccatgtggacctgccctagtgtggcctcgcttactgcccgccagggactctca

SEQ ID NO: 38818 - DNA, 30 bp, Homo sapiens
  chr1:4426176-4426206
  hypo
ccagatgccacacatcggcctgcaccttga

SEQ ID NO: 38819 - DNA, 51 bp, Homo sapiens
  chr1:4486515-4486566
  hypo
gtttgcggaatgaaacgactttgccaaagccatggccgcagacatacgatg

SEQ ID NO: 38820 - DNA, 41 bp, Homo sapiens
  chr1:4542688-4542729
  hypo
ccgaacgctgtcctgcgtggccaccacgtgctcctccctgc

SEQ ID NO: 38821 - DNA, 68 bp, Homo sapiens
  chr1:4652230-4652298
  hypo
cttgagtaaatcctccgaaaacggggagcagtagaggtggggccaacgcgtgacgatgggcctgaaat

SEQ ID NO: 38822 - DNA, 30 bp, Homo sapiens
  chr1:4659583-4659613
  hypo
tagaaagggctgcctcgggcagggggctgc

SEQ ID NO: 38823 - DNA, 124 bp, Homo sapiens
  chr1:4677050-4677174
  hypo
tcacagtggacaggccgaccgcccttgaactcgtgacgggccccgctgaggctagaggtccccccctcacagtggacatgccgaccacccttgaacttgcgacaggccccgctgaggctagagg

SEQ ID NO: 38824 - DNA, 23 bp, Homo sapiens
  chr1:4711648-4711671
  hypo
taataataagctgggcgcggtgg

SEQ ID NO: 38825 - DNA, 235 bp, Homo sapiens
  chr1:4726593-4726828
  hypo
atcacgggaggggtgcggagaggggcccgtgaatcacgggaggggtgcggagaggggcccgtgaatcacgggaggggtgcggagaggtgcctgtgaatcatgggaggggtgcggagagcgggcctgtgattcaccagagggttgcagagagaggcccaagaatcgcgggaggggtgcggagaggggcctgtgaatcacgggaggggtgcggagaggggcccgtgaatcacgggag

SEQ ID NO: 38826 - DNA, 148 bp, Homo sapiens
  chr1:4772507-4772655
  hypo
agtccaacacatttccgggcgtttacggccccaccacggtctccatcctacaaacacggaagacaactgtggccgccaccaccaccaccaccaccacggccacccccatgacgctgcagactaaggggttcaccgagtccttggatcc

SEQ ID NO: 38827 - DNA, 143 bp, Homo sapiens
  chr1:4782357-4782500
  hypo
ggtgcaagttcacagcgcagaggcgatccgtggtttgcacacttgtcctgtgcacggcaggacctgtggcgtccatacctgcctcattctgtgactgttatgaatctctgctctagtcctagacattccgaaagcagccgttc

SEQ ID NO: 38828 - DNA, 43 bp, Homo sapiens
  chr1:5893925-5893968
  hypo
aatgccttctgccaacgtcactcaggagcgttcccatgggagt

SEQ ID NO: 38829 - DNA, 38 bp, Homo sapiens
  chr1:5894998-5895036
  hypo
cagatgatgagtgcacgtgggtgcgatgctgctgcggg

SEQ ID NO: 38830 - DNA, 30 bp, Homo sapiens
  chr1:6046247-6046277
  hypo
gacacactggaatgccgtggattccttcca

SEQ ID NO: 38831 - DNA, 148 bp, Homo sapiens
  chr1:6071300-6071448
  hypo
caagtgtgcaggaggcgaggcaggcagctgtgcccagggccaggtgtgcgggagacaggcaggcggctgtgcccagggccaagtgtgcgggagacaggcaggcggctgtgcccagggccaggtgtgcgggaggcgaggcaggcagctg

SEQ ID NO: 38832 - DNA, 30 bp, Homo sapiens
  chr1:6131731-6131761
  hypo
cgtagggctctgctgcgtaggactcctgcc

SEQ ID NO: 38833 - DNA, 154 bp, Homo sapiens
  chr1:6166315-6166469
  hypo
aacacagggaagtctcgaggacggctagatatctgtcaaaaaaagaggagagccgggcttgcctgacgttggcagcagcaggcaggccgggcccggcgggcacccgtgtgcatgctgcccggagcggacgggcacctaccggtcacatagggcc

SEQ ID NO: 38834 - DNA, 171 bp, Homo sapiens
  chr1:6171763-6171934
  hypo
tcagagggctctccccgaggtccacggaggaacgggcaagtccctgcccagcccggcctggccaaggatacgtcacgatgcccgccagcagccagtagtcatggcgccggtgccagatgtcgtagattttcccagaggatacagcagcccgctcctcgttctgccacagcg

SEQ ID NO: 38835 - DNA, 54 bp, Homo sapiens
  chr1:6280243-6280297
  hypo
agttttgattttccccgtgtttgcatggcatgaagtcttcgtccttgtcacagt

SEQ ID NO: 38836 - DNA, 30 bp, Homo sapiens; identical to SEQ ID NO: 14204
  chr1:6360980-6361010
  hypo

SEQ ID NO: 38837 - DNA, 111 bp, Homo sapiens
  chr1:6391430-6391541
  hypo
cagaagcttcagtgacgcagcctcagccaagggacgcctggagccacccggcgctggagacgccaggagggatcctcgcctggggccaatggagggcgcagggccttgccc

SEQ ID NO: 38838 - DNA, 222 bp, Homo sapiens
  chr1:6446131-6446353
  hypo
tgagttccacctgggcggagttccacctgggcagagaggtcttggctcacaggcaccgggagagctggaaggctgcggggaagccgaggaaggccaacacaccgcacaacacggcaggtgcctggccctcctctgacagtggccctcaagctccaggagggccgaggaaaatgcagattcctgggcctacccctccctgaccttccccgcccctggagttag

SEQ ID NO: 38839 - DNA, 30 bp, Homo sapiens
  chr1:6635034-6635064
  hypo
ggtgtttttcgagtccgtggtgctgaccaa

SEQ ID NO: 38840 - DNA, 30 bp, Homo sapiens
  chr1:6801549-6801579
  hypo
aatgaaggcattggccgagctgtgttcctg

SEQ ID NO: 38841 - DNA, 195 bp, Homo sapiens
  chr1:6984148-6984343
  hypo
gcctggctggccacacggcatgactttgttcatgtcatgaatatttattgaacacctgccacatgccaggcactgttcccgggactgggtgtgaatagtgcacaagagggaagcctccctgctctcttggcgcttaccttctagctggggagactggaaacataaagatggtgcaaaggccgagtggagaaaaac

SEQ ID NO: 38842 - DNA, 30 bp, Homo sapiens
  chr1:7067759-7067789
  hypo
gtggggctcccggggcgtcgcttctgcctc

SEQ ID NO: 38843 - DNA, 30 bp, Homo sapiens
  chr1:7162881-7162911
  hypo
tccctgggttatgagcgagcccttttattc

SEQ ID NO: 38844 - DNA, 30 bp, Homo sapiens
  chr1:7729014-7729044
  hypo
gctccacctgtccgccggcactcttctcag

SEQ ID NO: 38845 - DNA, 39 bp, Homo sapiens
  chr1:10103760-10103799
  hypo
caggcgtgatccaacgcgctgggccgggatgcttcttat

SEQ ID NO: 38846 - DNA, 30 bp, Homo sapiens
  chr1:10166597-10166627
  hypo
agtgccacgagcagacgcccctcctccctg

SEQ ID NO: 38847 - DNA, 18 bp, Homo sapiens
  chr1:10959337-10959355
  hypo
taccctgtagggggccgg

SEQ ID NO: 38848 - DNA, 101 bp, Homo sapiens
  chr1:11036267-11036368
  hypo
gctccatgggaacaccgtgggctgaacacaggcaagccagacggccctgcgggagaggagggaagggggtggggacatgcaccgcccagctgctgcctcat

SEQ ID NO: 38849 - DNA, 80 bp, Homo sapiens
  chr1:11073881-11073961
  hypo
cccagtttccaggggcgtgtgggcttcgctacaggaatccagtgtctcagtgtatgagaggtgtccggctggtagaagga

SEQ ID NO: 38850 - DNA, 38 bp, Homo sapiens
  chr1:11131698-11131736
  hypo
cagagtaaaaggcagcgtcatcccgtgggcctctgctg

SEQ ID NO: 38851 - DNA, 30 bp, Homo sapiens
  chr1:11139771-11139801
  hypo
agcaggggcatctctcgggcctgctggatt

SEQ ID NO: 38852 - DNA, 30 bp, Homo sapiens
  chr1:11417987-11418017
  hypo
ctgcggaaagcagggcgcatgcaggcggag

SEQ ID NO: 38853 - DNA, 75 bp, Homo sapiens
  chr1:11596484-11596559
  hypo
cttcttctgcatcatcgccccatttgccaagttcggcaagattgtggcactcaacacgggcgtgtccatcctcta

SEQ ID NO: 38854 - DNA, 76 bp, Homo sapiens
  chr1:11792825-11792901
  hypo
agcccctccttctcccgtgaggcagtcacagaacaagaattcctcctttggcaggggatgaggtgactcaagtctg

SEQ ID NO: 38855 - DNA, 83 bp, Homo sapiens
  chr1:11854720-11854803
  hypo
cttcttctgccctcccgctcccaagaacaaagatgtatttgcaaggaaggtctgcaggccctcaccagcggccgttagggaac

SEQ ID NO: 38856 - DNA, 85 bp, Homo sapiens
  chr1:11936694-11936779
  hypo
gatgtgaagtagcttcgggcagaactccaaaccttagagagatcatttgaaaataccatttgggctgggcgcagtggctcatgcc

SEQ ID NO: 38857 - DNA, 76 bp, Homo sapiens
  chr1:12078805-12078881
  hypo
gtccttatcttctggcgcaaagcgggcactcgctaaaaacctgaatgaaagtataaagcaggccgggcgcagtggc

SEQ ID NO: 38858 - DNA, 543 bp, Homo sapiens
  chr1:12251415-12251958
  hypo
cgaggagcaggactgcggggaggagcgaaactgctgggaagagcgggactgcggggaagagcgggacttcggggaggagcggcactgcggggaggagcaggactgcagggaggagcgggactgtggggaggagcgggacttcggggaggagcgggactgcgggggacgagcgcgactgcgggggacgagcaggactgcggagagtagcgggactgcggagagtagcgggactgcggagagtagcaggactgccggtcctgcccctggactctggccggtgttgtgtgtgccccatgctgaggcggtccgccagcctcctggagatccgctgtctgagagtgctgggctgtctgggagggcagcgtgggtgtggcggaggcaggcgtgaccgtttgccgccctctcgctgctctagaccaggtggaaactcaagcctgcactcgggaacagaaccgcatctgcacctgcaggcccggctggtactgcgcgctgagcaagcaggaggggtgccggctgtgcgcgccgctgcgcaagtgccgcccg

SEQ ID NO: 38859 - DNA, 17 bp, Homo sapiens
  chr1:12805063-12805080
  hypo
aacgcatgcctcctctg

SEQ ID NO: 38860 - DNA, 194 bp, Homo sapiens
  chr1:14139406-14139600
  hypo
tacagagggggaaaccgaggctccgaggccgagcgacagggagtggcttaccctgggccatacagtcaatgagaatgaggattattagaggccacccccaggtctccagcggccatactgcatcctcctggggtgatgacttctccatatgagtccaccaaccgcaactgctgcagtcacgacactgtgctgat

SEQ ID NO: 38861 - DNA, 60 bp, Homo sapiens; identical to SEQ ID NO: 14211
  chr1:14730412-14730472
  hypo

SEQ ID NO: 38862 - DNA, 30 bp, Homo sapiens
  chr1:15651124-15651154
  hypo
ggtgagagaggaggacgcccaaggtagaaa

SEQ ID NO: 38863 - DNA, 30 bp, Homo sapiens
  chr1:15928989-15929019
  hypo
tgactataatttctccggtcatgtttcctt

SEQ ID NO: 38864 - DNA, 88 bp, Homo sapiens
  chr1:16059358-16059446
  hypo
ctcctgcctcagccccgggggtgagtgcctgctgctcttaaaacaaacccagaagagtcctcactgtccttgccgtctcttgctgcgc

SEQ ID NO: 38865 - DNA, 213 bp, Homo sapiens
  chr1:16475124-16475337
  hypo
gcgccacacaggcaccgatatcctggaaggccaggtagaagcctttgcgggtgagcggccccacggagcgctcctccacgttcagcttcacgtggcgtgcctcgaagtcgctgctgacggtgatctcatcgggcgcaatggtgtcaatcttggtgaacaggcgcttctggaagttggtgccgtagtccaggtccgactcggcatagtagaggt

SEQ ID NO: 38866 - DNA, 243 bp, Homo sapiens
  chr1:16534520-16534763
  hypo
ccgggtcatcagctccgatgccgagaagcgcctccgctcaggaccttcgaggctcactcgggtggacccagacaactccaccctgggctcctctgtgctcagggcctgctcttgcactacctggccaggctctaggaagacagcgtgggcctcggggcagccggggacctcttcacgctggtacacccgcatcttgcgccctagggttgggggcaaggagtgagagcacgggctggggtctcc

SEQ ID NO: 38867 - DNA, 67 bp, Homo sapiens
  chr1:16535138-16535205
  hypo
ggcagacttcttctccgagccgtggctggcccggcgctgtggctgtgtgtgtcggggactccagggt

SEQ ID NO: 38868 - DNA, 30 bp, Homo sapiens
  chr1:16736310-16736340
  hypo
agctgaggtgggcaccggggtcagggtcct

SEQ ID NO: 38869 - DNA, 30 bp, Homo sapiens
  chr1:17757538-17757568
  hypo
tatttgttggccaggcgcggtggctcacac

SEQ ID NO: 38870 - DNA, 20 bp, Homo sapiens
  chr1:17787462-17787482
  hypo
tggctcacgccggatcgcct

SEQ ID NO: 38871 - DNA, 16 bp, Homo sapiens
  chr1:18058862-18058878
  hypo
tcgtctaaaaaaaaaa

SEQ ID NO: 38872 - DNA, 63 bp, Homo sapiens
  chr1:18703385-18703448
  hypo
gctggagcgggttcccgccgagctcaatggctccatgtatcgctgcaccgcccagaacccact

SEQ ID NO: 38873 - DNA, 30 bp, Homo sapiens
  chr1:18818951-18818981
  hypo
tcatggagtaagaatcgcttcaaggttgtt

SEQ ID NO: 38874 - DNA, 68 bp, Homo sapiens
  chr1:19213653-19213721
  hypo
ggtgttggtccaaaccgcaccattttgtcagctccccgctattttgcagacctcgggccaagtgaaac

SEQ ID NO: 38875 - DNA, 103 bp, Homo sapiens
  chr1:19676719-19676822
  hypo
ccggcgctgaggccccgcagctcctgtgctgcagcccgagaggaaagggcctgggcttgtctaggcctccatgtctttgccttcacctcgcactaaataaaca

SEQ ID NO: 38876 - DNA, 35 bp, Homo sapiens
  chr1:20492304-20492339
  hypo
tgtgtgtgtgtgtgcgcgcgcgcatgtgtgtttag

SEQ ID NO: 38877 - DNA, 25 bp, Homo sapiens
  chr1:20534656-20534681
  hypo
agtgagaccccgcatccaaaagaaa

SEQ ID NO: 38878 - DNA, 317 bp, Homo sapiens
  chr1:21042770-21043087
  hypo
taagagcagcacctgcggggctctcacagggtgcatacagggcttctttcgtgcatgggcacaggaagcactgccatacacaggtgatggcccaatgtctgcctgcaatgcagggagctggacacgtacaggtgattctcgtggcgggctatggggcggggcacacagcgacaagagtccaggcagccagccggcagggacagggagtacaaagaagcgaaaacaggatggcacaggaagaacgaagcacagctttccaggcggcaaagacagggagaactgggggagctgggagtggggctcgtactttgccaggt

SEQ ID NO: 38879 - DNA, 30 bp, Homo sapiens
  chr1:21523157-21523187
  hypo
acccgtaggatgcagcgaatggcccctgcc

SEQ ID NO: 38880 - DNA, 30 bp, Homo sapiens
  chr1:21568339-21568369
  hypo
gagcgagggtctgatcgatctgaccggtca

SEQ ID NO: 38881 - DNA, 17 bp, Homo sapiens
  chr1:21573345-21573362
  hypo
ctcgccatgttgcccag

SEQ ID NO: 38882 - DNA, 30 bp, Homo sapiens
  chr1:21574092-21574122
  hypo
agatgcagcagctgccgctaccattcagca

SEQ ID NO: 38883 - DNA, 30 bp, Homo sapiens
  chr1:21611198-21611228
  hypo
gctgcctggggcccacgagacaagccggga

SEQ ID NO: 38884 - DNA, 120 bp, Homo sapiens
  chr1:22092109-22092229
  hypo
aaaaaaaaagggggggacagcccgaagctgaacaaggcatgagacgttccgaagctaaacaaggtgtgagacataactaacaatttttctagtggaagatgaggtcttaaaaagccaatt

SEQ ID NO: 38885 - DNA, 25 bp, Homo sapiens
  chr1:22378609-22378634
  hypo
gaactggtagtgggccgggcgcggt

SEQ ID NO: 38886 - DNA, 119 bp, Homo sapiens
  chr1:22447958-22448077
  hypo
ctgtcctgtcacagccgcacttctccagctccccactgctgcacgcccgcgtcactgcaaaggccacacctgccgaagagatggcgtacacgaaggccgcctcccgagtccctgtggga

SEQ ID NO: 38887 - DNA, 184 bp, Homo sapiens
  chr1:22777513-22777697
  hypo
agggtggcaaggggacgcttcaacagggaacgcatagtgtgtgagaaggaaaatgagcaaaagaaaagctaggactaaatcccaaagcccctaaatcccaaaattgggaggtgcgagaggcaggatcaggatgcctccaggatgccttcagcccactgcgccccaccagcgccaagcctgtccc

SEQ ID NO: 38888 - DNA, 30 bp, Homo sapiens
  chr1:22900903-22900933
  hypo
ccactgccagaactccgttcatcctgcaaa

SEQ ID NO: 38889 - DNA, 179 bp, Homo sapiens
  chr1:22927402-22927581
  hypo
gtggaggaggggtaccgcctgcccgcacccatgggctgcccccacgccctgcaccagctcatgctcgactgttggcacaaggaccgggcgcagcggcctcgcttctcccagattgtcagtgtcctcgatgcgctcatccgcagccctgagagtctcagggccaccgccacagtcagcag

SEQ ID NO: 38890 - DNA, 33 bp, Homo sapiens
  chr1:23694078-23694111
  hypo
agatagacttaatcacgccgacttcttgggagt

SEQ ID NO: 38891 - DNA, 40 bp, Homo sapiens
  chr1:23704242-23704282
  hypo
tcacccaaggttggccggacgcagtggcttacgcctgtaa

SEQ ID NO: 38892 - DNA, 30 bp, Homo sapiens
  chr1:23833122-23833152
  hypo
agcaggctggccaggcgtgtggccaccatg

SEQ ID NO: 38893 - DNA, 30 bp, Homo sapiens
  chr1:23859450-23859480
  hypo
gtgagtcaccgctcccggtcacatctctga

SEQ ID NO: 38894 - DNA, 35 bp, Homo sapiens
  chr1:24017587-24017622
  hypo
accaccactcctttccgtttgtataaattctattt

SEQ ID NO: 38895 - DNA, 127 bp, Homo sapiens
  chr1:24119136-24119263
  hypo
atgtatgcaggcccccgccgtggagccgtgtggtgtatgtgtggtaacaccatgtctgtgcccctgctcaccgatgctgccaccgtgtctggagctgagcgggaaacggccgcggtaagggtcccct

SEQ ID NO: 38896 - DNA, 30 bp, Homo sapiens
  chr1:24435099-24435129
  hypo
acctcccaagctgtgcggcagagtcatggt

SEQ ID NO: 38897 - DNA, 180 bp, Homo sapiens
  chr1:24740813-24740993
  hypo
gcgtgagccaccacgcccggccccaagccctgtttctaacagaagaaaaaaaaaaaaattgacatgggcgactatacaagggcagccacttagtattccaggagcccctcttcacacgcttcagggcagggcggtctcagcgaccttgtcactcccctgcttaaagtcctccaatggctc

SEQ ID NO: 38898 - DNA, 46 bp, Homo sapiens
  chr1:25220516-25220562
  hypo
tttcctaatttcaggcgtcagtgatttaggacggagttgttttcat

SEQ ID NO: 38899 - DNA, 30 bp, Homo sapiens
  chr1:26337225-26337255
  hypo
cggggatggtgtcagcgaggtaatggtatg

SEQ ID NO: 38900 - DNA, 43 bp, Homo sapiens
  chr1:26969603-26969646
  hypo
ttcttcactgctagccgtttgttcatctaccaaacatttgcca

SEQ ID NO: 38901 - DNA, 139 bp, Homo sapiens
  chr1:27190175-27190314
  hypo
gcaagaaggagatgccgcccaccaaccccatccgcctgggcctggccctgaacttttccgtcttccactacgagatcgccaacagccccgaggaggccatctctctggccaagaccactttcgacgaggccatggctga

SEQ ID NO: 38902 - DNA, 30 bp, Homo sapiens
  chr1:27628242-27628272
  hypo
gctcagtcaggctcccgctaggcattcaca

SEQ ID NO: 38903 - DNA, 76 bp, Homo sapiens
  chr1:27844518-27844594
  hypo
ggagagcctggctgtcggggagcagatctgagcacgctcctcaccagccctagctcaggctcggacctctctgact

SEQ ID NO: 38904 - DNA, 21 bp, Homo sapiens
  chr1:27868425-27868446
  hypo
ccaccgcgcctggcaaggagg

SEQ ID NO: 38905 - DNA, 217 bp, Homo sapiens
  chr1:27876116-27876333
  hypo
gtgaagaggttttggcgctcctggctgagctcggtctggcctgagggtgcacccgtgctgtagtagctgccacggcctgaggctccactctccagcccagtggaggcaaaggcccgggcctcggtcccctgaaacccacagtttcggccagcttgtccgcctgggtgcccatggtgaggggcccagccaccacccttatccccggcccactcagcac

SEQ ID NO: 38906 - DNA, 72 bp, Homo sapiens
  chr1:28293332-28293404
  hypo
tttctcctggttcaacgtggctgagggccgcacccgaggccgggccatcatccacttcgccttcctcctgag

SEQ ID NO: 38907 - DNA, 82 bp, Homo sapiens
  chr1:28853681-28853763
  hypo
atggcactcacatgccgggcaactgatgctcagagtaaccttcccacagcagccgcgatcttcagtgcatgtgtgtttttgt

SEQ ID NO: 38908 - DNA, 41 bp, Homo sapiens
  chr1:28865194-28865235
  hypo
ttcacctgcagccaacggcctggaatcgcaaagagacacca

SEQ ID NO: 38909 - DNA, 23 bp, Homo sapiens
  chr1:28926140-28926163
  hypo
atggcacgcgcctgtggtgccac

SEQ ID NO: 38910 - DNA, 29 bp, Homo sapiens
  chr1:29047659-29047688
  hypo
tttttttttgtgaggcggagtctgactcc

SEQ ID NO: 38911 - DNA, 30 bp, Homo sapiens; identical to SEQ ID NO: 14220
  chr1:29074253-29074283
  hypo

SEQ ID NO: 38912 - DNA, 26 bp, Homo sapiens
  chr1:29462593-29462619
  hypo
gggcgcggtggctgacgcctgtaatc

SEQ ID NO: 38913 - DNA, 17 bp, Homo sapiens
  chr1:29463615-29463632
  hypo
ttgaatgttcagggccg

SEQ ID NO: 38914 - DNA, 40 bp, Homo sapiens
  chr1:29516596-29516636
  hypo
atagtcaaggccgggcgcggtggctcacgcctgtaatccc

SEQ ID NO: 38915 - DNA, 188 bp, Homo sapiens
  chr1:30351554-30351742
  hypo
taaatagaggtgtgccgagagtaacgcggacggagatcacatgcaggtggctctcgaggagtccataaatctacactgatgaattacctgggcaggtggctctgccaccagccttccagctcagtacaggagcggcgtaattacctgtctggcagtggttgtctggagagagccggtccatttttctc

SEQ ID NO: 38916 - DNA, 30 bp, Homo sapiens
  chr1:30723094-30723124
  hypo
aatagcaggagccaccgctcattgactgga

SEQ ID NO: 38917 - DNA, 174 bp, Homo sapiens
  chr1:31208078-31208252
  hypo
tgtagcaccgccacacgcacttgaacatgtagacctggaaaaaggcccaggtcaggctgtgctttgctgagcgtccttctcacgctccagcaggcctaggacatatgccaggcaggagccaccactctctccagaagccagcatccagctgctcctgctcggacctctcattct

SEQ ID NO: 38918 - DNA, 64 bp, Homo sapiens
  chr1:32705509-32705573
  hypo
tggtctctgtgcctccgccagtcacgcgggcttgtttcgcggcctgggccgagagcgtgtccat

SEQ ID NO: 38919 - DNA, 33 bp, Homo sapiens
  chr1:32741468-32741501
  hypo
ctcactgcgttctttcgtcgctttgtccatcca

SEQ ID NO: 38920 - DNA, 30 bp, Homo sapiens
  chr1:33220942-33220972
  hypo
tggtgggagaatctacgggtgtattcccag

SEQ ID NO: 38921 - DNA, 149 bp, Homo sapiens
  chr1:33441493-33441642
  hypo
ttttaaagaggtttttttttttgagcgggagggtttcaatagattctgccccgcaagcttcccagccacctttctcatacctacagctcatggtgtgtcgccctgccttaaaccccacactggctccccgtgcccgatgagagagcatt

SEQ ID NO: 38922 - DNA, 143 bp, Homo sapiens; identical to SEQ ID NO: 14223
  chr1:33473115-33473258
  hypo

SEQ ID NO: 38923 - DNA, 50 bp, Homo sapiens
  chr1:33631092-33631142
  hypo
cttgagcagctgcagcgcttcggtgtgttcccgctcgctgtcttgaaggg

SEQ ID NO: 38924 - DNA, 32 bp, Homo sapiens
  chr1:33798865-33798897
  hypo
cagttaatcaagctccgcgtcttctgcagact

SEQ ID NO: 38925 - DNA, 30 bp, Homo sapiens
  chr1:33981589-33981619
  hypo
ggtaatccttgctgccgctgtgcagatggg

SEQ ID NO: 38926 - DNA, 28 bp, Homo sapiens
  chr1:34130113-34130141
  hypo
attttaggccaggagcggtggctcatgc

SEQ ID NO: 38927 - DNA, 41 bp, Homo sapiens
  chr1:34180223-34180264
  hypo
tctgccccccaggcacgtgatgcgggcggtgccctccagac

SEQ ID NO: 38928 - DNA, 27 bp, Homo sapiens
  chr1:34979405-34979432
  hypo
aagaagagggctgggcgcagtggctca

SEQ ID NO: 38929 - DNA, 23 bp, Homo sapiens
  chr1:35660562-35660585
  hypo
aggcgggaccgggtgcggtggct

SEQ ID NO: 38930 - DNA, 136 bp, Homo sapiens
  chr1:35664720-35664856
  hypo
tgagccaccggcgctagctattcttaagatttatcaagttactttacctgtatgttttgcctcagggcatttgcacttgctctttactcagcctgcagtgttctccccactcgccccgccccggctctttgcacag

SEQ ID NO: 38931 - DNA, 66 bp, Homo sapiens
  chr1:36056253-36056319
  hypo
ccgagacttcggttacgtctgtgagacggagttcccagccaaggcagctgccgagtacctgtgccg

SEQ ID NO: 38932 - DNA, 120 bp, Homo sapiens
  chr1:36271442-36271562
  hypo
gcacccaagcctgggcgacagagcgagactccgggtcaaaaaaaataaaagaatatagggtatggtatcagtagacaagaatgtaggcactagattaaaagtcccagttccggccgggcg

SEQ ID NO: 38933 - DNA, 252 bp, Homo sapiens
  chr1:36563342-36563594
  hypo
tataggtggccggcacgttgttcttgtacagggccacccacacgttggtgcccttgacgtgcacatggtaagcaaagtagtagacgccgcccacagggcaggtgaagatgccagtggctgggttgtagccgctgtggccattgtagagagtccggtcaaatttcacgggcatgcccgaggcggggaagggcgaggtgagcaccgcagtgaaggccggtgtggcatgggcagacagctcgcccagcccaaact

SEQ ID NO: 38934 - DNA, 180 bp, Homo sapiens
  chr1:37148125-37148305
  hypo
gacctgtgatgtgcacgtagcatgcaacaagcttctatcgttttaagccacagttagtgggaatatttgttatcagagcaaaaccaagtctctcctaactaatataataatatcctttaaaatgaagcatccggaaaacaaagacaaacctctaatattgttttccgatgatatccaagg

SEQ ID NO: 38935 - DNA, 30 bp, Homo sapiens
  chr1:37227648-37227678
  hypo
tatattatccctgggcggtggaggcaggtg

SEQ ID NO: 38936 - DNA, 30 bp, Homo sapiens
  chr1:38207058-38207088
  hypo
gcaagaaagtggaaacggagtaggtggctc

SEQ ID NO: 38937 - DNA, 87 bp, Homo sapiens
  chr1:38398355-38398442
  hypo
atacaaggcaaccaagttcagagaggttaagtctgaggtcgcagagtgactagcagagtggaggattcaaaccgatgccagagggtt

SEQ ID NO: 38938 - DNA, 30 bp, Homo sapiens
  chr1:39075313-39075343
  hypo
tgctcaccgctcagccgcttgtatcctcaa

SEQ ID NO: 38939 - DNA, 28 bp, Homo sapiens
  chr1:39345389-39345417
  hypo
tctgttttttttgttcgtttgttttctg

SEQ ID NO: 38940 - DNA, 146 bp, Homo sapiens
  chr1:39416821-39416967
  hypo
tgctgtatatcataacgctgccttataaaatcacagcacatgtcagcgtcatgaagtctctaaccttctaagaagtccttcaacaaacaagtctgttcaatgttgcttcacctagcacttcccaaacttgtctgacttcttttctt

SEQ ID NO: 38941 - DNA, 24 bp, Homo sapiens
  chr1:40025751-40025775
  hypo
gtgcccagccgaggtgacaccaga

SEQ ID NO: 38942 - DNA, 36 bp, Homo sapiens
  chr1:40349626-40349662
  hypo
ccactgcgccagaccacctgccgtcttaaatggtag

SEQ ID NO: 38943 - DNA, 30 bp, Homo sapiens
  chr1:40409694-40409724
  hypo
accaggcaatataggcgtattcattctgtt

SEQ ID NO: 38944 - DNA, 24 bp, Homo sapiens
  chr1:40625371-40625395
  hypo
gtttgttttttgagacggagtctt

SEQ ID NO: 38945 - DNA, 138 bp, Homo sapiens
  chr1:40905029-40905167
  hypo
taccctttgtaacagcgcatgcctaactggcactggctatatcacgtgaacaatctcaattcagtcctgcaaggcaaggtttaaaccagttttccacttgagagatcaagtgccttaaattaccgtgttgtgtaactg

SEQ ID NO: 38946 - DNA, 30 bp, Homo sapiens
  chr1:41117178-41117208
  hypo
ccaccctgtttgtggcgctttattgcagct

SEQ ID NO: 38947 - DNA, 46 bp, Homo sapiens
  chr1:41288701-41288747
  hypo
ccatggagcccagctcggtcccacgggcaggcgggcatcaagcttg

SEQ ID NO: 38948 - DNA, 30 bp, Homo sapiens
  chr1:41486134-41486164
  hypo
caggcaggcaagcaccggcactgagaactg

SEQ ID NO: 38949 - DNA, 30 bp, Homo sapiens
  chr1:41967243-41967273
  hypo
atcaccctggaccctcgccaggatcaccat

SEQ ID NO: 38950 - DNA, 145 bp, Homo sapiens; identical to SEQ ID NO: 4938
  chr1:41991640-41991785
  hypo

SEQ ID NO: 38951 - DNA, 30 bp, Homo sapiens
  chr1:42802631-42802661
  hypo
aaaatgactttaaatcggagacctgaaaga

SEQ ID NO: 38952 - DNA, 30 bp, Homo sapiens
  chr1:43209127-43209157
  hypo
tgtggccacccccaacgattctgcctgccc

SEQ ID NO: 38953 - DNA, 92 bp, Homo sapiens
  chr1:43826882-43826974
  hypo
ggcctgtctgagtgccgtggatgcccattcccaggtaatcttttgcctgttcctgcctctcccacatgcattcttaccgggcaactacattc

SEQ ID NO: 38954 - DNA, 91 bp, Homo sapiens
  chr1:43834716-43834807
  hypo
aatttctacctccagcggcccctggaacagtagcacacaacgatctaacaactgcttgtatgattggatggtgtaagtgcggacagaatta

SEQ ID NO: 38955 - DNA, 57 bp, Homo sapiens
  chr1:43991727-43991784
  hypo
agagggtgcagtggacggggaatagagagcaaagcctggaggcgccggagcaccctg

SEQ ID NO: 38956 - DNA, 30 bp, Homo sapiens
  chr1:44000506-44000536
  hypo
tctgtttactagcagcgtgactttaagcaa

SEQ ID NO: 38957 - DNA, 30 bp, Homo sapiens
  chr1:44016696-44016726
  hypo
gtttggagagtgattcggcaggtctttgga

SEQ ID NO: 38958 - DNA, 36 bp, Homo sapiens
  chr1:44043751-44043787
  hypo
tggctcctgtctgtccgtctgcggccagagcagccc

SEQ ID NO: 38959 - DNA, 34 bp, Homo sapiens
  chr1:44068855-44068889
  hypo
gctgtctgccccaggcgtgcggctcctgggatgg

SEQ ID NO: 38960 - DNA, 43 bp, Homo sapiens; identical to SEQ ID NO: 14234
  chr1:44351190-44351233
  hypo

SEQ ID NO: 38961 - DNA, 45 bp, Homo sapiens
  chr1:44463208-44463253
  hypo
agctgtgctcatatccgggagtcctggaggcggctggagccatta

SEQ ID NO: 38962 - DNA, 126 bp, Homo sapiens
  chr1:44463851-44463977
  hypo
agaagcaggcagggccgggggccggagcgcggtgagtgggaaggctctgcggaagggagaagtctgtctttgccacagtcctgaactggccaagcacagtagagctgctgccgcctttggaatcag

SEQ ID NO: 38963 - DNA, 150 bp, Homo sapiens
  chr1:44497521-44497671
  hypo
gcccctggccttctgcgcctgcgtttcccctagagagaagtcagagcaaattccattccctttggagcagagccgctagagactgtgggcattgctgggtaaggcctaggtcctactccttggaactggagggctcggggtagccctttc

SEQ ID NO: 38964 - DNA, 52 bp, Homo sapiens
  chr1:44584408-44584460
  hypo
gagggcggcgcagggcgggacgggtggggcctgaccccgccccttggcgcag

SEQ ID NO: 38965 - DNA, 54 bp, Homo sapiens
  chr1:44718072-44718126
  hypo
ctgcgacgggcctgccgcatagccctgctgtaggtgcggcgggtggccccctgt

SEQ ID NO: 38966 - DNA, 341 bp, Homo sapiens
  chr1:44726927-44727268
  hypo
cgtggcacgccccagcgggcagggcgcacagcgcggaggaaggcgcgagtcagtctggagtgctccccatttatcaagctcacgcaggccgccagccgagcgagtctttctatcattacacctctcaaaatccgattcataccactaatcctgccttcattctcccagattaataacatctctttcaaccttcacagtgtgataaatagacaaagagagaacaaaaggagagacagaagagagagaaagagctggagcaagtccccataatagagagagctgagaaagaggagagggaaaaaaggagagcgaacgagagcaggcagcggccagagactgca

SEQ ID NO: 38967 - DNA, 30 bp, Homo sapiens
  chr1:44794138-44794168
  hypo
tccaggtgactctgacgctcgctgaagtct

SEQ ID NO: 38968 - DNA, 62 bp, Homo sapiens
  chr1:45103094-45103156
  hypo
gagcagcagggctgacgactgtcccatgagttggacacatgggtgtccgatggcagccacac

SEQ ID NO: 38969 - DNA, 30 bp, Homo sapiens
  chr1:45106646-45106676
  hypo
actgcccccagtaaacgggcatctccagtt

SEQ ID NO: 38970 - DNA, 42 bp, Homo sapiens
  chr1:45156636-45156678
  hypo
aaggttgttgaggggcggggcgcggtgactcacgcctgtaat

SEQ ID NO: 38971 - DNA, 100 bp, Homo sapiens
  chr1:45280516-45280616
  hypo
tgcccggcctcagctccttctttcattccagacctgcccccctggagatcgctccctgaatgcccctcagacaccacaggctcggcgagaaattgatctc

SEQ ID NO: 38972 - DNA, 73 bp, Homo sapiens
  chr1:45293244-45293317
  hypo
agtacctgagctgggcgctcaggaaggcatgctccttggtgccccgaggcaccacatccgtcagggccaggcc

SEQ ID NO: 38973 - DNA, 81 bp, Homo sapiens
  chr1:45308234-45308315
  hypo
caccgcgcccggccggcataggcccattttctgagagcaggatacatatgtacacacacctgtcgtcgggtggacacagag

SEQ ID NO: 38974 - DNA, 16 bp, Homo sapiens
  chr1:45466077-45466093
  hypo
acgctgtataaataat

SEQ ID NO: 38975 - DNA, 16 bp, Homo sapiens
  chr1:45645619-45645635
  hypo
aggagccaagatggcc

SEQ ID NO: 38976 - DNA, 38 bp, Homo sapiens; identical to SEQ ID NO: 14239
  chr1:46079131-46079169
  hypo

SEQ ID NO: 38977 - DNA, 95 bp, Homo sapiens
  chr1:46921772-46921867
  hypo
tattcatcaccagctcgtggcgccggcgccgacgctgatacaatattagtgttgccccccctttcggagcccgctccgcccggctccccgatggc

SEQ ID NO: 38978 - DNA, 26 bp, Homo sapiens
  chr1:47749558-47749584
  hypo
tagcttttttttttgcgggggggtgg

SEQ ID NO: 38979 - DNA, 30 bp, Homo sapiens
  chr1:50918985-50919015
  hypo
ccaagcagggccatgcgagctggtgtgtgc

SEQ ID NO: 38980 - DNA, 200 bp, Homo sapiens
  chr1:51099269-51099469
  hypo
tgagctctgtcactacggcaaccagcagggaataagtatctgtgggtctatgaatttcagaatcccataaaagccagggctaaaaaggcatgtgcagcctctcagagattgactgcattaatacattagcaaatactgtgaaacactggataaatgtcagcaattatggaaaaagcgtctaataacgatattcgttgcct

SEQ ID NO: 38981 - DNA, 20 bp, Homo sapiens
  chr1:51176289-51176309
  hypo
ttcgagacagagtctcgctc

SEQ ID NO: 38982 - DNA, 19 bp, Homo sapiens
  chr1:51727596-51727615
  hypo
gctcactgcaacctccgtc

SEQ ID NO: 38983 - DNA, 78 bp, Homo sapiens
  chr1:51761832-51761910
  hypo
tgtaggtggcctgtgcgagacagagcaacagccaggtgtgagcagccctcctccagccccagccgggctggaatctgc

SEQ ID NO: 38984 - DNA, 93 bp, Homo sapiens
  chr1:51763252-51763345
  hypo
ggagacaccaagtcccggtgactttacctcccgtctcactctaggatcctgctggccttgccctacggctctcattatcggactgccaccatc

SEQ ID NO: 38985 - DNA, 213 bp, Homo sapiens
  chr1:51795524-51795737
  hypo
tgggcaggagagccacgttgaaggtgacaacacccactttttactacccaggttcctgctgcacccaatgggcccggctggcccataccttagctgtttaagttcccctaatgtccctgaagatgatggggtggggggatctgacaacagacagaactgagttcaaatcccacccgcaactcttacctcctgggtgaccgatgacaagtcact

SEQ ID NO: 38986 - DNA, 128 bp, Homo sapiens
  chr1:52455042-52455170
  hypo
gactttttctgtccacgattctcttattttctgtgatccccggtgcccgtgtaacaaggtccagtgcctgggtcccctccttggactcctgagtggccgagacaccgctagtgcgtggacaccactcc

SEQ ID NO: 38987 - DNA, 22 bp, Homo sapiens
  chr1:52832687-52832709
  hypo
ttgagctcaggagtccgagacc

SEQ ID NO: 38988 - DNA, 23 bp, Homo sapiens
  chr1:53129138-53129161
  hypo
atcagaacatgtggccgggcgcg

SEQ ID NO: 38989 - DNA, 41 bp, Homo sapiens
  chr1:53703048-53703089
  hypo
aaaaccttccaagcccggccgggcgcggtggctcacacctg

SEQ ID NO: 38990 - DNA, 27 bp, Homo sapiens
  chr1:53705674-53705701
  hypo
tcagtcttaacacggagtccttttctc

SEQ ID NO: 38991 - DNA, 75 bp, Homo sapiens
  chr1:53990562-53990637
  hypo
gtaacatggggggcacgggtggggtgagtgaggcccatccctacgggacacgcgcctccgcgtgacctgctgtgg

SEQ ID NO: 38992 - DNA, 407 bp, Homo sapiens; identical to SEQ ID NO: 14242
  chr1:54586590-54586997
  hypo

SEQ ID NO: 38993 - DNA, 30 bp, Homo sapiens
  chr1:54722666-54722696
  hypo
gtaagctaccagccacgttaaacctgcccc

SEQ ID NO: 38994 - DNA, 30 bp, Homo sapiens
  chr1:54766254-54766284
  hypo
aaggattatttctgccggagggtggggctt

SEQ ID NO: 38995 - DNA, 33 bp, Homo sapiens
  chr1:54839900-54839933
  hypo
gtggccggcagcccacggcgtgttggggatcca

SEQ ID NO: 38996 - DNA, 17 bp, Homo sapiens
  chr1:54880702-54880719
  hypo
cccggccacgtagagca

SEQ ID NO: 38997 - DNA, 23 bp, Homo sapiens
  chr1:55231044-55231067
  hypo
tttgtttttttgagacggagttt

SEQ ID NO: 38998 - DNA, 70 bp, Homo sapiens
  chr1:55529166-55529236
  hypo
tacaggcagcaccagcgaaggggccgtgacagccgttgccatctgctgccggagccggcacctggcgcag

SEQ ID NO: 38999 - DNA, 30 bp, Homo sapiens
  chr1:62189867-62189897
  hypo
gagggggatgcggatcgcttgagaccagga

SEQ ID NO: 39000 - DNA, 30 bp, Homo sapiens
  chr1:62657668-62657698
  hypo
attctttttctttttcgagacggagtctcg

SEQ ID NO: 39001 - DNA, 18 bp, Homo sapiens
  chr1:70599151-70599169
  hypo
cctcggcctcccaaagtg

SEQ ID NO: 39002 - DNA, 34 bp, Homo sapiens
  chr1:70672893-70672927
  hypo
accgtagcagcttttgcaacgttattaatgaggt

SEQ ID NO: 39003 - DNA, 79 bp, Homo sapiens
  chr1:72383504-72383583
  hypo
cggccaaattgaacagcaaaccactcttcaaaaagcacaaattgagttaggttgcctttaagaacgacctcactgctgt

SEQ ID NO: 39004 - DNA, 30 bp, Homo sapiens
  chr1:76259201-76259231
  hypo
ggccgtggggagcaccgggacctgcacttg

SEQ ID NO: 39005 - DNA, 24 bp, Homo sapiens
  chr1:76354586-76354610
  hypo
tttttttttttgagacggagtctc

SEQ ID NO: 39006 - DNA, 30 bp, Homo sapiens; identical to SEQ ID NO: 14245
  chr1:78244815-78244845
  hypo

SEQ ID NO: 39007 - DNA, 140 bp, Homo sapiens
  chr1:86860809-86860949
  hypo
gccaccgcgcccggcccggtttgtttctttaaccttaactcagttgcacttaaaactccaagaacctcattcattcaaaaacacttgaaaccgtactatgcgttgcgtgatgaggaaactgtcttcgaaatagattttat

SEQ ID NO: 39008 - DNA, 30 bp, Homo sapiens
  chr1:90292117-90292147
  hypo
aattttatagttgagcgtatccaggcacag

SEQ ID NO: 39009 - DNA, 33 bp, Homo sapiens
  chr1:92494939-92494972
  hypo
cggcttccagcccttcgacgaactctcaggtgt

SEQ ID NO: 39010 - DNA, 156 bp, Homo sapiens
  chr1:93222691-93222847
  hypo
aaacaaacactttgacggtgcgtgtgtcaaatttagttacaacaaatccgtgtatgacaaaaatgctcacgtcctggctaatagttcaaatatttcaaaaatattcaatacaacagaaaatttggacagactccaatttgccgttttgagatttga

SEQ ID NO: 39011 - DNA, 30 bp, Homo sapiens
  chr1:94048058-94048088
  hypo
ctccatctgagctgccgcaggttcccaagg

SEQ ID NO: 39012 - DNA, 30 bp, Homo sapiens
  chr1:94048424-94048454
  hypo
ggcaggctcgcttcccgtcctgaacacagg

SEQ ID NO: 39013 - DNA, 25 bp, Homo sapiens
  chr1:94343568-94343593
  hypo
aaatcaaaatttggccgggcgcggt

SEQ ID NO: 39014 - DNA, 30 bp, Homo sapiens
  chr1:97185220-97185250
  hypo
tcaatcaatatcgatcgagcgaatgtgggg

SEQ ID NO: 39015 - DNA, 98 bp, Homo sapiens; identical to SEQ ID NO: 14249
  chr1:99611990-99612088
  hypo

SEQ ID NO: 39016 - DNA, 38 bp, Homo sapiens; identical to SEQ ID NO: 14250
  chr1:99612148-99612186
  hypo

SEQ ID NO: 39017 - DNA, 197 bp, Homo sapiens
  chr1:100436557-100436754
  hypo
tctgctaaatatgctcgtctttcctcttcttacttgcactatagcaataacttccaaactggacttgtcctcagcctggcacccttccagtcacttgcctccatattacttttaaagccaaagatcttatgactttctttttttggttattccttcctcagaaatacgcagtgactctcgatcggcttcagaataaa

SEQ ID NO: 39018 - DNA, 86 bp, Homo sapiens; identical to SEQ ID NO: 4943
  chr1:100437183-100437269
  hypo

SEQ ID NO: 39019 - DNA, 34 bp, Homo sapiens
  chr1:100814764-100814798
  hypo
aaggcgttgttttcaaactcgacactttttacac

SEQ ID NO: 39020 - DNA, 30 bp, Homo sapiens
  chr1:100928393-100928423
  hypo
catctgtgagaacaccgaaggggccatcgc

SEQ ID NO: 39021 - DNA, 30 bp, Homo sapiens
  chr1:109076927-109076957
  hypo
tagccaggatggtctcgatctcctcaccct

SEQ ID NO: 39022 - DNA, 30 bp, Homo sapiens
  chr1:109370476-109370506
  hypo
aatgttttgttctgccgaggttaatatcta

SEQ ID NO: 39023 - DNA, 140 bp, Homo sapiens
  chr1:109585374-109585514
  hypo
tattccacaaatatacgtgatgttcaaccgagcttaattaagcatccaggaagtataaccataaggaagaatacaattacacaaacctgtaagaacatcattctcggccaggcgcggtggctcacgcctgcaattccagc

SEQ ID NO: 39024 - DNA, 19 bp, Homo sapiens
  chr1:109585754-109585773
  hypo
actccgtctcacagaaaaa

SEQ ID NO: 39025 - DNA, 28 bp, Homo sapiens
  chr1:109593505-109593533
  hypo
tcaagggccaggcaccgcggctcacgcc

SEQ ID NO: 39026 - DNA, 36 bp, Homo sapiens
  chr1:109631646-109631682
  hypo
attacaggcgtgagccgcgcccggccagctgctgct

SEQ ID NO: 39027 - DNA, 103 bp, Homo sapiens
  chr1:109644233-109644336
  hypo
gtgagctacggcgcccggccggcttgacattttttgtatgctaccaacacttgtatccccagggctaacggcatggtacagcatctgccgctaagggttatac

SEQ ID NO: 39028 - DNA, 30 bp, Homo sapiens
  chr1:109701309-109701339
  hypo
gatgtatatactgaacgtgtttatgtgctc

SEQ ID NO: 39029 - DNA, 30 bp, Homo sapiens
  chr1:109941519-109941549
  hypo
acaacttctacaacacgtagcacaggtaaa

SEQ ID NO: 39030 - DNA, 30 bp, Homo sapiens
  chr1:110305575-110305605
  hypo
tggtgttagtctgtgcgggtcaagggtatg

SEQ ID NO: 39031 - DNA, 99 bp, Homo sapiens
  chr1:110726670-110726769
  hypo
acatctctgaaagcacgctgtttccgacgatcagtgaggcaattatacaagcctgttttttctgtttttgttggttttttttgacggagtctcgctctg

SEQ ID NO: 39032 - DNA, 309 bp, Homo sapiens
  chr1:110883605-110883914
  hypo
gccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttacgagccactggatagcctagatcgcaggcgggatggttggtccttggaccgggacagaggtgat

SEQ ID NO: 39033 - DNA, 60 bp, Homo sapiens
  chr1:110884160-110884220
  hypo
agccagggtgacaagcgagaccgtaaaaactctgcatcagctgaacgagataggaagcac

SEQ ID NO: 39034 - DNA, 31 bp, Homo sapiens
  chr1:111544898-111544929
  hypo
gttctgggtttacaggcgtgagccaccgtgt

SEQ ID NO: 39035 - DNA, 199 bp, Homo sapiens
  chr1:112084890-112085089
  hypo
caggatcagacctgccggttcgaacacacgcgacaagagcaaagaagttaaaagagaagtgtctgtgtggctccttccacgtgggtgaaggactgtgccagctgagaggtggtagagcaggaagctgcctgaggacctccatttatttggtgaaaaactgggctccgcccttaagagagcaagtcgagggccgtgtagg

SEQ ID NO: 39036 - DNA, 16 bp, Homo sapiens
  chr1:112192214-112192230
  hypo
acgaccagaatattag

SEQ ID NO: 39037 - DNA, 152 bp, Homo sapiens
  chr1:112784462-112784614
  hypo
cagagaaataatgggcgtgactgggaggcgcattatacctttggccacatagaaagggaaatgggttgtcactgaagagtttgaggcagagaaatgacatgacctgacatgcattttaaaaagctcacaatagacgtggcacggtggctcac

SEQ ID NO: 39038 - DNA, 86 bp, Homo sapiens
  chr1:113751201-113751287
  hypo
cacgcccggccaaccatagcagtttacatgtgggtttggtttgggactgagagtcaagatccactgaggggcgtggcctctcttcc

SEQ ID NO: 39039 - DNA, 80 bp, Homo sapiens
  chr1:115055238-115055318
  hypo
gcaattacctgggaccgtagatgcacgccaccatgacttagctgatcttttttttccctttgcctcgaagaggctggggt

SEQ ID NO: 39040 - DNA, 115 bp, Homo sapiens
  chr1:116213930-116214045
  hypo
gtgaaagtggaggggcgcgagcactcaggtgggtgaacagcctgcggcctcctttccctggctgcaaagccgccactcaactctgctccagcccaggtttcggggagccgggatc

SEQ ID NO: 39041 - DNA, 155 bp, Homo sapiens
  chr1:116214288-116214443
  hypo
cccaggcaggggaggcgcagtgcaggttggactgtgtaaggaaatggcagcatggcgaggtttgtgccgcggcctacaagcagggctgcatgctccccaggcagactgtggcagagccaagcccctcacttgtagggaagcgtgtctcctaggtg

SEQ ID NO: 39042 - DNA, 45 bp, Homo sapiens
  chr1:116214942-116214987
  hypo
accaaaagccaggtacgctttccagccttccgatattggttcaaa

SEQ ID NO: 39043 - DNA, 61 bp, Homo sapiens
  chr1:116574202-116574263
  hypo
gtaattatactaaggcgtgttctgttgctctttaactaaggttgctcgagcttctcttgat

SEQ ID NO: 39044 - DNA, 124 bp, Homo sapiens
  chr1:150602992-150603116
  hypo
aacatttggtaaatacggttaatactagttaacctatccagaattacagtttaacatttcctgggcgtctgtctgtatgtggatggtactgtgttagttggggggggtacgtgtatagtaaggc

SEQ ID NO: 39045 - DNA, 30 bp, Homo sapiens; identical to SEQ ID NO: 14264
  chr1:150850705-150850735
  hypo

SEQ ID NO: 39046 - DNA, 16 bp, Homo sapiens
  chr1:151169624-151169640
  hypo
acggcgcccggcctgc

SEQ ID NO: 39047 - DNA, 141 bp, Homo sapiens
  chr1:151170065-151170206
  hypo
tttaatggagttatttcatgggccatgagtttgagaggatctatctgaccgactcttaccccgaatgttttaccattcctctttatttattcattccacagataattatggagcccctactatgtacgaagtcactggagg

SEQ ID NO: 39048 - DNA, 102 bp, Homo sapiens; identical to SEQ ID NO: 1538
  chr1:151252684-151252786
  hypo

SEQ ID NO: 39049 - DNA, 84 bp, Homo sapiens
  chr1:151300852-151300936
  hypo
ttcttccaaacaaaacgaaaccatattaggccaaacaaataaacaaaaacacgccatgcaaatgggcctctggtgttgcttttg

SEQ ID NO: 39050 - DNA, 30 bp, Homo sapiens
  chr1:151345799-151345829
  hypo
gtgtgtgaatttccacgtgtgtgaatgtgc

SEQ ID NO: 39051 - DNA, 30 bp, Homo sapiens
  chr1:151481617-151481647
  hypo
cttatccttgtaattcgtgttcatggtgct

SEQ ID NO: 39052 - DNA, 32 bp, Homo sapiens
  chr1:151678615-151678647
  hypo
aagagctgggctcagcgcggggtgacagggag

SEQ ID NO: 39053 - DNA, 40 bp, Homo sapiens
  chr1:152276060-152276100
  hypo
tcctctccttgaccccgggtgtccacgaatggtgtcctga

SEQ ID NO: 39054 - DNA, 51 bp, Homo sapiens
  chr1:152286249-152286300
  hypo
gatgcagtctgtccacgagaggaagtctctgcgtgacgagtgcctgattgt

SEQ ID NO: 39055 - DNA, 16 bp, Homo sapiens
  chr1:152696808-152696824
  hypo
ggagtcttgctctgtc

SEQ ID NO: 39056 - DNA, 109 bp, Homo sapiens; identical to SEQ ID NO: 14268
  chr1:153539476-153539585
  hypo

SEQ ID NO: 39057 - DNA, 219 bp, Homo sapiens
  chr1:153540023-153540242
  hypo
agcctggcagtgaggcgctccagactcggcctgctgctgcgtgtcccttaaacacaccggcacatgcaactagtgtggccaagaccctcggcttgcgctgacccctctgttcagaacgtgcccacacatgcccatgccctctatcctgctgaaatccaacccccccttcaaaggccactgcagggagccttcccagggcccaaccggattcagtgtcta

SEQ ID NO: 39058 - DNA, 150 bp, Homo sapiens
  chr1:153608334-153608484
  hypo
tagattggcttctgccgtttttgagaaattcccgggtattttgtgggccttgaagtttgtttgtttgtttggggttatttgtttgttttaaagagatggggtctcaggccagagtgcagtggcatgatcacggctctttgcagcctccaa

SEQ ID NO: 39059 - DNA, 43 bp, Homo sapiens
  chr1:153645007-153645050
  hypo
caggccacaccactccgagctaattttatttttttttttgaga

SEQ ID NO: 39060 - DNA, 102 bp, Homo sapiens
  chr1:153937070-153937172
  hypo
acaaggctccagaaacgaagcccagtaattccttaagtaaaagaggaatgtgaagacttcttaaggggccgggcgcggtggttcacgcctgtaatccaagca

SEQ ID NO: 39061 - DNA, 22 bp, Homo sapiens
  chr1:154098531-154098553
  hypo
ccgcgcccggccaagaaatgtt

SEQ ID NO: 39062 - DNA, 22 bp, Homo sapiens
  chr1:154107501-154107523
  hypo
ccacgcccggcctctgtgtacc

SEQ ID NO: 39063 - DNA, 23 bp, Homo sapiens
  chr1:154156755-154156778
  hypo
gccggcctcggcctcccaaagtg

SEQ ID NO: 39064 - DNA, 30 bp, Homo sapiens
  chr1:154305492-154305522
  hypo
aaagtgaatagaggtcggtaccatggctca

SEQ ID NO: 39065 - DNA, 54 bp, Homo sapiens
  chr1:154499777-154499831
  hypo
ccaataaaatataatcgagaactcaaaaagaggctcattcgtacacagaaacta

SEQ ID NO: 39066 - DNA, 35 bp, Homo sapiens
  chr1:154516810-154516845
  hypo
tgcaggcagtggggccgttgcgttttgcaccccac

SEQ ID NO: 39067 - DNA, 46 bp, Homo sapiens
  chr1:154682497-154682543
  hypo
agatatcatcttattcgatcacctgagcctccgatggtaggaatta

SEQ ID NO: 39068 - DNA, 30 bp, Homo sapiens
  chr1:154808785-154808815
  hypo
accccacctgatactcgactggccttaatt

SEQ ID NO: 39069 - DNA, 30 bp, Homo sapiens
  chr1:154851806-154851836
  hypo
ggttgctatggacaccgcagtcgggctctc

SEQ ID NO: 39070 - DNA, 98 bp, Homo sapiens; identical to SEQ ID NO: 14271
  chr1:155160925-155161023
  hypo

SEQ ID NO: 39071 - DNA, 30 bp, Homo sapiens
  chr1:155311790-155311820
  hypo
acaggatagcggttccggtggatcttgtaa

SEQ ID NO: 39072 - DNA, 21 bp, Homo sapiens
  chr1:155563460-155563481
  hypo
aataaaattgccattcgggcc

SEQ ID NO: 39073 - DNA, 26 bp, Homo sapiens
  chr1:155578901-155578927
  hypo
actaccgcacccggcccttgccttgt

SEQ ID NO: 39074 - DNA, 59 bp, Homo sapiens
  chr1:155668700-155668759
  hypo
gtcctccatttcacacgcttgagcatgccttcactggattctttcgggcctcatgttgg

SEQ ID NO: 39075 - DNA, 34 bp, Homo sapiens
  chr1:155826302-155826336
  hypo
aggcgtgagccaccgcgcccgacctacagttagt

SEQ ID NO: 39076 - DNA, 17 bp, Homo sapiens
  chr1:155892702-155892719
  hypo
aaagacagtcctggccg

SEQ ID NO: 39077 - DNA, 31 bp, Homo sapiens
  chr1:155905287-155905318
  hypo
gtggtaggattacaggcgtgagccaccgcgc

SEQ ID NO: 39078 - DNA, 30 bp, Homo sapiens
  chr1:155911924-155911954
  hypo
tggtggccatggctgcggggccaggcaccc

SEQ ID NO: 39079 - DNA, 30 bp, Homo sapiens
  chr1:155912603-155912633
  hypo
ggacagagggacacccgggtgaagggcgca

SEQ ID NO: 39080 - DNA, 53 bp, Homo sapiens
  chr1:155954259-155954312
  hypo
aaagccagacaaaggcgcccagggcttcctcccccacccgcttcacctagatc

SEQ ID NO: 39081 - DNA, 42 bp, Homo sapiens
  chr1:156030121-156030163
  hypo
ccttcaggatggtctcgatctcctgaccttgtgatccgcccg

SEQ ID NO: 39082 - DNA, 105 bp, Homo sapiens
  chr1:156031479-156031584
  hypo
taggctcctctgccccgttcctaatagaaacccaaatccctggtgtcagccagtgcagcacaagagatggaggtcagacttcagaaaggacttccctcttttatt

SEQ ID NO: 39083 - DNA, 206 bp, Homo sapiens
  chr1:156253833-156254039
  hypo
tatcccagcctactccgagcaccctttgttgcacaaatccacttttctccctctgctttcctgagctgggagttcttacgcattccaggtgcctagaatgtgaacttacccctttgcccagctgcatcccaactttcagaaaggatgacatcctcctctgatgcttttttttgtcggcagattcagcagggcggggcctgcccctt

SEQ ID NO: 39084 - DNA, 102 bp, Homo sapiens
  chr1:156271344-156271446
  hypo
gcctttgttttagctttttttttttttcttttgcatacactcaaaccaatctgcacacacacacccattttgagcccatcaaagccccggacccagccacaa

SEQ ID NO: 39085 - DNA, 47 bp, Homo sapiens; identical to SEQ ID NO: 14276
  chr1:156433495-156433542
  hypo

SEQ ID NO: 39086 - DNA, 18 bp, Homo sapiens
  chr1:156441212-156441230
  hypo
gcccggccagaatcaact

SEQ ID NO: 39087 - DNA, 34 bp, Homo sapiens
  chr1:156690386-156690420
  hypo
cattacaggcgtgagccaccgtgccaggcagaat

SEQ ID NO: 39088 - DNA, 153 bp, Homo sapiens
  chr1:156838167-156838320
  hypo
tgcctggggtgacatcgcctgggctccaggtcattgaggagggtgggggaaggagcagccccgcagtagagttctggggccactcccagctctaacaccccttggccctcgggcgtcctgggtggccaggtgtgcccacgctgaaggtccagg

SEQ ID NO: 39089 - DNA, 154 bp, Homo sapiens
  chr1:156843312-156843466
  hypo
cctgccctttgatttcgggttctactcgctttgcccgtggacttgtcgggtgtgtgccaggctccctccagctgcgccctgacctcctgctgttgctctttctggcccacagtcccggccagtgtgcagctgcacacggcggtggagatgcacc

SEQ ID NO: 39090 - DNA, 247 bp, Homo sapiens
  chr1:156849725-156849972
  hypo
taggctgtgccttgacgggctgtcccaggcgcccctggaattgatgcagtgtccgcccgtggcaggtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggtcagccccggcccatggtcacc

SEQ ID NO: 39091 - DNA, 37 bp, Homo sapiens
  chr1:156866362-156866399
  hypo
gagtgggccctggggcgtagcccgctcactgctggtg

SEQ ID NO: 39092 - DNA, 30 bp, Homo sapiens
  chr1:157086435-157086465
  hypo
gtctctgtctctgggcgttgaggttgttcc

SEQ ID NO: 39093 - DNA, 146 bp, Homo sapiens
  chr1:157247317-157247463
  hypo
gcttacctgggtatgggcattgtctgggccagtggcctttatgaccgcatttgaaacgggagtcaggtggaggtggattattaggaggcttccatgtagagccgcggcccagtggcctgcagggcctctgacggcagaggcaagca

SEQ ID NO: 39094 - DNA, 162 bp, Homo sapiens
  chr1:157458773-157458935
  hypo
gacttggcaaccagccggacactgattccattcctgcttctaccgctaagctctgtcatccagcagatcctcaatggcctcatctggaaaatgggataatacttcctctgcagggttgctgggaggactaaatagatagaagaaagccccacgcggacgggc

SEQ ID NO: 39095 - DNA, 38 bp, Homo sapiens
  chr1:157490582-157490620
  hypo
ctctaaagtcagtggcgctcttgcgcccagcccgccaa

SEQ ID NO: 39096 - DNA, 191 bp, Homo sapiens
  chr1:157527405-157527596
  hypo
agttattttatgaagcgcttacacatttagaattgttacctcttcctgataatttgacacactcgccattattaaatatctctctttatctctgtttcttgcctgaaagccacactgggagagtctcatctacatttggacttgattcagttgattggatgctatacttaaaaacccgaatctgatgctgt

SEQ ID NO: 39097 - DNA, 87 bp, Homo sapiens
  chr1:157543012-157543099
  hypo
cagtgcagaaggcagcgcttcctcagtgaagtgctaaggggaagaatggcagaagactggaggcaatgggagcgatcaggtggaggc

SEQ ID NO: 39098 - DNA, 36 bp, Homo sapiens
  chr1:157791984-157792020
  hypo
aacttgaacataaggcgggcggatcacgaggtcagg

SEQ ID NO: 39099 - DNA, 321 bp, Homo sapiens
  chr1:157895211-157895532
  hypo
gatgctccaaggtgacgacaagaaacagggcgtgaggagggtaagaggccctatgggcactgtagtcttgtgatgggggaggtggtggcagcggcagcggtggcagagagctagaggagggtgagaaggtggacgcggggccatgtatcccgagctcttcaccagagcccagcacagctctgccggaagcacccctgcagggttagaccagcaggtgcgaggtgcgacgtgggaaagagtccagggccggcggggtgctatgaggcgaggacttcctgagccgaggaccgggtgggttgtgagttgcgaccagcctcgctg

SEQ ID NO: 39100 - DNA, 141 bp, Homo sapiens; identical to SEQ ID NO: 14282
  chr1:158169208-158169349
  hypo

SEQ ID NO: 39101 - DNA, 60 bp, Homo sapiens
  chr1:158237112-158237172
  hypo
cccggtggtgcagaacgtgtgtgccaggtgcctgcggccgctgcacgtaagagccctggt

SEQ ID NO: 39102 - DNA, 20 bp, Homo sapiens
  chr1:158366698-158366718
  hypo
tattttggccaggggcggtg

SEQ ID NO: 39103 - DNA, 30 bp, Homo sapiens
  chr1:158578092-158578122
  hypo
ggttatatatagcggcggacattattagag

SEQ ID NO: 39104 - DNA, 16 bp, Homo sapiens
  chr1:158591676-158591692
  hypo
ggagtcttgctctgtc

SEQ ID NO: 39105 - DNA, 15 bp, Homo sapiens
  chr1:158591932-158591947
  hypo
cgtgagccactgcac

SEQ ID NO: 39106 - DNA, 30 bp, Homo sapiens; identical to SEQ ID NO: 14287
  chr1:158639324-158639354
  hypo

SEQ ID NO: 39107 - DNA, 178 bp, Homo sapiens
  chr1:158669704-158669882
  hypo
gaagtgagagacacacgtggaaaatgctgtgcggcggcctccagctgaatgaatacgtagaattacagccacaataccatcgtaggacatgaagatgagcatcacagctgtaataatctccactgcatgaatgacatccactacctgaatcatgacgatggctcgtgtgtctgtgcag

SEQ ID NO: 39108 - DNA, 44 bp, Homo sapiens
  chr1:158672331-158672375
  hypo
gattacaggcatgagccaccgtgcctggccgtgacctccacatt

SEQ ID NO: 39109 - DNA, 107 bp, Homo sapiens
  chr1:158723718-158723825
  hypo
tagcagaagatcaatcgatatatgagtgttagttgaataaatgtaccgatgatgaataatgatgcagctttactactgagaagggccccgtgcgtacagcaacaaag

SEQ ID NO: 39110 - DNA, 17 bp, Homo sapiens
  chr1:158730575-158730592
  hypo
ctgggtgcagtggctcg

SEQ ID NO: 39111 - DNA, 33 bp, Homo sapiens
  chr1:158748784-158748817
  hypo
ggcgacagtgcgagactgcgtctcaaaaaaaaa

SEQ ID NO: 39112 - DNA, 42 bp, Homo sapiens
  chr1:158815297-158815339
  hypo
aggattacaggcgtgagccaccgcgcccggcctcctgctcaa

SEQ ID NO: 39113 - DNA, 23 bp, Homo sapiens
  chr1:159448019-159448042
  hypo
tttttttttttgagacggagtct

SEQ ID NO: 39114 - DNA, 41 bp, Homo sapiens
  chr1:159650169-159650210
  hypo
ggattacaggcgtgagccaccacgcccggcccacttttttt

SEQ ID NO: 39115 - DNA, 20 bp, Homo sapiens
  chr1:159679189-159679209
  hypo
aagagcgagactccgtctcg

SEQ ID NO: 39116 - DNA, 30 bp, Homo sapiens
  chr1:159683905-159683935
  hypo
cacaaaagccttcctcgacatgtctgtgag

SEQ ID NO: 39117 - DNA, 169 bp, Homo sapiens; identical to SEQ ID NO: 14290
  chr1:159883486-159883655
  hypo

SEQ ID NO: 39118 - DNA, 19 bp, Homo sapiens
  chr1:159930262-159930281
  hypo
ttttttcctttgagacgga

SEQ ID NO: 39119 - DNA, 30 bp, Homo sapiens; identical to SEQ ID NO: 14291
  chr1:159932029-159932059
  hypo

SEQ ID NO: 39120 - DNA, 71 bp, Homo sapiens
  chr1:160025702-160025773
  hypo
gtacttacaggctcccgctacctggagcattccaattttaacatgttcagactcagcgtcctgtctcctca

SEQ ID NO: 39121 - DNA, 36 bp, Homo sapiens
  chr1:160451199-160451235
  hypo
tagactggagctgttcctattcggccatcttggctg

SEQ ID NO: 39122 - DNA, 85 bp, Homo sapiens
  chr1:160693873-160693958
  hypo
tcacccgtggtaacccgagccctggtattatacacataggtcctgtcctcctgaaaacgggtcaggactggccaggcgcagtggc

SEQ ID NO: 39123 - DNA, 143 bp, Homo sapiens
  chr1:160787406-160787549
  hypo
tttttgcacaatcttcgcaacaatcctacagagtagatattctcgtttttcccctttatatggataaagaaactgaggctcagaaaagataagggacttatccaaggtcacaccataaaagctggtttcgaaccctgagctct

SEQ ID NO: 39124 - DNA, 30 bp, Homo sapiens
  chr1:160820959-160820989
  hypo
ttgaccactggccatcggtgatcaacttaa

SEQ ID NO: 39125 - DNA, 30 bp, Homo sapiens; identical to SEQ ID NO: 14294
  chr1:160853373-160853403
  hypo

SEQ ID NO: 39126 - DNA, 94 bp, Homo sapiens
  chr1:160880601-160880695
  hypo
gggagagagtgaaggcgcacctacaaggggcttatcaggaccacttatcctctcaaatttctactcttgagtgcgagttaaagaaacaacttaa

SEQ ID NO: 39127 - DNA, 146 bp, Homo sapiens
  chr1:160953007-160953153
  hypo
aaaaataaaaaagaacggcctcgaatctactcgcagggacctcaggtatggaagtttcttctgtcttttgggaatccagccaggtcaggcctgagtcccagatcccaaagacacccacaaccctggggtaccggggacagtctcaa

SEQ ID NO: 39128 - DNA, 27 bp, Homo sapiens
  chr1:160992336-160992363
  hypo
cttaatagtcttggccgggtgcgtggc

SEQ ID NO: 39129 - DNA, 57 bp, Homo sapiens; identical to SEQ ID NO: 14297
  chr1:161007705-161007762
  hypo

SEQ ID NO: 39130 - DNA, 30 bp, Homo sapiens
  chr1:161044643-161044673
  hypo
gacgtcacccagagccgcaggctgttccca

SEQ ID NO: 39131 - DNA, 181 bp, Homo sapiens
  chr1:161056643-161056824
  hypo
accctctgagagatgcgaccagaacgctttcctcctcctatctccacagccagacccagtgacccttccaacaccccagcaccccacttcagccaggcctggaccatcacagagtcatcgtatttcagagctggaaggtcaatagagatcatctggtcctagctctcggtctactgaagtc

SEQ ID NO: 39132 - DNA, 33 bp, Homo sapiens
  chr1:161358973-161359006
  hypo
atgtaaagcaggccacgcacggtggtggctcac

SEQ ID NO: 39133 - DNA, 360 bp, Homo sapiens
  chr1:161367772-161368132
  hypo
gaaacaccgcgcctggccaaaaaatgttttattttaaattcaaaatgctgtaatggaggctgggtgcagtggctttttttactcagcatacttgagattcatgttgttgtatatgtgagcagttccgtcctttttttggctgagtaacattccattgtatggatcggtctttcacttgttgattgacatttggatagtctacagtttggggctattacaaatagagctgctatgaatgtttgtgtacaggcgtttgtatgggcatatgctctatttactcttggtaaatacctaggagtggaatggctgagtcatattgtagtagtttaacgcttttaaaaacccccaaactgttttcca

SEQ ID NO: 39134 - DNA, 169 bp, Homo sapiens
  chr1:161442404-161442573
  hypo
ttcccctggagaccccggcgggcagtctctcgaccctgggcggcagagaaagcgcaagatgggacgagtcgacctctctccctccgctctccctccgcgcccaacctcagttgcctggatgtgaggagagcctccccttctgccctcctcatcgcgccagcctgtcttg

SEQ ID NO: 39135 - DNA, 29 bp, Homo sapiens
  chr1:161471750-161471779
  hypo
ccaccgcacctggccggttctcttgaatc

SEQ ID NO: 39136 - DNA, 30 bp, Homo sapiens
  chr1:161493414-161493444
  hypo
ctttcccaggtgttgcgttctctcttgggc

SEQ ID NO: 39137 - DNA, 30 bp, Homo sapiens
  chr1:161577640-161577670
  hypo
tgaagccgagcagtacggggctgaggatga

SEQ ID NO: 39138 - DNA, 45 bp, Homo sapiens
  chr1:161879452-161879497
  hypo
gtgaacagtaagggccggtcacagaggctcacacctgtaatccca

SEQ ID NO: 39139 - DNA, 30 bp, Homo sapiens; identical to SEQ ID NO: 14301
  chr1:161913509-161913539
  hypo

SEQ ID NO: 39140 - DNA, 30 bp, Homo sapiens
  chr1:163363352-163363382
  hypo
tccaggaaaaaaaaccggaaatggatgttg

SEQ ID NO: 39141 - DNA, 39 bp, Homo sapiens
  chr1:165664200-165664239
  hypo
aaaaaaataaaaataaaaaaaggacgatgagctataaag

SEQ ID NO: 39142 - DNA, 36 bp, Homo sapiens
  chr1:165809083-165809119
  hypo
gggccggtcacttgccggtaccgtgattcatgttct

SEQ ID NO: 39143 - DNA, 30 bp, Homo sapiens
  chr1:167505794-167505824
  hypo
ataattaactcacttcgaaatcccttgctt

SEQ ID NO: 39144 - DNA, 38 bp, Homo sapiens
  chr1:167789113-167789151
  hypo
tagccaaatatttaaagccaaatcggatcaacagtagg

SEQ ID NO: 39145 - DNA, 95 bp, Homo sapiens; identical to SEQ ID NO: 14303
  chr1:167823347-167823442
  hypo

SEQ ID NO: 39146 - DNA, 30 bp, Homo sapiens
  chr1:168058977-168059007
  hypo
ctgcctctgcccatgcgcctctgcccaggg

SEQ ID NO: 39147 - DNA, 29 bp, Homo sapiens
  chr1:168116130-168116159
  hypo
actacacgtagaagccgggtgcggtggct

SEQ ID NO: 39148 - DNA, 30 bp, Homo sapiens; identical to SEQ ID NO: 14304
  chr1:168150766-168150796
  hypo

SEQ ID NO: 39149 - DNA, 120 bp, Homo sapiens
  chr1:171452999-171453119
  hypo
gccatacgtgtcagtcttatgaccttggttaatgtaatttcatctgattgctgaagttgttctccattgctcaagacagatgatttggctgggcgtggtggctcatgccggtaattccgg

SEQ ID NO: 39150 - DNA, 30 bp, Homo sapiens
  chr1:171555031-171555061
  hypo
tgaggtgtcttggggcgaggggcctgtcta

SEQ ID NO: 39151 - DNA, 18 bp, Homo sapiens
  chr1:171625525-171625543
  hypo
acactgacccttggccgg

SEQ ID NO: 39152 - DNA, 17 bp, Homo sapiens
  chr1:172902655-172902672
  hypo
atagcagacttgggccg

SEQ ID NO: 39153 - DNA, 30 bp, Homo sapiens
  chr1:173090762-173090792
  hypo
gaaagaaaaattttccgtctgtcatccata

SEQ ID NO: 39154 - DNA, 61 bp, Homo sapiens
  chr1:173477004-173477065
  hypo
tttctggtttttttacgccacccagtttgtggtactttgttacagccgtgcttgcaaacta

SEQ ID NO: 39155 - DNA, 30 bp, Homo sapiens
  chr1:173794930-173794960
  hypo
ccttatgtgtagaagcgaaattcactctca

SEQ ID NO: 39156 - DNA, 30 bp, Homo sapiens
  chr1:173897621-173897651
  hypo
gaaagagccaagctccgtctcgaggaaaaa

SEQ ID NO: 39157 - DNA, 77 bp, Homo sapiens
  chr1:173993036-173993113
  hypo
gcagtatgatttttacgttgtttatttttatctcgtcaatatttcaattaaaaatacgttaaaggacagatagatgc

SEQ ID NO: 39158 - DNA, 30 bp, Homo sapiens
  chr1:174421982-174422012
  hypo
gccactgcacccagccggtagctgctgttt

SEQ ID NO: 39159 - DNA, 30 bp, Homo sapiens
  chr1:175346485-175346515
  hypo
tgaacagttagccatcgattttatataact

SEQ ID NO: 39160 - DNA, 348 bp, Homo sapiens
  chr1:175355017-175355365
  hypo
ctcttgcttccttctcgcggtgtctatgacaaggccaatgctctgacacaccttgcctcattcctaatactcctcttgctgtgatgacaccaccggttggctccacccctctttccctccttgtgcgtctctcccccaccgcagccttacctgttgtgaactgagtggtggcagaatcgctctcgttggtccctcggacggcactgactgacacctcgtatcgggagccaggccgcagggcctgcactgagtattggctcaggggaggctgcagccggaaggtggtcctcccaccttccccgcccaccaggccatatttcaaaagaatgaaatcgactttggctcgag

SEQ ID NO: 39161 - DNA, 229 bp, Homo sapiens
  chr1:175365646-175365875
  hypo
aaaaatgaagcaggacggggaaatggtacgtacgggtggccaccttggcagtgatgggaaggctgaggatgttgctaatgacagcgtagacgctgatgttgtaggtgagacctggctccagctccgtgatggtgacaccactccaatctccaggcacccgctgctggagctggaggccccccagggccgtcggctggtaagagatcacatattccgtcactgccatcgg

SEQ ID NO: 39162 - DNA, 78 bp, Homo sapiens; identical to SEQ ID NO: 14308
  chr1:175372494-175372572
  hypo

SEQ ID NO: 39163 - DNA, 35 bp, Homo sapiens
  chr1:175375411-175375446
  hypo
ccctctccagcatctcgatccggctcagcagctcc

SEQ ID NO: 39164 - DNA, 30 bp, Homo sapiens
  chr1:175388670-175388700
  hypo
tctgtggcacgatctcggctcactgcaacc

SEQ ID NO: 39165 - DNA, 102 bp, Homo sapiens
  chr1:175472249-175472351
  hypo
tgaacagccagtacacgttgctgaggatgactgggagaccagaggacccatggctgagggaagagaagcctccctaagatgagaaggcgcagctgaatgggc

SEQ ID NO: 39166 - DNA, 32 bp, Homo sapiens
  chr1:178531766-178531798
  hypo
accgtaaacccttgtcgcgggggaaaagctag

SEQ ID NO: 39167 - DNA, 30 bp, Homo sapiens
  chr1:178857986-178858016
  hypo
tctcagaaccctgcccgtaaaaaagagttt

SEQ ID NO: 39168 - DNA, 30 bp, Homo sapiens
  chr1:178994064-178994094
  hypo
gaattctgttcagtacgccttactgattaa

SEQ ID NO: 39169 - DNA, 26 bp, Homo sapiens
  chr1:179262298-179262324
  hypo
gcgtgagccaccgcacctggcctcaa

SEQ ID NO: 39170 - DNA, 30 bp, Homo sapiens
  chr1:179781741-179781771
  hypo
cgcagccaaattattcgcagccccgttcag

SEQ ID NO: 39171 - DNA, 30 bp, Homo sapiens; identical to SEQ ID NO: 14309
  chr1:179849955-179849985
  hypo

SEQ ID NO: 39172 - DNA, 30 bp, Homo sapiens
  chr1:180096076-180096106
  hypo
gtggtggagctggatcggaaaccatttgtc

SEQ ID NO: 39173 - DNA, 30 bp, Homo sapiens
  chr1:180137119-180137149
  hypo
ccagtgagcatgagccgcaggggtgcagcc

SEQ ID NO: 39174 - DNA, 57 bp, Homo sapiens
  chr1:180235667-180235724
  hypo
ctacctcatggaggacgggcggctggtgtgcaaggaagactacgagacagccaagca

SEQ ID NO: 39175 - DNA, 30 bp, Homo sapiens
  chr1:180910386-180910416
  hypo
agtccagggccccatcgttacaatccctgc

SEQ ID NO: 39176 - DNA, 99 bp, Homo sapiens
  chr1:180925089-180925188
  hypo
agactagttctggagcgactcaaaaggccctgctgcacctgcatgaacaggccttcccctttctccctccctcccccacatatccgcagagaagtttcc

SEQ ID NO: 39177 - DNA, 30 bp, Homo sapiens
  chr1:181727256-181727286
  hypo
gagaggcacaagagccgactgagccccagc

SEQ ID NO: 39178 - DNA, 91 bp, Homo sapiens
  chr1:181922685-181922776
  hypo
gcatgtactatgtatcggacatcatgccaggccgtaggggactaaagaaatgagaaagacatggtccttgcatcagcggagtttttcgggg

SEQ ID NO: 39179 - DNA, 21 bp, Homo sapiens
  chr1:182815386-182815407
  hypo
tttgagatggagtttcgcttt

SEQ ID NO: 39180 - DNA, 158 bp, Homo sapiens
  chr1:183129382-183129540
  hypo
caaaggaagaaagagcgcctgaagcatgtgttcaccgggcaactatgaatggcttgactgggtggagccttcagtatctttttagttaagccttttagtctcaaaaatggaagaggcaaagctcaattcttaaagatcacttcttttttttttttgag

SEQ ID NO: 39181 - DNA, 37 bp, Homo sapiens
  chr1:183462987-183463024
  hypo
tacaggcgtgagtcatagcacccggccactttactgg

SEQ ID NO: 39182 - DNA, 30 bp, Homo sapiens
  chr1:185073818-185073848
  hypo
ttttaaactgtacaccgttctgagtagcct

SEQ ID NO: 39183 - DNA, 30 bp, Homo sapiens
  chr1:191565747-191565777
  hypo
cacacctagccaggtcgtcacagtgcatgg

SEQ ID NO: 39184 - DNA, 150 bp, Homo sapiens
  chr1:191763150-191763300
  hypo
tttttaatttttttgtttgtttgttttaactctccaaagtgacaatggaaacttctacttttctaaaaaaaaattaaggatatgctcccaactccgcattttggctcttgctttttgatataagatagatattctcgcattttgcagtac

SEQ ID NO: 39185 - DNA, 217 bp, Homo sapiens
  chr1:195732322-195732539
  hypo
tgagattttggtggccgcggaaagtaggaacgagagagctggagcacgccccctacctctttggcctctgtggttgctggcgtctcactcaggtttttgggtgccactgtgttcccctcatccagaccctggtacttgcagcggaagccgcctgtggtacacctggtccagctgcagcctcgcaaggagctggtgccggtgccggttcctggagctg

SEQ ID NO: 39186 - DNA, 30 bp, Homo sapiens
  chr1:197771436-197771466
  hypo
attaaaaattaatgtcggaattcgagggga

SEQ ID NO: 39187 - DNA, 160 bp, Homo sapiens
  chr1:200505065-200505225
  hypo
tttattgacagatatcgagttatttctcattttgcctgcacaatagaaaataagctgcaaaaacctatgtataggtcattcctaccccagaccaattataaatcaaaatctctgagagtcagggttgttttttttttttttgagacggagtctcactctg

SEQ ID NO: 39188 - DNA, 30 bp, Homo sapiens; identical to SEQ ID NO: 14313
  chr1:200519350-200519380
  hypo

SEQ ID NO: 39189 - DNA, 30 bp, Homo sapiens; identical to SEQ ID NO: 14314
  chr1:200864028-200864058
  hypo

SEQ ID NO: 39190 - DNA, 49 bp, Homo sapiens
  chr1:200941620-200941669
  hypo
ccgccttcccgggggcgctgggcacaagacctcgcgagtgagaagacac

SEQ ID NO: 39191 - DNA, 30 bp, Homo sapiens; identical to SEQ ID NO: 14315
  chr1:201244396-201244426
  hypo

SEQ ID NO: 39192 - DNA, 196 bp, Homo sapiens
  chr1:201445702-201445898
  hypo
ctgacctgctcgcaccgctttgatgtacagccctttgttccaggactttggggtttcctcggatctctgtttttctaaagggaaacagaaggaaaaaccctaccaaggtttcaagtctctgatgacttgggttttatgggcaccattgcgacagacttcaagtgggcagcaactctgcagccgacccgcccaggct

SEQ ID NO: 39193 - DNA, 39 bp, Homo sapiens
  chr1:201797433-201797472
  hypo
ttagaggcgtgagccactgcgcctcgccacaccctgcat

SEQ ID NO: 39194 - DNA, 30 bp, Homo sapiens
  chr1:201851118-201851148
  hypo
atcaatccaagtgctcgatcagaggctaga

SEQ ID NO: 39195 - DNA, 101 bp, Homo sapiens
  chr1:201977862-201977963
  hypo
tttttttttttgagacgcagtgattacaggtgtgagccaccggatcctacatttcaaatgcataaaaatctagatatgggctgggcgcagtagctcatgcc

SEQ ID NO: 39196 - DNA, 30 bp, Homo sapiens
  chr1:201981114-201981144
  hypo
agttctggtcgaagacgcaggttctggact

SEQ ID NO: 39197 - DNA, 42 bp, Homo sapiens; identical to SEQ ID NO: 14317
  chr1:201982442-201982484
  hypo

SEQ ID NO: 39198 - DNA, 105 bp, Homo sapiens
  chr1:201983126-201983231
  hypo
tacgagaagctgagccgggccatgaggtgagctggcggccaggaccctcacgatacagccggacatggggacaggcgctcacactcccaccgccctctttctggc

SEQ ID NO: 39199 - DNA, 98 bp, Homo sapiens
  chr1:201984047-201984145
  hypo
aagtcatgtaatttaatgatcagaccccagtcacagccataggatacaaagaagcaaaggcaaagagccctgtgtcctgggcacggttacaggccagt

SEQ ID NO: 39200 - DNA, 159 bp, Homo sapiens
  chr1:201986490-201986649
  hypo
tagacaaaggggatgcgggccagggcgtaggtctagcctcagaagctggggaagctttcacagctacttagtctaaaaatgaccccatttcttggaaattatgcattagactctggtctagtttccctagccacaatatctcggggtccttgcaccctt

SEQ ID NO: 39201 - DNA, 16 bp, Homo sapiens
  chr1:202081788-202081804
  hypo
ccgtctcaaaaaaaaa

SEQ ID NO: 39202 - DNA, 30 bp, Homo sapiens
  chr1:202101759-202101789
  hypo
gggtgaaggagaggccgagggaggtggagc

SEQ ID NO: 39203 - DNA, 139 bp, Homo sapiens
  chr1:202311995-202312134
  hypo
tgacttttaaaccatcttccaacgctagatgcatggtactttctgaacaaggaagaacctgtttatagttaagccaaccttaacttctcagagctgcctctgccagaggccaatgcttcatgagcgctgaaagatggca

SEQ ID NO: 39204 - DNA, 30 bp, Homo sapiens
  chr1:202856302-202856332
  hypo
tatgggctatatactcggcacagtgctaag

SEQ ID NO: 39205 - DNA, 37 bp, Homo sapiens
  chr1:202898225-202898262
  hypo
ggattacaggcgtcagccacagcgcctagccctttga

SEQ ID NO: 39206 - DNA, 33 bp, Homo sapiens
  chr1:202933730-202933763
  hypo
gtaatgcacctgtcccgccggcaatcattccca

SEQ ID NO: 39207 - DNA, 79 bp, Homo sapiens
  chr1:202995301-202995380
  hypo
tgacaattacaaggccgagactaaggccaatttagggaacgggctgttagactaggaacaagggcgagttcagagggag

SEQ ID NO: 39208 - DNA, 30 bp, Homo sapiens
  chr1:203257678-203257708
  hypo
gtaccagagcaacctcgaagaaagctgaga

SEQ ID NO: 39209 - DNA, 33 bp, Homo sapiens
  chr1:203298181-203298214
  hypo
ttcagtgacgcctgacggcgaggtcagggaaga

SEQ ID NO: 39210 - DNA, 85 bp, Homo sapiens
  chr1:203429564-203429649
  hypo
atggctactaagtaacgtctacagtgtgggtatgctggacaaagggcggattcatatcgccagcaggatgaagcgggagagtgca

SEQ ID NO: 39211 - DNA, 22 bp, Homo sapiens
  chr1:203911836-203911858
  hypo
gattcaggacagggccgggcgt

SEQ ID NO: 39212 - DNA, 30 bp, Homo sapiens
  chr1:204333529-204333559
  hypo
atgaggccgccttcccgcttgctttctatt

SEQ ID NO: 39213 - DNA, 30 bp, Homo sapiens
  chr1:204535867-204535897
  hypo
aaggaaatacagcctcgggctagctttcac

SEQ ID NO: 39214 - DNA, 30 bp, Homo sapiens
  chr1:204536295-204536325
  hypo
ggatgaccaggactccggaaatctagtaca

SEQ ID NO: 39215 - DNA, 122 bp, Homo sapiens
  chr1:204587578-204587700
  hypo
cacaaccacactaaccgtcttagtgtcagcccccaccaggttctgggccacacaggtgtatagccctgcctcttctgctgtcaccctccgcagctccagggtcccctcggggtacacccggt

SEQ ID NO: 39216 - DNA, 112 bp, Homo sapiens
  chr1:204588271-204588383
  hypo
gttggcaaagtcccccggccctacccgctggagcgggttcttgttgaggtctaggaacttgagcccgggcacctgttccagtgcccgcctgggcacccgggccagctggttg

SEQ ID NO: 39217 - DNA, 27 bp, Homo sapiens
  chr1:204721236-204721263
  hypo
gctacagacccacgcctcctgctgtat

SEQ ID NO: 39218 - DNA, 145 bp, Homo sapiens
  chr1:205310661-205310806
  hypo
tcagacccatctgggcgtccctgaactacaagcctgggtcgacagcaccggctcagtgccttctgttaccctattccatcaccctaattgccacctgttactgaataatctttgtttctttttctttttttttttgatacggagt

SEQ ID NO: 39219 - DNA, 24 bp, Homo sapiens
  chr1:205311046-205311070
  hypo
gattacaggcgtgagccaccgcgc

SEQ ID NO: 39220 - DNA, 30 bp, Homo sapiens
  chr1:205548923-205548953
  hypo
ctccctggtgtttgccgtcatccccttctg

SEQ ID NO: 39221 - DNA, 61 bp, Homo sapiens
  chr1:207200870-207200931
  hypo
tgctgtcacagctgccgacacgggtcacgggttctgagccagtccccgctggccacagctc

SEQ ID NO: 39222 - DNA, 27 bp, Homo sapiens
  chr1:207227190-207227217
  hypo
ttcgagattttcccacgtccctcactt

SEQ ID NO: 39223 - DNA, 25 bp, Homo sapiens
  chr1:207598909-207598934
  hypo
ccaaactcaccgagtcatgcaggct

SEQ ID NO: 39224 - DNA, 30 bp, Homo sapiens; identical to SEQ ID NO: 14325
  chr1:207656486-207656516
  hypo

SEQ ID NO: 39225 - DNA, 137 bp, Homo sapiens
  chr1:207787630-207787767
  hypo
gacctaaatgatagtcgaggaggaaatggtagtgaggaagctgagcatctattagcgaagaaatcaagggagagatgggaattgctcacacatttgctaccactttttttttctttaggttccgattaaaaggcagg

SEQ ID NO: 39226 - DNA, 30 bp, Homo sapiens
  chr1:207857205-207857235
  hypo
tttgcctctagataccgactcattggttcc

SEQ ID NO: 39227 - DNA, 129 bp, Homo sapiens
  chr1:207911135-207911264
  hypo
gaggaatctggtggccgtaataaccggggaacagatgagctggaggcctcatcaggaggggtgtcccttggtggaaggacaccattcccggccttaaaaggagaggctccagcacggctggggaagcat

SEQ ID NO: 39228 - DNA, 116 bp, Homo sapiens
  chr1:207991495-207991611
  hypo
tgtccctctgccccacgctccagcagagggggtagagaagagaaaggggaggacggtttgtccgcattcagtggcagtggaggtgcatcttctctctcggtcgcaagaaggtgggg

SEQ ID NO: 39229 - DNA, 30 bp, Homo sapiens
  chr1:207992298-207992328
  hypo
tgagttacctggtgtcgctcccatcctgat

SEQ ID NO: 39230 - DNA, 115 bp, Homo sapiens
  chr1:208951412-208951527
  hypo
actaagaatctcttgcgtttatatattgcttttactttctaagtgcattcgcatctgttctgtcattttcttattccaatacccttaggaatgatggatccgtcagaggcaatgc

SEQ ID NO: 39231 - DNA, 137 bp, Homo sapiens
  chr1:209306205-209306342
  hypo
tgctacacaagcaagcgagtgcgggaactggagtgagtgaatactggaaccgggggtcacttctctctggtgagaacaggctctgtgtgggccccgcagcagcctccgagcccctgccctctcggcacctgagttct

SEQ ID NO: 39232 - DNA, 185 bp, Homo sapiens
  chr1:209601396-209601581
  hypo
gcggagcccaagttgcgcatggaagcgggggtggggtaaaataatcaagtttatagaccgccctctttaaagttactaatgagcttgccttctctttccttaatttcccctcgcagtgtggtcttttccccacccccagacatgaaagggaagcaggtcacaaagcctttcggattataaaagaa

SEQ ID NO: 39233 - DNA, 191 bp, Homo sapiens
  chr1:209999773-209999964
  hypo
agaactgacaagaatcgcattctaatggttttattacaacttctatggtgtgacacagtatcagggaaaacccaaatttcccacagtagcactccaatagcagagctattattttgcttctcatttctctcattttggacgctcctgttttaccgtaaatattcaagtgaattctgcggcttatgatttaa

SEQ ID NO: 39234 - DNA, 33 bp, Homo sapiens
  chr1:211430421-211430454
  hypo
aagtgccaggattacaggcgtgggccaccgcgc

SEQ ID NO: 39235 - DNA, 31 bp, Homo sapiens; identical to SEQ ID NO: 4957
  chr1:212963970-212964001
  hypo

SEQ ID NO: 39236 - DNA, 180 bp, Homo sapiens
  chr1:213189664-213189844
  hypo
gtgaaaatttttaattgcccaaagtgcagattcccagctgaggctgaacaacgcatcctctgggtgcccatggaactgaggtaccacagaattttgcaattaatgttgcggaagcacagccatagctctcactttaaaatgtacgtgtatgggccgggcgcggtggctcacgcctgtaat

SEQ ID NO: 39237 - DNA, 101 bp, Homo sapiens
  chr1:213190144-213190245
  hypo
acctttattaaatgtattataggactgtagattgttgaaagacattatttaagtggagaccctgcaagaaacaggaagagagaaaccgagaaagaataaag

SEQ ID NO: 39238 - DNA, 41 bp, Homo sapiens
  chr1:215745246-215745287
  hypo
tacaggcgtgagccaccgcgcctagccgagataaactttta

SEQ ID NO: 39239 - DNA, 30 bp, Homo sapiens
  chr1:217805039-217805069
  hypo
agtgctttttttcttcgacatcaccactct

SEQ ID NO: 39240 - DNA, 30 bp, Homo sapiens
  chr1:219253291-219253321
  hypo
taactacactattgccgtttactctgtgaa

SEQ ID NO: 39241 - DNA, 39 bp, Homo sapiens
  chr1:220552763-220552802
  hypo
caaactcctctttgttccaccagtcgatggcctgccagc

SEQ ID NO: 39242 - DNA, 96 bp, Homo sapiens
  chr1:220636414-220636510
  hypo
acaggtaggatctgccctcccaggtgtcgctgcagctgcagcacctgtggctgcagacttgggcctccggcttcaggaagtcggtagaagcaggga

SEQ ID NO: 39243 - DNA, 30 bp, Homo sapiens
  chr1:221706708-221706738
  hypo
aaggcaaatgcctggcggatagggatttgg

SEQ ID NO: 39244 - DNA, 30 bp, Homo sapiens
  chr1:222391027-222391057
  hypo
aacagcagaaaccagcgtgccagaggctaa

SEQ ID NO: 39245 - DNA, 165 bp, Homo sapiens
  chr1:222987570-222987735
  hypo
ctcctggccagctaccggtacaagccaagctctcactccataacgtccttcttctctgcatgcccttctccactgtgcctgtcctttaactcttattcatcatttatttcagtctcaattgaagagtcattatttctagaaagccttctccgcccagctctctac

SEQ ID NO: 39246 - DNA, 30 bp, Homo sapiens
  chr1:223841897-223841927
  hypo
aaacacaaacccagacggacacatcaggta

SEQ ID NO: 39247 - DNA, 189 bp, Homo sapiens
  chr1:223907491-223907680
  hypo
tctcaggggtgtgtgcgtgtgtgtgtgtgtgtgtgtgtgtgtgcgcgcgcgcgcgtataatgcagtattggtcattttgttctttcagccttttattttggaggactctagttagatcacaatctgtgaaatgtggtatactgtactctcaccctgattctggcacctggccagcgggtgctgatgggg

SEQ ID NO: 39248 - DNA, 30 bp, Homo sapiens
  chr1:224232559-224232589
  hypo
gatcaaggtaccatacggaggtacacttaa

SEQ ID NO: 39249 - DNA, 24 bp, Homo sapiens
  chr1:224251284-224251308
  hypo
gattacaggcgtgagccaccacgc

SEQ ID NO: 39250 - DNA, 30 bp, Homo sapiens; identical to SEQ ID NO: 14332
  chr1:224267844-224267874
  hypo

SEQ ID NO: 39251 - DNA, 32 bp, Homo sapiens
  chr1:224300912-224300944
  hypo
aagtgctggattacaggcgtgagtcaacacgc

SEQ ID NO: 39252 - DNA, 16 bp, Homo sapiens
  chr1:224361275-224361291
  hypo
acgtagagtgagattc

SEQ ID NO: 39253 - DNA, 121 bp, Homo sapiens; identical to SEQ ID NO: 14333
  chr1:226062878-226062999
  hypo

SEQ ID NO: 39254 - DNA, 86 bp, Homo sapiens
  chr1:226163129-226163215
  hypo
taaagacatggttgtatacacagacactgaaattcctctagcggaaaacaacagcaaatgattaaagataacgttgtttgttgagg

SEQ ID NO: 39255 - DNA, 30 bp, Homo sapiens
  chr1:226284013-226284043
  hypo
gctcagagctcccctcggaggaaaggctgg

SEQ ID NO: 39256 - DNA, 127 bp, Homo sapiens
  chr1:226303892-226304019
  hypo
cacgatgttctcctccgcatgtgtgggtagctagggccctctctggtctctcttgagtgtgatgcaaactttcgcatgcctgcagccttccagaccactgagggtgtgaggccgcttacccactaat

SEQ ID NO: 39257 - DNA, 49 bp, Homo sapiens
  chr1:226314981-226315030
  hypo
gagttcgaggccctgcggagctgcttcgccgccgcggccaagaagacgc

SEQ ID NO: 39258 - DNA, 43 bp, Homo sapiens
  chr1:226620644-226620687
  hypo
gaatttctctggactcgtagggtgaactcgacccaacatcttc

SEQ ID NO: 39259 - DNA, 30 bp, Homo sapiens
  chr1:226725373-226725403
  hypo
acctttaactctccccggtaatcactgtca

SEQ ID NO: 39260 - DNA, 20 bp, Homo sapiens
  chr1:226816426-226816446
  hypo
gtctccgtgacaactacaca

SEQ ID NO: 39261 - DNA, 30 bp, Homo sapiens
  chr1:226846375-226846405
  hypo
caggctggatggcaccgaacatcctccaca

SEQ ID NO: 39262 - DNA, 87 bp, Homo sapiens
  chr1:226908374-226908461
  hypo
agtattttttacagccgtaccacctgttaattcatattgaactggtagtaaaattataactcccagtgaatttcaaaagaaatattg

SEQ ID NO: 39263 - DNA, 38 bp, Homo sapiens
  chr1:226954853-226954891
  hypo
actctaggctgggcacgatggctcaagcctgtaattct

SEQ ID NO: 39264 - DNA, 35 bp, Homo sapiens
  chr1:227174055-227174090
  hypo
tgaatgagaactcagcgccccgggcactgtgggag

SEQ ID NO: 39265 - DNA, 42 bp, Homo sapiens; identical to SEQ ID NO: 14335
  chr1:227750829-227750871
  hypo

SEQ ID NO: 39266 - DNA, 30 bp, Homo sapiens; identical to SEQ ID NO: 14336
  chr1:227921541-227921571
  hypo

SEQ ID NO: 39267 - DNA, 30 bp, Homo sapiens
  chr1:227921780-227921810
  hypo
gagactagggcagcacgagtggggcaactg

SEQ ID NO: 39268 - DNA, 61 bp, Homo sapiens
  chr1:227926624-227926685
  hypo
gggagatggagctctcgttcttgagatggaactctgtggtttagttcgctggtccgcaggg

SEQ ID NO: 39269 - DNA, 30 bp, Homo sapiens
  chr1:227955886-227955916
  hypo
ccacagggtatgtggcgcacatgcagtctc

SEQ ID NO: 39270 - DNA, 221 bp, Homo sapiens
  chr1:228083399-228083620
  hypo
catcagacacaactacggaagtgcaaaggtcagtcctggaggcggcgagttggcagtagcctgagggtaggacttgcgtctccctgtgtacctgccgcctccaagttcagatgcactggccgttctcgctggggccatgagccaggcagcacccggggcccggcaccccaggcctggactcctgggcctctgctcgctccagtttccggcacctttcccag

SEQ ID NO: 39271 - DNA, 30 bp, Homo sapiens
  chr1:228117865-228117895
  hypo
aacgtcggatccacacgctctgtggcgtgt

SEQ ID NO: 39272 - DNA, 49 bp, Homo sapiens
  chr1:228201221-228201270
  hypo
taatcccagctgggccggcgggcaggaggaggtgcgggttgggagagct

SEQ ID NO: 39273 - DNA, 37 bp, Homo sapiens
  chr1:228238537-228238574
  hypo
gtctcgggagttcgccgacgcccgggagaaccggcca

SEQ ID NO: 39274 - DNA, 30 bp, Homo sapiens
  chr1:228342820-228342850
  hypo
tagcagcatggaaggcggtgacacagcgac

SEQ ID NO: 39275 - DNA, 30 bp, Homo sapiens
  chr1:228466507-228466537
  hypo
tcaggagctgcagcccgggcccaagtacga

SEQ ID NO: 39276 - DNA, 164 bp, Homo sapiens
  chr1:228495832-228495996
  hypo
gggggctggttgatgcggaggtgacggccgatgaggatgttgagttcagctgtgaggtgtccagggctggagccacaggcgtgcagtggtgcctacagggcctgccactgcaaagcaatgaggtgacagaggtggctgtgcgggatggccgcatccacaccctg

SEQ ID NO: 39277 - DNA, 38 bp, Homo sapiens
  chr1:228504430-228504468
  hypo
agcctctgaaaaacgcggcggtccgggccggcgcacag

SEQ ID NO: 39278 - DNA, 332 bp, Homo sapiens
  chr1:228528840-228529172
  hypo
tggaagggccacaaccgtcacgtgttcctcttccgcaaccacctggtaatctgcaagccccggcgagactcccgcaccgataccgtcagctacgtgttccggaacatgatgaaggtctgcaggctctgggctgctgggcggggctccctgtccctcagcgccggggtggatgccagtggccacacctgcagccgctggtccagggtggcctgaatgtttcctcgtcgggtcccacatctgttgaggatggtcagcccgtgtccccctccctgtgctgacaccctcccccacccacagctgagcagcatcgacctgaacgaccaggtggaggg

SEQ ID NO: 39279 - DNA, 30 bp, Homo sapiens; identical to SEQ ID NO: 14338
  chr1:228536492-228536522
  hypo

SEQ ID NO: 39280 - DNA, 30 bp, Homo sapiens; identical to SEQ ID NO: 14339
  chr1:228552593-228552623
  hypo

SEQ ID NO: 39281 - DNA, 163 bp, Homo sapiens
  chr1:228554806-228554969
  hypo
gccacccgctggtcacggggctgctggaccagtttgagacccgcaagaccctcatcctcatcctggagctgtatcctgccctcagcccctgagacggcttgaggaggggcaggcagggccaggccggggctcagaggagccatgtgcacggtgtcccctgcct

SEQ ID NO: 39282 - DNA, 636 bp, Homo sapiens
  chr1:228558699-228559335
  hypo
ctgctgccccccatgcggttccagcgttccctgatgagctacaagtccatcctggtgatgcgctccatccctgagctgctgcggggcccacccgacagcccctccctcggcgtagcccggcacctctgcagggacactggtggctcctccagttcctcctcctcctctgacaacgagctcgccccatttgcccgggctaagtcactgccaccctccccggtgacacactcaccactgctgcacccccggggcttcctgcggccctcggccagcctgcctgaggaagccgaggccagtgagcgctccaccgaggccccagctccgcctgcatctcccgagggtgccgggccaccggccgcccagggctgcgtgccccggcacagcgtcatccgcagcctgttctaccaccaggcgggtgagagccctgagcacggggccctggccccggggagcaggcggcacccggcccggcggcggcacctgctgaagggcgggtacattgcgggggcgctgccaggcctgcgcgagccactgatggagcaccgcgtgctggaggaggaggccgccagggaggagcaggccaccctcctggccaaagccccctcattcgagactgccctccggctgcctgcctct

SEQ ID NO: 39283 - DNA, 46 bp, Homo sapiens
  chr1:228919370-228919416
  hypo
ccactgcacacagaccgggtgctgggtattgcgggaaccaaggagc

SEQ ID NO: 39284 - DNA, 28 bp, Homo sapiens
  chr1:229705999-229706027
  hypo
ttgctattacaggcgtaaaccaccgcac

SEQ ID NO: 39285 - DNA, 64 bp, Homo sapiens
  chr1:230107209-230107273
  hypo
ccatctcctggctcccggctggcgttccaggaacagcaccggctttccccgtcctcctctcctg

SEQ ID NO: 39286 - DNA, 65 bp, Homo sapiens
  chr1:230404233-230404298
  hypo
gcctctgctggaaagcgacacaccttacgctacagcacattaaacagaagcgtgtgctcaggccc

SEQ ID NO: 39287 - DNA, 72 bp, Homo sapiens
  chr1:230423782-230423854
  hypo
acaaggaagttggtccgatgccagcaggtgaggagcatcctcctcatgtgaggaacacggggctggagcagg

SEQ ID NO: 39288 - DNA, 30 bp, Homo sapiens
  chr1:230424489-230424519
  hypo
gcatccggggctgtgcgttgtgcaagcccc

SEQ ID NO: 39289 - DNA, 30 bp, Homo sapiens
  chr1:230453332-230453362
  hypo
tggggaggggagggccgaggctgatttatc

SEQ ID NO: 39290 - DNA, 53 bp, Homo sapiens; identical to SEQ ID NO: 14343
  chr1:230453632-230453685
  hypo

SEQ ID NO: 39291 - DNA, 30 bp, Homo sapiens
  chr1:230458365-230458395
  hypo
gatcatgcaaagagccgtgactgaggccgg

SEQ ID NO: 39292 - DNA, 128 bp, Homo sapiens
  chr1:230992827-230992955
  hypo
cgttctctgtgcagacgcctcctaacatgaacagccagtgggaggtcagtctttgaactcaaataacgaaggcatgccagggtctgggcagctgaaggcctattcccaagaagcggggacagggaagg

SEQ ID NO: 39293 - DNA, 53 bp, Homo sapiens
  chr1:231163086-231163139
  hypo
gaaaggaatcctgaccgcctaggaatacagcgcagccccgcacacacctatta

SEQ ID NO: 39294 - DNA, 96 bp, Homo sapiens
  chr1:231663293-231663389
  hypo
gagtttctctctagacggtgctgaattgccatctagttacctattctgacaccaggaacatgattcttcaacaaacattgacggaagcttacatgg

SEQ ID NO: 39295 - DNA, 120 bp, Homo sapiens
  chr1:231738873-231738993
  hypo
ttatttttcttatttaaacattttcttcctttgacttgtttgcttgtgtttgttctcagtttttagaatcattaaacattttggccatatagaaaaatatacagaagcctggccgggcgt

SEQ ID NO: 39296 - DNA, 30 bp, Homo sapiens
  chr1:232761388-232761418
  hypo
cacaggtcatgttcacgggtcacgttacac

SEQ ID NO: 39297 - DNA, 30 bp, Homo sapiens
  chr1:234445373-234445403
  hypo
tctgcgtgctcaccccgtctctcatgggcg

SEQ ID NO: 39298 - DNA, 278 bp, Homo sapiens
  chr1:234621065-234621343
  hypo
tagatgaattagggtcgtgactgttattttaacatcaaaagcaggtgtactatggatgagtgtctgagttttcctccctttaaagtagtagagtttagttacttcagtctagctcacgtatcccttacaccaggggtccctaacccctgggccatgaaccgctacccctccgtgacctgttaggaaccaggctgcacaggagaaggtgagctgcaggcgagtgggcattatcacctgagctccgcctcctatcaaatcagcagcggccttagattgtc

SEQ ID NO: 39299 - DNA, 30 bp, Homo sapiens
  chr1:234625024-234625054
  hypo
gaagtctagagaaagcgcttccaagcacgt

SEQ ID NO: 39300 - DNA, 30 bp, Homo sapiens
  chr1:234724806-234724836
  hypo
ctgttttttttttctcgtggtctttctcaa

SEQ ID NO: 39301 - DNA, 30 bp, Homo sapiens
  chr1:234795478-234795508
  hypo
tgagaatgagtcacccgctcaggcctcttt

SEQ ID NO: 39302 - DNA, 30 bp, Homo sapiens
  chr1:234845113-234845143
  hypo
agtctgaagggtacccgggagtttgacagg

SEQ ID NO: 39303 - DNA, 169 bp, Homo sapiens
  chr1:234882410-234882579
  hypo
cttgggaatcatgtgcgcacaaaagcaaacaaactttttgggagattccaaattaggcagttgggtcttggaaagaggccccccatgtgggaagctcgagccccctccagaaggctcttcagaagctgtgttagaacagtgtgtttctcatggtcggtccctgactcat

SEQ ID NO: 39304 - DNA, 30 bp, Homo sapiens; identical to SEQ ID NO: 14348
  chr1:234959409-234959439
  hypo

SEQ ID NO: 39305 - DNA, 76 bp, Homo sapiens
  chr1:235003807-235003883
  hypo
tctaaaaaaaaaaaaaaaaaaatttaattttaatccactcggattttaaaatagcatatcacgatggaaaaagcct

SEQ ID NO: 39306 - DNA, 39 bp, Homo sapiens
  chr1:235005711-235005750
  hypo
tccaccccaaccctccgttccacacgcacctcccactgc

SEQ ID NO: 39307 - DNA, 152 bp, Homo sapiens
  chr1:235267072-235267224
  hypo
ctcaaaaaaaggaaaaaaaaaaaaaaagaagatattctcatgccctttggaaatgaggcacctaagcctcagagaagttaagtgccccagtacgctgcacatttagaactcaaacccaagcccctgcttctaaaaaccgtgttcgttccgcc

SEQ ID NO: 39308 - DNA, 76 bp, Homo sapiens
  chr1:235292638-235292714
  hypo
agaaaaaatagaaaacgtgaattgttttatagccacacgaaaacatacacatgatcaggccaggcgcggtggctca

SEQ ID NO: 39309 - DNA, 120 bp, Homo sapiens
  chr1:235325361-235325481
  hypo
gtgaggactaggagtttgaaccagcctggtcgatctagcgagacttattctctacagaaaagaaattagacgggcaccttcgcgctcggcgcctgtagtcccagcactttgagaggctcg

SEQ ID NO: 39310 - DNA, 31 bp, Homo sapiens
  chr1:235325541-235325572
  hypo
tacactccagcctaagcggcagaccctggct

SEQ ID NO: 39311 - DNA, 30 bp, Homo sapiens
  chr1:235793720-235793750
  hypo
agcctgatgatgccacgctctcatcactta

SEQ ID NO: 39312 - DNA, 20 bp, Homo sapiens
  chr1:236044137-236044157
  hypo
tttagcggccgggcacggtg

SEQ ID NO: 39313 - DNA, 30 bp, Homo sapiens
  chr1:236081438-236081468
  hypo
cgcccccatgcccaacgctgaggaggacac

SEQ ID NO: 39314 - DNA, 24 bp, Homo sapiens
  chr1:236252519-236252543
  hypo
gcttaccaggccaggcgtggtggc

SEQ ID NO: 39315 - DNA, 111 bp, Homo sapiens
  chr1:236768713-236768824
  hypo
caatggttacacccacgtcagtggaagagtttgatgacttttagcaaatgcatgtataggtgtaatgacctccccagtcaaaatgacagtttccatcgcccctaaaaattg

SEQ ID NO: 39316 - DNA, 40 bp, Homo sapiens
  chr1:236771396-236771436
  hypo
tctccctatgctcttaggcagcgtccggaaacagtacaat

SEQ ID NO: 39317 - DNA, 30 bp, Homo sapiens
  chr1:236811244-236811274
  hypo
gatcccctcagctatcgctcttgctttctt

SEQ ID NO: 39318 - DNA, 30 bp, Homo sapiens
  chr1:236907863-236907893
  hypo
ctggcatgaggaagccgctgtgccctcagc

SEQ ID NO: 39319 - DNA, 30 bp, Homo sapiens
  chr1:237753724-237753754
  hypo
tataagataaatttccgaaaccgtctttag

SEQ ID NO: 39320 - DNA, 32 bp, Homo sapiens
  chr1:238235533-238235565
  hypo
aaaatgggccgggcacggtggctcacgcctgt

SEQ ID NO: 39321 - DNA, 19 bp, Homo sapiens
  chr1:239516662-239516681
  hypo
agagcgatactctgattaa

SEQ ID NO: 39322 - DNA, 192 bp, Homo sapiens
  chr1:239523114-239523306
  hypo
gtacaagaacacatgcgaacaaaaactgtacagtaagtagtttaaaatgtacagggaattgtgtagggggagatgagagatggaaggggggacatggatgtatcaacaaatataaacaagaaacaaagaacaaaacaggattggacttttcagagatcactgataattacgttctttcgtgatgatgagtat

SEQ ID NO: 39323 - DNA, 42 bp, Homo sapiens
  chr1:239987383-239987425
  hypo
cggtgccctctgtctcgttggtgaggccgcatttcactccag

SEQ ID NO: 39324 - DNA, 250 bp, Homo sapiens
  chr1:240118753-240119003
  hypo
ccctgacacttcacccgcgagcctggataaaaaggctcccatgacctctctctttagccaaccccgctgggtgcaatattcagaagtgctccccgaggtttccaattacccgctgtgccccacctgtggcagagtaaacctacttcctccagactcgcatggcagggactgaccaagaaggaaagcggccctcactccagggttccgtggtgatacctgcatcagcacaccagcccgggggtctgcactc

SEQ ID NO: 39325 - DNA, 30 bp, Homo sapiens
  chr1:240308662-240308692
  hypo
tccctcctccatctccgctgccactgccct

SEQ ID NO: 39326 - DNA, 120 bp, Homo sapiens
  chr1:240372821-240372941
  hypo
gggatgacaggcgtgagccaccgggcacggccgcaaatcaaattcttaggtaaactgactctggagcatgatttagtgcacactttaaaatgcacagccctgtccgggtgcggtggctca

SEQ ID NO: 39327 - DNA, 169 bp, Homo sapiens; identical to SEQ ID NO: 14351
  chr1:240463082-240463251
  hypo

SEQ ID NO: 39328 - DNA, 20 bp, Homo sapiens
  chr1:240893174-240893194
  hypo
gactccgtctcaaaaaaaaa

SEQ ID NO: 39329 - DNA, 55 bp, Homo sapiens
  chr1:241052144-241052199
  hypo
ctggaggttagggaacgcggaggcagagagagggaagcagcgggtgcaaagggca

SEQ ID NO: 39330 - DNA, 39 bp, Homo sapiens
  chr1:241096456-241096495
  hypo
caggtgtgagccaccgcgcccggccggtgttactttctg

SEQ ID NO: 39331 - DNA, 30 bp, Homo sapiens
  chr1:241753208-241753238
  hypo
ttgtgtttggcattgcgatgagtgggaatg

SEQ ID NO: 39332 - DNA, 30 bp, Homo sapiens
  chr1:241913315-241913345
  hypo
ctgacatgctttatacgctcatatgggaat

SEQ ID NO: 39333 - DNA, 30 bp, Homo sapiens
  chr1:242087568-242087598
  hypo
atgagccacaatttacgtcatccaccttaa

SEQ ID NO: 39334 - DNA, 19 bp, Homo sapiens
  chr1:242122940-242122959
  hypo
attacgggcatgagccacc

SEQ ID NO: 39335 - DNA, 177 bp, Homo sapiens; identical to SEQ ID NO: 14352
  chr1:242286750-242286927
  hypo

SEQ ID NO: 39336 - DNA, 28 bp, Homo sapiens
  chr1:242633355-242633383
  hypo
aggggctgccgggtgcggtggctcatgc

SEQ ID NO: 39337 - DNA, 147 bp, Homo sapiens
  chr1:242973101-242973248
  hypo
tgctaggattacaggcgtgagcaaccgcacccggccagataaagaatgttttaacaagaaagatgacctcattcccttagtaccgtattttagttcagtcaaattttgactggtgccattctcctcagctgccgtgatttccaattt

SEQ ID NO: 39338 - DNA, 30 bp, Homo sapiens; identical to SEQ ID NO: 14353
  chr1:243057075-243057105
  hypo

SEQ ID NO: 39339 - DNA, 33 bp, Homo sapiens
  chr1:243145074-243145107
  hypo
ttttatagttactcttatcgtgagtcgtaagta

SEQ ID NO: 39340 - DNA, 36 bp, Homo sapiens
  chr1:244115683-244115719
  hypo
tggatgacgaggacacgctgacgaaagcaatgaaag

SEQ ID NO: 39341 - DNA, 30 bp, Homo sapiens
  chr1:244139857-244139887
  hypo
caaagaacagggaatcggaagacctggact

SEQ ID NO: 39342 - DNA, 98 bp, Homo sapiens
  chr1:244142970-244143068
  hypo
gacggaaggtacccacgagggtggcgtgtggggccatcggccaggagtgggggggatgggacggaaggtacccacgagggtggcgggtggggcagatg

SEQ ID NO: 39343 - DNA, 105 bp, Homo sapiens
  chr1:244200765-244200870
  hypo
ggtagagggtggctgcgtccccaaacagcagggcccagcaagagggaaaagccacacaccttctctgaggggccccccaaaaaatgatcgcggtagcagtagctt

SEQ ID NO: 39344 - DNA, 132 bp, Homo sapiens
  chr1:244243999-244244131
  hypo
aagaggcagagaagacgtgagtttcttgccaattccacctggtggagagcctgccaggcctcctgacttgtggtcctgtctctgaccggcacggtggctgcttttcctaggcaagtgcggcataatgtccct

SEQ ID NO: 39345 - DNA, 30 bp, Homo sapiens
  chr1:244319117-244319147
  hypo
catcacaggcggctgcgtgcttattacccc

SEQ ID NO: 39346 - DNA, 30 bp, Homo sapiens
  chr1:244914578-244914608
  hypo
acgaagcaagtgctccgtcattgtggctgc

SEQ ID NO: 39347 - DNA, 180 bp, Homo sapiens
  chr1:245060866-245061046
  hypo
attagcttctggactcgtgccggcagggcgggggcagggtggaggggaggagtgttcacctggctatgtggagaggtggagggaacatgatgggaactcttccacaggtttggaaccagtttccctgtttccagccccacttggcagaacctgtctctcgcagtccgagcctttaacggt

SEQ ID NO: 39348 - DNA, 143 bp, Homo sapiens; identical to SEQ ID NO: 4959
  chr1:245135719-245135862
  hypo

SEQ ID NO: 39349 - DNA, 30 bp, Homo sapiens
  chr1:245376976-245377006
  hypo
atcatcatcagaaggcgttgtgcgtggtgt

SEQ ID NO: 39350 - DNA, 151 bp, Homo sapiens
  chr1:245461494-245461645
  hypo
ttctaactcataaggaaattttaccttcattcactacgagtaggctcatactatacaaatattagtttctagagtccattgatggatgaagagataaacaaaatgtggtctatgcatacaatggcatattcttcagcgtggagaaagaatg

SEQ ID NO: 39351 - DNA, 43 bp, Homo sapiens
  chr1:245499703-245499746
  hypo
gtatgcgggtgcctccgactggcggctgcgtggtggatctggc

SEQ ID NO: 39352 - DNA, 26 bp, Homo sapiens
  chr1:245627605-245627631
  hypo
aggtaatgtgtgtcccgtcccccgac

SEQ ID NO: 39353 - DNA, 30 bp, Homo sapiens
  chr1:245750646-245750676
  hypo
ttgaagacagcaactcgtttttaagctctt

SEQ ID NO: 39354 - DNA, 33 bp, Homo sapiens
  chr1:245753467-245753500
  hypo
aaggggaggccgaggcgccggtggaagcacaaa

SEQ ID NO: 39355 - DNA, 197 bp, Homo sapiens; identical to SEQ ID NO: 14356
  chr1:245772643-245772840
  hypo

SEQ ID NO: 39356 - DNA, 154 bp, Homo sapiens
  chr1:245986642-245986796
  hypo
gtgcttgctcgctctcgctctctctctctcttttctaaggctccaggcatccgtccctggagaagtgcaccttgggaaggcgatgaaatgaaagaagggcacatcctcctttaaccccaaacatctgaagtcagcgccgcgcactactgcgatt

SEQ ID NO: 39357 - DNA, 109 bp, Homo sapiens
  chr1:246172251-246172360
  hypo
agttcaagtgccagccgtaccgcttgctagcagcgtggccttgggcaagtcacttggcttcggtttcctcctcttagctgcaaaatatgaaaaacgggcctgctatgaa

SEQ ID NO: 39358 - DNA, 30 bp, Homo sapiens
  chr1:246330476-246330506
  hypo
tcattcaactaacaacgagcattttggctg

SEQ ID NO: 39359 - DNA, 30 bp, Homo sapiens
  chr1:246363735-246363765
  hypo
gaagatggagaacagcgtagatgctgagca

SEQ ID NO: 39360 - DNA, 132 bp, Homo sapiens
  chr1:246488175-246488307
  hypo
tgcaccatcacacaccgtcaacattctgggctcagtgactcatccctgaaagctgcaggatctatttaggttaatttaggatctttcatgaacaaggaaggagaaggagtcagggggcgggaaggagggaga

SEQ ID NO: 39361 - DNA, 30 bp, Homo sapiens
  chr1:246991095-246991125
  hypo
tcttcagtgtcggctcgagtactatttttt

SEQ ID NO: 39362 - DNA, 163 bp, Homo sapiens
  chr1:247185348-247185511
  hypo
tacgaaaaatgttagcgtattccaccttgctcaaggtcctaggtagcagacggtaatactgtactattgggtaatacatgccaatcatctctagcaatccttattcccagtggcattacactccagagagtgtggagaatattgatcccgtatgttatatttt

SEQ ID NO: 39363 - DNA, 245 bp, Homo sapiens
  chr1:247589856-247590101
  hypo
tcagctttcttgatccgttgacattaccatgaccaggaccaccttcctagtcatggtttggccatgaaggactgactgcccacagggccgcagtggtggtgaagacccaggtcctggtcacagggacttgaggtctggctgtgggacagtccggaaacaagtgcagatgtcggggagggggtcatgggctctgacaaggaaacttgcagagtatccaaagcacaaggggacgaacctgttcacca

SEQ ID NO: 39364 - DNA, 30 bp, Homo sapiens
  chr1:247615881-247615911
  hypo
attcatgctgatctccgctgtcatgaccac

SEQ ID NO: 39365 - DNA, 30 bp, Homo sapiens
  chr1:247694897-247694927
  hypo
ccatgtgccggagggcgctcttcacctccg

SEQ ID NO: 39366 - DNA, 172 bp, Homo sapiens; identical to SEQ ID NO: 14360
  chr1:247709336-247709508
  hypo

SEQ ID NO: 39367 - DNA, 180 bp, Homo sapiens; identical to SEQ ID NO: 14361
  chr1:247752018-247752198
  hypo

SEQ ID NO: 39368 - DNA, 32 bp, Homo sapiens
  chr1:248002278-248002310
  hypo
ttgactcagacttgtcgtcctgtgttcatgct

SEQ ID NO: 39369 - DNA, 94 bp, Homo sapiens
  chr1:248026872-248026966
  hypo
acttcacctacaaggccgtataacaatgtaacaaaactgcatttgtaccccatgaatatatacaaaaaataaaataaatcgataaaacaggaca

SEQ ID NO: 39370 - DNA, 294 bp, Homo sapiens
  chr1:248027965-248028259
  hypo
gaggccaagcactgacgatgtgatccacggtgtcacctcaggagaaagtggaaatgcagaggcagcgcttcagattggagtttgagaagcatcgtggctttctggcccaggaggagcaacggcagctgaggcggctggaggcggaggagcgagcgacgctgcagagactgcgggagagcaagagccggctggtccagcagagcaaggccctgaaggagctggcggatgagctgcaggagaggtgccagcgcccggccctgggtctgctggaggtgaggccgggtgccagaaaag

SEQ ID NO: 39371 - DNA, 197 bp, Homo sapiens
  chr1:248034262-248034459
  hypo
agtatattcatgagccgtatcagagtcacggccacccatagagcctgcaccaccacgcccagaagaacgaggattagtatattcatgagcagtatcagagtcacggccacccatagagtctacatttggttagactatgggcttaaaactgtaggtcatctcttattagctgatatgagtaacgttacttccagtaa

SEQ ID NO: 39372 - DNA, 45 bp, Homo sapiens
  chr1:248047093-248047138
  hypo
taaattatgacaggccgggcgtggcggctcacgactgtaatccca

SEQ ID NO: 39373 - DNA, 30 bp, Homo sapiens
  chr1:248047898-248047928
  hypo
agggtctcactctgtcgcccaggctgaggt

SEQ ID NO: 39374 - DNA, 30 bp, Homo sapiens
  chr1:248074318-248074348
  hypo
ccctcttgtatcgttcgtaatatccagcag

SEQ ID NO: 39375 - DNA, 63 bp, Homo sapiens
  chr1:248074864-248074927
  hypo
tattagtcccaatgtcgcagagggtgtacaccgcctctgtaatatccacgggggaaaaggatg

SEQ ID NO: 39376 - DNA, 36 bp, Homo sapiens
  chr1:248098787-248098823
  hypo
aatgtatgggccaggcgcggtggatcacgcctgtaa

SEQ ID NO: 39377 - DNA, 30 bp, Homo sapiens
  chr1:248099290-248099320
  hypo
tcatgcagtgtcctgcgtctgtcatctgct

SEQ ID NO: 39378 - DNA, 282 bp, Homo sapiens
  chr1:248099765-248100047
  hypo
ccgtggtcaccatggcgatgtggtgcccacggtcagaggtggcattggggaagtcagccactcggacgctggtgctcctcactgacttctcatcgctcctgtgctcgctgtagacggtgtttaactcagaatccacatgcaggatgttctcggttttcaggtgtgcgtgggtcagccggttctcgtgcagaaatctaagggtgtggcagagctggtgggccatgtgccagacatgtgggaggggaatggctggatgttattctccttcgggaactcaagggt

SEQ ID NO: 39379 - DNA, 203 bp, Homo sapiens
  chr1:248328673-248328876
  hypo
cacccgtgactcgccaggctccgtctgagacccgtgctaggctcgctctgtccctgcgttccctcgcctctctctccagttgtttttcccattctcacaccagcactgcaccaaggtgagaggagccccgctggaaaggaaacattcggactccggtttcagcacctcctccagaagcacaggatgtgcgaccttcagccttt

SEQ ID NO: 39380 - DNA, 30 bp, Homo sapiens
  chr1:248329246-248329276
  hypo
catttgtgaagttcacgcttggtgaaataa

SEQ ID NO: 39381 - DNA, 24 bp, Homo sapiens
  chr1:249121618-249121642
  hypo
gagccaccacgcccagcctagctt

SEQ ID NO: 39382 - DNA, 233 bp, Homo sapiens
  chr2:314488-314721
  hypo
actcaaaatttggagcggatgaggggcaggagcagctcactgattgggccccgactttcccaggtgtctacactgctagagctacgctcacagctgcggacgtgcacgcgctgccagcaactgcaccgagcactcagcgcacacctgctcccacgcgccacgcactcgtgcaggtgccgggagctccgtcgtcagcagccagaggaaagccctgttctcgtggaacctccatc

SEQ ID NO: 39383 - DNA, 70 bp, Homo sapiens
  chr2:484928-484998
  hypo
tgctgagactgcaggcgcttcatggcgcgtgtcctgggggttcacagtgcgaacccgaagggtggtttcc

SEQ ID NO: 39384 - DNA, 157 bp, Homo sapiens
  chr2:496214-496371
  hypo
gaagctacaggaggccgagcggctgttgacgcccaggaccgtgggcagcaccttgcagggggaaaccggcttcctccggtctcccagaagaagagttcaggccttctctcctctctccaggcctccagctcttccccatccccgctctcagcggagg

SEQ ID NO: 39385 - DNA, 69 bp, Homo sapiens
  chr2:503076-503145
  hypo
gggacgcaggaatcacgggacgcgggaatcacgggacgcgggaatcacgggacgcgggaatcacgggac

SEQ ID NO: 39386 - DNA, 142 bp, Homo sapiens
  chr2:503859-504001
  hypo
tttgctggggtactgcggtggccacaactcgcatggagcgccgcctgggaaagggaggagaggacgcatgagatcagaaacactggctgccgtaaacacttacaatgaaaataacgtaacaaataagcgaaaggtaaaatgt

SEQ ID NO: 39387 - DNA, 64 bp, Homo sapiens
  chr2:522014-522078
  hypo
ggaacccacggaacccgatggcatggaaccagaaccgatggcaccgaaccggaacctgacggca

SEQ ID NO: 39388 - DNA, 49 bp, Homo sapiens
  chr2:647861-647910
  hypo
gctcccggcctgggtcggggtcagtcgctggcaccgaggtttctatacg

SEQ ID NO: 39389 - DNA, 61 bp, Homo sapiens; identical to SEQ ID NO: 14369
  chr2:720836-720897
  hypo

SEQ ID NO: 39390 - DNA, 30 bp, Homo sapiens
  chr2:925888-925918
  hypo
caagctggtggcagacggcccacatggcct

SEQ ID NO: 39391 - DNA, 30 bp, Homo sapiens
  chr2:951526-951556
  hypo
aacagggaggcctcccgtagtctggggtcc

SEQ ID NO: 39392 - DNA, 49 bp, Homo sapiens
  chr2:973406-973455
  hypo
ttaactagaccttaccgagatcaggacctgcctgcgttgccaacgtcac

SEQ ID NO: 39393 - DNA, 156 bp, Homo sapiens
  chr2:1019358-1019514
  hypo
gcccagccctggctccgtcactgtgccactgtcagcacatctgcaccccgcgtagtctggggacatttagacagccttaggctcaatgtcaagtggatccagaacctcggcagtctgcaaggagagttgtgtgtgtgccatcgatgtccgcttaca

SEQ ID NO: 39394 - DNA, 108 bp, Homo sapiens
  chr2:1204810-1204918
  hypo
ccatagctaaggacccgaggtatgagaagcgctggctggacaccttgtccgtgcctctgtccatggctcgcatctcaaggtacaaagccggaacggaaaaattaaggt

SEQ ID NO: 39395 - DNA, 62 bp, Homo sapiens
  chr2:1424987-1425049
  hypo
ccctggaccaaaagccgtgcaaacctctctgtaaaaccatcctaagacgtaactctgtgcac

SEQ ID NO: 39396 - DNA, 30 bp, Homo sapiens
  chr2:1635811-1635841
  hypo
ctgttacagcgatcccgcacagtggctgct

SEQ ID NO: 39397 - DNA, 30 bp, Homo sapiens
  chr2:1637034-1637064
  hypo
ggctcttgttcaggacgtggacgcaaccag

SEQ ID NO: 39398 - DNA, 33 bp, Homo sapiens
  chr2:1689084-1689117
  hypo
gaagacaaggaaaaccgccgtgggcgagcatga

SEQ ID NO: 39399 - DNA, 41 bp, Homo sapiens
  chr2:1893020-1893061
  hypo
ctttggactcgtcctcgtctatcctccggggtttcattttg

SEQ ID NO: 39400 - DNA, 30 bp, Homo sapiens
  chr2:1950712-1950742
  hypo
agatgcagctgtgcacggatggctcctcca

SEQ ID NO: 39401 - DNA, 156 bp, Homo sapiens
  chr2:1972852-1973008
  hypo
agctacatcagtccacggtatgaacagaagtgaaacagaagtccctgattagaaatcaccctccagcaccactggctttttctcaccctgtgaaggcactggaagcaggactacagtgatgctgggccccggcgggggatgcgggcaggtgggagg

SEQ ID NO: 39402 - DNA, 30 bp, Homo sapiens
  chr2:2030884-2030914
  hypo
ccccatcgccgctgccgccacagactgagc

SEQ ID NO: 39403 - DNA, 30 bp, Homo sapiens
  chr2:2190112-2190142
  hypo
gcagccgggccttcccgagtcctgcggtcc

SEQ ID NO: 39404 - DNA, 106 bp, Homo sapiens
  chr2:2402544-2402650
  hypo
ggctcttccttttgacgtaaggccacccacccaccccctttcttgcgtcacatttccagtaattgactccgtaactggacattttttctcccgccgtatctccctg

SEQ ID NO: 39405 - DNA, 189 bp, Homo sapiens; identical to SEQ ID NO: 14371
  chr2:2522670-2522859
  hypo

SEQ ID NO: 39406 - DNA, 50 bp, Homo sapiens
  chr2:2575682-2575732
  hypo
gagctttcttcctggcggggttgctttgtcctgcgcgacagcaggagttg

SEQ ID NO: 39407 - DNA, 83 bp, Homo sapiens
  chr2:2665528-2665611
  hypo
ggcagccaggcgctgcggctgggtccagtgagggcacgcactctgctgattttggtttttttttttcttgaggcggagtctcg

SEQ ID NO: 39408 - DNA, 447 bp, Homo sapiens
  chr2:2725048-2725495
  hypo
tgcatctccacaccccggccatgccatcggcacctgcacctccacaccccggccacgccaccagcacctgcacctccacaccccagccacaccgcccgtacctatgtctccacaccccagccatgccatcagcacctgcacctccacaccccggccacaccaccagcatctgcacctccacaccccagccacagcactggcacctatgtctccacaccccggccatgccacccgcacctgggtctccacaccctggccatgctgccggcacctgcacctccacaccccggccacgccaccagcacctgcacctccactccccagccacacctccagcacctatgtctccacaccccagccatgccatcggcacctgcacctccacaccccggccacaccaccagcacctgcacctccacaccccagccacaccgccggcacctatgt

SEQ ID NO: 39409 - DNA, 92 bp, Homo sapiens
  chr2:2730695-2730787
  hypo
ataagtccttaatgacgcacctaaaggaaaagcaaacagttgttttgaaatgagggaaggggctaggaaagggatcgcgtccacactgtctg

SEQ ID NO: 39410 - DNA, 30 bp, Homo sapiens
  chr2:2753113-2753143
  hypo
gtgaccacagtcaggcggctacaggccagg

SEQ ID NO: 39411 - DNA, 40 bp, Homo sapiens
  chr2:2799315-2799355
  hypo
cggctcctgacaccccgggatggtgcgggcggctcctgac

SEQ ID NO: 39412 - DNA, 30 bp, Homo sapiens
  chr2:2844886-2844916
  hypo
taaaaccagtattgccgattctgaaatccc

SEQ ID NO: 39413 - DNA, 110 bp, Homo sapiens
  chr2:2854353-2854463
  hypo
ctgcgtgtcagggaacggctcctctgctgctcctgatgcctggccacccgtcccggtccacccctcgcgaggaaggccaggcctccgctcctctgcggagcctttcagga

SEQ ID NO: 39414 - DNA, 30 bp, Homo sapiens
  chr2:2939589-2939619
  hypo
ggtcaaaaataaaaccgtttcctggccccg

SEQ ID NO: 39415 - DNA, 92 bp, Homo sapiens
  chr2:2941866-2941958
  hypo
gggattacaggtgtgagccaccgtgcccagccccttttgtgtctgatgcccatgactgaattcatttctctttctctcgcatgttcacgtca

SEQ ID NO: 39416 - DNA, 105 bp, Homo sapiens
  chr2:3050299-3050404
  hypo
gtatgtgcatatgtgcgtaagggccacgccgggagcctgctttgggtcagacccagctcctcatcctgcagccgcagctatgatgacggtcgtcagctcccagga

SEQ ID NO: 39417 - DNA, 30 bp, Homo sapiens
  chr2:3176032-3176062
  hypo
ttgtgttatgacacacgatataaaaggctc

SEQ ID NO: 39418 - DNA, 30 bp, Homo sapiens
  chr2:3285842-3285872
  hypo
gccagttggtgcagccgtcaagtgaaggag

SEQ ID NO: 39419 - DNA, 30 bp, Homo sapiens; identical to SEQ ID NO: 14373
  chr2:3331786-3331816
  hypo

SEQ ID NO: 39420 - DNA, 33 bp, Homo sapiens
  chr2:3352677-3352710
  hypo
ccagtggagccttcccggcgtctctcctggtct

SEQ ID NO: 39421 - DNA, 181 bp, Homo sapiens
  chr2:3833780-3833961
  hypo
catgcagatgtgtcccgcttgtgcacagggcctctcgtgtgggtgtgtcccgcctgtgcacggaacctctgatgtggatgtttcccgcccccgccctccacgtgcagtgaacctctcgtgcagatgtgtcccgcctgtgcacggagcctccggtgtgcgtgtgtcccgcctgtgcacggag

SEQ ID NO: 39422 - DNA, 129 bp, Homo sapiens
  chr2:3990793-3990922
  hypo
agagcttcctgaggtcggccggggccagggattgccctaattacacttcttcctctgcccagtctctccctgctacctgcaccgatactgacaccaaatgaagttctcgcaccccggactccctctctg

SEQ ID NO: 39423 - DNA, 30 bp, Homo sapiens
  chr2:4130725-4130755
  hypo
agtgtcagatggtctcgaaagagggacaca

SEQ ID NO: 39424 - DNA, 57 bp, Homo sapiens; identical to SEQ ID NO: 14375
  chr2:5704308-5704365
  hypo

SEQ ID NO: 39425 - DNA, 34 bp, Homo sapiens
  chr2:6024520-6024554
  hypo
tttgagatggagtctcgctctgtcgcccaggctg

SEQ ID NO: 39426 - DNA, 30 bp, Homo sapiens
  chr2:6809103-6809133
  hypo
agctgctgccgtgctcgggcccagcaagtg

SEQ ID NO: 39427 - DNA, 30 bp, Homo sapiens
  chr2:6989494-6989524
  hypo
ctgagggagatgcagcgagcccatcatgac

SEQ ID NO: 39428 - DNA, 30 bp, Homo sapiens; identical to SEQ ID NO: 14376
  chr2:7036178-7036208
  hypo

SEQ ID NO: 39429 - DNA, 89 bp, Homo sapiens
  chr2:7164511-7164600
  hypo
aatggaagaagatgacgcgcccatcaagcgctgccccaagtgcaaagtctacatcgagcgagacgaaggctgcgcgcagatgatgtgca

SEQ ID NO: 39430 - DNA, 387 bp, Homo sapiens
  chr2:7172412-7172799
  hypo
agctctgctggaatccgcgccccttgcagctctgctggaatccgcgccccttgcagctctgctggaatccgcgccccttgcagctctgctcgaatccgcgccccttgcagctctgctctggctgctgtgacaaagcgctgcagactgggtggctcagaacagcagaaatgtattggctcagtcctggagctcagaattctgaaatcgaggtgtcagcagggccctgcctgctctgaaacctgtaggagagtccctccggccttgtccagcttctgtggttcgccagccatctgcggcattcctggacagatcgatgcgtcactgcaatcctccgtcttcctccggctgcctcttccctgtgcgtctccacctcgtcttccatcattg

SEQ ID NO: 39431 - DNA, 17 bp, Homo sapiens
  chr2:7237246-7237263
  hypo
cccgcccctcatggtgg

SEQ ID NO: 39432 - DNA, 24 bp, Homo sapiens
  chr2:7605198-7605222
  hypo
aaaatgtaccgagttgtttctacc

SEQ ID NO: 39433 - DNA, 30 bp, Homo sapiens
  chr2:8768562-8768592
  hypo
cccgaggcagacgcccgggagtcatgcact

SEQ ID NO: 39434 - DNA, 171 bp, Homo sapiens; identical to SEQ ID NO: 14378
  chr2:8833973-8834144
  hypo

SEQ ID NO: 39435 - DNA, 24 bp, Homo sapiens
  chr2:8834789-8834813
  hypo
atcgctttgcagcaacggaaatta

SEQ ID NO: 39436 - DNA, 23 bp, Homo sapiens
  chr2:8834873-8834896
  hypo
gcaaacgccgcaaataattttgc

SEQ ID NO: 39437 - DNA, 28 bp, Homo sapiens
  chr2:8835589-8835617
  hypo
gaccccctgcgcccggcctgaccacaca

SEQ ID NO: 39438 - DNA, 30 bp, Homo sapiens
  chr2:8860441-8860471
  hypo
gaggatggtgtagcccgacaggaattttga

SEQ ID NO: 39439 - DNA, 30 bp, Homo sapiens
  chr2:8870364-8870394
  hypo
agcctctccctgtagcgtcacaggctgtgc

SEQ ID NO: 39440 - DNA, 92 bp, Homo sapiens; identical to SEQ ID NO: 14381
  chr2:8978147-8978239
  hypo

SEQ ID NO: 39441 - DNA, 199 bp, Homo sapiens
  chr2:9134235-9134434
  hypo
atcacaccagccctgcggactctaaacatgctccgtgccaagaatggtcctaggcagacgggacacaaagatgagtaagtggaggtccttattcttaaggaatttagtttgggagggagacttgtaaagcaaacaaaaaaaaaatcaatgctccaggtgttatcagagtagaatacagtgaaagcggggcatgatggga

SEQ ID NO: 39442 - DNA, 180 bp, Homo sapiens; identical to SEQ ID NO: 14383
  chr2:9352635-9352815
  hypo

SEQ ID NO: 39443 - DNA, 242 bp, Homo sapiens
  chr2:9960219-9960461
  hypo
ggtgtcggcagtcaccgtgggcctctcttctctcttcatacaccaggaaccaacccagccaggttaaaggacttgcccaaggtcacgcggaggaaagctggttggtgccaagtggttaggagagaaagggtgaggtcatgagagcaaacctaagagggctgctaccgactcccaggatgaaatcacagatgaagtcacagaatcggaatgctggctttgggagagaccgccctgctccttca

SEQ ID NO: 39444 - DNA, 57 bp, Homo sapiens
  chr2:9960734-9960791
  hypo
tggcatttcagggagcggcaagccagttgctgccaacccgcccgatgactgtgtcta

SEQ ID NO: 39445 - DNA, 16 bp, Homo sapiens
  chr2:10115730-10115746
  hypo
cgcggtggctcttgcc

SEQ ID NO: 39446 - DNA, 120 bp, Homo sapiens
  chr2:10151717-10151837
  hypo
gtgcgtacgggcgggtcagatggacaggatcgcgtacgggcgggtcaggtggacagtattggcgtgcatacgggcaggtcagatggacaggatcgcgtacaggcgggtcaggtggacagg

SEQ ID NO: 39447 - DNA, 120 bp, Homo sapiens
  chr2:10151897-10152017
  hypo
tgcgtacaggcgggtcaggtgggcaggcatgtgtgtgggagagtcaggtggacaggattgagtacgggccggtcaggtggacaggattgcgtacgggcgggtcaggtgagcaggcgtgcg

SEQ ID NO: 39448 - DNA, 420 bp, Homo sapiens
  chr2:10153019-10153439
  hypo
gcgtatggtcgggtcatgtgggcaggcgtgcttatgggcaggtcaggtgggcaggtgtgcatgtgggagagtcaggtggacaggattgaatatgggcgggtcaggtgcgcagacatgcgtatggccgggtcacgtgggcaggcgtgcgtttgggcgggtcaggtgggcaggggtgcatatgggcgggtcaggtggacaggcgcacgtatgggtgagtaagatggacaggcatgtgtgtgggagagtcaggtgaacaggattgcttatgggctagtcaggtggacaggtgtgcgtatgggtgtgcctatgggagagtcaggtggacaggattgcgtatagccggatcaggtgggcaggcatgcgtatgagcgagtcaggtgggcagacatgcgtatgggcgggtcaggtggacaggcgtgt

SEQ ID NO: 39449 - DNA, 120 bp, Homo sapiens
  chr2:10154039-10154159
  hypo
ggtggacaggattgcgtatgggagagtcaggtggacagccctgcgtatgagcgagtcaggtggacaggattgcttatgggcaagtcaggtggacaggcgtgcgtatgagcgagtcaggtg

SEQ ID NO: 39450 - DNA, 322 bp, Homo sapiens
  chr2:10156308-10156630
  hypo
tggacaggcgtgtgtatgggtgagtcaggtggaccactgtgtgtacgggcgagtcaggtggaccggcgtgcatatgggcaggtcaggtgggtaggcgtgtgtatggatgtgcatatgggcgggtcaggtggacaggtgtgtatatgggtgtacatgtgtgcacaggtgctactttactctgtgttcaacacgtgttcgtggacgtgctccaggcccaaggcgaaggaataggatgtagcaggggcagggtctccgccccatactcagagtccttgggctccgggaagacacaaccgataagtggttacggggatgcctggga

SEQ ID NO: 39451 - DNA, 30 bp, Homo sapiens
  chr2:10238076-10238106
  hypo
agcacctgttatgtgcgaggattgcgctct

SEQ ID NO: 39452 - DNA, 30 bp, Homo sapiens
  chr2:10278078-10278108
  hypo
tgttagtgcaggggccgctgcagcaaaggg

SEQ ID NO: 39453 - DNA, 51 bp, Homo sapiens
  chr2:10281143-10281194
  hypo
gctggggctgcatctcgcccacgtcgctgtcatgtgcggggcccacgttgt

SEQ ID NO: 39454 - DNA, 77 bp, Homo sapiens; identical to SEQ ID NO: 14389
  chr2:10344641-10344718
  hypo

SEQ ID NO: 39455 - DNA, 30 bp, Homo sapiens
  chr2:10408242-10408272
  hypo
ggcccacaggaggggcgaggggcggggagg

SEQ ID NO: 39456 - DNA, 30 bp, Homo sapiens
  chr2:10526275-10526305
  hypo
gggcctccctgatgtcggtttagacatgtg

SEQ ID NO: 39457 - DNA, 30 bp, Homo sapiens
  chr2:10577316-10577346
  hypo
agggtagggaaacaccgaatgaatgctggg

SEQ ID NO: 39458 - DNA, 30 bp, Homo sapiens
  chr2:10600641-10600671
  hypo
gtagataaaaccagacgggtcagattccct

SEQ ID NO: 39459 - DNA, 30 bp, Homo sapiens
  chr2:10911393-10911423
  hypo
gcccatttactgatccgacagccttgatcc

SEQ ID NO: 39460 - DNA, 226 bp, Homo sapiens
  chr2:10924927-10925153
  hypo
ctcttaaaaggcccacgggtgcaccagggctgaggtctgatgggaaggacttgactccaggtgcagagatgcacaggctcaagagagtaaaccaggactgctgcccgcacagcttccctcccgggcactcacctcgccatccctgccgtcccaaggctctctctcaacgatggtagggaaagccccgcctcctacaggtgccgtggagccacgcccaaaagagagc

SEQ ID NO: 39461 - DNA, 88 bp, Homo sapiens
  chr2:11538637-11538725
  hypo
cagtcaatagttctccgttctggaaaccgactccagtcaggggctgtgtctcatgcctgtaatcccagctactcggcaggctgagttg

SEQ ID NO: 39462 - DNA, 148 bp, Homo sapiens
  chr2:11538785-11538933
  hypo
tcaaaaaaaacaaataaataaaatgacattgagtaaactaaaaagtcatatttttcaaaaagctaactccagtccagtttatatatacacacgtaaatacacacacacacacacacacacacacagcagtccacgtatgggccgcccc

SEQ ID NO: 39463 - DNA, 126 bp, Homo sapiens
  chr2:11678173-11678299
  hypo
gcacggggcactccacgtacagaccgcgtacagtgtgcctccccaacgagtaaagccctggcactagggatgcttcagagctgcagatgctcgctcgggcagaacctccagcgggtgccacccctg

SEQ ID NO: 39464 - DNA, 120 bp, Homo sapiens
  chr2:11886072-11886192
  hypo
catttcaccaccagacgttatgtggctcattgtttatccgctgcctgcctcccggctggagaggcgcagggagctgcctgtccctcctgttcagagccaccgttccgcacctggaccacc

SEQ ID NO: 39465 - DNA, 34 bp, Homo sapiens
  chr2:12092493-12092527
  hypo
agaggccacatgaaacgaccgaaagtggcttgct

SEQ ID NO: 39466 - DNA, 117 bp, Homo sapiens
  chr2:12103180-12103297
  hypo
tcagccctttgaatacggcacaaatgtttttcatcagttataacagtgaaaccctggccattggaaaggtaataaaatctctgacccaaggaaagaatgtttcgcacatacctagca

SEQ ID NO: 39467 - DNA, 30 bp, Homo sapiens
  chr2:12303872-12303902
  hypo
tctcctgcctgccctcggccacctccagcc

SEQ ID NO: 39468 - DNA, 76 bp, Homo sapiens
  chr2:12355766-12355842
  hypo
gagtgccactctaaacgatgatgctcttgcactccctattaaccaatgcctaaaaacagtcacctcaaaactgttt

SEQ ID NO: 39469 - DNA, 19 bp, Homo sapiens
  chr2:15579677-15579696
  hypo
gtctacagctcccagcgtg

SEQ ID NO: 39470 - DNA, 30 bp, Homo sapiens
  chr2:15960211-15960241
  hypo
ggtatgtagcgcactcggcacatggcaagg

SEQ ID NO: 39471 - DNA, 68 bp, Homo sapiens
  chr2:18453289-18453357
  hypo
cgtgtagcaagaggccggggtctggtctgcagccactgacttgggggcttgggcggctgcagtttcac

SEQ ID NO: 39472 - DNA, 39 bp, Homo sapiens
  chr2:20253274-20253313
  hypo
taagatcaggggagccgggcgcggtggctcacgcctgta

SEQ ID NO: 39473 - DNA, 42 bp, Homo sapiens; identical to SEQ ID NO: 14394
  chr2:20431336-20431378
  hypo

SEQ ID NO: 39474 - DNA, 142 bp, Homo sapiens; identical to SEQ ID NO: 14395
  chr2:20432683-20432825
  hypo

SEQ ID NO: 39475 - DNA, 30 bp, Homo sapiens
  chr2:20442384-20442414
  hypo
aaggcaggggcatctcgccatgtttcccag

SEQ ID NO: 39476 - DNA, 30 bp, Homo sapiens; identical to SEQ ID NO: 14396
  chr2:20456198-20456228
  hypo

SEQ ID NO: 39477 - DNA, 30 bp, Homo sapiens
  chr2:20553860-20553890
  hypo
tttgggaatgtgtctcgttggcctgttgag

SEQ ID NO: 39478 - DNA, 39 bp, Homo sapiens; identical to SEQ ID NO: 1545
  chr2:20642609-20642648
  hypo

SEQ ID NO: 39479 - DNA, 21 bp, Homo sapiens
  chr2:24584330-24584351
  hypo
tggcacagtggctcacgcttg

SEQ ID NO: 39480 - DNA, 63 bp, Homo sapiens
  chr2:24775908-24775971
  hypo
agtggtgagagcagacgttcatgtctcgttcgtcatcttaggagacaacgtttaatcttttgt

SEQ ID NO: 39481 - DNA, 44 bp, Homo sapiens
  chr2:25241776-25241820
  hypo
gacttttcaactttacgatggtgcaaaagcgatacacattccat

SEQ ID NO: 39482 - DNA, 28 bp, Homo sapiens
  chr2:25439965-25439993
  hypo
gacagagaaagaccgtttctaaataagt

SEQ ID NO: 39483 - DNA, 77 bp, Homo sapiens
  chr2:26372967-26373044
  hypo
cagagaaatcatggccgcatcagtgaaatccttagtgacagtgtggtgccagacattccgtccgctgtcacaacagc

SEQ ID NO: 39484 - DNA, 142 bp, Homo sapiens
  chr2:26607241-26607383
  hypo
catattgcccgaggtcgtgtgatcaatggcggaagcaggactggaatttggagctctgttcagctgagcaggcgtgtattgtataacctcctgtgtgcttagagacactgagatgtggtatgccagtcgcacctcagagtct

SEQ ID NO: 39485 - DNA, 42 bp, Homo sapiens; identical to SEQ ID NO: 14399
  chr2:27090590-27090632
  hypo

SEQ ID NO: 39486 - DNA, 24 bp, Homo sapiens
  chr2:27433305-27433329
  hypo
ctttttttttggagacggagtctc

SEQ ID NO: 39487 - DNA, 135 bp, Homo sapiens
  chr2:27578363-27578498
  hypo
gcaacaagaacaaaactccgtatcaaaaaaaaaaaaaatacacttctcatggaaggcagcagcaggatgtaatggtacaaattctggatacacagtaaaggaatagatgatcagtaaattcgtactgagtttcta

SEQ ID NO: 39488 - DNA, 141 bp, Homo sapiens; identical to SEQ ID NO: 14400
  chr2:27887525-27887666
  hypo

SEQ ID NO: 39489 - DNA, 212 bp, Homo sapiens
  chr2:28676953-28677165
  hypo
gccctgtgaagggcccgcttggagccatgcatgtctgggcctgagggtggcggtgcctacgtgaggccctgcggtctcttcaggagctccccgagaggggcacttggccactgttggagctgagaggggcctggcccagctcacccgcctctcctgcttctcacccagcccctgctgctgagagctctggcagcctccgtgtgcacagcagg

SEQ ID NO: 39490 - DNA, 40 bp, Homo sapiens
  chr2:29462699-29462739
  hypo
caatgggacaaagaacgttggctcccgctgtggtatgaag

SEQ ID NO: 39491 - DNA, 81 bp, Homo sapiens
  chr2:29504693-29504774
  hypo
gatgctgctcacgtacgactcagaaaatgtaccatctcattcaggcaacagactgttaatggacagcgaatataatgcctt

SEQ ID NO: 39492 - DNA, 87 bp, Homo sapiens
  chr2:30368623-30368710
  hypo
ttatctcctggaaaactcacttattaaaagataactagtccttttgcctttgatgctcaggtaaacttcagacgaactaaatgaaaa

SEQ ID NO: 39493 - DNA, 37 bp, Homo sapiens
  chr2:30497257-30497294
  hypo
tacaggcgtcagccaccgcacccggcctgacagactt

SEQ ID NO: 39494 - DNA, 79 bp, Homo sapiens
  chr2:32263984-32264063
  hypo
gggatgataggcgtgggccatcgcgcccggcgaagggtttcttaattttaatatgcggtttttacgtagcaacatccca

SEQ ID NO: 39495 - DNA, 18 bp, Homo sapiens
  chr2:32275102-32275120
  hypo
aaaaaatatctgggccgg

SEQ ID NO: 39496 - DNA, 44 bp, Homo sapiens
  chr2:32472347-32472391
  hypo
gacaagcttaacctgcgtatatatttattttttttaattttttt

SEQ ID NO: 39497 - DNA, 30 bp, Homo sapiens
  chr2:32494200-32494230
  hypo
aggcatgagccaccacgctcagtctcgtca

SEQ ID NO: 39498 - DNA, 180 bp, Homo sapiens
  chr2:32504317-32504497
  hypo
gcgtgagccaccgcgccccggccattttcaaatttttattacacttcgtgcaccagttattttccagtgaccagacttactggctgctatgaaatcataaattatgtttacagaaatttcagtctgagaaagaacctagattttcctttttttttttttttttttttgagactgagtctc

SEQ ID NO: 39499 - DNA, 27 bp, Homo sapiens
  chr2:32551637-32551664
  hypo
tgtgagccaccgcgcccagcctaccct

SEQ ID NO: 39500 - DNA, 22 bp, Homo sapiens
  chr2:33313226-33313248
  hypo
atatggacagtgagccgggcgc

SEQ ID NO: 39501 - DNA, 30 bp, Homo sapiens
  chr2:33315571-33315601
  hypo
gtactaaatgctgttcgtgaattacccatt

SEQ ID NO: 39502 - DNA, 34 bp, Homo sapiens
  chr2:33530065-33530099
  hypo
tagtgtgggagataacgaaaaaatacaataaatg

SEQ ID NO: 39503 - DNA, 70 bp, Homo sapiens
  chr2:33532830-33532900
  hypo
tttagggtcagtacccggaagcattttaattctgggtgaacagtcattataataacgtggttttatttga

SEQ ID NO: 39504 - DNA, 105 bp, Homo sapiens
  chr2:33653875-33653980
  hypo
aggtgtgagccaccgtgaccgacctgatctcatttcttaaaccaaaccccctgattttgatgtttatactcagttcttcttcctttttcgcgtacctgacacatt

SEQ ID NO: 39505 - DNA, 66 bp, Homo sapiens
  chr2:36824207-36824273
  hypo
ccccaccagaccatgcgatcgttaccatcagtaagcagggcccttcgttttcgtctctgtggcggc

SEQ ID NO: 39506 - DNA, 21 bp, Homo sapiens
  chr2:38365727-38365748
  hypo
ctcccccgtcctgtcttaaag

SEQ ID NO: 39507 - DNA, 177 bp, Homo sapiens
  chr2:42281964-42282141
  hypo
taggcctgagggatccggctccctggccaggttagcgttctgccccaggttggaatagaggaaggatgtgtctccaaaggctggattcctgagccactggtttccctctgccacaggtttttcttcacatacctcctgcctcacagtgccccgccttcactgcgtcctctgctggac

SEQ ID NO: 39508 - DNA, 30 bp, Homo sapiens
  chr2:42282578-42282608
  hypo
gagggtgaatgaccccgcccaattaggcta

SEQ ID NO: 39509 - DNA, 30 bp, Homo sapiens
  chr2:43227374-43227404
  hypo
ggcagccagttctgccgtttttggccaggc

SEQ ID NO: 39510 - DNA, 189 bp, Homo sapiens; identical to SEQ ID NO: 4967
  chr2:43408168-43408357
  hypo

SEQ ID NO: 39511 - DNA, 39 bp, Homo sapiens; identical to SEQ ID NO: 14407
  chr2:43412683-43412722
  hypo

SEQ ID NO: 39512 - DNA, 107 bp, Homo sapiens
  chr2:43812086-43812193
  hypo
tacatgcacagtgcacgccaaatactgagacctcagccttcttccctcactcagcaaccagaatattaagacaatggtttggaagagtcttccgtggcaaatccagt

SEQ ID NO: 39513 - DNA, 40 bp, Homo sapiens; identical to SEQ ID NO: 14408
  chr2:43824353-43824393
  hypo

SEQ ID NO: 39514 - DNA, 87 bp, Homo sapiens
  chr2:44224206-44224293
  hypo
tctaaaacaaaacaaaaaaaccacgtcgctgccttcacagggcttacagactggatcggttccctgtgcacacgtgggaagctgaga

SEQ ID NO: 39515 - DNA, 45 bp, Homo sapiens
  chr2:44497699-44497744
  hypo
aggtgcaactttcttcggtcgtctcgaatccgggttcatccgaca

SEQ ID NO: 39516 - DNA, 30 bp, Homo sapiens
  chr2:47200712-47200742
  hypo
cacacaaacaaatggcgtgcttccaaacaa

SEQ ID NO: 39517 - DNA, 30 bp, Homo sapiens
  chr2:47567513-47567543
  hypo
gaaggtcttgtgtgtcgattagagacaagc

SEQ ID NO: 39518 - DNA, 30 bp, Homo sapiens
  chr2:47574359-47574389
  hypo
agctttcttttccgacgccagtgagaccac

SEQ ID NO: 39519 - DNA, 120 bp, Homo sapiens
  chr2:47597757-47597877
  hypo
ctggagtgcaatggcaagatcttgactcattgtagactacgcctcccggcctcagaccatccttctgcgtcagcctttatgcctggctaatttttgtatttattatttattattattatt

SEQ ID NO: 39520 - DNA, 180 bp, Homo sapiens
  chr2:47598297-47598477
  hypo
taaaatggtgactggtatgttgcaccgttattcaaatgttagacatgtagtttgatttcagtttctcttaactgtggaataaacaacttggctgccgtctctctctctctcttttttttggaaacagtgtctccgtctgtcgttcagcctggagtgcagtggcacatttacatgtcactg

SEQ ID NO: 39521 - DNA, 83 bp, Homo sapiens
  chr2:47598537-47598620
  hypo
tacaggcatgagccaccggtccggcatctcttggtttatttgtaagatggtgcctagaagtggagtggcgtttgccaaaggtc

SEQ ID NO: 39522 - DNA, 23 bp, Homo sapiens
  chr2:47599482-47599505
  hypo
agaggcggtgacagccgggcatg

SEQ ID NO: 39523 - DNA, 30 bp, Homo sapiens
  chr2:52856863-52856893
  hypo
gtccgcgggagccttcggtcttcttgtctg

SEQ ID NO: 39524 - DNA, 30 bp, Homo sapiens
  chr2:55653035-55653065
  hypo
ttttagcatcagcaacgggttttgtggaag

SEQ ID NO: 39525 - DNA, 21 bp, Homo sapiens
  chr2:55669245-55669266
  hypo
tggagccaagatggccgaata

SEQ ID NO: 39526 - DNA, 28 bp, Homo sapiens
  chr2:55874935-55874963
  hypo
gcgtgagccaccgcgcccagcagacatt

SEQ ID NO: 39527 - DNA, 166 bp, Homo sapiens
  chr2:58641373-58641539
  hypo
cagtgatgtggataacgcctcttgaaaaccctatcgtgagaccaaaatgaagaattccattaagattttgtgttctcatccttgagatcttgaaaatattccacagaacggtggtaatcctgcctattttaaaaatcagtacattcaatatcgatattgctaactt

SEQ ID NO: 39528 - DNA, 44 bp, Homo sapiens
  chr2:59269682-59269726
  hypo
tgacaacaagtctaaatctctgcttctgtcgcatttactaacat

SEQ ID NO: 39529 - DNA, 45 bp, Homo sapiens
  chr2:60411741-60411786
  hypo
aaatctacacctggccgggcgcggtggctcacgcctgtaatccca

SEQ ID NO: 39530 - DNA, 30 bp, Homo sapiens; identical to SEQ ID NO: 14413
  chr2:60442223-60442253
  hypo

SEQ ID NO: 39531 - DNA, 110 bp, Homo sapiens; identical to SEQ ID NO: 14414
  chr2:60705907-60706017
  hypo

SEQ ID NO: 39532 - DNA, 185 bp, Homo sapiens
  chr2:60706789-60706974
  hypo
cgaccaggcaagaaccgtcctgtactcctgccccagctctaatgcaataaaatgtcttttatcaatgtaattcaaggcaaagagtcaagggtctgtcaccattttaaagaggcttattacatggccacaaaaatttgcctcaggctcaaacctggcatgtaaggtatcagcgtgggacaggttct

SEQ ID NO: 39533 - DNA, 30 bp, Homo sapiens
  chr2:60733708-60733738
  hypo
aaaacacagcacccacgtgcctttgtgcat

SEQ ID NO: 39534 - DNA, 30 bp, Homo sapiens; identical to SEQ ID NO: 14415
  chr2:60887794-60887824
  hypo

SEQ ID NO: 39535 - DNA, 37 bp, Homo sapiens
  chr2:61231438-61231475
  hypo
agaaataataaaagacggcaataaaataaagtaacat

SEQ ID NO: 39536 - DNA, 30 bp, Homo sapiens; identical to SEQ ID NO: 14416
  chr2:61406196-61406226
  hypo

SEQ ID NO: 39537 - DNA, 18 bp, Homo sapiens
  chr2:61992299-61992317
  hypo
aggcgtgagccaccgcgc

SEQ ID NO: 39538 - DNA, 56 bp, Homo sapiens
  chr2:62409597-62409653
  hypo
agggatctgccctcacgaagggattaatgcagtttcttgagcgtgtgagagcaggt

SEQ ID NO: 39539 - DNA, 86 bp, Homo sapiens; identical to SEQ ID NO: 4970
  chr2:62589799-62589885
  hypo

SEQ ID NO: 39540 - DNA, 30 bp, Homo sapiens
  chr2:64348216-64348246
  hypo
ccacttaggttacagcgaaataaatctgcg

SEQ ID NO: 39541 - DNA, 145 bp, Homo sapiens
  chr2:64835504-64835649
  hypo
ctgaggacagggaggcgaagtgagctgttaaaagtcaccatctaaggagctgtgctggggatagaacacgggtggctacgccgggcatggtggtgcgcacctgcagtcctggctgctggagaagctgaggcggaaggatcgctta

SEQ ID NO: 39542 - DNA, 92 bp, Homo sapiens
  chr2:65413492-65413584
  hypo
ggccaacaaacacttaagtgtcttctatgaacctagcaagtgcttggcactgcttctgttgagtgcacagccccaagcggaagacaaacatt

SEQ ID NO: 39543 - DNA, 30 bp, Homo sapiens
  chr2:65868490-65868520
  hypo
tcaaatgcataacagcgcccttgatttcac

SEQ ID NO: 39544 - DNA, 30 bp, Homo sapiens
  chr2:66561514-66561544
  hypo
gagatggttgagccacgaaggcaaaatagt

SEQ ID NO: 39545 - DNA, 39 bp, Homo sapiens
  chr2:67625453-67625492
  hypo
tttttttataccttacgtgtcttttttcttttgggaaag

SEQ ID NO: 39546 - DNA, 38 bp, Homo sapiens
  chr2:67625732-67625770
  hypo
gctgggattacagccaccgcgcccggccaccttacatg

SEQ ID NO: 39547 - DNA, 39 bp, Homo sapiens
  chr2:68530252-68530291
  hypo
caggcgtgagtcaccgcgcccggccgaaaaacattttaa

SEQ ID NO: 39548 - DNA, 39 bp, Homo sapiens
  chr2:68537171-68537210
  hypo
tggattggccaggcacggtggctcactcctgtaatccca

SEQ ID NO: 39549 - DNA, 249 bp, Homo sapiens
  chr2:68672689-68672938
  hypo
tcaaaataacaaacacgcacgacgtcttcgatcaccttcctgtaaaaccgggtttctagccggacccatgtcctcacagttcctgaatcaagttcaccgtctgtgcaagcgccacctgacagagctccctgcgacactgaaacgcgtttgggcacttcccacgtgggaaccactcgccacgggcacctcctgagtacaaggtgcagtgctggggctggggcaggctgaagcgttcgttctaagtttctt

SEQ ID NO: 39550 - DNA, 48 bp, Homo sapiens
  chr2:68882413-68882461
  hypo
ctgggcgcccttctacggcttcaccatcgtgcgcgacttcttccccac

SEQ ID NO: 39551 - DNA, 139 bp, Homo sapiens
  chr2:69182056-69182195
  hypo
tcactcccagctccccgccgagggagtgaaattgctgacctggaagggcctggtgctgacggtgcccacctttggataccctgacgtagtaggtctaaaacttccgtgggttattcagattgaacgctgtttcaagtct

SEQ ID NO: 39552 - DNA, 141 bp, Homo sapiens
  chr2:69720070-69720211
  hypo
actacttgctttttgcggggtaaaaccaaatttgtagtttgcccaggttctagagacactgaaccctgagccctttcctcactcaatattcaaaaatgttaaaaaaggatgcagtaaggctgaggcaggagaatggcgtga

SEQ ID NO: 39553 - DNA, 95 bp, Homo sapiens
  chr2:69914132-69914227
  hypo
agagaaccaaagtcacgagtgtgtgaaacaacggagaggagcggcgctgtgcagcctggagctcaagacacttgcatgagcggtgagatgagagg

SEQ ID NO: 39554 - DNA, 48 bp, Homo sapiens; identical to SEQ ID NO: 14421
  chr2:70364215-70364263
  hypo

SEQ ID NO: 39555 - DNA, 90 bp, Homo sapiens
  chr2:70367809-70367899
  hypo
acaggcatgagacaccgtgcccagcgacaagataattttaaaaggagagggaacgtctgcttttgttgcctttctcgtcttttgtggttc

SEQ ID NO: 39556 - DNA, 19 bp, Homo sapiens
  chr2:70477741-70477760
  hypo
gtcggctgagcggggcggc

SEQ ID NO: 39557 - DNA, 30 bp, Homo sapiens
  chr2:71270959-71270989
  hypo
ccacatggcagggggcgggcgccccccgtg

SEQ ID NO: 39558 - DNA, 30 bp, Homo sapiens
  chr2:71355087-71355117
  hypo
gtttgaggaaacatacgtatttagaaagtc

SEQ ID NO: 39559 - DNA, 92 bp, Homo sapiens
  chr2:71455196-71455288
  hypo
atcaataaatacaaattaaaataaaactttattgcctcccttggatttagaatgtccaatctgcttgcaaaggacttcgaattgtattccac

SEQ ID NO: 39560 - DNA, 30 bp, Homo sapiens
  chr2:71502899-71502929
  hypo
tagttgtcctctggccgaaatctcctcgtg

SEQ ID NO: 39561 - DNA, 32 bp, Homo sapiens
  chr2:71622692-71622724
  hypo
ttgatcatcctattgcgcgcaggactgctccc

SEQ ID NO: 39562 - DNA, 83 bp, Homo sapiens
  chr2:72778912-72778995
  hypo
ccgcgcccggccattaaaatcttaatagcttataaaaactagcatacacacagtgatgagatacaatgcggtcatactataat

SEQ ID NO: 39563 - DNA, 23 bp, Homo sapiens
  chr2:73440127-73440150
  hypo
caggtgatcctcccacgcatcac

SEQ ID NO: 39564 - DNA, 23 bp, Homo sapiens
  chr2:73440270-73440293
  hypo
cgacaaagcgagaccctgtctca

SEQ ID NO: 39565 - DNA, 30 bp, Homo sapiens
  chr2:73723848-73723878
  hypo
actccacatcctcaccgatgtgtaaattgt

SEQ ID NO: 39566 - DNA, 93 bp, Homo sapiens
  chr2:74010528-74010621
  hypo
acaatgggcagtcaacgaactttgccgttcaaccaagttacaaaagaaggctctttaatcccttctttggcccttaaaagcggcagcagggcc

SEQ ID NO: 39567 - DNA, 17 bp, Homo sapiens
  chr2:74425137-74425154
  hypo
atatggtctcactctcg

SEQ ID NO: 39568 - DNA, 317 bp, Homo sapiens
  chr2:74454002-74454319
  hypo
caggaggggaggttgcgctgcacctctgggttgcccaggccaacctgccaggcaggagggggaagcccgtgcccactttaccatgaccgggaagatgatggcagccaccgtggatttgaggatccagagcaccgccaggcagaggatctgcaccagggtgaagaggtggatccggcgcagcggcacgtgccgcaggaaggcatggtccggctggtgcttggctggcatcaggaagagcttgcagcgttcccagaactagggggacagcgggggctcagccaggcagccagaccccgagggcccgctgggtcctggga

SEQ ID NO: 39569 - DNA, 22 bp, Homo sapiens
  chr2:74669781-74669803
  hypo
cataaagagcagctgcgcgcgg

SEQ ID NO: 39570 - DNA, 92 bp, Homo sapiens
  chr2:74700397-74700489
  hypo
ttctccatgaattagcgtagctcccaggacttaagttgaagtgcattctagccagttttctttttttgagacgaagttttgctcttgttgcc

SEQ ID NO: 39571 - DNA, 36 bp, Homo sapiens
  chr2:74733345-74733381
  hypo
gactggtagaattcccgaatccgtttctcttcacct

SEQ ID NO: 39572 - DNA, 24 bp, Homo sapiens
  chr2:74874703-74874727
  hypo
tgggttcactttaaacgaaatgaa

SEQ ID NO: 39573 - DNA, 35 bp, Homo sapiens
  chr2:81421368-81421403
  hypo
ccccgcccgggtggacgtggcgctccctcctcggc

SEQ ID NO: 39574 - DNA, 54 bp, Homo sapiens
  chr2:81424249-81424303
  hypo
gaggcaggacagcaccgacgtaggggtgggcacaccggtcggctctggtcaggc

SEQ ID NO: 39575 - DNA, 30 bp, Homo sapiens
  chr2:85533655-85533685
  hypo
ccaacctggtcagcccgggacaactatgta

SEQ ID NO: 39576 - DNA, 30 bp, Homo sapiens
  chr2:85542244-85542274
  hypo
gttttcatctgcctgcgaggcaccaaggag

SEQ ID NO: 39577 - DNA, 34 bp, Homo sapiens
  chr2:85769773-85769807
  hypo
ggattataccaaggtcgaccgttcagctgcttat

SEQ ID NO: 39578 - DNA, 28 bp, Homo sapiens
  chr2:85838295-85838323
  hypo
actccagcctgggcgacagagacctagt

SEQ ID NO: 39579 - DNA, 29 bp, Homo sapiens
  chr2:86423740-86423769
  hypo
atcaaaataaaacacgttaaatattaagc

SEQ ID NO: 39580 - DNA, 16 bp, Homo sapiens
  chr2:87056517-87056533
  hypo
gcgcctggctggcata

SEQ ID NO: 39581 - DNA, 80 bp, Homo sapiens
  chr2:87961966-87962046
  hypo
ggtggcaaggcagggcggaaggtaagcggagaccttctccaatcagaagtctagaaggcagggcacgcagtaggtctgca

SEQ ID NO: 39582 - DNA, 30 bp, Homo sapiens
  chr2:88306721-88306751
  hypo
gaattccagcttcctcgctgcttaccagtc

SEQ ID NO: 39583 - DNA, 96 bp, Homo sapiens
  chr2:88469312-88469408
  hypo
ctcacaaccctgcagcgaagactccgaggctgaacgtcaataaagcgtttactaaagcgccttaaaaaatgggccgcggggctgggcgcggtggct

SEQ ID NO: 39584 - DNA, 87 bp, Homo sapiens
  chr2:88573562-88573649
  hypo
gggacacagtggatacgcaaaaggttcttgtcagattagactactaatagacggcagctctagggcaggtgtgtgtgtgtgtgtgtg

SEQ ID NO: 39585 - DNA, 232 bp, Homo sapiens
  chr2:88990189-88990421
  hypo
agattcaagagctcacggcctcagagggcaaagcatagttaagaaaatctaggtgataaccggcagttaacagtggcccataccagtgacttgcgctcacggaagagttctgaaggcctggaatgcgtttgaagatgagttcatgagcagacagaaaggattccactaacagccgagaaacacaaaggtcatgtgtttttagggacctccaagtggtcggtaaggttggggt

SEQ ID NO: 39586 - DNA, 34 bp, Homo sapiens
  chr2:89071947-89071981
  hypo
gtgagccaccacgcccggccgtgaatgatacatt

SEQ ID NO: 39587 - DNA, 30 bp, Homo sapiens
  chr2:89371674-89371704
  hypo
agatgatattactttcgatatcgtaaacac

SEQ ID NO: 39588 - DNA, 38 bp, Homo sapiens
  chr2:90003862-90003900
  hypo
aaacagctccttggccgggcgcggtggctcacgcctgt

SEQ ID NO: 39589 - DNA, 89 bp, Homo sapiens
  chr2:95742095-95742184
  hypo
tgaaagtaaagctcacgggtttttttctacttcgggttgtttaaataaccacaatcggtcgggagcggtggctcacgcctgtaatccca

SEQ ID NO: 39590 - DNA, 30 bp, Homo sapiens
  chr2:95745768-95745798
  hypo
ccaccgtgcctggcccggacacaagcattt

SEQ ID NO: 39591 - DNA, 223 bp, Homo sapiens
  chr2:95941629-95941852
  hypo
ctgggcagtgggggtcgggtcacccctcatgccctgctgcctgcccaggtggtgcggtacgaggcgggctacgtggtatgcgctgtgatcgcgggcctctacctgctgctggtgcccactgccgggctttgcttctgctgctgccgctgccaccggcgctgcgggggacgagtgaagacagagcacaaggcgctggcctgtgagcgcgcggccctcatggtct

SEQ ID NO: 39592 - DNA, 82 bp, Homo sapiens
  chr2:96784580-96784662
  hypo
gccccaggctgtcaccgtctactgcagctgtctcctcctggctccaccccaggatggacaagtgcagcgtgggtgcgccagc

SEQ ID NO: 39593 - DNA, 24 bp, Homo sapiens
  chr2:96872240-96872264
  hypo
cttaaaagtggaacacggccgggc

SEQ ID NO: 39594 - DNA, 92 bp, Homo sapiens; identical to SEQ ID NO: 1550
  chr2:97427763-97427855
  hypo

SEQ ID NO: 39595 - DNA, 30 bp, Homo sapiens; identical to SEQ ID NO: 14434
  chr2:97428063-97428093
  hypo

SEQ ID NO: 39596 - DNA, 30 bp, Homo sapiens
  chr2:97437788-97437818
  hypo
ccaggctctctggaacgcctggtctctggc

SEQ ID NO: 39597 - DNA, 30 bp, Homo sapiens
  chr2:97603228-97603258
  hypo
ctgaggccaactgcccgtggctcagtagcc

SEQ ID NO: 39598 - DNA, 119 bp, Homo sapiens
  chr2:97605950-97606069
  hypo
ggagtaaagggcacccggcatgagaacggtatggggtccagggcccaggcacttaagtgctccacacatatgggcagctgctgctgccaccgccacaggagacgcgacctgcagatgag

SEQ ID NO: 39599 - DNA, 32 bp, Homo sapiens
  chr2:97652373-97652405
  hypo
gtgcgcatccacgtgcgcgggaattggctggc

SEQ ID NO: 39600 - DNA, 30 bp, Homo sapiens; identical to SEQ ID NO: 14435
  chr2:98025687-98025717
  hypo

SEQ ID NO: 39601 - DNA, 30 bp, Homo sapiens
  chr2:98263541-98263571
  hypo
ctgatgaagagcaggcgactgggttggaga

SEQ ID NO: 39602 - DNA, 30 bp, Homo sapiens
  chr2:98351134-98351164
  hypo
aactttggctcagtgcgccagggcgtgtac

SEQ ID NO: 39603 - DNA, 30 bp, Homo sapiens
  chr2:98354137-98354167
  hypo
tgcccctgtgatgcccgactggatgggctg

SEQ ID NO: 39604 - DNA, 145 bp, Homo sapiens
  chr2:98357736-98357881
  hypo
gatcttttctcttggcggctctgaccaagccccttcaccctcctccagggtttccagcgcccacgcggactcccctctgggcctctgcattcaccgctgccgctgcctggaaagctctccccgtccccaccggtgatgtccccta

SEQ ID NO: 39605 - DNA, 189 bp, Homo sapiens
  chr2:98702143-98702332
  hypo
atagacacataaacacgaaagatagggacagatcatcttggtgacttgcacgtatgtggcaagtgtcctagggaaaggagcaggcatggggtgaaggtgggaacaagagtgcctggcgtgaccatgtgaggcagggcatttggctatgtgttgctgtgtgctctgtctcacccccgtgacccaagaata

SEQ ID NO: 39606 - DNA, 30 bp, Homo sapiens
  chr2:98957314-98957344
  hypo
tatgtagtagaagtacgcatttcttggctt

SEQ ID NO: 39607 - DNA, 30 bp, Homo sapiens
  chr2:99004156-99004186
  hypo
gaacctgcgaccacacgtatttgccactac

SEQ ID NO: 39608 - DNA, 88 bp, Homo sapiens
  chr2:99795933-99796021
  hypo
cactcagcactgaaacgtgatatctatgcttattgctgttgtcactgtcatcattatcatcaaataatgccccaggcaaggtagagtt

SEQ ID NO: 39609 - DNA, 148 bp, Homo sapiens
  chr2:99796321-99796469
  hypo
cggccggtagagtttgtagttctgaccaaagcaccaaaccataaagggctcccctctgctgccccaaagcttctgtaacactttaattataagaagcttaaactagaaagaacagagggagcttagtccagaccgggagtgtcggggg

SEQ ID NO: 39610 - DNA, 100 bp, Homo sapiens; identical to SEQ ID NO: 1551
  chr2:99798646-99798746
  hypo

SEQ ID NO: 39611 - DNA, 39 bp, Homo sapiens
  chr2:99951448-99951487
  hypo
ttacaggcgtgagccagccgcgcccggccaaaattttac

SEQ ID NO: 39612 - DNA, 30 bp, Homo sapiens
  chr2:100107667-100107697
  hypo
tcgtcgctaatccaacgaatttagattgca

SEQ ID NO: 39613 - DNA, 162 bp, Homo sapiens
  chr2:100108060-100108222
  hypo
ctcacgaccagttgccgactgcaacaccaggaggtcatctgctgagatgctacagaaaaacagtggtaaccccttgttatgggtgagttttgttttggttgttgttcttttgcttgttttaaatgtctaaatggcagcattcctgcacgattgtatttcaat

SEQ ID NO: 39614 - DNA, 95 bp, Homo sapiens
  chr2:101009832-101009927
  hypo
atacacggtaatgcccggagggatagtcgggtatgacaccaggtggtcaatgccagcctcttttaagatgtatggggcatcgtcctccagggtct

SEQ ID NO: 39615 - DNA, 177 bp, Homo sapiens
  chr2:101520526-101520703
  hypo
ctaagggaggaactgcggattacactcctttggggctgattcttccaggccacttgtcagaggagcttgtgtggtttgaatggacagataaacactctcctttaggatgtcataggccactggggtcctgcaagcaggagtgaacaaggcccgctgtggtgtcgctaacggatccca

SEQ ID NO: 39616 - DNA, 41 bp, Homo sapiens
  chr2:101835056-101835097
  hypo
gctgggattacaggcatgagccaccgcgcccagcctagtca

SEQ ID NO: 39617 - DNA, 30 bp, Homo sapiens
  chr2:101893777-101893807
  hypo
gagggcagcatattccgagcttcaactatg

SEQ ID NO: 39618 - DNA, 204 bp, Homo sapiens
  chr2:102246999-102247203
  hypo
accgtcttgtgtttgcgccacactgcctgtgaggttggaacaggggacaatggctcacaggggtctttccaccctgccagccaatgcctccttctctgcctagcttgtcctcaccccgaaagtgcctgcttctgacctcttcttggtccacccgggctggcccgtgattggcattctagaaatgctgctcgagggaccgggcct

SEQ ID NO: 39619 - DNA, 91 bp, Homo sapiens
  chr2:104014594-104014685
  hypo
aatttacaatagctccgtgaaccggtgcagggtcagatgctgacacaatggtggaggggcgctgatgccgaacttacggataatactgtca

SEQ ID NO: 39620 - DNA, 30 bp, Homo sapiens
  chr2:105719619-105719649
  hypo
agacaccagaggggtcggctcgggtttcag

SEQ ID NO: 39621 - DNA, 41 bp, Homo sapiens
  chr2:105858359-105858400
  hypo
gctgaacaccagcaacgcctcagactcggggtccacccagt

SEQ ID NO: 39622 - DNA, 156 bp, Homo sapiens
  chr2:105972350-105972506
  hypo
gccagcaaaccaatgcgtaaatgaacatacatggctgtgtttgaataaaacttttttgttaagaaaacagaccaggtgtgatgactcatgctggtaatcccagcgttttggaatgccaagatggggggaatcgcttgagcccaggagtttgagacc

SEQ ID NO: 39623 - DNA, 257 bp, Homo sapiens
  chr2:106016141-106016398
  hypo
cccacattccaagcccgggccctctgcgtgacgctgacgctgggtagggacagatggcactgttcagcattgtcgcagggagagcacaggttgagcccatccctgggagagggtgcgtcgtgatggaaacatttgctcctgagcaggtaaccggtccacttgcagaaaccggtggacgatgagtaggtggaccacaaaggcgtcctcggcactttgggggcaggtgtattatttttaacattcggggcagctcatag

SEQ ID NO: 39624 - DNA, 177 bp, Homo sapiens; identical to SEQ ID NO: 14440
  chr2:106060615-106060792
  hypo

SEQ ID NO: 39625 - DNA, 30 bp, Homo sapiens
  chr2:106111101-106111131
  hypo
ctaccaacctcctctcgacagccagccgct

SEQ ID NO: 39626 - DNA, 30 bp, Homo sapiens; identical to SEQ ID NO: 14441
  chr2:106672847-106672877
  hypo

SEQ ID NO: 39627 - DNA, 201 bp, Homo sapiens
  chr2:106959338-106959539
  hypo
acactccctgcctctcgaggactctgcttgttcctcatcacagcacggttgctctcgcacccaaggcggtgtccccccagcgcctcaccacgatcgcggcagagatctcctgcagggcgtccgggccttgggaaggcatcgccatctcccgcagcgccctcccggactagcgcagcaggctggcatcgcttcctgaggttt

SEQ ID NO: 39628 - DNA, 127 bp, Homo sapiens; identical to SEQ ID NO: 14443
  chr2:106959916-106960043
  hypo

SEQ ID NO: 39629 - DNA, 21 bp, Homo sapiens
  chr2:107278930-107278951
  hypo
ccaccgcgcctggcctatttt

SEQ ID NO: 39630 - DNA, 245 bp, Homo sapiens
  chr2:107460171-107460416
  hypo
aaccggctgggtgggcgcggggcagcgcctggcgtgcgtccaggcccccaggcggggagggctcatgtgcggcgcccatgatggcccgctgcttcccctgcaccggcaggagcctcctggtctccaggaaggagagggagctgggtacaggctcagcggggttgctgtcggtgaagtagatgaaaatcagcaaaaagaggagcccccaagcgaatattccgaaaagcattcgttgtctccattgc

SEQ ID NO: 39631 - DNA, 24 bp, Homo sapiens
  chr2:108104796-108104820
  hypo
tttttttttttgagacggagtccc

SEQ ID NO: 39632 - DNA, 47 bp, Homo sapiens
  chr2:108160878-108160925
  hypo
ggagatggaaggagacgcggtgcactgagaagcggatgtgaaactga

SEQ ID NO: 39633 - DNA, 92 bp, Homo sapiens
  chr2:109335074-109335166
  hypo
tacaggcgtgaaccacagcgcccggcggaatgcgtggattttggcataagacggtggttctggaaccaatcccccgccgagatgactgttta

SEQ ID NO: 39634 - DNA, 30 bp, Homo sapiens
  chr2:111438469-111438499
  hypo
tcaagagccacttgacgatacagaataaag

SEQ ID NO: 39635 - DNA, 40 bp, Homo sapiens
  chr2:111898079-111898119
  hypo
attttctcttaggcacgtgcatctgcgaaggtgtctgagg

SEQ ID NO: 39636 - DNA, 157 bp, Homo sapiens
  chr2:113013160-113013317
  hypo
agcccagaatttttaaaattagttgttaggattctgctttcaccttggtgaaaactcttccatcaaaatcacagtatttctaagggatggtagtaacagctaacatttatctgagcactccactactattccttagaaatagcgtttcacatgttag

SEQ ID NO: 39637 - DNA, 38 bp, Homo sapiens
  chr2:113103393-113103431
  hypo
gcatcccgggcagagcgcagctgcgcagcaatcttgct

SEQ ID NO: 39638 - DNA, 30 bp, Homo sapiens
  chr2:114394659-114394689
  hypo
gtctgtaaatacgcacggccttaccttggc

SEQ ID NO: 39639 - DNA, 16 bp, Homo sapiens
  chr2:114469916-114469932
  hypo
acggagtctcgctgtc

SEQ ID NO: 39640 - DNA, 265 bp, Homo sapiens
  chr2:114515303-114515568
  hypo
atcttggtcagatggcgtgaagaaattaaattttcttactcctatagtcgcgatgtagtgtacctcttaccttttaagtctcgtttcagtgaagttgaatgcatattctagcaactaataaaacaataccaatgaacattttttaattgatcgaatcagtttcaaactatcagcatcaaacacctctaataagtcattcagaaacctattgtgcagagtaaaaaaaaaaaccaaccaggccggtcgcggtggctcatgcctgtaa

SEQ ID NO: 39641 - DNA, 24 bp, Homo sapiens
  chr2:114515808-114515832
  hypo
gcgagactccgtctcaaaataaat

SEQ ID NO: 39642 - DNA, 37 bp, Homo sapiens
  chr2:118628528-118628565
  hypo
tacaggtatgagccactgtgcgcggcttcctcctcca

SEQ ID NO: 39643 - DNA, 270 bp, Homo sapiens
  chr2:120005499-120005769
  hypo
gttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacct

SEQ ID NO: 39644 - DNA, 30 bp, Homo sapiens
  chr2:120441329-120441359
  hypo
gtgtgtatgtgtgtgcgtgtgtgtgcgcgt

SEQ ID NO: 39645 - DNA, 81 bp, Homo sapiens
  chr2:120973474-120973555
  hypo
ctttcaactctttatcggatgagaaggcgtaggaatcatgtctttctaactggctgatgatatggccgagcagatgctaac

SEQ ID NO: 39646 - DNA, 211 bp, Homo sapiens
  chr2:120973770-120973981
  hypo
gcccaaccccagtctcggccctgctccactccagcactgtagttgtagcagttttcctactcatccgtttctactctttaatagaaaataacctattcatccaaacctttacattatgtctaggggctattaccaccctacttacagcaatctgcccttcagcgccaggggaatgcccgacagctaccttctcccccgtgaccgccgggct

SEQ ID NO: 39647 - DNA, 424 bp, Homo sapiens
  chr2:120980068-120980492
  hypo
tgtccagctttagggcgatgaagatgaactgcaggatgttgaccgagcacaggatctccagctccagcgacctatcgtgtcgaaagccccagacgcaggcagccacggacacgggggacacgaagaagagaggcatgaagaccagcagccagaagtgggtgcccctctccaccctgtcgcagaccaggacttcgaacatgagcagcagcaggtggatgcccacagcgatcagcatggctttgaactccacacaggcctctccctcggtgcggtagcgagggttgcgggcccaaacgcccgcgcccacggaggcgcctgcgacgactagaagcttccacagccatatgggggcaaagacggcccagtagctccattggatgatgccgtccaggcggaggggcagcagcaccgagaagagcagcag

SEQ ID NO: 39648 - DNA, 120 bp, Homo sapiens
  chr2:121003516-121003636
  hypo
cccaccccagagatgcgcattttaatggtttggtggtcttacctcctggtggagcgagggtctggggccttctcaggtatgtccttttaccccccgacaccaccccgcattcctcgagcc

SEQ ID NO: 39649 - DNA, 30 bp, Homo sapiens
  chr2:121639825-121639855
  hypo
ggaaggcagccagggcgtgaggccttgggt

SEQ ID NO: 39650 - DNA, 24 bp, Homo sapiens
  chr2:122013325-122013349
  hypo
tttttttttttgagacggaatctc

SEQ ID NO: 39651 - DNA, 47 bp, Homo sapiens
  chr2:122088821-122088868
  hypo
gctcccccactgaaccggctcaactgcccacccgacaaagtacaatg

SEQ ID NO: 39652 - DNA, 30 bp, Homo sapiens
  chr2:122104569-122104599
  hypo
cagagcccaggtgtgcgtatcagcccaggt

SEQ ID NO: 39653 - DNA, 272 bp, Homo sapiens
  chr2:122495322-122495594
  hypo
caccgcgcccggccctaatttggttattctttcactcacttgtgtgtgagctctcctgtgtggccccgtccgtccgcggcccttggagaacttacagcctgagggcagcatggctgctttaagagaccaaagaggcttgtgggggagaggcacactgggtggcgccggagggtcccccttaggaggtggcgttagcaccgaggcctgaaggctaaagagcggggtgtggagaaccgagcgcctgccgtccgctggaccggacaggcctgcac

SEQ ID NO: 39654 - DNA, 30 bp, Homo sapiens
  chr2:122511801-122511831
  hypo
gacccgactgggcaacgtaatgagaccaaa

SEQ ID NO: 39655 - DNA, 37 bp, Homo sapiens
  chr2:126237007-126237044
  hypo
cctgactggtggcgccggctggcggctccagggccct

SEQ ID NO: 39656 - DNA, 27 bp, Homo sapiens
  chr2:126347693-126347720
  hypo
accaacaaaataggccgggtgtagtgg

SEQ ID NO: 39657 - DNA, 21 bp, Homo sapiens
  chr2:126413305-126413326
  hypo
agcaatggccgggtgcggtgt

SEQ ID NO: 39658 - DNA, 30 bp, Homo sapiens
  chr2:127395350-127395380
  hypo
ataaatttaacacaacgttggcagcacaca

SEQ ID NO: 39659 - DNA, 30 bp, Homo sapiens
  chr2:127397957-127397987
  hypo
tatgcattctcaccacgttttcaggtgtct

SEQ ID NO: 39660 - DNA, 81 bp, Homo sapiens
  chr2:127422857-127422938
  hypo
aacttttatagagtacgttgttacaattgttttacttcattattcattgttgttaatatcttactgtgtctaatttataaa

SEQ ID NO: 39661 - DNA, 21 bp, Homo sapiens
  chr2:127423058-127423079
  hypo
aaccaccgattcatgggacag

SEQ ID NO: 39662 - DNA, 64 bp, Homo sapiens
  chr2:127423286-127423350
  hypo
gcacgccctggcaagcgcccactctgccctgctccgcacctagtgaggacgtgtaacacacaca

SEQ ID NO: 39663 - DNA, 30 bp, Homo sapiens
  chr2:127427725-127427755
  hypo
gtctccttctgagaccgcagctcccactca

SEQ ID NO: 39664 - DNA, 59 bp, Homo sapiens; identical to SEQ ID NO: 4979
  chr2:127428985-127429044
  hypo

SEQ ID NO: 39665 - DNA, 127 bp, Homo sapiens
  chr2:127433244-127433371
  hypo
ctgttcgtcactacccgagaaaacgcagacttcttagtctgatcttcaggatccttcattgccctttcctcacccaagcaggtgagtaataaaatttattagtgatattcaccgtagtagtgatggt

SEQ ID NO: 39666 - DNA, 40 bp, Homo sapiens; identical to SEQ ID NO: 14455
  chr2:127435251-127435291
  hypo

SEQ ID NO: 39667 - DNA, 53 bp, Homo sapiens
  chr2:127438087-127438140
  hypo
caaactcagggagctcgagaagcaaagtctgtggccagcggccctgtgattcc

SEQ ID NO: 39668 - DNA, 262 bp, Homo sapiens
  chr2:127438633-127438895
  hypo
actgtaaaaataacacgttttttgtagatgacttggaaaatacagacagccatatgttagaagtaaacaaaaccactcctaacccgtctacttcttaaaagccggtacttaacatttgaagcgtatttcttttcatcgctttgttttaaggtttttgtggaatatttttcatcatttctatttagagggtcccgttttcttcacttaacatcaataccctaagcatttcttcctgttgctaagttcacgtgcaccccttccc

SEQ ID NO: 39669 - DNA, 113 bp, Homo sapiens
  chr2:127453528-127453641
  hypo
tgctgctgtggccatcgtcctagtctccctcctcttcgtcatgctgcgctacatgtaccggcacaagggcacgtaccacaccaatgaggccaagggcacggagtttgctgaga

SEQ ID NO: 39670 - DNA, 21 bp, Homo sapiens
  chr2:127459661-127459682
  hypo
ccaccgcgctcagcccaggaa

SEQ ID NO: 39671 - DNA, 81 bp, Homo sapiens
  chr2:127801154-127801235
  hypo
cattcccctggaacacgaaggagcaaacctgcccggctgcattccgccctcccgctgccctaggcccgctataggctggat

SEQ ID NO: 39672 - DNA, 30 bp, Homo sapiens
  chr2:127809267-127809297
  hypo
ccagcgcaggtggtgcggtgcagcctgtgc

SEQ ID NO: 39673 - DNA, 169 bp, Homo sapiens
  chr2:128050797-128050966
  hypo
taaatgctatttattcggcagataaaaggattcactacatggggtagggctggggaaggagtgagagtaaaccgaggggttagagctgttggaagcccaggtccggccgccacacgtgtgcgcaactgctcgctgttgccttgggctgttccaacgtgtgtggatgaaa

SEQ ID NO: 39674 - DNA, 30 bp, Homo sapiens
  chr2:128293422-128293452
  hypo
gggcgtgtctgccagcggggagtagggggt

SEQ ID NO: 39675 - DNA, 51 bp, Homo sapiens
  chr2:128380871-128380922
  hypo
aatgtgcatgcacatcgctcacaagcagggcctcagcgaccacctgggctt

SEQ ID NO: 39676 - DNA, 151 bp, Homo sapiens
  chr2:128616477-128616628
  hypo
aaatgatgctgttttcgacactggagaaaacaaaaggttgtacaataaggtaaataatcatagcttattagtcaacaatatcttagctcattagtcaacaatgtttagatggtcatattgtaaactctgttgatttaataaaaaatgaatt

SEQ ID NO: 39677 - DNA, 120 bp, Homo sapiens
  chr2:128847683-128847803
  hypo
catcctcagcgtgagccaccgcgcccggcctccatcagtgttccattagtcatctccttcatcctcctctccttcctccccttcatcatgttggctcatgtttatttattaaaattattt

SEQ ID NO: 39678 - DNA, 30 bp, Homo sapiens
  chr2:129128223-129128253
  hypo
gatggatgaggaaaacgaatctcagggagc

SEQ ID NO: 39679 - DNA, 171 bp, Homo sapiens
  chr2:130497037-130497208
  hypo
ggccatcccagcccccgcggtatggaggaggttaaccgaaatgtgaaactgggtaacagctcacagttttatagtccctgtaattatttaccaattaaaaagaaccacaactgtttatcatagggctgcgtgcatattaatggccggcaggctattcgtgtgatgcttctg

SEQ ID NO: 39680 - DNA, 178 bp, Homo sapiens
  chr2:130666498-130666676
  hypo
ctcctctctgctcctcggggagggccagctgcgggcagcactcacacccagagccatctggctctgctgaactcccagctgctctcacatggggtcacccggcctgatacccagccacctccagcccctgcctcacctctgtgagatgaagatggtgaaggcccggtgcccactgagg

SEQ ID NO: 39681 - DNA, 30 bp, Homo sapiens
  chr2:130886777-130886807
  hypo
ggcaggagaagctcccgctactggttgccc

SEQ ID NO: 39682 - DNA, 135 bp, Homo sapiens
  chr2:130947982-130948117
  hypo
caggtgctgcagttacggggcacgcccattcctaatcattgtgctttgtgtctcctcagggagaaacaaaggcagcgctgccctcgggggagcattggccctggcggaacgcagcagccgcgaaggatccagcca

SEQ ID NO: 39683 - DNA, 42 bp, Homo sapiens
  chr2:131114462-131114504
  hypo
tataaagattctaaacgtgggccaggtgcggtggctcacacc

SEQ ID NO: 39684 - DNA, 151 bp, Homo sapiens; identical to SEQ ID NO: 14462
  chr2:131477785-131477936
  hypo

SEQ ID NO: 39685 - DNA, 61 bp, Homo sapiens
  chr2:131486943-131487004
  hypo
atcctgcggaaccaacggctgcgacaggagccccactacctgctcccggctaacatcctgc

SEQ ID NO: 39686 - DNA, 261 bp, Homo sapiens; identical to SEQ ID NO: 14463
  chr2:131967115-131967376
  hypo

SEQ ID NO: 39687 - DNA, 103 bp, Homo sapiens
  chr2:132415272-132415375
  hypo
ccaggggtaccagggcggggatccacagttgccatagtgaggacctctgaggagtctggttcctgccttgctgcagtccggggagcagcgggcaggggtcctc

SEQ ID NO: 39688 - DNA, 30 bp, Homo sapiens
  chr2:132416768-132416798
  hypo
gctcctgcacagaggcggtctgtgcctcta

SEQ ID NO: 39689 - DNA, 30 bp, Homo sapiens
  chr2:135832320-135832350
  hypo
gatttagagaaagtacgtagatgtatttag

SEQ ID NO: 39690 - DNA, 36 bp, Homo sapiens
  chr2:140650928-140650964
  hypo
gtcttttttttttaatcaacacggtgtatttttatc

SEQ ID NO: 39691 - DNA, 30 bp, Homo sapiens
  chr2:143931491-143931521
  hypo
cgcttttcaaggggtcgttccgagttttat

SEQ ID NO: 39692 - DNA, 41 bp, Homo sapiens
  chr2:145167740-145167781
  hypo
gctgggattacaggcgtgagccaccgcgcccagccataaaa

SEQ ID NO: 39693 - DNA, 43 bp, Homo sapiens
  chr2:145174534-145174577
  hypo
ggctagaaatgatagcgcatttattatgcgctaacgttgcact

SEQ ID NO: 39694 - DNA, 21 bp, Homo sapiens
  chr2:145204291-145204312
  hypo
taacaattggctggacgcggt

SEQ ID NO: 39695 - DNA, 153 bp, Homo sapiens
  chr2:148776729-148776882
  hypo
atcggacatgattaccgtacacaatacagaagatactaagggctaagcaatgatgcataaacggggtccactgcccaaacttacagaaagcaaaacgtggaaaattagtaactttaactgatagtgtacacctaaagaacctacaccggccgg

SEQ ID NO: 39696 - DNA, 38 bp, Homo sapiens
  chr2:149514655-149514693
  hypo
atagttagggctgggcgtggtggctcacgcctgtaatc

SEQ ID NO: 39697 - DNA, 79 bp, Homo sapiens
  chr2:152266023-152266102
  hypo
gtgcttggattacaaggtgtgagtcaccgcgcccggccagctcttagtcttaaacccaacagtacgttatctccttttg

SEQ ID NO: 39698 - DNA, 30 bp, Homo sapiens
  chr2:162087925-162087955
  hypo
ctctggatagagctgcgtgtttgccacctg

SEQ ID NO: 39699 - DNA, 40 bp, Homo sapiens
  chr2:162166372-162166412
  hypo
cattttaatttaggccgggtgcggtggctcacacctgtaa

SEQ ID NO: 39700 - DNA, 105 bp, Homo sapiens
  chr2:170282975-170283080
  hypo
tggcccagagccaggcgggagcgtcagtaccgcgcactgttaacagcggcccgacaaacccagcaaatgcagaattggccaggggatccccgaaagaaccaatcc

SEQ ID NO: 39701 - DNA, 164 bp, Homo sapiens
  chr2:170551729-170551893
  hypo
ctatcagatgttccacgtaataatgctggtaagtatggaataattaagaaaatatttgaagacagaaattagtttgtgcacatacagcgctggtaggtttttggaactataccttaaaaagtgtcaagaactgggggccaggcgcggtggctcacgcctgtaat

SEQ ID NO: 39702 - DNA, 30 bp, Homo sapiens
  chr2:170584782-170584812
  hypo
aactctcttactattcgttaaaatgtatag

SEQ ID NO: 39703 - DNA, 23 bp, Homo sapiens
  chr2:170681880-170681903
  hypo
agtggagaggcagggcgcggcgg

SEQ ID NO: 39704 - DNA, 240 bp, Homo sapiens
  chr2:170682143-170682383
  hypo
ctgggagacagagcgagactccgtctcaaaaaaaaaaagacagtggaaatgaaaataaaagaataggtagtggtgtcaaatactggaaagaggtcgggcttcataaagtaggagcagaaattaagttgtagcagattgtggagcgaatggaaatttaggaagaagaaagagtaaatgtgaacaattaaacgtggccccggaagcggtggctcacccctgtgatcccaacattttgggagg

SEQ ID NO: 39705 - DNA, 29 bp, Homo sapiens
  chr2:171624032-171624061
  hypo
tgagccaccgcgtccggccctcaacaaat

SEQ ID NO: 39706 - DNA, 23 bp, Homo sapiens
  chr2:171769313-171769336
  hypo
catctaatcgctttggtaacttc

SEQ ID NO: 39707 - DNA, 21 bp, Homo sapiens
  chr2:172129423-172129444
  hypo
ccaccgcgcctagatggggca

SEQ ID NO: 39708 - DNA, 74 bp, Homo sapiens; identical to SEQ ID NO: 14471
  chr2:172367021-172367095
  hypo

SEQ ID NO: 39709 - DNA, 41 bp, Homo sapiens
  chr2:172411125-172411166
  hypo
ggatagtcaccagaccgcaatggaaacgtcctaaggagcca

SEQ ID NO: 39710 - DNA, 20 bp, Homo sapiens
  chr2:173036684-173036704
  hypo
caccgcgcccagcccaataa

SEQ ID NO: 39711 - DNA, 30 bp, Homo sapiens
  chr2:173291566-173291596
  hypo
ctagttctgaaagtccggggctaggaaaga

SEQ ID NO: 39712 - DNA, 49 bp, Homo sapiens
  chr2:173422685-173422734
  hypo
caagcctagaactaccggcaagcaccaccacgcccggctattttttatt

SEQ ID NO: 39713 - DNA, 21 bp, Homo sapiens
  chr2:176030420-176030441
  hypo
ggagtctcgctgtgtcgccca

SEQ ID NO: 39714 - DNA, 79 bp, Homo sapiens
  chr2:176430829-176430908
  hypo
cagctcccaacctgccgcactgagtgtgcatcatacagctgtcagcagagccagggcaccacagcgatgagtgcttgtg

SEQ ID NO: 39715 - DNA, 20 bp, Homo sapiens
  chr2:176569563-176569583
  hypo
tagaccggagctgttcctat

SEQ ID NO: 39716 - DNA, 97 bp, Homo sapiens
  chr2:177498024-177498121
  hypo
gagcactagttactccggttctaaaaagctatgaattttgatatatagcctacgttatgaaagcttacctctttatggcttcaaccaggtgagtgta

SEQ ID NO: 39717 - DNA, 32 bp, Homo sapiens
  chr2:178089350-178089382
  hypo
aatcttaaagaatggcgtgtctaggctgggtg

SEQ ID NO: 39718 - DNA, 30 bp, Homo sapiens
  chr2:178131780-178131810
  hypo
ctgtctttgggaagacggccttccctacat

SEQ ID NO: 39719 - DNA, 186 bp, Homo sapiens
  chr2:178972992-178973178
  hypo
cctggccagagtccacgcctcaacttcgaggctggcgatccagaaagagcacctcacgccctgggctgcaagcgcagccggacgcgcgcgaccagtgatcgccagccaatggcaagccgggacccggtcccactgctgattggcccccagatcccgtgggatctcacctctcgcagaggcttaaag

SEQ ID NO: 39720 - DNA, 38 bp, Homo sapiens; identical to SEQ ID NO: 4985
  chr2:179317019-179317057
  hypo

SEQ ID NO: 39721 - DNA, 30 bp, Homo sapiens
  chr2:179672126-179672156
  hypo
gaggctgggaatgcacgactgctcaagagc

SEQ ID NO: 39722 - DNA, 138 bp, Homo sapiens
  chr2:180886772-180886910
  hypo
ccacgcgaggtggttcgtaatatccagtgggggagagggtgatatcacacccacatcgcggggggtgggagggcatgtacacaggatattatgttggttgaggttactgactctgaggcaaggcggccagaatatgta

SEQ ID NO: 39723 - DNA, 148 bp, Homo sapiens
  chr2:182422221-182422369
  hypo
ggatgagtgattgtgtaatacaatcagcttttgaatgatgtttccctcttttctggatcacagtgttgctctaacggttctccgtgtctctgacctctactttctcctgctcccaacctctaatcattccacacggtgaggcaaaatg

SEQ ID NO: 39724 - DNA, 128 bp, Homo sapiens
  chr2:184406833-184406961
  hypo
taaatatcctttatacgctccatctttctgtatgattaacagtttatggttttataatcaactatgctaagttctagaagcagttataaaattttagatgaatgaaatagttgcgtcacacacagatt

SEQ ID NO: 39725 - DNA, 141 bp, Homo sapiens
  chr2:188235961-188236102
  hypo
ccgtctaaaaaaaaaaaaaagttaaataaataatatctaatgtaaagcctgggatacagaccgcagaataggctatatctcaggaccatagtgtataacaaatttacaatgaataaatggacgtaccgtgagttaagagag

SEQ ID NO: 39726 - DNA, 16 bp, Homo sapiens
  chr2:196302359-196302375
  hypo
ccgcaggtcacttcag

SEQ ID NO: 39727 - DNA, 30 bp, Homo sapiens
  chr2:196319761-196319791
  hypo
atctttaaatcatctcgagttaattttcgt

SEQ ID NO: 39728 - DNA, 30 bp, Homo sapiens
  chr2:197503336-197503366
  hypo
aatgagctctcatctcggatctgattgctt

SEQ ID NO: 39729 - DNA, 102 bp, Homo sapiens
  chr2:200524640-200524742
  hypo
tatgctgatgctcctcggagtcagtaataaaatgactgacagggaaagggataaagtgatgcctcagattatccaaggttttaaagacgcagctgaagacgc

SEQ ID NO: 39730 - DNA, 30 bp, Homo sapiens; identical to SEQ ID NO: 14479
  chr2:203129332-203129362
  hypo

SEQ ID NO: 39731 - DNA, 23 bp, Homo sapiens
  chr2:203484340-203484363
  hypo
tgccatatcgggtgcaccagtta

SEQ ID NO: 39732 - DNA, 106 bp, Homo sapiens
  chr2:206757186-206757292
  hypo
aacatggggtctgcacgcccaagagcattgtcccttggttaccatggtaacccaagcgcatccaccaagcactttactccaaaggaaatagcgagcttgggctatg

SEQ ID NO: 39733 - DNA, 30 bp, Homo sapiens
  chr2:206859091-206859121
  hypo
gctagtccttgctaccgtgcagtttctttg

SEQ ID NO: 39734 - DNA, 18 bp, Homo sapiens
  chr2:207022702-207022720
  hypo
tttgagacagagtctcgc

SEQ ID NO: 39735 - DNA, 107 bp, Homo sapiens
  chr2:207557814-207557921
  hypo
agaaagattgctggccggttaccataacacccagggcccttggtggctgctctgtgggatcagccaatcctcgcagccactcacctggcctgcgcatggtgaggcac

SEQ ID NO: 39736 - DNA, 30 bp, Homo sapiens
  chr2:208140368-208140398
  hypo
agtagagtggtccagcgtagctccttcaaa

SEQ ID NO: 39737 - DNA, 180 bp, Homo sapiens
  chr2:208574959-208575139
  hypo
gaaattgggacgcagaagttaagttacttccgcaagcttacatgactgctcagggtgagggtccctgatcatgatgatcagaaaataaaggtagaaatcaagcttagggaggaagtgacattgtgtgtatatatatatatttgtttatttatttttatttttatgttttatttttttgaa

SEQ ID NO: 39738 - DNA, 31 bp, Homo sapiens
  chr2:209094651-209094682
  hypo
gatgcaggctgggggcggtggctcacgcctg

SEQ ID NO: 39739 - DNA, 30 bp, Homo sapiens
  chr2:209225350-209225380
  hypo
gggtaaaacagcacccggaagcagtcgtcg

SEQ ID NO: 39740 - DNA, 175 bp, Homo sapiens
  chr2:214080302-214080477
  hypo
aataaataaatgatgcgtgtttgttgacctatgtgtgtttgttgacctatgaaggtaccgttgaaaaataatcctacgtcttatactaggttcttcgatgctactcattttattcatgtttgttttgaagctttaaagaactgtcaggttctctttaaatcgcactgcatcaatg

SEQ ID NO: 39741 - DNA, 48 bp, Homo sapiens
  chr2:217675074-217675122
  hypo
tggctgtgggggagacgggcgggaggcccagaccggcagggagctttc

SEQ ID NO: 39742 - DNA, 30 bp, Homo sapiens
  chr2:219250043-219250073
  hypo
cattttcagcttccacgatcaaataaatac

SEQ ID NO: 39743 - DNA, 30 bp, Homo sapiens
  chr2:219251809-219251839
  hypo
ccagccctgaggctccgtaggagttagaga

SEQ ID NO: 39744 - DNA, 185 bp, Homo sapiens
  chr2:219284495-219284680
  hypo
catctcccctctacccggagctgccccattggcctccccagccactgtgggcccattcagcagaactaggaatgggagctagctgcagaccaggctctgaggacacactggctgctgtcttctcgggacatcatctgctggggcagagcctttgggctggagggtcttggcgggtgtccattccc

SEQ ID NO: 39745 - DNA, 189 bp, Homo sapiens
  chr2:219431996-219432185
  hypo
tcatggcttgcaagacgcatcctcctctattggttattaaacagcaggaattcgtcaatgctccatcctaggtgcctttattttacagcactatactctttttcggcaatttcatccacatccatggcttcaattactatcaatatggcagatgacaaacacatacacacaccgcgcacatttacgtac

SEQ ID NO: 39746 - DNA, 30 bp, Homo sapiens
  chr2:219611841-219611871
  hypo
tatcctgccccaggacgccaagctcctgcg

SEQ ID NO: 39747 - DNA, 30 bp, Homo sapiens
  chr2:219773320-219773350
  hypo
cagccagactgacttcgagtttcggccgca

SEQ ID NO: 39748 - DNA, 33 bp, Homo sapiens
  chr2:220080826-220080859
  hypo
atgagcagctccacccgccgagacgtgaactgc

SEQ ID NO: 39749 - DNA, 30 bp, Homo sapiens; identical to SEQ ID NO: 14482
  chr2:220316287-220316317
  hypo

SEQ ID NO: 39750 - DNA, 42 bp, Homo sapiens
  chr2:220384416-220384458
  hypo
gtggctataggctgccgtgttggacagcgcagctctggatgg

SEQ ID NO: 39751 - DNA, 39 bp, Homo sapiens
  chr2:221861787-221861826
  hypo
ctgtgtgaaatctagcgtttcctgcatttaattgttcat

SEQ ID NO: 39752 - DNA, 119 bp, Homo sapiens
  chr2:223753484-223753603
  hypo
cagacgctttgtttgcgacgctttgtttgcgtatccaagattgccatcttttaatgaagtagatgtgatggaaaaaggaatatactttgtccactttaatagtacgcctcactttgttt

SEQ ID NO: 39753 - DNA, 30 bp, Homo sapiens; identical to SEQ ID NO: 14483
  chr2:223764711-223764741
  hypo

SEQ ID NO: 39754 - DNA, 75 bp, Homo sapiens
  chr2:225394300-225394375
  hypo
gtgccactgtactccgagactccctctcaaaaagaaaaaaaaaagaatgaatcaaattaacgtatgtaagtaaag

SEQ ID NO: 39755 - DNA, 24 bp, Homo sapiens
  chr2:226298377-226298401
  hypo
aaaaaattagttgggcgtgatggc

SEQ ID NO: 39756 - DNA, 32 bp, Homo sapiens
  chr2:228264610-228264642
  hypo
cctataaatagccaccgcgcctggcctataaa

SEQ ID NO: 39757 - DNA, 28 bp, Homo sapiens
  chr2:228466749-228466777
  hypo
aaaacctgtttgacgttggactaggaac

SEQ ID NO: 39758 - DNA, 30 bp, Homo sapiens
  chr2:228735796-228735826
  hypo
cctgccttccattcccgcctatccatttag

SEQ ID NO: 39759 - DNA, 215 bp, Homo sapiens
  chr2:228888319-228888534
  hypo
ttacccagtattttccgagtgcctattgcatgcaaattatgcaaggaggtgcattttccgagtgcctattgtatgcaaattatgcaaggaggtgcaaaaatgaatcagacaattgctctggggagaagggcacactatactatcagtgagtcaacctcagcagagtccaagtgattcacacggagttgattcacttccagcgccaggggtgatca

SEQ ID NO: 39760 - DNA, 100 bp, Homo sapiens
  chr2:230795535-230795635
  hypo
tgctggagccctcctcgaggtgtgctgtggttttccctcctgctgtcatttaccccctcactgctcctcctgatggcagcaagtgcgcaaacattccctt

SEQ ID NO: 39761 - DNA, 37 bp, Homo sapiens
  chr2:231170274-231170311
  hypo
ctaggcccagctgcccgtagggcgtggtcaggcaggg

SEQ ID NO: 39762 - DNA, 99 bp, Homo sapiens
  chr2:232243072-232243171
  hypo
catttctgtgatcaccgagggcttcttccagttgtcctgggtgtcacttggacaccttcctgcttggcacagtgttgctgctcacgctctcgctgtccc

SEQ ID NO: 39763 - DNA, 30 bp, Homo sapiens
  chr2:232283743-232283773
  hypo
gtgtgctccctttcacgagggtcggaatgc

SEQ ID NO: 39764 - DNA, 40 bp, Homo sapiens
  chr2:232330287-232330327
  hypo
aaaatcacctcaggccgggcgcggtggctcagatccgcaa

SEQ ID NO: 39765 - DNA, 39 bp, Homo sapiens
  chr2:232485651-232485690
  hypo
cgttgttcctcatagcggcatctccgcagtatggatgga

SEQ ID NO: 39766 - DNA, 16 bp, Homo sapiens
  chr2:232526123-232526139
  hypo
tttctactggccgggc

SEQ ID NO: 39767 - DNA, 30 bp, Homo sapiens
  chr2:232541215-232541245
  hypo
agagacacagacacacgcacacacaataca

SEQ ID NO: 39768 - DNA, 27 bp, Homo sapiens
  chr2:232546676-232546703
  hypo
attaaaagagctggccgggcgcggtga

SEQ ID NO: 39769 - DNA, 25 bp, Homo sapiens
  chr2:232570350-232570375
  hypo
cctgcatgggaataacgtcagaaaa

SEQ ID NO: 39770 - DNA, 46 bp, Homo sapiens
  chr2:233322968-233323014
  hypo
aggcactcactgaggcggtcatgttcgacgacgccattgagagggc

SEQ ID NO: 39771 - DNA, 30 bp, Homo sapiens
  chr2:233474440-233474470
  hypo
tcacccaagatgagacggaaacagtcccga

SEQ ID NO: 39772 - DNA, 50 bp, Homo sapiens
  chr2:233750505-233750555
  hypo
gtgacacatggggcccggcacagggccaggctcgccgcaggctctcaggg

SEQ ID NO: 39773 - DNA, 30 bp, Homo sapiens; identical to SEQ ID NO: 14487
  chr2:233960620-233960650
  hypo

SEQ ID NO: 39774 - DNA, 55 bp, Homo sapiens
  chr2:233986907-233986962
  hypo
tgcaataccctgtgccgctggaggaagaggacacaggcgacgaccctgaggagga

SEQ ID NO: 39775 - DNA, 116 bp, Homo sapiens
  chr2:233991021-233991137
  hypo
tgacagggctgaagccgcatttccaacttgaaggatccatctgaggctgccagggctgccctcctcctactctctcacttggcaaaatatgaagtagatgccgatgggacacatac

SEQ ID NO: 39776 - DNA, 30 bp, Homo sapiens
  chr2:233997245-233997275
  hypo
ctttcatcagtaaggcgacagccaggcttg

SEQ ID NO: 39777 - DNA, 111 bp, Homo sapiens
  chr2:234079674-234079785
  hypo
gaatcagaattaaaacgaaagtctctctgtttcagaggaggaagaaatcacgtttgccccaacctaccgttttgagagactgactcgggacaaatacgcctacaccaagca

SEQ ID NO: 39778 - DNA, 176 bp, Homo sapiens
  chr2:234109964-234110140
  hypo
tttcagctcccaaagcgaatggatcttggtgcataacaacgagcacacagcttggtgggagcatgctccccacagccccatggtgacagctgcagacaggctgccatccacgggcaaggggcccccagggtacgcttctaactcactgctcaccaaggaggcgcttggagcctgga

SEQ ID NO: 39779 - DNA, 30 bp, Homo sapiens
  chr2:234330364-234330394
  hypo
tcttttctggtctcccgtttttccataggg

SEQ ID NO: 39780 - DNA, 43 bp, Homo sapiens
  chr2:234331271-234331314
  hypo
tacacttttaacttgcgctgcccacatacgcccttgtccttaa

SEQ ID NO: 39781 - DNA, 380 bp, Homo sapiens
  chr2:234369732-234370112
  hypo
agccactgtgtccctcgtggctggtggtcagcattgtctgccattcctgctcctcgcccgccaggtgcgggttccgcctgtgagtccctcccagccggcagctgtgctgctccgccggtgcggggcctgcctgcattctccccccgtggccgcacgctggctggtgccctggtgtccctttcttgtttcccctgggctccttcttctcctggctgtggacaggtgcacccgtcggttttgtgcccggcatgccgtgtgcccttccaggcagcctgcccagccctggcgtgcagatggatcgtctgtgccagccttcggctcttgtcgagcaggtggtcgctgtcccagtcatcaccggcgttcctcgctctgcacttcca

SEQ ID NO: 39782 - DNA, 30 bp, Homo sapiens
  chr2:235382081-235382111
  hypo
ccagctggtactcaccgggaccaccatgct

SEQ ID NO: 39783 - DNA, 92 bp, Homo sapiens
  chr2:236452425-236452517
  hypo
gtggtagtgtcagggcggtagccatctgagctcacactggccctaggggctgtactttggggtatccaggggcaacacgtgccctctaaaag

SEQ ID NO: 39784 - DNA, 30 bp, Homo sapiens
  chr2:236877238-236877268
  hypo
agccgacggcctgtccggcactgctgaagg

SEQ ID NO: 39785 - DNA, 110 bp, Homo sapiens
  chr2:238475095-238475205
  hypo
ccagctccgtgcacacgcaccctgatgcctgtgtgacgctgctcctgccccttctcccccaggccgtgtcctcctcatttggatctcccctccagcggggcctcctcgga

SEQ ID NO: 39786 - DNA, 360 bp, Homo sapiens
  chr2:239050963-239051323
  hypo
cttcagagccttgcccgtggacggtcaccttgtattctaattcctggcagtgggagatctgggggttccatatggggggccagggtggatggctgtgggagagcctggggtcctgggagacctaggcagtgactgcttaccggccgttcctaagacagccagcatttcccactgagccgggacaccctcgtgccgcctgctggaggccacccagggagcaggggcagggagaagcttatgcgtggcgctgcggacctgctatgggatcggttctgaagatggttcaggaactccaggaatgcccctgaaaggcacatggtgcaaggagggagcagcttgtgcactcgggcacacgccatc

SEQ ID NO: 39787 - DNA, 30 bp, Homo sapiens
  chr2:239083135-239083165
  hypo
cgtttaagatcaccacggggctcccaaatc

SEQ ID NO: 39788 - DNA, 30 bp, Homo sapiens
  chr2:239134032-239134062
  hypo
tggcccatgtggatacgtgcaagagcacca

SEQ ID NO: 39789 - DNA, 42 bp, Homo sapiens
  chr2:239147417-239147459
  hypo
agatccagggagggccgggcccacccccgcaggactctggct

SEQ ID NO: 39790 - DNA, 30 bp, Homo sapiens
  chr2:239183260-239183290
  hypo
cccaactgatcagaacgaactttccctttg

SEQ ID NO: 39791 - DNA, 89 bp, Homo sapiens
  chr2:239265698-239265787
  hypo
gtgagccaccgcgcctggccgggaatgtttttaagtcttttttttaaatacatgttctattgtacctggttccccgcagtctccctcac

SEQ ID NO: 39792 - DNA, 184 bp, Homo sapiens
  chr2:239322426-239322610
  hypo
tcacatggttgggcacggtgttgtatctatatatgcccattctgtcgagcttgtaaccattttgttcaaatcgatatgctaatagatgttttttctattggattcaccatttaatgagagaggtgttttaaagtttcccgagtactacgatgaacaatttatttctcctcgtagttttttctgg

SEQ ID NO: 39793 - DNA, 247 bp, Homo sapiens
  chr2:239957267-239957514
  hypo
ctagcctagcagccccgctctcctgcgggctcccccgtgggccaagtctcctaaactgggccagcctggagtcaggtgcgtgcagccctgccactctacctccttgcagcgaggcctggagggcgttccacgcgtgggcaccgcggccttcggaggcctccagagtcggcctcagtgggcgcgtcctccctcctgctggaggggactggacaccgttaatgacagcgaaaatcgcctggagttgatg

SEQ ID NO: 39794 - DNA, 127 bp, Homo sapiens
  chr2:239997460-239997587
  hypo
cctgcagcctgaagacgacatctcccctcagcttcccagggaatagagctgggctgggacagcagacaggtgccagccactccccttggtttcccgggaaacaaagctgggccgggatagcaggtgg

SEQ ID NO: 39795 - DNA, 57 bp, Homo sapiens
  chr2:240080496-240080553
  hypo
ggtcccaggccagaccgcacacgcgtgccctccgcgaagaagcgtccagcagggcga

SEQ ID NO: 39796 - DNA, 134 bp, Homo sapiens
  chr2:240103588-240103722
  hypo
gatgtcgcctagagacgccgacttcctgcagacactaaatatcctaaggtaaaatcaggccccctcaaggctagggagatactacctggagcacaccttcctaacgcggtgttccttgccgccacatgcaagca

SEQ ID NO: 39797 - DNA, 121 bp, Homo sapiens
  chr2:240103944-240104065
  hypo
atctcctcgtcatggcgagcccctcccctctggctgtcacctgcacagggccccttggctccctccctcccgctgctcagagctcactcagggcggaaacgcagagcggacagatgcagcc

SEQ ID NO: 39798 - DNA, 323 bp, Homo sapiens
  chr2:240168786-240169109
  hypo
aggtgatgcagctatcggcaatggctggagactagctctgcggtctgctcgtggataaccgcgctccctcgctgccgggccacccgcacagccgggcaaaccaaaaggcccactttttcatgctgtacccaccacttctgtttccccgcaggcatcctactttctaaactaacaccttttcactcccgagaattctaacaaatattatacaattcctacccgcatctaccctccacctggacgtagaacccgtgtgggaggcagtcctgcagggtttggggtggaatatcccccctgtcgagtggagacgaggctgacatgag

SEQ ID NO: 39799 - DNA, 50 bp, Homo sapiens
  chr2:240213736-240213786
  hypo
cagcccagctcagggcggccacaccaggggctgcgcgcacagcccagctc

SEQ ID NO: 39800 - DNA, 58 bp, Homo sapiens
  chr2:240566166-240566224
  hypo
gtttgggacgtttgacgtctgcgtagatacacacaggtgcagccgtccatccagttat

SEQ ID NO: 39801 - DNA, 55 bp, Homo sapiens
  chr2:240582300-240582355
  hypo
tcatttgtcaagtaccgacgagacaccctctggtgtgaggcggcattgttagtaa

SEQ ID NO: 39802 - DNA, 326 bp, Homo sapiens
  chr2:240658183-240658509
  hypo
ggcagtgatgtctgtcggtaccccaaggcctgtgtggaggcagcaaagtgtctgggggacggactggtttcccggctttgctcaagctccgatgcccacgggaggagggtaggaggcagtcgctggtctcggtaggacacgggatgccacgcatggctggttggccaatctgtgtttgggtcaacgcgcccctgtgtgctcggacctggaactgcacctttgtcgggcaccctgagataggaagggctcacaccctgacaggtgcgatcagtcagggcagggaggcgggcagcaggactggccactggccccgataggtgctggtg

SEQ ID NO: 39803 - DNA, 42 bp, Homo sapiens
  chr2:240658874-240658916
  hypo
tgcttctctccaggtcgcagcagggcacggggggcagggagt

SEQ ID NO: 39804 - DNA, 203 bp, Homo sapiens
  chr2:240809498-240809701
  hypo
ggagaatcctggacacgcagcctcacctgggacacctgtcactccgacggagaatcctggacaggcagcctcacccgggacacctgtcattccgaaggagaatcctggacatgcagcctcacctgggacacctgtcactccgatggagaatcctggacacgcagcctcacctgggacacctgtcactccgatggagaatcctg

SEQ ID NO: 39805 - DNA, 148 bp, Homo sapiens; identical to SEQ ID NO: 14498
  chr2:241095637-241095785
  hypo

SEQ ID NO: 39806 - DNA, 163 bp, Homo sapiens
  chr2:241107135-241107298
  hypo
agccttgacaaatgccgccagggtgaaattgctctcatggctctggtccggcacagggatgaagcccataaatccagagttcaggggcaggaggctctgaggagggatgaggaccgagggctgctccctgctaatagctgggtggctgcgtggcacgtgccac

SEQ ID NO: 39807 - DNA, 30 bp, Homo sapiens
  chr2:241262151-241262181
  hypo
agaccttcacagactcgagatctcagtcag

SEQ ID NO: 39808 - DNA, 115 bp, Homo sapiens
  chr2:241350181-241350296
  hypo
gtccccctgggcaagcggcaaagcaggtaagcagaaaacagccggcaattgaacattcataagggccagtgtagaaggaagagcacccaagcgagggaggcggcccccaccatgg

SEQ ID NO: 39809 - DNA, 30 bp, Homo sapiens
  chr2:241398532-241398562
  hypo
ctggagaccgcgctccgggacagcagccgc

SEQ ID NO: 39810 - DNA, 30 bp, Homo sapiens
  chr2:241542135-241542165
  hypo
aggctcctggggcaccgccgcccactccct

SEQ ID NO: 39811 - DNA, 56 bp, Homo sapiens
  chr2:241543418-241543474
  hypo
ttcccttggggctaccgccccggctcacacctgctggccagcgtatttactccttg

SEQ ID NO: 39812 - DNA, 30 bp, Homo sapiens; identical to SEQ ID NO: 14499
  chr2:241544980-241545010
  hypo

SEQ ID NO: 39813 - DNA, 30 bp, Homo sapiens
  chr2:241662384-241662414
  hypo
gcctcaggagagggccgaggggtgggcaga

SEQ ID NO: 39814 - DNA, 44 bp, Homo sapiens
  chr2:241721534-241721578
  hypo
ccaggcagcttcacacgtggcgcgctccgcggcacctccgactc

SEQ ID NO: 39815 - DNA, 58 bp, Homo sapiens; identical to SEQ ID NO: 14500
  chr2:241722184-241722242
  hypo

SEQ ID NO: 39816 - DNA, 30 bp, Homo sapiens
  chr2:241861894-241861924
  hypo
ccagcccctgcctggcgggttcaggagcag

SEQ ID NO: 39817 - DNA, 77 bp, Homo sapiens
  chr2:241862358-241862435
  hypo
gcctcctgggctcagcgtgggcctctcacgcaaccaggcaccaccgtcccagcctctgagagcggctcagcagcatc

SEQ ID NO: 39818 - DNA, 671 bp, Homo sapiens
  chr2:241864757-241865428
  hypo
gtctgactccctctccgcgtcaccccgccccgcgaaaggcacctccctcccagcccctggcaccttgtctcaggcattgagggacgggccaaggttgcagagccagagccaggagagctcggggcaggggcagatatcgcagggaggcaggagggcactgggctggcacctgggagagccaccttgatgctggcactcagtttaggggtcctttgtggggcccatggcaggtgggggcagagcagcggctgtgcacctgagcccaggtcagttaggcccagagggtttggggttccattcaagccccttgacttggggactctgagcgcctctcttaggagaggcttcctacccccaccatgccctgtgggttctctgtccaggagcaccggcctctgtcaggtgaacgcgctcctgcgggagcagctggaacatatgaagaaggccaatgacgcgctgggccgggagctggccgggatgacgggcagcgtgcagcgcctgcagggcgagctggagctgaggcgctgggcccagagacaggtgctcccccaacccttgctcacctcatggcggccgcctgtctgggtgcctatggctgggtagcaggcagggacatggtgagggtgcactggctcagtggctgtccctcttggggacgaggccacagcttc

SEQ ID NO: 39819 - DNA, 254 bp, Homo sapiens
  chr2:242004922-242005176
  hypo
ggcctacaacatctccgtcttctcagtgaagcgaaacagtaacaacaagaatgacatcagcaggcctgccgtgctgctggcccgcacgcgtgagtgtccccgagcctggccgtccctgcccagcccctgcccctcgagggcagcgctggccccggcacctgcagggcggctgtcatgccgtccaccctcctagttcttgcagcagcaagacagacagctgagctgggggttggaggcaccgccctgctggagac

SEQ ID NO: 39820 - DNA, 78 bp, Homo sapiens
  chr2:242006616-242006694
  hypo
ttgccgggagctgagcgctgccctctggctctgcctggtgcatcagcagtggcactggagcttcggaggagactggct

SEQ ID NO: 39821 - DNA, 284 bp, Homo sapiens
  chr2:242009374-242009658
  hypo
tgccacctctgcccacgtggtctgggatgccccgactccaggcagcttgctggaggcttatgtcatcaatgtgaccaccagccagagcaccaagagccgctatgtccccaacgggaagctggcgtcctacacggtgcgcgacctgctgccgggacggcggtaccagctctctgtgatagcagtgcagagcacggagctcgggccgcagcacagcgagcccgcccacctctacatcatcacctgtgagtgccgtgggccctgcgcgtgggcggggccagtgtttg

SEQ ID NO: 39822 - DNA, 30 bp, Homo sapiens
  chr2:242011200-242011230
  hypo
ctctctgcaggttctcggagcttgtggacg

SEQ ID NO: 39823 - DNA, 70 bp, Homo sapiens
  chr2:242021761-242021831
  hypo
aggcgtctgtcaccacgtgtaagttggtttctgtcctccgccttaccgcatttgtcgtgtgttcttgact

SEQ ID NO: 39824 - DNA, 30 bp, Homo sapiens
  chr2:242128768-242128798
  hypo
acaccctccggtcatcgtcgcagctccaaa

SEQ ID NO: 39825 - DNA, 30 bp, Homo sapiens
  chr2:242131916-242131946
  hypo
cctcctataaggacacgagttgtcatggat

SEQ ID NO: 39826 - DNA, 30 bp, Homo sapiens
  chr2:242138318-242138348
  hypo
tgtacacctggtgaccgatcaaaggtgagg

SEQ ID NO: 39827 - DNA, 74 bp, Homo sapiens
  chr2:242156554-242156628
  hypo
tcttaacctagcaagcgggcatgtgagccggcaggccccggagctccccagcgtagccgcggcatctgtggaaa

SEQ ID NO: 39828 - DNA, 106 bp, Homo sapiens
  chr2:242436356-242436462
  hypo
tgagcctcctgtcaccgggtgtcacccaccctcggggggctgtggctggatcagcaggctgcccaggacctggacccgagtggctgcttcccgctggggcctccac

SEQ ID NO: 39829 - DNA, 79 bp, Homo sapiens
  chr2:242523982-242524061
  hypo
gtagccaggccctcccgagggctccagaagctctaggtttacggggtcaccttcttgtaggtgacgtgaagatgctgag

SEQ ID NO: 39830 - DNA, 120 bp, Homo sapiens
  chr2:242636866-242636986
  hypo
aagtacatgggtaaactgtggaacatccggacgttggaatatttttcaaattaaacatgaactagctattaagccacggaaaggcacgctgggaccttaaatgcatattgctgagtgaaa

SEQ ID NO: 39831 - DNA, 86 bp, Homo sapiens
  chr2:242637046-242637132
  hypo
caaactggaaacagtaaaatgatcagtggttgccaggggcctcgggagggggagagggatgaatcgggaagcgcaggggattttta

SEQ ID NO: 39832 - DNA, 71 bp, Homo sapiens
  chr2:242672951-242673022
  hypo
aggacaaatccagctcgccggttttctgtgtgactaccaggacccatctgctgtcacgggcgtagcctcca

SEQ ID NO: 39833 - DNA, 587 bp, Homo sapiens
  chr2:242756039-242756626
  hypo
gcccaggtccctggacgtcctggtcagcggaacttcctcctctgggcagtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcagggtaggcgggcagggtgccggtctgggtccctttgattggccacggtccacatggaagggagattccagcgggaaattgccattctgccccacccctgtctccagccacaagggaaccaaccatccctttccccaggactgttctgcgcctcccgtcccaggcaaatccctctccccaggaccgtcctgagcctcccgtcccagacaaatccctctccccaggactgttctgcgcctcccgtcccaggcaaatccctctccccaggaccgtcctgcacctccc

SEQ ID NO: 39834 - DNA, 135 bp, Homo sapiens
  chr2:242757497-242757632
  hypo
cagccctcactccttcgccttctacagcgatgaccacggccgcacctggcgctgtggaggcctcgtgcccaacctgcgctcaggcgagtgccagctggcggcggtggacggtgggcaggccggcagcttcctcta

SEQ ID NO: 39835 - DNA, 30 bp, Homo sapiens
  chr2:242763132-242763162
  hypo
gcccctcctagcagccgtggcctcctcagg

SEQ ID NO: 39836 - DNA, 98 bp, Homo sapiens
  chr2:242784279-242784377
  hypo
ccagtctatgaaggccggagagaaaggagagaaaggaggatggaatcctgcctgcaggcatctttggatttgagtggctacttcggctcctcctgcgt

SEQ ID NO: 39837 - DNA, 39 bp, Homo sapiens
  chr2:242791597-242791636
  hypo
gcagccctcccaccccgctgtggacgccctggcaccagg

SEQ ID NO: 39838 - DNA, 165 bp, Homo sapiens
  chr2:242794852-242795017
  hypo
ccgctgtcattgcgccgggccctgaccacgctcatgtggaagtcacgcccgttgggcagttgtgtgacacggaagcggcagtcctggccgggctggctgcggtcctcggggaaggcggccagcttgtccgtctggttgctggggctcatgcggtaccagtttagc

SEQ ID NO: 39839 - DNA, 30 bp, Homo sapiens
  chr2:242814897-242814927
  hypo
cgtcccagtgggtcacgacgccctgccaga

SEQ ID NO: 39840 - DNA, 342 bp, Homo sapiens
  chr2:242832880-242833222
  hypo
tggatacgtcccagccgaaatgttcaccgtgaatccggcaacctgtggagctgatttccatttctaaggaatgaggggggatggggaagaaccccccaggacagcaccaacagtccctgcggggacctttcccggacacccggccttctcggcggtgaggcaggtggcggcaccgacaggcccgggggggacctttcccggacacccagcctcctcggtggcgaggcaggtggcggcaccgacaggcccggcggggacctttcccggacacctggcctccttggcaaggcaggtggcggcaccaacaggcccgggggggacctttcccggacacctggcctc

SEQ ID NO: 39841 - DNA, 110 bp, Homo sapiens
  chr2:242833478-242833588
  hypo
ttggttctgtggcctcggtttctgtcttcctgatggcacctctgtgacaggagctcagaccccggcatcagaccggcctccgcagggaggagctgcggtgcccaggccag

SEQ ID NO: 39842 - DNA, 32 bp, Homo sapiens; identical to SEQ ID NO: 14514
  chr2:242833797-242833829
  hypo

SEQ ID NO: 39843 - DNA, 56 bp, Homo sapiens
  chr2:242836469-242836525
  hypo
tcagcccatcccacgcggagcctggggcagggcgataatttcggcattgtgagtca

SEQ ID NO: 39844 - DNA, 76 bp, Homo sapiens
  chr2:242891535-242891611
  hypo
gctgaatctggaagccgggggccaggggtgctccatgtaccgtgggcgttggaagtgggggcgtcttgtgggctca

SEQ ID NO: 39845 - DNA, 30 bp, Homo sapiens
  chr2:242892372-242892402
  hypo
gcatgggtccgtgtgcgagcacaggtgtgc

SEQ ID NO: 39846 - DNA, 166 bp, Homo sapiens
  chr2:242925496-242925662
  hypo
tctcaaaagatacttcgagcaaaaacaccggacagaagcgtccgtgccagccccgcaggctgcctgtgtgccaggctatcccgtgccatctgatccgggagaagcaggactttcttgcacaggtactcagcgctgtggctgtgggaggagccgggagggccctggc

SEQ ID NO: 39847 - DNA, 114 bp, Homo sapiens
  chr2:242985077-242985191
  hypo
gctgttacctgaggacggagcaggtgcggctgttacctgaggactgagcaggtgcggctgttacctgaggacggagcaggtgcggctgttacctgaggacggagcaggtgcggc

SEQ ID NO: 39848 - DNA, 30 bp, Homo sapiens
  chr3:1741068-1741098
  hypo
aacaagtgggagtcccgcccccttccaaat

SEQ ID NO: 39849 - DNA, 191 bp, Homo sapiens
  chr3:2909417-2909608
  hypo
cacccaaccatgctgcgtcaggtacctactgtatcgagtctacgaccataccccaaaagatctcataattctgcatcacagttgtctgtgttcttcactgtctgtcttactagcaatttgcctttttaaagcatatgtagtaccttattcacagccacctctgctgcacctggtttcgcaactggtacatc

SEQ ID NO: 39850 - DNA, 38 bp, Homo sapiens
  chr3:3167655-3167693
  hypo
cggcaaaagtaatcccggcacttttgggggccgaggcc

SEQ ID NO: 39851 - DNA, 30 bp, Homo sapiens
  chr3:3167988-3168018
  hypo
ctctttgctcttttccgctctagaaagaat

SEQ ID NO: 39852 - DNA, 30 bp, Homo sapiens
  chr3:4755974-4756004
  hypo
ctgaggacgacaccacggtgagtgtggagg

SEQ ID NO: 39853 - DNA, 87 bp, Homo sapiens
  chr3:5831053-5831140
  hypo
ttaaagaaaacagaagatgaaagggaaacaaggccaagtaacatctctgcagagttcctctgctgtctcattcgctgggcaggctca

SEQ ID NO: 39854 - DNA, 30 bp, Homo sapiens
  chr3:5970953-5970983
  hypo
gccggtggccaaatgcgctcaccctggctc

SEQ ID NO: 39855 - DNA, 30 bp, Homo sapiens
  chr3:9006374-9006404
  hypo
atttaagaccaggtccgtggcctgagtgaa

SEQ ID NO: 39856 - DNA, 17 bp, Homo sapiens
  chr3:9688167-9688184
  hypo
gccggattggtcatttc

SEQ ID NO: 39857 - DNA, 30 bp, Homo sapiens
  chr3:10127378-10127408
  hypo
attcttttttcaaaccgttaaactattgat

SEQ ID NO: 39858 - DNA, 49 bp, Homo sapiens; identical to SEQ ID NO: 14519
  chr3:10182868-10182917
  hypo

SEQ ID NO: 39859 - DNA, 35 bp, Homo sapiens
  chr3:10452258-10452293
  hypo
gccaggtgtgcggggcggttcgtgggtctgaggcc

SEQ ID NO: 39860 - DNA, 66 bp, Homo sapiens
  chr3:11581322-11581388
  hypo
cctgccctgcacagccgcctggaggttcacctgcatcattgcgtgtgtcagcgcttggtgcctttc

SEQ ID NO: 39861 - DNA, 30 bp, Homo sapiens
  chr3:12039968-12039998
  hypo
cttgctatatcaagccgctgatgaccgcag

SEQ ID NO: 39862 - DNA, 30 bp, Homo sapiens; identical to SEQ ID NO: 14520
  chr3:12586227-12586257
  hypo

SEQ ID NO: 39863 - DNA, 68 bp, Homo sapiens
  chr3:12867218-12867286
  hypo
catcagagcaggtgccggggccacatggcctgggtcaagtcctgccctgactccgagctgtgggaccc

SEQ ID NO: 39864 - DNA, 30 bp, Homo sapiens
  chr3:13083168-13083198
  hypo
ggaggtatgaacattcgggcttgtggtgcc

SEQ ID NO: 39865 - DNA, 100 bp, Homo sapiens
  chr3:13083990-13084090
  hypo
atggcccagcccgcccggcgcagcttgtacagtacacgcctccaatacaaagagcagccagcacaaaagcctagcaactcattcacgcagctcgcctggc

SEQ ID NO: 39866 - DNA, 30 bp, Homo sapiens
  chr3:13096379-13096409
  hypo
tcctcatttgtaaaacggggctgatcagag

SEQ ID NO: 39867 - DNA, 30 bp, Homo sapiens
  chr3:13367390-13367420
  hypo
gaggatgctgttggccgaggagctccaggt

SEQ ID NO: 39868 - DNA, 42 bp, Homo sapiens
  chr3:13373208-13373250
  hypo
aagtgtcctgtggcccgtggagtctcccgcttggcaactgcc

SEQ ID NO: 39869 - DNA, 30 bp, Homo sapiens
  chr3:13442799-13442829
  hypo
cctaggcagatgtcccgccttctggctgga

SEQ ID NO: 39870 - DNA, 188 bp, Homo sapiens
  chr3:13612034-13612222
  hypo
gcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcg

SEQ ID NO: 39871 - DNA, 97 bp, Homo sapiens
  chr3:13679132-13679229
  hypo
agctcaacttccagacgggcctcctggtgcctgcgcatatcttccgcattggccccgcgccagccttcacgggggacaccatcgccctgaacatcat

SEQ ID NO: 39872 - DNA, 30 bp, Homo sapiens; identical to SEQ ID NO: 14522
  chr3:13680779-13680809
  hypo

SEQ ID NO: 39873 - DNA, 78 bp, Homo sapiens
  chr3:13860693-13860771
  hypo
gtgtccatgggcttgcggtacgacagtggcttcttgatcttcaggaaggtgggccgcttgttgcggctggcacgcaca

SEQ ID NO: 39874 - DNA, 30 bp, Homo sapiens
  chr3:14197900-14197930
  hypo
tatttcaggagatgccgcttcagggcatac

SEQ ID NO: 39875 - DNA, 161 bp, Homo sapiens
  chr3:14443179-14443340
  hypo
aaggatcggctctctcctccccgcctcccaggtgcagagagagagagagagagagagggacaggagaaggctggggttcggggttctcacagcgtttccctctcatgctgccagggcggggcagtggaaaatggtccctgagggcccgttcattcaaataa

SEQ ID NO: 39876 - DNA, 30 bp, Homo sapiens
  chr3:14676121-14676151
  hypo
tcgtttgctggaccacgatctccttgaagt

SEQ ID NO: 39877 - DNA, 30 bp, Homo sapiens
  chr3:14964046-14964076
  hypo
tgtggcaaggtgagtcgctgcatctggggt

SEQ ID NO: 39878 - DNA, 30 bp, Homo sapiens
  chr3:15105526-15105556
  hypo
caaatggctaggaagcggcttccggatctc

SEQ ID NO: 39879 - DNA, 30 bp, Homo sapiens
  chr3:16952388-16952418
  hypo
ctttggttttatcttcgagatataactagt

SEQ ID NO: 39880 - DNA, 38 bp, Homo sapiens
  chr3:17001303-17001341
  hypo
tgtaagaaggtccaccgggtgctgtggctcatgcctgt

SEQ ID NO: 39881 - DNA, 66 bp, Homo sapiens; identical to SEQ ID NO: 14524
  chr3:17499802-17499868
  hypo

SEQ ID NO: 39882 - DNA, 36 bp, Homo sapiens
  chr3:18299798-18299834
  hypo
tggaggcaagaaagccgagcctttttttttttttta

SEQ ID NO: 39883 - DNA, 92 bp, Homo sapiens
  chr3:19791264-19791356
  hypo
tgaggggagttctcccgggcccaggatggcaaaggtccgcgtgggaagtgtggatcccccggggcctctcactcaatcgccccttccccacc

SEQ ID NO: 39884 - DNA, 31 bp, Homo sapiens
  chr3:20013239-20013270
  hypo
tacaggtggaagccaccgcacctggcccagt

SEQ ID NO: 39885 - DNA, 20 bp, Homo sapiens
  chr3:20139710-20139730
  hypo
gacaacgtcccaaattaaaa

SEQ ID NO: 39886 - DNA, 81 bp, Homo sapiens
  chr3:21447519-21447600
  hypo
accacggagcaggtccgtgccttggagggcgtcttccggcaccaccagtacctgggccctctggagcggaattggctggcc

SEQ ID NO: 39887 - DNA, 91 bp, Homo sapiens
  chr3:22370592-22370683
  hypo
ttattaaagttgctcatatcactttctaggctcactgctatttctcatatgccatgccttcctctagtccaccgtccgtgctgatgtacat

SEQ ID NO: 39888 - DNA, 158 bp, Homo sapiens
  chr3:32151266-32151424
  hypo
agctggacacagtcccggtccttaaacaacttaccttcaggtctgagatcagtgaggacatggaagataagaccgaaggaattgccaagtggaatggagtaactgctctgttacactttaaatcgtgtttctttttttgtttgtttgtttttgttttt

SEQ ID NO: 39889 - DNA, 197 bp, Homo sapiens
  chr3:33841159-33841356
  hypo
taagaacattttttacgattttatagttaaacatttcttttgcataccttgttaatctcgttttctccgtatagtatattctacttgtttcacaggagaatcacaattgtattccaatccaagtagcagaaacccaggctaaactagcttgagctaagaaaagacttattctgccgggcgcggtggctcacgcctgt

SEQ ID NO: 39890 - DNA, 76 bp, Homo sapiens
  chr3:33841656-33841732
  hypo
ctgaaaagtctagggatattccttccttagctttaggtatcactggagatcgtcttgcctccgtgatgcttccctc

SEQ ID NO: 39891 - DNA, 17 bp, Homo sapiens
  chr3:34246982-34246999
  hypo
gggcgcggtgactcacg

SEQ ID NO: 39892 - DNA, 180 bp, Homo sapiens
  chr3:34690946-34691126
  hypo
ctgaacttcattttccgtaactacacagttatcattaaactcagattgactcataaagttaccattaatcatcaaagaccaatgaaattcagagtgtaatcctgatcaaggcaagaaagttggataatttagaattacttgcagcagtcaatattatgtaatgctcgctaatccccgaag

SEQ ID NO: 39893 - DNA, 17 bp, Homo sapiens
  chr3:37296942-37296959
  hypo
cacgcctgacctttata

SEQ ID NO: 39894 - DNA, 37 bp, Homo sapiens
  chr3:37876204-37876241
  hypo
gcttatccacggtttcgctttccgagctttcagttat

SEQ ID NO: 39895 - DNA, 32 bp, Homo sapiens
  chr3:38032423-38032455
  hypo
gggccacagagcctccgcggcagaattgggag

SEQ ID NO: 39896 - DNA, 30 bp, Homo sapiens
  chr3:38041112-38041142
  hypo
aatcatacacagccacgggcactcacacaa

SEQ ID NO: 39897 - DNA, 147 bp, Homo sapiens
  chr3:38627339-38627486
  hypo
gcagcaggcctgagtcgctgtccctcagctccgagtagttcttgccaaagagctgcatgcccaccacagcaaagatgaacacgatgatggctagcaccagtgtcaggttccccagtgcccccactgagttcccgatgatcttgatga

SEQ ID NO: 39898 - DNA, 30 bp, Homo sapiens
  chr3:38950258-38950288
  hypo
agcatcaagaccaagcgttccccgttttga

SEQ ID NO: 39899 - DNA, 37 bp, Homo sapiens; identical to SEQ ID NO: 14527
  chr3:40501058-40501095
  hypo

SEQ ID NO: 39900 - DNA, 52 bp, Homo sapiens
  chr3:41289147-41289199
  hypo
ccatgaccaggagaccgttccatgcattcctgctctgcgcatcaaagcccct

SEQ ID NO: 39901 - DNA, 149 bp, Homo sapiens
  chr3:42200630-42200779
  hypo
cctgagcagaattctcggccctaaggattcaaagacgaatgagatatggttcccgaacttgtgtagaaaattgttttatgaagaccttgcccctgctaaaatctctcttggctacctgggggaggcagcctgttcgggaggttggaatg

SEQ ID NO: 39902 - DNA, 18 bp, Homo sapiens
  chr3:42222719-42222737
  hypo
ttgcattgaaatgtgcgt

SEQ ID NO: 39903 - DNA, 120 bp, Homo sapiens
  chr3:42640761-42640881
  hypo
atgtgtattttatagtttaaaaaaaaaacttataaaatagtgtggtactcagacacagatcattggaacaaaaatccagaaacagacccacacatatatggtcacaaggcgaaggtaatt

SEQ ID NO: 39904 - DNA, 30 bp, Homo sapiens
  chr3:42851003-42851033
  hypo
agctgctattgaacacggcaggtgagagaa

SEQ ID NO: 39905 - DNA, 21 bp, Homo sapiens
  chr3:43664372-43664393
  hypo
tttgagatagagcctcgcaat

SEQ ID NO: 39906 - DNA, 30 bp, Homo sapiens
  chr3:44938829-44938859
  hypo
ccacttatgggctgacgttaggtgtaaatg

SEQ ID NO: 39907 - DNA, 34 bp, Homo sapiens
  chr3:44999995-45000029
  hypo
aacattcaatagccacgtgcgcagcttggcatat

SEQ ID NO: 39908 - DNA, 30 bp, Homo sapiens
  chr3:45821641-45821671
  hypo
ctccgccaggcccagcgtgtgctcccagga

SEQ ID NO: 39909 - DNA, 30 bp, Homo sapiens; identical to SEQ ID NO: 14530
  chr3:45885052-45885082
  hypo

SEQ ID NO: 39910 - DNA, 37 bp, Homo sapiens
  chr3:46584785-46584822
  hypo
ttccctttaccataccgggcacattaaacacgcttta

SEQ ID NO: 39911 - DNA, 46 bp, Homo sapiens
  chr3:46949012-46949058
  hypo
gtcattctccatgtgcgagcgtttgtatgcgcgtgctgcttgtgta

SEQ ID NO: 39912 - DNA, 22 bp, Homo sapiens
  chr3:47555871-47555893
  hypo
gccgacacggaattatatcttg

SEQ ID NO: 39913 - DNA, 20 bp, Homo sapiens
  chr3:48227769-48227789
  hypo
atgtttatcaccgggcgcgg

SEQ ID NO: 39914 - DNA, 41 bp, Homo sapiens
  chr3:48236523-48236564
  hypo
aatgggagtaatggccgggcgcggtggctcacgcctgtaat

SEQ ID NO: 39915 - DNA, 459 bp, Homo sapiens
  chr3:48636676-48637135
  hypo
cacctggccctgtgccgcacccagctcggagatgctgcccagagcagcacaagacaggctttgagtggaaagagaggagagaacattcccccaggggtgctgagcctgtcccttcatgttctggcccttgaagccccaccccacatggaggtgcccgttacctgacgggtgcagggtattgatgaaggcaccttggcaggcagtcaaggaactgctgggacaggttttctgagcaagaactccctggcagccaggggactggggagagctgcttggggccttaactggctgctctgtaagctgagcagcagtgcgggagcagaggtggaaggggaggccaagagaacggcctgaggaaataaacaaagagcagaccccctaggccacttaccatatccagccactgctgggcactggtcatagatgtacttggagcagatctcacgtaccacactggca

SEQ ID NO: 39916 - DNA, 30 bp, Homo sapiens
  chr3:48883988-48884018
  hypo
tgcccaggctggtctcgaactcttggattc

SEQ ID NO: 39917 - DNA, 30 bp, Homo sapiens; identical to SEQ ID NO: 14534
  chr3:48948476-48948506
  hypo

SEQ ID NO: 39918 - DNA, 90 bp, Homo sapiens
  chr3:49034204-49034294
  hypo
ataattaagtctgtccggggttcgacaaacagcatcttgtccaaggtgagcatagcccaaggctatgtgcctgcccggagactcagcttg

SEQ ID NO: 39919 - DNA, 21 bp, Homo sapiens
  chr3:49056918-49056939
  hypo
tttttttttttgagacggagt

SEQ ID NO: 39920 - DNA, 48 bp, Homo sapiens
  chr3:49057282-49057330
  hypo
ggcaacagccatttacgggccaaccaaataatgcgaccataatagaaa

SEQ ID NO: 39921 - DNA, 30 bp, Homo sapiens
  chr3:49140985-49141015
  hypo
cacctccttctcactcgtgcccagaagaaa

SEQ ID NO: 39922 - DNA, 25 bp, Homo sapiens
  chr3:49189546-49189571
  hypo
ggccgggcacagtggcgcacgcctg

SEQ ID NO: 39923 - DNA, 51 bp, Homo sapiens
  chr3:49755535-49755586
  hypo
ctacgtgcttgtggacgctggccttgcggctgggtgcgtctggcggtgtgg

SEQ ID NO: 39924 - DNA, 892 bp, Homo sapiens
  chr3:49939702-49940594
  hypo
cgcctgcccccccaccgcgcccccagatcccctcagtgatggaagggaagcagcctgtgttcagccatgtgcatgcagctcacaagtaagggccccttctttcagcttaccgggttggggcaaaaactgggcgactggaagaagtcgaggcctcgccggaggcctggatggactggggattcacaacagcgctccacaccctcatcaattagtgtgtccagcaggtcaatggggaaggcacagacgacagagttggggcccacgccaggaccaccatccttgccagtcacaaagaccccaaatagtacttcctggccctcggcgatgctcagctcagtggcaagttgggcacccactggagcggagtgggccacccgcagcacagggtagggctgtccgccttctggggccccccggcgcctgcgttttggagcaaatctgcagtcgaggaccagctcccgatagtcacccaactctggctcagtggcgctaagccgtgccaggcgtgtgtgcagggcactaggatcatctgtcacgctggccggctgtacagtcaggaagtatacgaaggctcccgtgtggaagctgtgcacgtattcaatactgtaggagacaagatgcttgggcagcactgacaacgccacaaagcccggtgcgaatcccgaggcgtcagccttgagacgcctgatagacactgagcgtgggctgaagctggcagccacggctgcgtccagtgaggatgccacgtagaaataggaggcctggccttgctcaaccacagttacacgggtgcccaatgggctggccacacagtcggggcagtcatcgggccggttatggtgggctgagaagaggcaggctggcgctgccagatgcacggctgtcccttggg

SEQ ID NO: 39925 - DNA, 30 bp, Homo sapiens; identical to SEQ ID NO: 14538
  chr3:50395506-50395536
  hypo

SEQ ID NO: 39926 - DNA, 43 bp, Homo sapiens
  chr3:50425370-50425413
  hypo
agggagtgaggaagacggagaacagagccgagtttgggcagga

SEQ ID NO: 39927 - DNA, 30 bp, Homo sapiens
  chr3:50426624-50426654
  hypo
ctcggcctttccctgcgcccggctccgacc

SEQ ID NO: 39928 - DNA, 192 bp, Homo sapiens
  chr3:50433950-50434142
  hypo
acaaatgcctgcccacgccgaccccaaacccagggatggatgaggcccccaattcataagcctgcagtgaccttgtgtagagggcattactgtgtgacttgtacggttcgcaatgcttgtcaccagtgttaggcgagcacctgcagtacagcaggtgccgagctcagtaacttggcccggaggctgtgtaaa

SEQ ID NO: 39929 - DNA, 27 bp, Homo sapiens
  chr3:50575602-50575629
  hypo
ggggctcaagcaatacgactccagcca

SEQ ID NO: 39930 - DNA, 20 bp, Homo sapiens
  chr3:52352335-52352355
  hypo
acaggcgtgagccactgcgc

SEQ ID NO: 39931 - DNA, 128 bp, Homo sapiens
  chr3:52415830-52415958
  hypo
tcacaaggctcgcctcgcacatgtgagcgcctccagggcgtgctgggcagtgggcggccagggctggctggtcggtttgactgacccatgcttttgcacagtggtagaggcctcgggcaaccctgaag

SEQ ID NO: 39932 - DNA, 30 bp, Homo sapiens
  chr3:52429714-52429744
  hypo
cagacccagtggggccgcctctgcatccat

SEQ ID NO: 39933 - DNA, 30 bp, Homo sapiens
  chr3:52537738-52537768
  hypo
gttcttggggttggacgtggtgttcccctc

SEQ ID NO: 39934 - DNA, 84 bp, Homo sapiens; identical to SEQ ID NO: 14542
  chr3:52552577-52552661
  hypo

SEQ ID NO: 39935 - DNA, 240 bp, Homo sapiens; identical to SEQ ID NO: 14543
  chr3:52553207-52553447
  hypo

SEQ ID NO: 39936 - DNA, 30 bp, Homo sapiens
  chr3:52599737-52599767
  hypo
ctaaaaaaagacatacgaatgtccaatagg

SEQ ID NO: 39937 - DNA, 135 bp, Homo sapiens
  chr3:52900714-52900849
  hypo
gtcctcctcagagcccgatctgggctggcgctccacgtggacccactgactagcagaaggaagttggaattttacacttgatgtcacagagtggtagagtaacaagtcaaaaaacacaggcgttggaagggatat

SEQ ID NO: 39938 - DNA, 31 bp, Homo sapiens
  chr3:53032137-53032168
  hypo
aaatgtagatcaggtcgggcacggtggctca

SEQ ID NO: 39939 - DNA, 837 bp, Homo sapiens
  chr3:53032798-53033635
  hypo
gggagctggtgctgccgatcgacctgactggcccacaacgtcttcagctaccactgcaagggcctgcggggtgacggctgtgcagcgctgctcgcctagctgttgatcgcctggctgttgatgggctggcacccgcagagctgccctgccggccaccgaccaccatggagggagcattcagctggtgcgcgagctgggtactaaactggctctactgtgagccgccctcggcccctccatctcctcttaccccttgtcatccatgcgtaagccggggacgcccgaggacatgctcttcacccaaggcctgcgccggcgtctgctgatcaagggcccagtacaaaggccgtcatggagatccaggccttcgccaacagcggcctgttctggtgcaagggccagccgggcagcccaaggacctcacgactggctgctgggtcaaggcgttcccggggtgaaggtggataagcagaccaccaagggctcctggaaccctacgtgaaggaggccaagcacagccgtggacaccggcctgaaggctgggaaaggagccgacgccccacctcctctgaccaggcctgcggggaggagccacccacgcgccacagcaagtcctggacctggccctgcattccagggtggggcagggaggctggattctgagagagctgcttccggattgcgttggggtagtcaaggagctcgggacatcgcaggggaggcaaaaagccttggccagtgctcttttggtgtatcccttcagcttccagaggggaagccacaccctgatgctatgttcaaacgctccagaagacaggagttcgtgtccttgcccct

SEQ ID NO: 39940 - DNA, 30 bp, Homo sapiens
  chr3:53217535-53217565
  hypo
cttctgtgaccactgcggcagcctgctctg

SEQ ID NO: 39941 - DNA, 38 bp, Homo sapiens
  chr3:56718243-56718281
  hypo
cagtataaactatcacgggttatcgtgagtacagccaa

SEQ ID NO: 39942 - DNA, 28 bp, Homo sapiens
  chr3:57740997-57741025
  hypo
gagccaccgcgcccggcctaattgctac

SEQ ID NO: 39943 - DNA, 187 bp, Homo sapiens
  chr3:58456517-58456704
  hypo
gatctggggcctcctcgacttccataggggaggttgggcctgcactgtccaccatgacccatacaaccacagacagaagttccttggtagtaaccagcatgtgttcattacagtgaatgaaaagaccagagcaggtagcatggatctcagccgcagctcatggaccacccagcgctgggaattgcag

SEQ ID NO: 39944 - DNA, 30 bp, Homo sapiens
  chr3:67047776-67047806
  hypo
gatgaaggatctaagcgctcaggggttgaa

SEQ ID NO: 39945 - DNA, 31 bp, Homo sapiens
  chr3:68834960-68834991
  hypo
gtgaggactgccagcacgctgtaacctctca

SEQ ID NO: 39946 - DNA, 81 bp, Homo sapiens
  chr3:69741003-69741084
  hypo
tgggcttgatcttgttataatgtcaccatttctcagatgagaattcagaggctcagaagcacatcgcgagagaatgtggga

SEQ ID NO: 39947 - DNA, 21 bp, Homo sapiens
  chr3:70083716-70083737
  hypo
aggcgtggtggctcacgctta

SEQ ID NO: 39948 - DNA, 30 bp, Homo sapiens
  chr3:72305951-72305981
  hypo
ggaaggctgggatttcgcagctctttgcac

SEQ ID NO: 39949 - DNA, 30 bp, Homo sapiens
  chr3:72773579-72773609
  hypo
cagtataaagaaaaccggcaatggggatgg

SEQ ID NO: 39950 - DNA, 28 bp, Homo sapiens
  chr3:73045129-73045157
  hypo
tttttgaaacagtctcgctttgtcgcct

SEQ ID NO: 39951 - DNA, 88 bp, Homo sapiens
  chr3:73045517-73045605
  hypo
tcccaaagtgttgggatcaccggcctgagccccctgcccggcctcgctctacgttttttaggcgcattctgaacgtgaagtgtataca

SEQ ID NO: 39952 - DNA, 165 bp, Homo sapiens
  chr3:73498616-73498781
  hypo
ccataatccacagtgcgagcaaatcctccgtggatgcatattgatttctgaatcatgatgaggacttgtatattgaacaaataattattttgcttctttctactggcagccacattgttaatcatatcccacgcctcactgttaaataagcgaacaacgcgtgta

SEQ ID NO: 39953 - DNA, 32 bp, Homo sapiens
  chr3:86960228-86960260
  hypo
tgaaagttgacacttcggccgggcgcggtggc

SEQ ID NO: 39954 - DNA, 28 bp, Homo sapiens
  chr3:87226527-87226555
  hypo
tcagtgtgtttcacggaatagttttgga

SEQ ID NO: 39955 - DNA, 163 bp, Homo sapiens; identical to SEQ ID NO: 14551
  chr3:87782694-87782857
  hypo

SEQ ID NO: 39956 - DNA, 28 bp, Homo sapiens
  chr3:87881755-87881783
  hypo
gcgtgagccaccgcgcccagccagaata

SEQ ID NO: 39957 - DNA, 37 bp, Homo sapiens
  chr3:88248004-88248041
  hypo
ggattacagggttgagcaaccccgcccgcccgattct

SEQ ID NO: 39958 - DNA, 18 bp, Homo sapiens
  chr3:93697929-93697947
  hypo
tatttatttttgagacgg

SEQ ID NO: 39959 - DNA, 30 bp, Homo sapiens
  chr3:93801136-93801166
  hypo
aacttgctagagctacgaatttcaggctct

SEQ ID NO: 39960 - DNA, 52 bp, Homo sapiens
  chr3:97200376-97200428
  hypo
gggggtccctagagccgccggggcgcggcgcgtccggcgctgggggactgtt

SEQ ID NO: 39961 - DNA, 31 bp, Homo sapiens
  chr3:98029454-98029485
  hypo
ggcaaaattcacccccgatatttcatgtagg

SEQ ID NO: 39962 - DNA, 153 bp, Homo sapiens
  chr3:101230951-101231104
  hypo
ccgcgcccggccaataaatctgtaattgttaactgtctctgcagaaaccaacggtaccatcagaaacagaaaaatgaaatgaaataattgattcattgggcgttcgtttgtgtactggactgtaagcatatgagtcctcgtcctctcctccta

SEQ ID NO: 39963 - DNA, 93 bp, Homo sapiens
  chr3:101397204-101397297
  hypo
tttcccccatggggtcgggcagtgagagcagaagaccaaatgcaccctctgcgaacccaggaggctggtctacgtgtcaggccaaccccactc

SEQ ID NO: 39964 - DNA, 30 bp, Homo sapiens
  chr3:107632034-107632064
  hypo
tttaaacattggaaccgttggctgaaatgc

SEQ ID NO: 39965 - DNA, 30 bp, Homo sapiens
  chr3:107771985-107772015
  hypo
cagcagatggaggcacgcctccaggactgc

SEQ ID NO: 39966 - DNA, 30 bp, Homo sapiens; identical to SEQ ID NO: 14555
  chr3:107833994-107834024
  hypo

SEQ ID NO: 39967 - DNA, 34 bp, Homo sapiens
  chr3:111988003-111988037
  hypo
gcccgggctggagtgcgatcatagctcactgcag

SEQ ID NO: 39968 - DNA, 18 bp, Homo sapiens
  chr3:113557458-113557476
  hypo
tttcgcacattggggcag

SEQ ID NO: 39969 - DNA, 30 bp, Homo sapiens
  chr3:113958215-113958245
  hypo
ccggttgggtcggggcgacctgcaagcttg

SEQ ID NO: 39970 - DNA, 36 bp, Homo sapiens
  chr3:115502421-115502457
  hypo
aaagaaaacaaaaaaaatgcacggagggaaaacagc

SEQ ID NO: 39971 - DNA, 71 bp, Homo sapiens
  chr3:115752446-115752517
  hypo
ctccgtaacatgctgcggggccagagcactctagcgaatgatttctgtggcagccacgaccctctgtgact

SEQ ID NO: 39972 - DNA, 148 bp, Homo sapiens
  chr3:116990241-116990389
  hypo
ctccatcttaaaaaaaaaaaaaaaaaaaaaaaggagcataatctctcaacatctgctaaattaaaaacaaaaggatctggccctttatgtgtcagtaaacaggtaagaactctgttctcaactatgcgaccggcggcagtggcacaaa

SEQ ID NO: 39973 - DNA, 37 bp, Homo sapiens; identical to SEQ ID NO: 14558
  chr3:118976384-118976421
  hypo

SEQ ID NO: 39974 - DNA, 30 bp, Homo sapiens
  chr3:119055204-119055234
  hypo
tttacatcagccagtcgctagatgggccat

SEQ ID NO: 39975 - DNA, 98 bp, Homo sapiens
  chr3:119815404-119815502
  hypo
taattgttaggggcccgatagcagtaggagggtgaaaacaaaatggtttgggaccttaaataattgaaatgtatctttatttatttatttatttttga

SEQ ID NO: 39976 - DNA, 180 bp, Homo sapiens
  chr3:119815742-119815922
  hypo
gagtgtcaggattacaggcgtaagccaccacaccgggccggttgaaatttatctttaaaatagtgcacctttaatcctttttttatttctgtgtgtatcttataatgtgcatatcatgttagctcaagatcaagagtttatggacaagccaggagtggtggcttatgactgtaatcccag

SEQ ID NO: 39977 - DNA, 18 bp, Homo sapiens
  chr3:119817451-119817469
  hypo
aaacgctaggattactgg

SEQ ID NO: 39978 - DNA, 25 bp, Homo sapiens
  chr3:121265940-121265965
  hypo
aaataaaagagatctcgccggccgt

SEQ ID NO: 39979 - DNA, 30 bp, Homo sapiens
  chr3:121438641-121438671
  hypo
gcaagttacactccccgaatattgcacaaa

SEQ ID NO: 39980 - DNA, 82 bp, Homo sapiens
  chr3:121563924-121564006
  hypo
gaaaagctctgatgccgaaagaacaaagagtttgtggaataagtgactttacgtagtaaatcatagtataatgaaaaatggg

SEQ ID NO: 39981 - DNA, 34 bp, Homo sapiens
  chr3:121638037-121638071
  hypo
tctcctgtagtctagcgagcgggagcgtgttacg

SEQ ID NO: 39982 - DNA, 30 bp, Homo sapiens
  chr3:121980857-121980887
  hypo
cagatcccaggcttccgggaattcctgaag

SEQ ID NO: 39983 - DNA, 30 bp, Homo sapiens
  chr3:122100925-122100955
  hypo
gggattctaggcactcgattttaaacactc

SEQ ID NO: 39984 - DNA, 38 bp, Homo sapiens
  chr3:122231278-122231316
  hypo
cataatgcggctgggcgcggtggctcatgcctgtaatc

SEQ ID NO: 39985 - DNA, 32 bp, Homo sapiens
  chr3:122234217-122234249
  hypo
gcttgataacgtatgcgtagtatcaaaaataa

SEQ ID NO: 39986 - DNA, 91 bp, Homo sapiens
  chr3:122234549-122234640
  hypo
ataataacaataataataataataataatgaaactacatgaaacacatactcgttttactctcaactgctctcaaacgaaaacttggagca

SEQ ID NO: 39987 - DNA, 29 bp, Homo sapiens
  chr3:122573648-122573677
  hypo
gactcaaaggctgggcgcggtggctcacg

SEQ ID NO: 39988 - DNA, 148 bp, Homo sapiens
  chr3:122702275-122702423
  hypo
gcacaataaatcatccgcggggcggggacggggcggggtggtaaaaaaaacctataaagacacacgagaaagccaagctacttttgggggagcacagagaagcttctagaatggctgacagagtcctattacttgacttgggtgatga

SEQ ID NO: 39989 - DNA, 102 bp, Homo sapiens; identical to SEQ ID NO: 14566
  chr3:125456444-125456546
  hypo

SEQ ID NO: 39990 - DNA, 39 bp, Homo sapiens; identical to SEQ ID NO: 14567
  chr3:125785793-125785832
  hypo

SEQ ID NO: 39991 - DNA, 98 bp, Homo sapiens
  chr3:126134590-126134688
  hypo
gacacggggcggggtcggggtgtggggaggtgagtcctgccttcctgctcctccgaaagttttctcccaagggagggctggctcgaagccacccccag

SEQ ID NO: 39992 - DNA, 35 bp, Homo sapiens
  chr3:126138969-126139004
  hypo
ggaggtttctgcagacgatgcggctggggcggagc

SEQ ID NO: 39993 - DNA, 167 bp, Homo sapiens
  chr3:126195886-126196053
  hypo
cccccacccctcccccgcaccccacctctttttcccagttcatccagcaagccaagctggttccagcctcagagacttggcgcagctgatctctgattcctctgggaggactctgcgccccttctgatccaaagcacatgcttacccagtcccgtattcccacctct

SEQ ID NO: 39994 - DNA, 77 bp, Homo sapiens
  chr3:127394832-127394909
  hypo
accttcgatggtgagcgctgcctctatggggcactgagtgaccccatccgccgggctctacgcgattacaagcaggt

SEQ ID NO: 39995 - DNA, 48 bp, Homo sapiens
  chr3:127395914-127395962
  hypo
tgtctgagtttggtgcgagcagggtttggggcccggggccatgggtgc

SEQ ID NO: 39996 - DNA, 68 bp, Homo sapiens
  chr3:127534964-127535032
  hypo
cccagggagcatctgcgctaaaccagctggctggtgatgcgggaacacctagtcgcaggtggcgtgag

SEQ ID NO: 39997 - DNA, 90 bp, Homo sapiens
  chr3:127536741-127536831
  hypo
tgggccagtctccatcgccgtgctgatagcatcagtggacatttgctcatgatccagtatccccccctttttctttttttgagatggagt

SEQ ID NO: 39998 - DNA, 52 bp, Homo sapiens
  chr3:127637657-127637709
  hypo
aggaaagtcaggagacgaggcaggaaagtttgggaggcgccagaatgcctga

SEQ ID NO: 39999 - DNA, 30 bp, Homo sapiens
  chr3:128346689-128346719
  hypo
aacatgccagcaagacgcccataaaaacga

SEQ ID NO: 40000 - DNA, 80 bp, Homo sapiens
  chr3:128599546-128599626
  hypo
gccttaaaatggagatagtgttgtgtctccttcacagatgtgttgtagagccccagtgagataaacggtgcatggagagt

SEQ ID NO: 40001 - DNA, 34 bp, Homo sapiens
  chr3:128611894-128611928
  hypo
caattttattctggccgggcgtggtggctcacac

SEQ ID NO: 40002 - DNA, 30 bp, Homo sapiens
  chr3:128765921-128765951
  hypo
ggaggcccctctgtgcggccagcttcgtcc

SEQ ID NO: 40003 - DNA, 41 bp, Homo sapiens
  chr3:128790177-128790218
  hypo
tgattaagacaccaccgcgtggcgcccgctggagtggacca

SEQ ID NO: 40004 - DNA, 72 bp, Homo sapiens
  chr3:130127080-130127152
  hypo
atcaccctgggaaaacgaatgcattcccggtgtgggggtggtggcagggggtgggggcgggtctctaaaatg

SEQ ID NO: 40005 - DNA, 217 bp, Homo sapiens
  chr3:130474409-130474626
  hypo
tagcagtaacatagtcgtttattgtcattaccaagtattctgtattgtgcatagttgtatgtgctagactgttatatgactggcaatgcaggttattttgcaccagcatcaccacaaacaggtgagcaatagaaatttttcagctccattataatcttatgggacgttgtatatgtggtccatcattgaacacatttttatgcggccattggcggta

SEQ ID NO: 40006 - DNA, 39 bp, Homo sapiens
  chr3:130519901-130519940
  hypo
tgtaaattggccaggcgtcgtggctcatgcctgtaatcc

SEQ ID NO: 40007 - DNA, 30 bp, Homo sapiens
  chr3:133101687-133101717
  hypo
gcctctcatagctttcggtctccttcaggt

SEQ ID NO: 40008 - DNA, 220 bp, Homo sapiens
  chr3:134320427-134320647
  hypo
tagctgttatgcctccggggcctttgtgcatttttcaggtgtgagtgacacgaggctggctgggtggcctcggtggcagagactgcggagggcgcaggacctgcccaggacagttcagccccccaggggagacaccccttttgctcgaggccgccggcctgttggatgatgggcacccttgtgagctggttctgggctaggccaccgtgctgggtggcag

SEQ ID NO: 40009 - DNA, 30 bp, Homo sapiens
  chr3:134624264-134624294
  hypo
ttctcttgtcattcccggcattactgactg

SEQ ID NO: 40010 - DNA, 120 bp, Homo sapiens
  chr3:136582940-136583060
  hypo
tcaaaaaaataaataaaatgtgtatttatttttctaggcattatcctttgtccaggtttctgcagtgctttcaggtccatctaaataaaatttgaaacctacgtgtaatgttggccgggc

SEQ ID NO: 40011 - DNA, 17 bp, Homo sapiens
  chr3:137561189-137561206
  hypo
agtctagctattggccg

SEQ ID NO: 40012 - DNA, 84 bp, Homo sapiens
  chr3:137717830-137717914
  hypo
acagctgttttcaactaccaggggctgtggcgctcctgtgtccgagagagctctggcttcaccgagtgccggggctacttcacc

SEQ ID NO: 40013 - DNA, 22 bp, Homo sapiens
  chr3:138058968-138058990
  hypo
gccaccgcgcccagccagcatc

SEQ ID NO: 40014 - DNA, 236 bp, Homo sapiens
  chr3:141174296-141174532
  hypo
ggccgccattttcgtcgtctcttatcacgatgggaatcagcgttctctgctgctgctcctgctgaacacgacgacattccagccaccgggaactgctcgggactcagtatcattctcagacctaggcaggagcgttccgtgcttgccctcctccacaggtgccccgccgcacggggcaaagagtctgcagggccaacagggatgtgcccccgcaatgtccacgccatccccagaga

SEQ ID NO: 40015 - DNA, 138 bp, Homo sapiens
  chr3:141481968-141482106
  hypo
ctattcggccatcttggctcctcctccagatcttcttaaggatgaaaaatatgggcttggattcttcccatacctcatgcttcaaatagccgttgatgaccctgaagccatagtgctgtgtttcggtcaaacaacagc

SEQ ID NO: 40016 - DNA, 30 bp, Homo sapiens
  chr3:142337360-142337390
  hypo
gctctaggggagaatcgttttcatggctca

SEQ ID NO: 40017 - DNA, 28 bp, Homo sapiens
  chr3:142791151-142791179
  hypo
atattaagactgtcacgcgcgttcgtgt

SEQ ID NO: 40018 - DNA, 17 bp, Homo sapiens
  chr3:142802592-142802609
  hypo
agcgtgagccaccgtgc

SEQ ID NO: 40019 - DNA, 24 bp, Homo sapiens
  chr3:142853160-142853184
  hypo
gggctcaagcgatcctcccatcta

SEQ ID NO: 40020 - DNA, 30 bp, Homo sapiens
  chr3:142896285-142896315
  hypo
catcactccgacgctcgatggggccagggg

SEQ ID NO: 40021 - DNA, 35 bp, Homo sapiens; identical to SEQ ID NO: 5001
  chr3:142913215-142913250
  hypo

SEQ ID NO: 40022 - DNA, 30 bp, Homo sapiens
  chr3:142973621-142973651
  hypo
gccacatgaactccacgtgactacttgaat

SEQ ID NO: 40023 - DNA, 30 bp, Homo sapiens
  chr3:142973851-142973881
  hypo
tgtaggctggcaggccgagtaactgcctct

SEQ ID NO: 40024 - DNA, 21 bp, Homo sapiens
  chr3:142977041-142977062
  hypo
acagagcgatactccatctca

SEQ ID NO: 40025 - DNA, 45 bp, Homo sapiens; identical to SEQ ID NO: 14579
  chr3:143092973-143093018
  hypo

SEQ ID NO: 40026 - DNA, 34 bp, Homo sapiens
  chr3:143151477-143151511
  hypo
attatttttttgagacggagtctcattctgttgc

SEQ ID NO: 40027 - DNA, 38 bp, Homo sapiens
  chr3:143210840-143210878
  hypo
cacctaccacttggccgggtgtggtggctcaagcctgt

SEQ ID NO: 40028 - DNA, 58 bp, Homo sapiens
  chr3:146187920-146187978
  hypo
gtgaaaatgatgaggcgtgtagaatgtttaatttttcaggacgcgcctttgatttttc

SEQ ID NO: 40029 - DNA, 37 bp, Homo sapiens
  chr3:146188305-146188342
  hypo
gcctgggagagagagcaagactcgtctcaaacaaaca

SEQ ID NO: 40030 - DNA, 43 bp, Homo sapiens
  chr3:148472167-148472210
  hypo
ccataaaggtctggccgggcgcggtggctcacacctgtaattc

SEQ ID NO: 40031 - DNA, 20 bp, Homo sapiens
  chr3:148556015-148556035
  hypo
cagagcgagactctgtctca

SEQ ID NO: 40032 - DNA, 41 bp, Homo sapiens
  chr3:148705411-148705452
  hypo
ccgaatggggggcctcgtctcggccccgctcggctccgcca

SEQ ID NO: 40033 - DNA, 27 bp, Homo sapiens
  chr3:148802983-148803010
  hypo
actacaattatgggccggatgcggtgg

SEQ ID NO: 40034 - DNA, 26 bp, Homo sapiens
  chr3:148803250-148803276
  hypo
ggacgacagagcgagactccatgtca

SEQ ID NO: 40035 - DNA, 30 bp, Homo sapiens
  chr3:149956581-149956611
  hypo
tctgcacaccttgtccgaggctccgatgtt

SEQ ID NO: 40036 - DNA, 161 bp, Homo sapiens; identical to SEQ ID NO: 14584
  chr3:150135175-150135336
  hypo

SEQ ID NO: 40037 - DNA, 88 bp, Homo sapiens
  chr3:150237908-150237996
  hypo
ctcgtgatccgcccgcctcggcatcccaaagtgcactccaggttttaattacctctcgggtgattgtggtgcacgctcaagtttgaga

SEQ ID NO: 40038 - DNA, 90 bp, Homo sapiens
  chr3:152321039-152321129
  hypo
gttctcattcagacacgaatgtgagctgcttcttctgcatagagctcagtatggttgcctgacaatctatttttttttttttaagacgga

SEQ ID NO: 40039 - DNA, 30 bp, Homo sapiens
  chr3:152332728-152332758
  hypo
tgccatctcatataacgatattatggactg

SEQ ID NO: 40040 - DNA, 27 bp, Homo sapiens
  chr3:152829598-152829625
  hypo
ggcgtgagcgaccgcacccagctgata

SEQ ID NO: 40041 - DNA, 30 bp, Homo sapiens
  chr3:152877598-152877628
  hypo
gtgagttcagagtcccgaccagatcctgaa

SEQ ID NO: 40042 - DNA, 25 bp, Homo sapiens
  chr3:152979662-152979687
  hypo
ccaccacgtccggccaactcatatt

SEQ ID NO: 40043 - DNA, 30 bp, Homo sapiens
  chr3:152999015-152999045
  hypo
catgagaggtgacaacgtgctagcagccct

SEQ ID NO: 40044 - DNA, 18 bp, Homo sapiens
  chr3:153018756-153018774
  hypo
aaaaatatgattggccgg

SEQ ID NO: 40045 - DNA, 23 bp, Homo sapiens
  chr3:154623592-154623615
  hypo
cgagactccgtctcaaaaaaaat

SEQ ID NO: 40046 - DNA, 101 bp, Homo sapiens
  chr3:157303466-157303567
  hypo
ttatggctttctctgcggctcgttgcatctctattcataaacccttgatcggctatttccagtaactgtgaggtattcatacccacaaacccagcctgttt

SEQ ID NO: 40047 - DNA, 30 bp, Homo sapiens
  chr3:166984418-166984448
  hypo
cagaaatagggatgacgttaagggtataaa

SEQ ID NO: 40048 - DNA, 30 bp, Homo sapiens
  chr3:168490451-168490481
  hypo
tcccctgaaaatgttcgatcattattcaca

SEQ ID NO: 40049 - DNA, 64 bp, Homo sapiens
  chr3:169485397-169485461
  hypo
atatccttaactaaccgcttgtctaaaccagggaaagaggttgatcccccggcaaggataatat

SEQ ID NO: 40050 - DNA, 562 bp, Homo sapiens
  chr3:169540047-169540609
  hypo
tgtcagcttcctccacgccctgcgcgagctccggctctaccagaccgacctgaaggaaattcccgtcgtcatctttaaaaacctccaccatctcgagctgctcggactgaccggaaaccacctgaaatgtctgcccaaggaaatagtgaaccagaccaagctgagggagatctacctgaagcgaaaccagtttgaagttttcccccaggagctctgtgttctctacaccctggaaatcattgacctggacgagaacaaaataggtgccatcccagaagagatcggacacctgacggggctgcagaagttctatatggcttctaacaaccttcccgttctgcccgcgtccttgtgccagtgtagccaactgtcggtgctcgatttatcccacaacctcctccactccatcccgaagagcttcgccgagctcaggaagatgacggaaatcgggctgagcgggaaccgcctggagaaggtgccacgcctcatttgcaggtggacctcgctgcacctgctctacctgggaaacaccggcctgcacaggctgcggggctccttcagg

SEQ ID NO: 40051 - DNA, 79 bp, Homo sapiens
  chr3:169541070-169541149
  hypo
tgtaagtgctgcagccgcgattccagcccacagctgccaggctccagggtctacattcttttttttttttttttctctt

SEQ ID NO: 40052 - DNA, 42 bp, Homo sapiens
  chr3:169980664-169980706
  hypo
accttcttttgtggccgggcgcggtgactcacgcctgtaatc

SEQ ID NO: 40053 - DNA, 33 bp, Homo sapiens
  chr3:171193088-171193121
  hypo
aggtacagtggctctcgcctgtaatcccagcac

SEQ ID NO: 40054 - DNA, 145 bp, Homo sapiens
  chr3:172033174-172033319
  hypo
aaaaaaggaatttacaggtgtcattggcttttcagctgtggccttcagtttcgattttcacctgaaacaggtcagtttttattacttgagaaggtgtggccattccttgccaagttcccttgtggtgactcgtgagctttagtgt

SEQ ID NO: 40055 - DNA, 58 bp, Homo sapiens; identical to SEQ ID NO: 14590
  chr3:172384961-172385019
  hypo

SEQ ID NO: 40056 - DNA, 18 bp, Homo sapiens
  chr3:172425382-172425400
  hypo
attatttttttgagacgg

SEQ ID NO: 40057 - DNA, 17 bp, Homo sapiens
  chr3:172425700-172425717
  hypo
aacgttcatctcccaga

SEQ ID NO: 40058 - DNA, 31 bp, Homo sapiens
  chr3:172469925-172469956
  hypo
ttttttttttttagacggagtctacctcttg

SEQ ID NO: 40059 - DNA, 31 bp, Homo sapiens
  chr3:172470196-172470227
  hypo
tgtgagccaccgcgtccggcctttcaaatgg

SEQ ID NO: 40060 - DNA, 162 bp, Homo sapiens
  chr3:172727266-172727428
  hypo
tgcctggaatctgtgcggaggcaccactcaagcccatgtgaagcccaatggatcttggatcccagagcaccctagagccagctacagtagccccaccaacaggggaggctaggctctttcgcatgcccttaggatagctgcagcagccgcagtgctcaggag

SEQ ID NO: 40061 - DNA, 92 bp, Homo sapiens
  chr3:172858998-172859090
  hypo
atcaggctgcttgctcgcggggacgccaggacttgaaacgtcccgtgccacgaggcccatcgcgcccacaagtggcgcgggtcactggcacc

SEQ ID NO: 40062 - DNA, 24 bp, Homo sapiens
  chr3:176545097-176545121
  hypo
aaaagagaatttttccgacgggtg

SEQ ID NO: 40063 - DNA, 41 bp, Homo sapiens
  chr3:176872455-176872496
  hypo
tacaggcatgagccaccgcgcccggccgacagaacttttta

SEQ ID NO: 40064 - DNA, 77 bp, Homo sapiens
  chr3:176897068-176897145
  hypo
agtgtactttgagctcgactattgttacctgatgcaaaacatgaatatgctggggaaaatcacgtatgaaccagagc

SEQ ID NO: 40065 - DNA, 28 bp, Homo sapiens
  chr3:178577720-178577748
  hypo
aaacaaaataaagttcggaaggggagcc

SEQ ID NO: 40066 - DNA, 34 bp, Homo sapiens
  chr3:178861413-178861447
  hypo
ggctgaaaatagtcttttacgaatttcaaagctt

SEQ ID NO: 40067 - DNA, 30 bp, Homo sapiens
  chr3:179136841-179136871
  hypo
cataggtgttcaatacgtatttgcttatga

SEQ ID NO: 40068 - DNA, 23 bp, Homo sapiens
  chr3:179171196-179171219
  hypo
accgatcccggccccatattctt

SEQ ID NO: 40069 - DNA, 23 bp, Homo sapiens
  chr3:179367897-179367920
  hypo
acccgcctcggcctcccaaagtg

SEQ ID NO: 40070 - DNA, 30 bp, Homo sapiens
  chr3:180042862-180042892
  hypo
cggccgtctggagtccgcgagactgaaagg

SEQ ID NO: 40071 - DNA, 323 bp, Homo sapiens
  chr3:182314974-182315297
  hypo
ccggaagcagtgaaacgcactgggcttattgcaacaaccccagctactgaaaatgccaccctctccacgacgaagcaccgccagtcccaaactccaatcagccgctgggctgggaggccgaaaaggcaagaagacacagagcggggttgaaatgaagaaggaactctttttcaacgagactcattacagtatgcaaaacctaaaaaactgtaccctgtgttgtaatgagaatatgactgcatgggaaatgtgggttacaactcttgactttacctgcttttcacatattttcacatagtgagtaaaatcgctgtgggaggaaa

SEQ ID NO: 40072 - DNA, 21 bp, Homo sapiens
  chr3:182704506-182704527
  hypo
agcaaatgggctgggcgcggt

SEQ ID NO: 40073 - DNA, 30 bp, Homo sapiens
  chr3:182800477-182800507
  hypo
cgagtgtggccagggcggtggctcacgtcg

SEQ ID NO: 40074 - DNA, 19 bp, Homo sapiens
  chr3:182812783-182812802
  hypo
tgccctggccaggcacggt

SEQ ID NO: 40075 - DNA, 18 bp, Homo sapiens
  chr3:182816009-182816027
  hypo
ccccgccaacttccaaca

SEQ ID NO: 40076 - DNA, 41 bp, Homo sapiens
  chr3:182895956-182895997
  hypo
attaaaaataaattccggctgggcgcggtggctcacgcctg

SEQ ID NO: 40077 - DNA, 52 bp, Homo sapiens
  chr3:182987877-182987929
  hypo
cctgaaaactatgatcgacgttccggaattagaaggacgtggggcaatgaaa

SEQ ID NO: 40078 - DNA, 30 bp, Homo sapiens
  chr3:183035309-183035339
  hypo
ggacagggtgccttccgtagtcctttttct

SEQ ID NO: 40079 - DNA, 29 bp, Homo sapiens
  chr3:183183673-183183702
  hypo
gtgagccactgccccgggccatgaaaaaa

SEQ ID NO: 40080 - DNA, 30 bp, Homo sapiens
  chr3:183603067-183603097
  hypo
ccctagaggaaccaacgtggcaagccaagt

SEQ ID NO: 40081 - DNA, 172 bp, Homo sapiens
  chr3:183622013-183622185
  hypo
gaggtcacacactggcgcacggcacccatggccatgacgctgctgaggcgctgcacgtcatggaggacagcatggtgtaaggcagtcgcttgcggtcttcatagcagacaaccggggcagcacccagcacctcgtccagctccagctgcaccgtctccgcaggtggcttagt

SEQ ID NO: 40082 - DNA, 30 bp, Homo sapiens; identical to SEQ ID NO: 14600
  chr3:183648152-183648182
  hypo

SEQ ID NO: 40083 - DNA, 222 bp, Homo sapiens
  chr3:183684023-183684245
  hypo
aacaccctcacacagcgtgtacacacacaggtgtacctacgtacaccacaaactggtagcattctgatgtgcacttcaaagggttcagaagtccccagggggtctactgtggaaagccggcacttctggctgctgcacaaacaccgcacattgcagcgctatcaacagatgtaaactacagttaaagcagggctgaccagcccaacccgtttccctgccaga

SEQ ID NO: 40084 - DNA, 34 bp, Homo sapiens
  chr3:183713864-183713898
  hypo
gattacaggtgtaagccaccgtgtccggccagaa

SEQ ID NO: 40085 - DNA, 17 bp, Homo sapiens
  chr3:183728806-183728823
  hypo
ggcgtgagccaccgtgc

SEQ ID NO: 40086 - DNA, 16 bp, Homo sapiens
  chr3:183965935-183965951
  hypo
ccggcagaaatgcatc

SEQ ID NO: 40087 - DNA, 26 bp, Homo sapiens
  chr3:184016195-184016221
  hypo
atgaggttaataggccgggcgcggtg

SEQ ID NO: 40088 - DNA, 149 bp, Homo sapiens
  chr3:184018038-184018187
  hypo
ttgtctgagccctgtcgtctcttgatcaggagaaggatacatccctgtatcgaccagcgctggaggaattgcgaaggcagattcgttcttctacaacttccatgacttcagtgcccaagcctctcaaatttctgcgtccacactatggc

SEQ ID NO: 40089 - DNA, 26 bp, Homo sapiens
  chr3:184057527-184057553
  hypo
gtgagccactgcgcccggcctgagaa

SEQ ID NO: 40090 - DNA, 71 bp, Homo sapiens
  chr3:184200659-184200730
  hypo
taaagtgagtgcctccgtgggtctccccgaggcatgaaggtgctggattgaatgtgcgtggagaatctcag

SEQ ID NO: 40091 - DNA, 30 bp, Homo sapiens
  chr3:184226786-184226816
  hypo
actctggaatctcaccggcccaagaatcag

SEQ ID NO: 40092 - DNA, 109 bp, Homo sapiens
  chr3:184785147-184785256
  hypo
acactgggctggctgcggtgaacacaaaagggagccgtacacagccctgccctcaggcacctgccggctggggaaggacacgttcagcaggaaacgctcccatagctct

SEQ ID NO: 40093 - DNA, 29 bp, Homo sapiens
  chr3:185001906-185001935
  hypo
tgaaccactacgcgcggccactttccttt

SEQ ID NO: 40094 - DNA, 23 bp, Homo sapiens
  chr3:185270882-185270905
  hypo
aaaagaaaaacaggccggcacgg

SEQ ID NO: 40095 - DNA, 87 bp, Homo sapiens
  chr3:185271296-185271383
  hypo
taattccctttctggcgagagtgcttgcaacactaactcaggcttctagtggtctgatgagcttaaaaatcaattaataagccgggc

SEQ ID NO: 40096 - DNA, 30 bp, Homo sapiens; identical to SEQ ID NO: 14609
  chr3:185278325-185278355
  hypo

SEQ ID NO: 40097 - DNA, 304 bp, Homo sapiens
  chr3:185363001-185363305
  hypo
aactaaaagggatagcgtcgtgggagttcaggagagatccgagtggatggtgaagtggatggctgaagcctgcagaagccctggggggcgggaggcggggctcggtggttctggcaaacctggctgaccttccccgcccctcctcggcccctggggttctcagggcctcggcagagtccctggccgcctccgcagacttctcattcctcagatggtctttggtttgctcccgatctggctggctgcgtttggtctcattctgtcaggtgttggaagggctacattcatccgttgttttgctggt

SEQ ID NO: 40098 - DNA, 136 bp, Homo sapiens
  chr3:185385541-185385677
  hypo
cacctcattttattgcgtttggctttattgaactttgcagataatcgtgttttttacaaactggaaggcttgtggcaaccctatgtcacacaagtctattggtatcatttgtccaaatgcgcgtgctcactttgtg

SEQ ID NO: 40099 - DNA, 30 bp, Homo sapiens
  chr3:185504526-185504556
  hypo
aaccctcttaagatacgtggaaacctacat

SEQ ID NO: 40100 - DNA, 25 bp, Homo sapiens
  chr3:185551925-185551950
  hypo
atcccaggctgggtgcggtggctca

SEQ ID NO: 40101 - DNA, 66 bp, Homo sapiens
  chr3:185643324-185643390
  hypo
ctgtaagacctgctacgtgatcgtctatgggagcgggagcgagaccgtgaccgggtataatgcctt

SEQ ID NO: 40102 - DNA, 91 bp, Homo sapiens
  chr3:185667518-185667609
  hypo
ctctaattcagactgcgtggcttacttctaagtgtcttaacggagactgtgctgatattgttcttctatttgatacctgtcaggcctctga

SEQ ID NO: 40103 - DNA, 21 bp, Homo sapiens
  chr3:186019128-186019149
  hypo
tccatgtgacgggtgcggtgg

SEQ ID NO: 40104 - DNA, 30 bp, Homo sapiens
  chr3:186495172-186495202
  hypo
aatgactaatacacacggcatacaatttac

SEQ ID NO: 40105 - DNA, 78 bp, Homo sapiens
  chr3:186527185-186527263
  hypo
ccctgtgaagttttttaatcttaaaagagggctttcaaaagttgagtacagctttatttagtgcgttgccctttgaaa

SEQ ID NO: 40106 - DNA, 30 bp, Homo sapiens
  chr3:187416788-187416818
  hypo
agcagtggaacctgccgggaggagaaggag

SEQ ID NO: 40107 - DNA, 190 bp, Homo sapiens
  chr3:187870406-187870596
  hypo
gtaaaggggggactacgctctgtcctatctaactcacctgaagatgcaatagccgggtgagagactgctttcattatgtgctaacgtgagggattactttagatattaataggagagaagtgcaaggaaaggaagtctcagggtatggaatgctttcctggccatggctgctgcgcgtcataatccccta

SEQ ID NO: 40108 - DNA, 29 bp, Homo sapiens
  chr3:190065742-190065771
  hypo
agaccatgggctgggcgcggtggctcaca

SEQ ID NO: 40109 - DNA, 30 bp, Homo sapiens
  chr3:193093790-193093820
  hypo
gccacagggaatcttcggggaaggaagagc

SEQ ID NO: 40110 - DNA, 80 bp, Homo sapiens; identical to SEQ ID NO: 5008
  chr3:193312128-193312208
  hypo

SEQ ID NO: 40111 - DNA, 174 bp, Homo sapiens; identical to SEQ ID NO: 5009
  chr3:193548530-193548704
  hypo

SEQ ID NO: 40112 - DNA, 35 bp, Homo sapiens
  chr3:193588124-193588159
  hypo
tggggaaatggaggccgagacgtgggaatgcttta

SEQ ID NO: 40113 - DNA, 30 bp, Homo sapiens
  chr3:193656666-193656696
  hypo
acacagctgcacactcggtaaatagactca

SEQ ID NO: 40114 - DNA, 30 bp, Homo sapiens
  chr3:193774655-193774685
  hypo
caaattctgactcctcgacagtctagccaa

SEQ ID NO: 40115 - DNA, 36 bp, Homo sapiens; identical to SEQ ID NO: 14616
  chr3:193922775-193922811
  hypo

SEQ ID NO: 40116 - DNA, 18 bp, Homo sapiens
  chr3:194041075-194041093
  hypo
agcactttgggaggccga

SEQ ID NO: 40117 - DNA, 197 bp, Homo sapiens
  chr3:194048751-194048948
  hypo
cacacaaccacacaacggtgtggctgaagccagcagaaatgaaaagtcctctggtacctccccttcaaacagctcacactcatgcgggtcactgtggcacggcgccctcacacgcgcatccgcagagcgcacctgtcccagcgtggccaagaccgcctctttcacccagggccctctgtggacgttagtctgctctg

SEQ ID NO: 40118 - DNA, 30 bp, Homo sapiens
  chr3:194128418-194128448
  hypo
attctggggtggggacggggaaagtctgaa

SEQ ID NO: 40119 - DNA, 30 bp, Homo sapiens
  chr3:195183871-195183901
  hypo
gaagtttaaaaagcacggtacagggctggg

SEQ ID NO: 40120 - DNA, 30 bp, Homo sapiens; identical to SEQ ID NO: 14618
  chr3:195536686-195536716
  hypo

SEQ ID NO: 40121 - DNA, 36 bp, Homo sapiens
  chr3:195538313-195538349
  hypo
gattacaggcatgagccaccgcgcacggcctccact

SEQ ID NO: 40122 - DNA, 265 bp, Homo sapiens
  chr3:195586997-195587262
  hypo
caggatcacgagagccgcctctaacccacccccaaaacaacaaaaggatgcgctctggccttgccaacttcagtgcctgggacaagccggctcgtgcccgccgcctcggctgcagggccctccacctgcagcgctttcgtccctacctggcgttcaccgttctcacccatcacatcagcacaacgtgaccttgtggggagccacctcctctgctcccaagacacctggtgcgtaacgattacagagcacccgtcctgccgtgatg

SEQ ID NO: 40123 - DNA, 72 bp, Homo sapiens
  chr3:195597490-195597562
  hypo
catggccaggaggtgcgggagaggctgggccacctgtcctgctccggatccaccctccgtccctgcaccaac

SEQ ID NO: 40124 - DNA, 108 bp, Homo sapiens
  chr3:195599732-195599840
  hypo
gttccctggcaaggccggggccccagtcctcttctggccacttgatttcactcctcggctgggttccaggagttctgagaggtgcgggggtgccgggggacacctagg

SEQ ID NO: 40125 - DNA, 485 bp, Homo sapiens
  chr3:195600086-195600571
  hypo
ctctgacctcagacacgaaacctctgctgatgtggcctaagccggggcctgggcaggggcaggggcaggggcaggggcaggcaggccaggaagcacagggctcccgcaagacactcctgactcccgaaggctctcacaggttgtgaggctcccgcgtctgctgctggacttgtcatacgtgatgccgtgagcagagtctgggcaggcgggggcggtgagagccccgtgggcagtgtctgggcaggcgggggcggtgagagccccgtgggcagtgtctgggcaggcgggggcggtgacagccccgtgggcagagtctgggcacgcgggggcggtgacagcccagagctgctagggtggacacgtgtggcaccacactgcacgccctccccaccaacccccacttctcctgtcccagggccaaagcgtgaagaagggctcctctgaaacccagccaggccggggagagaggacggaggaggtggcga

SEQ ID NO: 40126 - DNA, 112 bp, Homo sapiens
  chr3:195600916-195601028
  hypo
gcacacagcctcccacggcggcccgtagaggaggaaccccggcaccggctgggctgcggctctcccgctacacccacgggctccccggtggctgccgcgggccagacgccgg

SEQ ID NO: 40127 - DNA, 40 bp, Homo sapiens
  chr3:195601324-195601364
  hypo
aggagagtaagagtgcggaggacgtgtgcaagaagctccc

SEQ ID NO: 40128 - DNA, 30 bp, Homo sapiens
  chr3:195603893-195603923
  hypo
catgaggctggacttcgggctggaggccct

SEQ ID NO: 40129 - DNA, 37 bp, Homo sapiens
  chr3:195604262-195604299
  hypo
ggcacaggattgcaccgaaggccgcagactccaaaag

SEQ ID NO: 40130 - DNA, 30 bp, Homo sapiens
  chr3:195604945-195604975
  hypo
aaggcactaggaagacggaggcaggcctgt

SEQ ID NO: 40131 - DNA, 55 bp, Homo sapiens
  chr3:195637288-195637343
  hypo
atgtcccagcccaaacggaggcagccctgggcagcgggcgcgtggagcccaaggg

SEQ ID NO: 40132 - DNA, 219 bp, Homo sapiens
  chr3:195648722-195648941
  hypo
acagaggagcacttccgtcacccaggaacacggctctgatcaaggaattcaagaacccaacagaaaaatacagaacagaaactactgcgataaagctctaataccttgattggagtgacagttactcttacatttttcaaaattcataaagtttacatttaagatctgttgcggggcgagggggcgaagcgggggagagcatcgggacaaatagctaag

SEQ ID NO: 40133 - DNA, 30 bp, Homo sapiens
  chr3:195835032-195835062
  hypo
gtgctgggtgaaaggcgcagcctagagggc

SEQ ID NO: 40134 - DNA, 30 bp, Homo sapiens
  chr3:195874797-195874827
  hypo
attcctatggaatgacgttttcatcaaaca

SEQ ID NO: 40135 - DNA, 16 bp, Homo sapiens
  chr3:195926800-195926816
  hypo
gcgacactctggctca

SEQ ID NO: 40136 - DNA, 36 bp, Homo sapiens
  chr3:195993024-195993060
  hypo
ctactgccatactagcgcattgtaaatatgcaataa

SEQ ID NO: 40137 - DNA, 37 bp, Homo sapiens
  chr3:196056123-196056160
  hypo
ttttaagaagatgacaattcagcgggaaaaagtctct

SEQ ID NO: 40138 - DNA, 30 bp, Homo sapiens
  chr3:196063648-196063678
  hypo
aggtgagcacgtcatcggctagatgtccag

SEQ ID NO: 40139 - DNA, 360 bp, Homo sapiens
  chr3:196069871-196070231
  hypo
caagacacttctttaagaaatcatgtacttgagataaacgggtctcgtaaggctagcgttgggactatctcttcatttccatgtggcgagcctcctagggcaacagaggcacggtcgctgccatgaaagcactgaagcttcacctctttgagacgtgttaataaccgcggagtgtggctctactggagatggagctacttgctgttactttgtcggtgatgctcctagggaggagcaaatgggagtctgaggacataaatgacgaacagggcctgggctgagaaaaccagtcatgccacaaaaggcttcctgaggctgaaagatttgggagacggccaggtgccagtgacccacacctgt

SEQ ID NO: 40140 - DNA, 26 bp, Homo sapiens
  chr3:196226403-196226429
  hypo
ctaaaacagcccggacgcggtggctc

SEQ ID NO: 40141 - DNA, 78 bp, Homo sapiens
  chr3:196256227-196256305
  hypo
tcattggtttaggaacggacaggtggcagaattctggcccatgaaatataagaagaggcccactgtggagcttctgag

SEQ ID NO: 40142 - DNA, 30 bp, Homo sapiens; identical to SEQ ID NO: 14628
  chr3:196294577-196294607
  hypo

SEQ ID NO: 40143 - DNA, 30 bp, Homo sapiens
  chr3:196386861-196386891
  hypo
cctctcagagaactacgaagagacggcagc

SEQ ID NO: 40144 - DNA, 507 bp, Homo sapiens
  chr3:196387158-196387665
  hypo
caacctcccctgcatcgtggacttcgggctcacgcggctgcgggtcctcaacgtcagctacaacgtcctggagtggttcctcgcgaccgggggagaggctgccttcgagctggagacgctggacctgtctcacaaccagctgctgttcttcccgctgctgccccagtacagcaagttgcggaccctcctgctgcgcgacaacaacatgggcttctaccgggacctgtacaacacctcgtcgccgagggagatggtggcccagttcctcctcgtggacggcaacgtgaccaacatcaccaccgtcagcctctgggaagaattctcctccagcgacctcgcagatctccgcttcctggacatgagccagaaccagttccagtacctgccagacggcttcctgaggaaaatgccttccctctcccacctgaacctccaccagaattgcctgatgacgcttcacattcgggagcacgagccccccggagcgctcaccgagctggacctgag

SEQ ID NO: 40145 - DNA, 265 bp, Homo sapiens
  chr3:196388333-196388598
  hypo
tgcagcatgggcagacggtggccgactgggccatggtcacctgcaacctctcctccaagatcatccgcgtgacggagctgcccggaggtgtgcctcgggactgcaagtgggagcggctggacctgggcctgctctacctcgtgctcatcctccccagctgcctcaccctgctggtggcctgcactgtcatcgtcctcacttttaagaagcctctgcttcaggtcatcaagagccgctgccactggtcctccgtttactgacctgg

SEQ ID NO: 40146 - DNA, 41 bp, Homo sapiens
  chr3:196402166-196402207
  hypo
gttgtacttactggccgggcgcggtggctcccgcctgtaat

SEQ ID NO: 40147 - DNA, 30 bp, Homo sapiens
  chr3:196731020-196731050
  hypo
tcacccgcccagtgccgctagctgcaaatt

SEQ ID NO: 40148 - DNA, 246 bp, Homo sapiens
  chr3:196731283-196731529
  hypo
ggtgggattcctgagcgttctgctaggcctgctgagcacttcttggccttttccataaggctttctcactctgtcttacagatatctccccacaaacctaaacaatttcgagagggacttgtgttctgcaaccagtcacagaatatcaggtgagctgggcgtgtcttcactgacccacccgcccagggatgctgcactcctctccaccctgctcagaatcactagaatgaccgttctgtggctaca

SEQ ID NO: 40149 - DNA, 220 bp, Homo sapiens
  chr3:196754516-196754736
  hypo
ccgggcctggcagggcgaggtcggctcctttcctggtgaatggggctgttgtgtgctccctcctgagtcacagccctcttgtctggcagggtggaagggagaggactcaccgcgatgagctggacgcagtggtcggcggaggtgccccggacgcagaggagggagggctggatgcccgcttcccggaaggcctcgctcatgttgccgcacttgtgctgct

SEQ ID NO: 40150 - DNA, 30 bp, Homo sapiens
  chr3:196784239-196784269
  hypo
gccgcacctgacagtcgttgactatttgaa

SEQ ID NO: 40151 - DNA, 39 bp, Homo sapiens
  chr3:197313900-197313939
  hypo
tataagaacccaacacggcgaaaccccgtctctactaaa

SEQ ID NO: 40152 - DNA, 300 bp, Homo sapiens
  chr3:197327024-197327324
  hypo
gcccggcccaattcaacattctttacttttctagtcataacctattttcagctggaaaccagaaaggctggttctatgtgcagatggcaatgctgaggtttagaggtaaaacacccacctgaagtgaatagaggctggactggaacccaggatggctcacctggaggcggcgctcccatacggcacccggcagcctgttttgtacaggaacaatacttgccttcctccgcaaaaaacaaacaaacaaacaaaaaatgcaggggttgaaaagaaaactgcctgagctgaaaagttttgttg

SEQ ID NO: 40153 - DNA, 52 bp, Homo sapiens
  chr3:197327804-197327856
  hypo
ccagctggttacacacgagcgcgcgacatgtccaaagcgaagcacagccctt

SEQ ID NO: 40154 - DNA, 66 bp, Homo sapiens
  chr3:197402137-197402203
  hypo
gccacagccccttctcgccaccaaggcgtggtgtcccctggggaggccccgcgaggtgctgagtgg

SEQ ID NO: 40155 - DNA, 29 bp, Homo sapiens
  chr3:197685787-197685816
  hypo
tgcctcctggctgggcgcggtggctcacg

SEQ ID NO: 40156 - DNA, 29 bp, Homo sapiens
  chr3:197686056-197686085
  hypo
gacgagtgaaactccgtctcaaaaaaaaa

SEQ ID NO: 40157 - DNA, 288 bp, Homo sapiens
  chr4:619531-619819
  hypo
gtgcccgccggactgcgacagcctccgggacctctgccaggtggaggagagcacggcgctgctggagctggtgcaggatatgcaggagagcatcaacatggagcgcgtggtcttcaaggtcctgcggcgcctctgcaccctcctgcaggccgaccgctgcagcctcttcatgtaccgccagcgcaacggcgtggccgagctggccaccaggcttttcagcgtgcagccggacagcgtcctggaggactgcctggtgccccccgactccgagatcgtcttcccactgga

SEQ ID NO: 40158 - DNA, 74 bp, Homo sapiens
  chr4:628132-628206
  hypo
ggcatccaggaagcccgacgtggccggagggcggcaggtgcgtgaggtgccaggcagggcggggccccccatga

SEQ ID NO: 40159 - DNA, 344 bp, Homo sapiens
  chr4:628444-628788
  hypo
ctctttcctctcttgcggcagtgccctcacttcagctcatttgctgacgagctcactgactacaagacaaagaatatgctggccacacccatcatgaatggcaaagacgtcgtggcggtgatcatggcagtgaacaagctcaacggcccattcttcaccagcgaagacgaagatgtgagtgtggggggcacctgggcagccgcgcgtctgcctccctgcctgcctgcccgcccgcctgttctgtgctgcgcatccacctctttacctgcctgcccgcctgcccgtgtgttctctgctgcgtgtctgcctccttacctgcctgcccgcgtgttctgtgctgcgtg

SEQ ID NO: 40160 - DNA, 437 bp, Homo sapiens
  chr4:650884-651321
  hypo
tccccgccaagcattcggctgtgtgcgtgtgctcatgtgtgtgcggtatgcatgcggccagggagaggacgacaaagggcccccccgggagcaggagcctctgcagagcacccgggagaccccacacagaagcactgcgacaccatggtggcagccccaggacctgcccgccgagccacggggcctggcacacaggcacatgggagggggcgcgccgggagcgctgagcgccagtgacactgccatcccctccagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctggtgcggcggggcaggacgtccaggggtcacccaggggt

SEQ ID NO: 40161 - DNA, 335 bp, Homo sapiens
  chr4:660894-661229
  hypo
ctgagtctctgaggacgcaaggcggacatggagggggagactcgatggggcaggggtctgaccgtggggccctgtgtgatgcccataagagccagctgcctccggccacactccctggtgatggaatccacgccccaaggaggatgccacgggttccacatgaagttgtcccggagtgggctgtgcccactccccgccccatcctacccaccccgggtcgtcagtgctggggagaaggtgggacaagggtggatatttgggcctgaagtggccacaggtcacggccccactgcaggtgccccccactgccttccccaccccgccacactccatgt

SEQ ID NO: 40162 - DNA, 177 bp, Homo sapiens
  chr4:672016-672193
  hypo
gtgttgtgggaagtacgtgcctcacgttgctctcctggtgagagtccggagcaggatgagggggttcctggctttcacaaaatcccggtacccagaacaagcccacccagagtccacttgcccctcaagccttcagaggccaagctggctcctgctggacggcgatccctgaccact

SEQ ID NO: 40163 - DNA, 78 bp, Homo sapiens
  chr4:676743-676821
  hypo
gggaaatgttgacatcggtgctgtcccttgtgccaccaccctcctgaaggcagcacgcagcctcggtcatgggcccta

SEQ ID NO: 40164 - DNA, 161 bp, Homo sapiens
  chr4:678471-678632
  hypo
aaatccaccctaccccggggatcccacggcactgaccagcttgagcccatccaggaacttctctgaggtggagctggcagccccggcagagggcggggtggggggcacactctcccacaggcagatggtggacagcaggcagacgacgccagcagggatgg

SEQ ID NO: 40165 - DNA, 30 bp, Homo sapiens
  chr4:679038-679068
  hypo
cctgatacacatgcacgagcacacacaggt

SEQ ID NO: 40166 - DNA, 59 bp, Homo sapiens; identical to SEQ ID NO: 14641
  chr4:718181-718240
  hypo

SEQ ID NO: 40167 - DNA, 76 bp, Homo sapiens
  chr4:738388-738464
  hypo
tgaaaccaaagcagacgacagttcaaacaaagaggccgcggaggagaagccggaggaggacaacgactaccaccgc

SEQ ID NO: 40168 - DNA, 33 bp, Homo sapiens
  chr4:759808-759841
  hypo
gtgtcttccagaaggcgccgctcctgctgcact

SEQ ID NO: 40169 - DNA, 161 bp, Homo sapiens
  chr4:828951-829112
  hypo
ggacagctctgaccccgccccaaccaggcacccactgcagctcgcctgcggtaggacagtcggggtctgctgccacctggggcttctggggggacgtggagtcctcagcccccggctcgggtcatcctgctgcagtggcagtcgggcgtggtctgtttctg

SEQ ID NO: 40170 - DNA, 81 bp, Homo sapiens
  chr4:829611-829692
  hypo
cagacacccggactgcgtcctcaggagtggagctccccgaggaaagagtgcctttgcttcccttgacgtgtcctgcacttt

SEQ ID NO: 40171 - DNA, 270 bp, Homo sapiens
  chr4:955184-955454
  hypo
gccagctgggctcagcggggaccggggacgcccaccctgggctcgcccgcccactcggccggcggctcaccatgtgcacgacgcccgtcacgcccacaacctccagcagcccgtcgtccatgcgtggcttctcaaacctggtgtcgctgtcggagccccacaggtcggcccccgagccccagctgccgcataagagagcgggcacagaggtgtaggtgcaggcaggacgagggctgagcctgcccatggccccgccgggcagagcctctg

SEQ ID NO: 40172 - DNA, 934 bp, Homo sapiens
  chr4:955867-956801
  hypo
gatctggggacagggcgttcatctcccaggacccggccgccctcaccaggccccctgagctccccaacagctctgccggcaggcagagacaagagcaaggaccaccctggcaccaagccgagcacccaggagagggcagcatgggcaggtcctggccaggctctgtcgccagctggctcagcacaatccccagcagtggctactttctgtgtctccctcaactgcccgctttgcagaggggatgatgcgggcgcgtacacccgagtgtggctgggaagaggacgcccgttgtgacgcgtgtagcggggtcatatgcaggagcctggaaggcaccccacgccgggctgccctgtaccttggggggctctgcgtctgccgtgtcgttctctgcactgccagcctcgtgggcatccagcaggatggtccagcggtccatgagcacggcgtcggcctcgtccacagacagcagtacggagaacgggtcctcgccgctgtagcccgccccccagcggaggactcgaccaaggtcattccctgggacacaagcagacacagagcatctgtccacacccacccgcccatcagctgggtgcagaccccaccacgaggacagccagcccaggcctcggcaaaagctgcacaggaaggggtagaccctgaggccccctcctcggctgcacggctgagcccacctgtgcccaggggcaggatggccacagaaggctccgggcaggccagtcggtaccgtgtctcctccagggcgccaagcacccagcccacagtgccatcgccaccacacaccagcacccggaagcagggcacctgggagaacaggtggagcctagcgggagacaggaagtgtcctctaccagctgcgggcgcagcccatcccccacccaggctgcctcttccaagtgcccgtcctggccgtgtg

SEQ ID NO: 40173 - DNA, 30 bp, Homo sapiens
  chr4:957020-957050
  hypo
cactcttggggttcacgaacacaaggaggg

SEQ ID NO: 40174 - DNA, 35 bp, Homo sapiens
  chr4:1016331-1016366
  hypo
acggggacacacctggggcccgagagtcagccagc

SEQ ID NO: 40175 - DNA, 150 bp, Homo sapiens
  chr4:1016642-1016792
  hypo
ttctgttctcttctgcgcctggggcccgggcgctgggcttggacaggtgtccagagagacacgccctccatacctagggacccggcaccccgcctgctccgctgggctcctgggtgtggggccctcgggtggagctcctgggagctgggc

SEQ ID NO: 40176 - DNA, 150 bp, Homo sapiens
  chr4:1016852-1017002
  hypo
tctgaatacaggagcctggcccaggccccagcagggtctgggggtgcggcctgagacagcctggtcctgggctcagtgaaggagcggctgtcacagggtggatggaggggacattccacagcacgccctgcccctcggcattgtgtggaa

SEQ ID NO: 40177 - DNA, 30 bp, Homo sapiens
  chr4:1022834-1022864
  hypo
ctcacctgtcctgcccgggtcacctgcaca

SEQ ID NO: 40178 - DNA, 194 bp, Homo sapiens
  chr4:1024234-1024428
  hypo
gctggtggggcctggcgggtcctgggcctcagccacacaagacccaggcctgtgttccagggctctgggttgccgatgaattttaggtttgcattgcagtgcctgaggagagacgccagtccctgagaaacaccggctctgcccaggggccgcactcgccaccgttggcctcctctgctcggcctgtctctccc

SEQ ID NO: 40179 - DNA, 318 bp, Homo sapiens
  chr4:1025875-1026193
  hypo
cctgggcacgcaggccgacatggattctgtggctgaggccgtcagcgtgtgaaagccacagacacaggcgggcccggagtgcctgtccaccccgaggcgcctgccctggcccggcctctccttcctgggtgtcggaagaccttcatctatgcccctgccctgtacccgctcagtgggctgagcacgggcagggtgtggttctgaggggcaaccccaccagcctgcttgggccccagcgtcttctcagcgtctgcctcctgtgaaaaccttccactcagtaaaggagcacagtaggttggttgccgggccaggctgggg

SEQ ID NO: 40180 - DNA, 294 bp, Homo sapiens
  chr4:1036245-1036539
  hypo
cacccacacacacaccgacacacacaccgacacacacacctccacatacacccccgcacactgacacacccacacacacaccgacacacacacctccacaaacacaccccccgcacactgacacacacccacccccacacactgacacatccaccccccacaccgacacacacctacagtgacacccgcacactgacacacacccactcctgcacactgacacccactcctgcacactgacacacacccccgcacagacacacacccacccccgcacaccgatacacacaccta

SEQ ID NO: 40181 - DNA, 38 bp, Homo sapiens
  chr4:1282473-1282511
  hypo
taggaaggtcaggaacgctgttacggggagcagggtta

SEQ ID NO: 40182 - DNA, 163 bp, Homo sapiens
  chr4:1299056-1299219
  hypo
gtccctgtggaaagccgctgcactaggtgagcccggccctggtgagggtgccttgtgagtggagcctgcttgtgctgctgtgccccgctgcttccaggcggcgcggccctccgtctgattgctggaggactcttcggtgtggacacaccgtggtttgtttacc

SEQ ID NO: 40183 - DNA, 185 bp, Homo sapiens
  chr4:1299450-1299635
  hypo
tgttcttctgggtgccggggttctccagagaaacagagccagtggcacccacatgtgtgtgtgcgcacgcgtgtgtgggagtgtgcgtgcgtgcacgtgcgcacgcgtgcgtgtaaggagctgtgtcacaaagaattggctggtgcagttatcaaagctaagtcccgagccggagacccaggaga

SEQ ID NO: 40184 - DNA, 30 bp, Homo sapiens
  chr4:1331816-1331846
  hypo
ttgtggaactctgggcgagagggctggcgt

SEQ ID NO: 40185 - DNA, 119 bp, Homo sapiens
  chr4:1332541-1332660
  hypo
ggggccaggctggcacgcgtcgccatcgggacagggctgtgtggggcgggcagggcagcggggccaggctggcacacgtcgccattgggacagggctgtcctctcgccccaccctgcct

SEQ ID NO: 40186 - DNA, 222 bp, Homo sapiens
  chr4:1332878-1333100
  hypo
tcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactctta

SEQ ID NO: 40187 - DNA, 91 bp, Homo sapiens; identical to SEQ ID NO: 14656
  chr4:1338688-1338779
  hypo

SEQ ID NO: 40188 - DNA, 16 bp, Homo sapiens
  chr4:1339130-1339146
  hypo
gggcaggcccaggcac

SEQ ID NO: 40189 - DNA, 211 bp, Homo sapiens
  chr4:1504889-1505100
  hypo
ttgtgtcctctgcaccgcgatggcttcgctgggggagggagtggggagagctggcctgcccacggggcatcgctgcacgtggtagggggtgacctgggccgaaggaggataccgggcctctgctagggcagggaggccaagggagtttgggccggaggggacaccctgagcgccccacctgcctcccgactgttgccggcctgtgattgat

SEQ ID NO: 40190 - DNA, 54 bp, Homo sapiens; identical to SEQ ID NO: 14658
  chr4:1512344-1512398
  hypo

SEQ ID NO: 40191 - DNA, 110 bp, Homo sapiens
  chr4:1556398-1556508
  hypo
tgtccacccccagaccgccttctgcctgtgcagccacggcccccaccagcctcgacctgcccgtcccgtcatccatttatttatgccccgcttgccgatgcctgcggctg

SEQ ID NO: 40192 - DNA, 55 bp, Homo sapiens
  chr4:1562145-1562200
  hypo
atccactgcaaaatgcgtcatttcttgttgtgttagcggtcgctgtttcctgact

SEQ ID NO: 40193 - DNA, 250 bp, Homo sapiens
  chr4:1576408-1576658
  hypo
ggggccttgcacacacgggcacccctgagacaggcgaggcctggacaggtgcaggaggtgggcctggagccggtgggtggggctggctggacggcaggtggtcagcgggcggcaggctcagcttgtctctggcaggagggcccacgccctgtgtgccaggctgctgggcctccccggacggaccggctgcccgaacccctcggctatggcaagctttcatggtctctgcctccctcggtgtcaacacatg

SEQ ID NO: 40194 - DNA, 118 bp, Homo sapiens
  chr4:1577697-1577815
  hypo
caccccccacctgcccggctgtgggctgcagcctccctcctggccatcccagcagcatctgcagctgggcctatgcggtgagtccaccttaagtgggtttgatcggcccgtgcactgg

SEQ ID NO: 40195 - DNA, 154 bp, Homo sapiens
  chr4:1605613-1605767
  hypo
aggcctgacattggccggtgtcagttctcggggcgacagggccaaggccaccttgggccagccaggtaggagggttcccatccctcacaagccctcatgggcacagctgctgcctccagcctgccagaaaagccctgcccggctgccctcagag

SEQ ID NO: 40196 - DNA, 530 bp, Homo sapiens
  chr4:1616563-1617093
  hypo
cacccagaggcaggtcgccccacacgcatttctccacggggtgccccatggccgtcctatgctgacggacaccagatggcatttcagcaccgggcacaggggccgctttaaacagcaaaatcaccaaagggacacgagagcaaaaacatggcacacgcaaaccacaaaaaaggacatttacagatgagcagagacagaaggcaggatgcggccacgcccaccccacctgggcacacagaaggcaggacacgaccacgcccacctcacctggggacacaagggaggcaggatgcagccacgcccaccccacctgggtacacacggaagacaggatgcggctacgcccaccctacttgggcacacacacggaaaacaggatgcggccatgcccatcccgcctgggcacacatggaagacaggatgtggccacgcccaccctacctgggcccacacggaagacaggatgcggccacacccaccccacctgggcgcacactgaagacaggatgcggccacgcccaccccacctg

SEQ ID NO: 40197 - DNA, 30 bp, Homo sapiens
  chr4:1623727-1623757
  hypo
ttaaagggcaggttccgaccccatctgctc

SEQ ID NO: 40198 - DNA, 74 bp, Homo sapiens
  chr4:1663439-1663513
  hypo
gctcagcgaggcacccgtgcccactcccctcccaccgcctcatgcctgtggttactggtcgtctgtgtaggtcc

SEQ ID NO: 40199 - DNA, 357 bp, Homo sapiens
  chr4:1687122-1687479
  hypo
ggccaccgtggggctcggtggccacgtcccacagtggacactgtgggcagacagatgcatggaggccggctggttccgggaataggctatgggtgaggccatgcagcacccctggggctggatgctgggggaggcatcggggctcccaggggtcaggctggggcctcccaacaggttctgggcctggtaaggctagtccggtgcaggctgcgaagccaggccagctgacaccaggactggctggagtcagcctcacctgtctggaagagtgggagtcccagcggggctggggaggggagaagggctggagcaggcgtccaggccattctcttcgctggggtccggtaatcccccacc

SEQ ID NO: 40200 - DNA, 66 bp, Homo sapiens
  chr4:1791278-1791344
  hypo
ccctgtcgggaaaggcggcagctgcctgcccggagtgctgtggggaacaggcggtgtggatctgag

SEQ ID NO: 40201 - DNA, 345 bp, Homo sapiens
  chr4:1803132-1803477
  hypo
agctgctggccgtgccggccgccaacaccgtccgcttccgctgcccagccgctggcaaccccactccctccatctcctggctgaagaacggcagggagttccgcggcgagcaccgcattggaggcatcaaggtgggcgcggcggggtggctctgggcctggcaggcgcggtggttgctgcctccgctcactcacccgcccgcgtcccggtgcagctgcggcatcagcagtggagcctggtcatggaaagcgtggtgccctcggaccgcggcaactacacctgcgtcgtggagaacaagtttggcagcatccggcagacgtacacgctggacgtgctgggtgaggg

SEQ ID NO: 40202 - DNA, 335 bp, Homo sapiens
  chr4:1805302-1805637
  hypo
aggagttggtggtggcggcgttttccttgcagcggctggatcctgccgtgtggactctgtgcggtgcccgcagggcggtgctggcgctcgcctatcgctctgctctctctttgtagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccaggtaccggcttctgctgctgctgctgctccgcactgtctgggggacgctggctcgggacacgccaaagctgccag

SEQ ID NO: 40203 - DNA, 398 bp, Homo sapiens
  chr4:1807294-1807692
  hypo
ctgacaaggacctgtcggacctggtgtctgagatggagatgatgaagatgatcgggaaacacaaaaacatcatcaacctgctgggcgcctgcacgcagggcggtaggtgcggtagcggcggtggtgccggctgggcggccctcctgggcctggcagcccgtctgaggagcccgtgtccccagggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaaggtgggcagggcggcaggtgtgggtg

SEQ ID NO: 40204 - DNA, 260 bp, Homo sapiens
  chr4:1960118-1960378
  hypo
actgagccccaaacacgtagatcctgtacctcagagagcaagatggcggggcggcaggggagcttgccagttctgtgtttattccagtgagctcgagagccccagcaggaggaagtgcagccagggcagggctctgtgagagctccaggcccctcagggctgcctgcgctcagagctggtgcggcaagccgcatccccaggagcctcgtggccgttcctgacgagtgtttgtgataagtgtgtgccggaggtcaggtgct

SEQ ID NO: 40205 - DNA, 30 bp, Homo sapiens
  chr4:1961374-1961404
  hypo
cagtgcttcaccaagcgccagtacccagag

SEQ ID NO: 40206 - DNA, 155 bp, Homo sapiens
  chr4:1976939-1977094
  hypo
tgttgacctaatacacgccccttagcttttgaagagaaaggcaggtgtttccaatttggtgtctgtctcctcttctcccagggacggagctgacttttaactacaacctcgattgtctgggcaatgaaaaaacggtctgccggtgtggagcctcc

SEQ ID NO: 40207 - DNA, 620 bp, Homo sapiens
  chr4:1993715-1994335
  hypo
ggcctactcttccaccggtgcgcagatgcaagaaaacctgaagggtgagaagccggggccaccactgctcccgcagaaagcctgcgggtgggaaatcctggggatgaggggcgtagagcaggcaggtgcccggcacagcagagcgcaggagcagggtggagtcacctgccgcgggggtgtgtgcctgggcagcagggggtggggcctgggacctggggcagcacccgtgacagctgagctggtgcctagtcaccatctaggcagggacggctgcctctgggtctggacggcgctgggagttggcgctcgtggagcctggaggtggccccgggatctggagtgaggccagggccttggggaggccatgggcgacgtgcgtggaggaagcaggcgcaccccgtgctccctcaatacctgggaggccagatccatccacaccagggcctgcttcggccacataaaccccctcccacgaggaaacgcagagagccaggccatggcgtgcctgtgcctctgccatgcgcccactgggctgctcacagtgtgagacagctgggctggctggcgctgggggtgaacaacagcgccctgccctgtccagacgccggggctgaaacccc

SEQ ID NO: 40208 - DNA, 74 bp, Homo sapiens; identical to SEQ ID NO: 14668
  chr4:1994756-1994830
  hypo

SEQ ID NO: 40209 - DNA, 30 bp, Homo sapiens
  chr4:2009272-2009302
  hypo
cactaactccaaatccggcaaccaagctgt

SEQ ID NO: 40210 - DNA, 299 bp, Homo sapiens
  chr4:2065601-2065900
  hypo
ccgaggcaagggcatcgccaaggcgctgggccggaaggtgctggagttcgccgtggtgcacaactactccgcggtggtgctgggcacgacggccgtcaaggtggccgcccacaagctctacgagtcgctgggcttcagacacatgggcgccagtgaccactacgtgctgccgggcatgaccctctcgctggctgagcgcctcttcttccaggtccgctaccaccgctaccgcctgcagctgcgcgaggagtgaccgccgccgctcgcccgcccgcccccccggccgccctgtccgcctt

SEQ ID NO: 40211 - DNA, 151 bp, Homo sapiens; identical to SEQ ID NO: 5014
  chr4:2066114-2066265
  hypo

SEQ ID NO: 40212 - DNA, 30 bp, Homo sapiens
  chr4:2129422-2129452
  hypo
gcaggatctttcacccgcagctcaagaagc

SEQ ID NO: 40213 - DNA, 141 bp, Homo sapiens
  chr4:2278785-2278926
  hypo
agaaggccggattggcgtggcgcccgacacagaaggctcaggggtattattgcccaaaaccactgaactgtgtgatttagaaaggtgaattttgtggtatgtatgttacatatcaataaaggcttttttttaaagatcacg

SEQ ID NO: 40214 - DNA, 333 bp, Homo sapiens
  chr4:2305585-2305918
  hypo
gagaagtgggcagtgcgctcggatgcggctcagggcaaggggcccggcgctggcacagcccgctcccactgccccgcacaggcacgcggctcacaccaggggcgggatgggccggggctgcggcaggtgagctgagggcttggcactgcgcccatgtcacctgacaggcacccggaacatcagaaacagggaagcgggcccgctggcgcacattttctggtgcatgacgccccacagggcaggtgcctctgcagccagctcctgcccctgcccctcctcacacacagaccccacactcggccagggcccagcacctgccggtggccaagatgg

SEQ ID NO: 40215 - DNA, 124 bp, Homo sapiens
  chr4:2459775-2459899
  hypo
agagccaggaggcaccgccgccctcttctgcactcccggcctgaggcgcccagccgtctccctgtgccatggtctgacgctgtggctgcgcggggagggccggtgtggacgcctcttttctctc

SEQ ID NO: 40216 - DNA, 35 bp, Homo sapiens; identical to SEQ ID NO: 14672
  chr4:2527902-2527937
  hypo

SEQ ID NO: 40217 - DNA, 114 bp, Homo sapiens
  chr4:2926282-2926396
  hypo
gttgctctcctgggccgtcgtcatcctgggagctaggcactcctcctaagaggacctcttcaccggtttttgtctcgttctagaccagccactgcattacgtagttgtgactga

SEQ ID NO: 40218 - DNA, 139 bp, Homo sapiens
  chr4:2932947-2933086
  hypo
gctcaccatagccagcgaccacggaggacaggcagggcaccacaacggcggcggctggtgggagacatcgaggaggtgcccgtcagcccaggggagggtgcatcacccagcccctgctgcccatcggatcccctgccag

SEQ ID NO: 40219 - DNA, 30 bp, Homo sapiens
  chr4:2978968-2978998
  hypo
tatgatgagtaacagcgcatactactgctg

SEQ ID NO: 40220 - DNA, 45 bp, Homo sapiens
  chr4:2987431-2987476
  hypo
tcagatacagaaggccgggtgtggtggctcacgcccgtaatccca

SEQ ID NO: 40221 - DNA, 30 bp, Homo sapiens
  chr4:3252743-3252773
  hypo
ggcaggccccaaagccgggacctagggtgc

SEQ ID NO: 40222 - DNA, 30 bp, Homo sapiens
  chr4:3292632-3292662
  hypo
ttgacaccttctctccgtctcaggcaattt

SEQ ID NO: 40223 - DNA, 50 bp, Homo sapiens
  chr4:3310501-3310551
  hypo
ctgggaagcggctggcgccgttcagggctgggagccgctctgtcaggatt

SEQ ID NO: 40224 - DNA, 91 bp, Homo sapiens
  chr4:3313229-3313320
  hypo
gaaggagtgacagtgcgggttgagcatcccttatccagatgctccagaatcggaaaccctctgacaccgatgtggcacctcaggcatagct

SEQ ID NO: 40225 - DNA, 35 bp, Homo sapiens
  chr4:3418235-3418270
  hypo
ctgtgcatgtcgctgcggcacgtgggtcacgttca

SEQ ID NO: 40226 - DNA, 213 bp, Homo sapiens
  chr4:3445886-3446099
  hypo
aggtgagctgggcctcggaggtccgcaggggtccaggggccggagcaagtccccggaggatgggagaacaggtggctcccgagtgcagggcaggggccctgcacggggacagcaggtggcagggtgtgagggcttactgtgcacccctcagagaaatgctttgatgagacccgctacgagtacctggaggggggcgaccgctgggcccgcgtg

SEQ ID NO: 40227 - DNA, 686 bp, Homo sapiens
  chr4:3446443-3447129
  hypo
acggctctgcaacatcggtgagtgggtcagccccccggggtgccctggggcagtgccgggtggacccaccgtgggccggcctcactgcccctctgcccgcagagcctgatgagcgctgcttcttggggaacggcactgggtaccgtggcgtggccagcacctcagcctcgggcctcagctgcctggcctggaactccgatctgctctaccaggagctgcacgtggactccgtgggcgccgcggccctgctgggcctgggcccccatgcctactgccggtcagcaccacgccgctccaggccgccgcatgcggggcaggcaggatttgtcctggggagaggccccccggctccctaggacccaggcggggccagctccgtccagacaggccccggaacctctgcctgggaggctgcccgagggagggccactctcttcccactgctccaggtgcggggaaccgccctgctgggggttccgatgccccctccccatgccctcttcgaggggcagtgtgactccctgccagcccccacttatgcaccgcaggaatccggacaatgacgagaggccctggtgctacgtggtgaaggacagcgcgctctcctgggagtactgccgcctggaggcctgcggtgcgcggctggcggggggtgctgccttgggccccaccgaggtcacagcagt

SEQ ID NO: 40228 - DNA, 199 bp, Homo sapiens
  chr4:3447816-3448015
  hypo
ctgagccagcctccccggggcgccaggcctgcggcaggaggcacaagaagaggacgttcctgcggccacgtatcatcggcggctcctcctcgctgcccggctcgcacccctggctggccgccatctacatcggggacagcttctgcgccgggagcctggtccacacctgctgggtggtgtcggccgcccactgcttctc

SEQ ID NO: 40229 - DNA, 30 bp, Homo sapiens
  chr4:3449723-3449753
  hypo
acaagtgccagattgcgggctggggccact

SEQ ID NO: 40230 - DNA, 271 bp, Homo sapiens
  chr4:3475099-3475370
  hypo
ggctggcgtccctgacggccacgctccttgcagactgcctgctgatgctggtctacaaggacaagtcggagcgtatcaagggcctgcgggagcgcagcagcctgacgctagaggacatctgcgggctggagcccggcctgccctacgagggcttggtccacacgctggccattgtctgcctgtcccaggccatcatgctgggctttgacagccacgaggccatgtgtgcgtgggatgcccggatccgctatgcgctcggcgagggtgagtg

SEQ ID NO: 40231 - DNA, 38 bp, Homo sapiens
  chr4:3664470-3664508
  hypo
cggtcccacctgctccggcgccccgtggctgctgtctt

SEQ ID NO: 40232 - DNA, 61 bp, Homo sapiens
  chr4:3690841-3690902
  hypo
gtccccagaggctcacgcggtggaagctggatcccacggccggccgcggtgctgaggggtg

SEQ ID NO: 40233 - DNA, 30 bp, Homo sapiens
  chr4:3702485-3702515
  hypo
tttggaatctaagagcgttccagcccttag

SEQ ID NO: 40234 - DNA, 30 bp, Homo sapiens
  chr4:3782694-3782724
  hypo
atccccaggtgcccccgacatgaggtgagc

SEQ ID NO: 40235 - DNA, 34 bp, Homo sapiens
  chr4:3783286-3783320
  hypo
ccaaactcctcctcccgcacgaaactcctcccct

SEQ ID NO: 40236 - DNA, 30 bp, Homo sapiens
  chr4:4251746-4251776
  hypo
ctcttctctctcgtacggggttagaagcct

SEQ ID NO: 40237 - DNA, 82 bp, Homo sapiens; identical to SEQ ID NO: 14678
  chr4:4256159-4256241
  hypo

SEQ ID NO: 40238 - DNA, 30 bp, Homo sapiens
  chr4:4417662-4417692
  hypo
ctgtttgttctgtagcgtgtcaggtgcttc

SEQ ID NO: 40239 - DNA, 30 bp, Homo sapiens
  chr4:5171284-5171314
  hypo
gaaaatcaaggtgtgcgtgccaggtgccac

SEQ ID NO: 40240 - DNA, 30 bp, Homo sapiens
  chr4:5458789-5458819
  hypo
atgccgtggaataaacgctgttatgggggt

SEQ ID NO: 40241 - DNA, 68 bp, Homo sapiens
  chr4:6537166-6537234
  hypo
acacaccacatgcaacgcgagcaccgccacccacggccgccctggccgccgcccggcacagctccagc

SEQ ID NO: 40242 - DNA, 182 bp, Homo sapiens
  chr4:6540136-6540318
  hypo
ccccagcgacgcaagcgtttcagagcaaaacggaaacatacaaggatgatttaacaatctgtgttgatggtgctgaacacacccaatggtgggaagggaacaaaatcaatcccctgctattttcactaggcaaaggaaaatgagatgaggtcacgtcatcttccaaacgccaataacacggc

SEQ ID NO: 40243 - DNA, 30 bp, Homo sapiens
  chr4:6627192-6627222
  hypo
cagcaatcctggaagcggctagccgcaggt

SEQ ID NO: 40244 - DNA, 47 bp, Homo sapiens; identical to SEQ ID NO: 14679
  chr4:6670153-6670200
  hypo

SEQ ID NO: 40245 - DNA, 93 bp, Homo sapiens
  chr4:6719866-6719959
  hypo
agagcatggtatatttctttcctctcgaaatggatagttaaattatttgtgtgagtgaatggtattaggattttcctgcggatacagtagact

SEQ ID NO: 40246 - DNA, 153 bp, Homo sapiens; identical to SEQ ID NO: 14681
  chr4:6748421-6748574
  hypo

SEQ ID NO: 40247 - DNA, 44 bp, Homo sapiens
  chr4:6896389-6896433
  hypo
gcaatccccaggctgcggggtgctgagcacgcaaggcaacccct

SEQ ID NO: 40248 - DNA, 43 bp, Homo sapiens
  chr4:6957577-6957620
  hypo
tagcagcctcggacacgtaagtccgagtcgcagctctgtgttg

SEQ ID NO: 40249 - DNA, 19 bp, Homo sapiens
  chr4:7035959-7035978
  hypo
gagacgcagggaaggatgt

SEQ ID NO: 40250 - DNA, 151 bp, Homo sapiens
  chr4:7047052-7047203
  hypo
cccggctgatgtttacgtttacttcttgccttgaccactttgggagcctccttgttcgttattccccctccaccccattcccctattccacacaccataaccggagcgagctttggaagcacaaagcgcctcacaccggcctcagtggctt

SEQ ID NO: 40251 - DNA, 24 bp, Homo sapiens
  chr4:7084531-7084555
  hypo
cgccatgcccggccccttgttcct

SEQ ID NO: 40252 - DNA, 30 bp, Homo sapiens
  chr4:7134112-7134142
  hypo
gttgccacgtcgccacgcagccacctaaag

SEQ ID NO: 40253 - DNA, 30 bp, Homo sapiens
  chr4:7237615-7237645
  hypo
acaggtgtgagcacccgtgaaactctaggt

SEQ ID NO: 40254 - DNA, 32 bp, Homo sapiens
  chr4:7475475-7475507
  hypo
aggtgggagggtgggcgcggtcctggcatggg

SEQ ID NO: 40255 - DNA, 233 bp, Homo sapiens
  chr4:7647740-7647973
  hypo
tgccctagagtcaaacgtgttcattcggtcagcaaatgggccttgcgcacccggcagccacggattccgggctaccgctggtgccgcaggtgagcgaggcaggtgtgtgcccccgggctgtgagcggcttagccgaggagcaggagataaactcccaggacgcaaggaagtcagcaaacagctgtgcaggcgtgagctccgcacagcgcacacggggccggcaggctggggac

SEQ ID NO: 40256 - DNA, 30 bp, Homo sapiens
  chr4:7679932-7679962
  hypo
agtgcttcctggaggcggctgagcaggagt

SEQ ID NO: 40257 - DNA, 339 bp, Homo sapiens
  chr4:7741325-7741664
  hypo
caggtgaaggatgggcgaggactcaggcaaggactcaggtgtgtctgggctgtgccgcgggtgctcccagccgtgtctcccggtgcccttgaggcggggcagctctgggtcctgggtcctcgacctgtctccttgactcctaaccagcccccacccgggacacccggctcaccccttggcactgacatccctatgcccccctctctcccactctcgcctcccggggcctcgccactctacgccctgcagcgcccactgccaggagggggcggagcctcagcccctctcgcacccccttgctgccgatgccgggggcgatccccacgcaggtcagtggct

SEQ ID NO: 40258 - DNA, 30 bp, Homo sapiens
  chr4:7968495-7968525
  hypo
agcggggaagggtggcgtgaagctagccgt

SEQ ID NO: 40259 - DNA, 105 bp, Homo sapiens
  chr4:8039486-8039591
  hypo
acccctcagcagggtcgggggcccttctgtcctgtctacctctggcctaccctggcccacagtggcgctcctgcccttgctgaatgaatgcgggacgctgggaga

SEQ ID NO: 40260 - DNA, 114 bp, Homo sapiens
  chr4:8240177-8240291
  hypo
acactggcactgcatcggtgctcgttgtgggctggggggccagggcgctccagtccagggactgagctcttgggggccttagaacaacatgaggagctgcggcaaccctaagac

SEQ ID NO: 40261 - DNA, 32 bp, Homo sapiens
  chr4:8252769-8252801
  hypo
caccagcacagggtccgcgcctagcaggcgtt

SEQ ID NO: 40262 - DNA, 105 bp, Homo sapiens
  chr4:8327019-8327124
  hypo
gggccagaggagacacggactcagagaagaggcaggtggtctcactgttcaactcccctgggccctcggcacaggctaatcatcaaatgccgctcctgtgcagga

SEQ ID NO: 40263 - DNA, 30 bp, Homo sapiens
  chr4:8378202-8378232
  hypo
gcagggtgaagcacacggcagcagggtctc

SEQ ID NO: 40264 - DNA, 30 bp, Homo sapiens
  chr4:8386144-8386174
  hypo
gaaaacgggcactgacgggcagtgaattct

SEQ ID NO: 40265 - DNA, 50 bp, Homo sapiens
  chr4:8483913-8483963
  hypo
cagttcttcaggaaccgcctggaggcactcctcaacggcatcctcctcca

SEQ ID NO: 40266 - DNA, 225 bp, Homo sapiens
  chr4:8607707-8607932
  hypo
gcccccagtggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgaggtgagcgcccagatgcctgg

SEQ ID NO: 40267 - DNA, 110 bp, Homo sapiens
  chr4:8608541-8608651
  hypo
acgtccgagtactaccggctggcggagacccgcggcgcacgcagcgaccacatccccatcccccagcactactggtggggtaaggtaggagccgccgctgcccatgctgg

SEQ ID NO: 40268 - DNA, 39 bp, Homo sapiens
  chr4:8615881-8615920
  hypo
cagctgcaggaggggcgtctgtggcgagtacctgctgca

SEQ ID NO: 40269 - DNA, 30 bp, Homo sapiens
  chr4:8793763-8793793
  hypo
ccgatgggagacagacgtgcacacgcacac

SEQ ID NO: 40270 - DNA, 124 bp, Homo sapiens
  chr4:8967222-8967346
  hypo
acgctgccttcctcacgccgaacttcagtgaaaagcagactcagaagcggtcccaaggtgccactgtaagctgggtgaaggccagcgctgtgtgcttccagttccccctcggcatctgtagact

SEQ ID NO: 40271 - DNA, 30 bp, Homo sapiens
  chr4:10200240-10200270
  hypo
atgtctcatggaaagcggcttctgccctgt

SEQ ID NO: 40272 - DNA, 30 bp, Homo sapiens
  chr4:15697120-15697150
  hypo
aagctgagtggtcctcgggggctgactcgc

SEQ ID NO: 40273 - DNA, 33 bp, Homo sapiens
  chr4:15789491-15789524
  hypo
ttaacattgttgttccgccgtgcagggagcagt

SEQ ID NO: 40274 - DNA, 100 bp, Homo sapiens
  chr4:16787098-16787198
  hypo
tgcccattccgactccgtaaacaggccaaaatgtaatgtggcagcatcgcctaccgtggctgcaatggccgggcagcagccgcatcgggtgaaagcagag

SEQ ID NO: 40275 - DNA, 30 bp, Homo sapiens
  chr4:24535112-24535142
  hypo
cctcagacttaaagacggcaaagttttatt

SEQ ID NO: 40276 - DNA, 37 bp, Homo sapiens
  chr4:36418721-36418758
  hypo
aggaaaaattaagcacgcagatattgaaaagtgaatg

SEQ ID NO: 40277 - DNA, 97 bp, Homo sapiens
  chr4:36418818-36418915
  hypo
gttgttggttgcccccttcacagttgaacacaagggcttttatatatccgctgatggggctgggttccctaggtgtataaagcgccaattcctggcg

SEQ ID NO: 40278 - DNA, 174 bp, Homo sapiens
  chr4:39448304-39448478
  hypo
gcctctgttgcatgccgacgggtggctgaacccatcgacggccgaggccttccaggcctacgctgggctgtgcttccaggagctgggggacctggtgaagctctggatcaccatcaacgagcctaaccggctaagtgacatctacaaccgctctggcaacgacacctacggggc

SEQ ID NO: 40279 - DNA, 98 bp, Homo sapiens; identical to SEQ ID NO: 5017
  chr4:39816677-39816775
  hypo

SEQ ID NO: 40280 - DNA, 38 bp, Homo sapiens; identical to SEQ ID NO: 5018
  chr4:39817075-39817113
  hypo

SEQ ID NO: 40281 - DNA, 30 bp, Homo sapiens
  chr4:40479216-40479246
  hypo
aaacggccagaatgacgacaagaacatttt

SEQ ID NO: 40282 - DNA, 100 bp, Homo sapiens
  chr4:40533094-40533194
  hypo
gacagagtaagactctggaataaataaataaaatagaattctctatgcaaccattgtcaatggcatggacttggtttacataaaacgaaacctgtttgcc

SEQ ID NO: 40283 - DNA, 30 bp, Homo sapiens; identical to SEQ ID NO: 14692
  chr4:40910280-40910310
  hypo

SEQ ID NO: 40284 - DNA, 81 bp, Homo sapiens
  chr4:41314285-41314366
  hypo
ctcctatcccgctgggagccacttccattgcccaataaaattctccatatacactacccttcaatccgtttgtgtgatctg

SEQ ID NO: 40285 - DNA, 29 bp, Homo sapiens
  chr4:41994108-41994137
  hypo
ttgtaaaccttaggacgctgaggtgggtg

SEQ ID NO: 40286 - DNA, 151 bp, Homo sapiens
  chr4:42200720-42200871
  hypo
ggaaaaaagaaagaaagaaagaaacagacactgtttagatgctactcaaatgatcagagagaaggattatacctcttcgttatagggaagttagtctaaatctggaactgcactgtgacaataccactacttctagcgctaacaccaatat

SEQ ID NO: 40287 - DNA, 30 bp, Homo sapiens
  chr4:42316051-42316081
  hypo
tgaggcggcgtgccccgcccccctgtggcg

SEQ ID NO: 40288 - DNA, 90 bp, Homo sapiens
  chr4:43553281-43553371
  hypo
tgagttccaggtgggcgtgagctcattgggccccagacttggagcggccgcccagtgccaacagcccaggcagtgaggggcttagcaccc

SEQ ID NO: 40289 - DNA, 30 bp, Homo sapiens
  chr4:45473432-45473462
  hypo
gggatttgggaaagccgccctcaccaagtc

SEQ ID NO: 40290 - DNA, 19 bp, Homo sapiens
  chr4:48378645-48378664
  hypo
tttttttttttgagacgga

SEQ ID NO: 40291 - DNA, 37 bp, Homo sapiens
  chr4:52892695-52892732
  hypo
tacaggcgtaagtcatcgcgcccggcctaaattgctt

SEQ ID NO: 40292 - DNA, 178 bp, Homo sapiens
  chr4:55393642-55393820
  hypo
agaactcaacgcccccgccgccccactcctcacgcttcctgatacattagggaacaccccttaagccataattgccgctggtgtcagtaaacattttaacaggcaaaaacatggccactgcacttctaagggaatctgagtctgtaaatgaagagaattctgtcgatactcacttcca

SEQ ID NO: 40293 - DNA, 31 bp, Homo sapiens
  chr4:55406444-55406475
  hypo
atacacatttccggccgggcgcggtggctca

SEQ ID NO: 40294 - DNA, 68 bp, Homo sapiens
  chr4:57182183-57182251
  hypo
aggaaaaagcctcaccgtttggaataaaattgagaaggaccaactattccttgcgcttcaactgcgac

SEQ ID NO: 40295 - DNA, 16 bp, Homo sapiens
  chr4:61380678-61380694
  hypo
gaagcagtctggatgc

SEQ ID NO: 40296 - DNA, 30 bp, Homo sapiens
  chr4:72226942-72226972
  hypo
ctttcccctggtaaccggttttcaaacatt

SEQ ID NO: 40297 - DNA, 32 bp, Homo sapiens
  chr4:74468507-74468539
  hypo
aatagacacaagtttcggccaggcgcggtggc

SEQ ID NO: 40298 - DNA, 29 bp, Homo sapiens
  chr4:75241002-75241031
  hypo
taaagtaatgactagcgattctttttttt

SEQ ID NO: 40299 - DNA, 148 bp, Homo sapiens
  chr4:75241331-75241479
  hypo
caccgcgcccggcctgaccagcgattcttaaggttaacaggatagtggatgtaatatttctctggagatagattttttattcattggatcgcattcactcttctaccctagtttgcaagtgtttgggagcagacgcatattgcaggaa

SEQ ID NO: 40300 - DNA, 27 bp, Homo sapiens
  chr4:76912383-76912410
  hypo
gtttatttttaatcccgcagtctaaaa

SEQ ID NO: 40301 - DNA, 199 bp, Homo sapiens
  chr4:76912718-76912917
  hypo
cgctagataacactattccctcttaggaggaaaaaagagcaacgagggtcatataagttaatgtgtatgattttagatatgtttttattttggttttggttgtttcaacttagcgtgacccatacaagggaaaagagggctggataaaatgtgatcatgttgaccattaataaatgcaattaatcgttaaaattcaacc

SEQ ID NO: 40302 - DNA, 30 bp, Homo sapiens
  chr4:77156176-77156206
  hypo
taaaaataaattggccggtcgcggtggctc

SEQ ID NO: 40303 - DNA, 30 bp, Homo sapiens
  chr4:79689676-79689706
  hypo
gtggacctgtacatgcggcagaaagtctct

SEQ ID NO: 40304 - DNA, 30 bp, Homo sapiens
  chr4:79861382-79861412
  hypo
atgtgtataatagaacgcttagtccattgt

SEQ ID NO: 40305 - DNA, 177 bp, Homo sapiens
  chr4:81307899-81308076
  hypo
ggccttcagcttgtccggccggttgaacaacttaccgcagcttgtgtgcgtcgataaagggcatttatatttcttgaagggctggtggatcaacatgtctctcttacagtttgtccttgaggttgaatgcggactcgcacaccgagcatttgtagggcttctcgcctgagtggttgt

SEQ ID NO: 40306 - DNA, 30 bp, Homo sapiens
  chr4:82157454-82157484
  hypo
cgctagatgtccagccgcttgtcttcttcc

SEQ ID NO: 40307 - DNA, 28 bp, Homo sapiens
  chr4:83149079-83149107
  hypo
aacaggcaatgcagccgggcgcggtggc

SEQ ID NO: 40308 - DNA, 16 bp, Homo sapiens
  chr4:83301216-83301232
  hypo
gcgacaggccatgaat

SEQ ID NO: 40309 - DNA, 100 bp, Homo sapiens
  chr4:83323436-83323536
  hypo
tgcaaatgatctagacgcttgctggagttgacttgtttcatggtgagggctccttgaaacactggcaccaccaggtacttcaggtcggtggaagcaatct

SEQ ID NO: 40310 - DNA, 152 bp, Homo sapiens
  chr4:83551716-83551868
  hypo
tcaagcacatgacaacgtatatttgacgtattttagctatagcgattaaatcacatgtccacactctaatgttaaatcgtagtaatattgacttgaaaagttttttaggctgggcgcgctggctcccagctactcgggaggctgaggcagga

SEQ ID NO: 40311 - DNA, 41 bp, Homo sapiens; identical to SEQ ID NO: 14696
  chr4:84169961-84170002
  hypo

SEQ ID NO: 40312 - DNA, 30 bp, Homo sapiens
  chr4:86922651-86922681
  hypo
aagaatggcatttaacgattcaggctttga

SEQ ID NO: 40313 - DNA, 37 bp, Homo sapiens; identical to SEQ ID NO: 14697
  chr4:87899606-87899643
  hypo

SEQ ID NO: 40314 - DNA, 22 bp, Homo sapiens
  chr4:88010193-88010215
  hypo
cgcatgtcgagtattaagccag

SEQ ID NO: 40315 - DNA, 30 bp, Homo sapiens
  chr4:88025280-88025310
  hypo
gtgcagggtggctcacgcctgtaaccccag

SEQ ID NO: 40316 - DNA, 128 bp, Homo sapiens
  chr4:89116521-89116649
  hypo
tagaagggtttgttccgggctatccagaaaacagatagggtccatataatatgtggtcggcttgttagcagcagaaggtatcctagtcacgtggcaccaaaatatgttagtagcggccaatccacaca

SEQ ID NO: 40317 - DNA, 20 bp, Homo sapiens
  chr4:89912577-89912597
  hypo
gactccgtctcaaaataaaa

SEQ ID NO: 40318 - DNA, 106 bp, Homo sapiens
  chr4:90043853-90043959
  hypo
tctatacgattcctgcgtgtttcccacaccaggtttcccttttataaaccccttcagtcagccttaaaatttgagttatcattttgagactcgagtccggacatgt

SEQ ID NO: 40319 - DNA, 203 bp, Homo sapiens
  chr4:91168356-91168559
  hypo
gattgccattggcagcgagtgactgaaactgtggaaagcaaaactgcagctccatcccatagcaaacattaggcataaaatctttatcaaattcttatctcgtacagagttgaggacaggtaaaagggaacttgtcgtagttgttgatacatcctggttgctatgtgaataataattcacaacaatatcggaataatatagat

SEQ ID NO: 40320 - DNA, 143 bp, Homo sapiens
  chr4:95127590-95127733
  hypo
attaaaacaattgaacgtatgagaaacggtagaacgatggctaccagaggctgggaagggtagtgtggggcgggggaggaccccggtggtcggtgagcatggttaatgggtacgaaaatacagtttgaatgaataagatctag

SEQ ID NO: 40321 - DNA, 17 bp, Homo sapiens
  chr4:95762912-95762929
  hypo
ttcggccatcttggctc

SEQ ID NO: 40322 - DNA, 78 bp, Homo sapiens
  chr4:97118687-97118765
  hypo
ggggggtttagttaccggggatggctttgggatgaaactgtcccacctcagatcatcattctcataaggagcgtgcaa

SEQ ID NO: 40323 - DNA, 17 bp, Homo sapiens
  chr4:97118825-97118842
  hypo
cccgcggatctgacagg

SEQ ID NO: 40324 - DNA, 64 bp, Homo sapiens
  chr4:97442548-97442612
  hypo
cactgcctcagtccccgccgtgggctcccgtgggcccaagactccctgacgggtgctaccccct

SEQ ID NO: 40325 - DNA, 106 bp, Homo sapiens
  chr4:99495888-99495994
  hypo
tattacctaaaagcacgaagggtgcctagcgacggacctgatccccaacagacacatggtaaatggcaacattactgaagaagttagaggccgctctgcctggtga

SEQ ID NO: 40326 - DNA, 24 bp, Homo sapiens
  chr4:103350988-103351012
  hypo
ctgaggcaggagaatcgcttgaac

SEQ ID NO: 40327 - DNA, 27 bp, Homo sapiens
  chr4:103811714-103811741
  hypo
ggcttggtgcagtgacgacacacctgt

SEQ ID NO: 40328 - DNA, 30 bp, Homo sapiens
  chr4:107134495-107134525
  hypo
tagaaataagaataccgggggaggaaccaa

SEQ ID NO: 40329 - DNA, 23 bp, Homo sapiens
  chr4:107994276-107994299
  hypo
gggctacacgtggcacttgcagg

SEQ ID NO: 40330 - DNA, 122 bp, Homo sapiens
  chr4:108302152-108302274
  hypo
ggaagaaatcgtttacgccctctgttggcagcaggggcctgtcctcctttactctttagaatctagagggagaaagccaaaaaccaacctctctagaagggaaagaccggtgtctagacaac

SEQ ID NO: 40331 - DNA, 26 bp, Homo sapiens
  chr4:109311251-109311277
  hypo
aataaaaacagccaacggcggccggg

SEQ ID NO: 40332 - DNA, 79 bp, Homo sapiens
  chr4:110735440-110735519
  hypo
aaaaagaccaacattcgttaaaatcaaattgcagcatttactaaactaaaagaaaaagaacaagtaaagtttcctctct

SEQ ID NO: 40333 - DNA, 19 bp, Homo sapiens
  chr4:110735819-110735838
  hypo
gccccgcctacaaaggtat

SEQ ID NO: 40334 - DNA, 30 bp, Homo sapiens; identical to SEQ ID NO: 14701
  chr4:113154853-113154883
  hypo

SEQ ID NO: 40335 - DNA, 30 bp, Homo sapiens
  chr4:113199029-113199059
  hypo
ttcatccatttctgtcggagaactgctttg

SEQ ID NO: 40336 - DNA, 28 bp, Homo sapiens
  chr4:113559151-113559179
  hypo
tattaaaacattttgcgaggctgggcac

SEQ ID NO: 40337 - DNA, 87 bp, Homo sapiens
  chr4:113559419-113559506
  hypo
gcagcctgggccactgagagaggctgcgtctccaaacaaacatttttcatataatttcctcaggagaaattacgaaatacttttaaa

SEQ ID NO: 40338 - DNA, 30 bp, Homo sapiens
  chr4:114176916-114176946
  hypo
tgcccagggagaccacgtggaatgtgtgaa

SEQ ID NO: 40339 - DNA, 89 bp, Homo sapiens; identical to SEQ ID NO: 14704
  chr4:123866964-123867053
  hypo

SEQ ID NO: 40340 - DNA, 34 bp, Homo sapiens
  chr4:124335284-124335318
  hypo
tgtttgcaggccgggcgcggcagctcacgcctgt

SEQ ID NO: 40341 - DNA, 100 bp, Homo sapiens
  chr4:128984233-128984333
  hypo
ccaatgctgtatggccgtcggtgctttattttgattgtagtaactgcaacttaagaaagtaaaaatgggccggcgcggtggctcacgcctgtaatcccag

SEQ ID NO: 40342 - DNA, 30 bp, Homo sapiens
  chr4:136320705-136320735
  hypo
ggccaaaatttctttcgcagatcttacact

SEQ ID NO: 40343 - DNA, 37 bp, Homo sapiens
  chr4:140566711-140566748
  hypo
agattacaggcatgggccaccgcgcccggcctgtttt

SEQ ID NO: 40344 - DNA, 30 bp, Homo sapiens
  chr4:140753539-140753569
  hypo
acaaacgtgagccaccgcacctggcccctc

SEQ ID NO: 40345 - DNA, 59 bp, Homo sapiens
  chr4:140754226-140754285
  hypo
gactacatcgataaacggaggttcagctccctcactcttcgtcacgtcaccagcagctt

SEQ ID NO: 40346 - DNA, 30 bp, Homo sapiens
  chr4:141031335-141031365
  hypo
agtaaggaaatcagacggtaaaatgtccta

SEQ ID NO: 40347 - DNA, 30 bp, Homo sapiens
  chr4:144100466-144100496
  hypo
ttcacatttttgggccgaccagccattagg

SEQ ID NO: 40348 - DNA, 43 bp, Homo sapiens
  chr4:146853888-146853931
  hypo
gtgttgggattacaggcgtgagccaccgcgctcagcttgtatt

SEQ ID NO: 40349 - DNA, 32 bp, Homo sapiens
  chr4:147048518-147048550
  hypo
tccctgttgttaagtgacgcatgactatatat

SEQ ID NO: 40350 - DNA, 20 bp, Homo sapiens
  chr4:153437373-153437393
  hypo
caactggtactggtccgtgg

SEQ ID NO: 40351 - DNA, 100 bp, Homo sapiens
  chr4:153535608-153535708
  hypo
ggaggccctagccaccggtgcagccttcattgcctgccactccccctatgcaccctaagtgcggcagccaagccgtgcagtcctgcgctttctgactcac

SEQ ID NO: 40352 - DNA, 30 bp, Homo sapiens
  chr4:153702805-153702835
  hypo
gcttagcatgacccacgtcttctcccaact

SEQ ID NO: 40353 - DNA, 181 bp, Homo sapiens
  chr4:153918964-153919145
  hypo
gatgctcggactctccgtgtgtgccattttgcagtggggtcacgctccacgtgttgttctgccactgcctttggtttctcgacactgcctcgtggacacgcagggagagcttgcagctggtgacaagctctccagcaggtgagtaatccagcagctctttctgcctcgaggtgagtgaggt

SEQ ID NO: 40354 - DNA, 63 bp, Homo sapiens
  chr4:154216373-154216436
  hypo
gtagagtctccttctcgccggtggagggcactgccccgggctaggccccgccctgtgggacga

SEQ ID NO: 40355 - DNA, 163 bp, Homo sapiens
  chr4:154216735-154216898
  hypo
cagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacgggga

SEQ ID NO: 40356 - DNA, 30 bp, Homo sapiens
  chr4:154372568-154372598
  hypo
gccagcgtggtggctcgggcctgtaatcct

SEQ ID NO: 40357 - DNA, 115 bp, Homo sapiens
  chr4:154540115-154540230
  hypo
ctgggatatgtctcacgcctctgaatctagcttgtcctgcattccccttttctttgtcatactcacggagaactctttgatgcttctggtcaccgagtcccgcctctcagtagtc

SEQ ID NO: 40358 - DNA, 30 bp, Homo sapiens
  chr4:154702659-154702689
  hypo
ctgccaccgcttcaccgaggtgatcaccag

SEQ ID NO: 40359 - DNA, 40 bp, Homo sapiens
  chr4:155321157-155321197
  hypo
gtaagtaggctttcacggccgggcgcggtggctcatgcct

SEQ ID NO: 40360 - DNA, 173 bp, Homo sapiens
  chr4:155677688-155677861
  hypo
gggatgttgcggttgcggggagaaggcagactgtgggttgagatttaaatggaaaatgactacgagcttctctttgtagcagtttggtgggagaagaaagaaacagataaagcccaaagactcagaaagcagtataacgtgatatctcttactacttccgcatgctttagaac

SEQ ID NO: 40361 - DNA, 89 bp, Homo sapiens
  chr4:156676888-156676977
  hypo
caggcgtgagccaccgcgcccggccgattacaatacttttaatacttaacttaccaaagtaatttatttttattcgctgaaaatgtgag

SEQ ID NO: 40362 - DNA, 40 bp, Homo sapiens
  chr4:157119835-157119875
  hypo
ggcagagacacaagcagcttgatgtcgtgaggaacaccta

SEQ ID NO: 40363 - DNA, 169 bp, Homo sapiens
  chr4:158740667-158740836
  hypo
acgcaccagccgtcacgctccctctccacactgcagcttccttctgcctcacggcaactccccacttcacactgctagtacgtgtctgccaggtgtctgccaggtgagttctgcttctgttgccctgccagcacacaggagttcaatccacctccgatagccccactga

SEQ ID NO: 40364 - DNA, 153 bp, Homo sapiens
  chr4:170484641-170484794
  hypo
aatgctgcttcaccacgattttctaggtaggtaatcatatcaaatgtaaatacgatatgtctatgttttctctcctcttccaatatttacatttctttccttttaattgctctagctagaacctctggcataatttaacgatggcaatgacag

SEQ ID NO: 40365 - DNA, 30 bp, Homo sapiens
  chr4:170919945-170919975
  hypo
ttaaatctgccaaaacgagtatgttagttt

SEQ ID NO: 40366 - DNA, 22 bp, Homo sapiens
  chr4:172596059-172596081
  hypo
taacatacgcccacttgggctc

SEQ ID NO: 40367 - DNA, 31 bp, Homo sapiens
  chr4:172903760-172903791
  hypo
gtttgcttcttccagacgagcttgttggagg

SEQ ID NO: 40368 - DNA, 69 bp, Homo sapiens
  chr4:175940800-175940869
  hypo
agtacgcgtgtgcctcgcgccagtccacgctaggagagcactgggaccgagacccggcaccacctcccg

SEQ ID NO: 40369 - DNA, 21 bp, Homo sapiens
  chr4:178599688-178599709
  hypo
ccactgcgcccagccgagtcc

SEQ ID NO: 40370 - DNA, 30 bp, Homo sapiens
  chr4:180818589-180818619
  hypo
tcctagttgtaaggacgtacgaaatgattc

SEQ ID NO: 40371 - DNA, 30 bp, Homo sapiens
  chr4:183959079-183959109
  hypo
aatcaactcatatgccgctacagaggcccc

SEQ ID NO: 40372 - DNA, 30 bp, Homo sapiens
  chr4:184205426-184205456
  hypo
gttcgccccaaagagcgcagcagcctgagc

SEQ ID NO: 40373 - DNA, 15 bp, Homo sapiens
  chr4:184375711-184375726
  hypo
cgatcctgcttcttt

SEQ ID NO: 40374 - DNA, 30 bp, Homo sapiens
  chr4:184921881-184921911
  hypo
ggtgttatccttcctcgactctcagcaccc

SEQ ID NO: 40375 - DNA, 30 bp, Homo sapiens
  chr4:185833058-185833088
  hypo
caatgcccgctgcagcgggaaacaattgtt

SEQ ID NO: 40376 - DNA, 30 bp, Homo sapiens
  chr4:185913935-185913965
  hypo
ttcttggggacaggacgtcaacgtatcctt

SEQ ID NO: 40377 - DNA, 161 bp, Homo sapiens
  chr4:186348467-186348628
  hypo
ggatgtggggaagggcgttgtatttagttatgtttcagtttaaaatgaatcttcacttgcccctttggtgttacgtattagcaatgattcatgctcaggtgagccagtttcaggcaggcttgcagagaggcactcaaacagcttgctttaaatttaaggta

SEQ ID NO: 40378 - DNA, 72 bp, Homo sapiens
  chr4:190474969-190475041
  hypo
cagcgcacctgtccacgagtctggccgcagcgcacctgtccccgagtccggccgcagcgcacctgtccacaa

SEQ ID NO: 40379 - DNA, 36 bp, Homo sapiens
  chr5:109867-109903
  hypo
ccattcctgctctaccgccaccgccccattggctaa

SEQ ID NO: 40380 - DNA, 30 bp, Homo sapiens
  chr5:139715-139745
  hypo
tgcaggtcacgtcggcggggaagcagtcag

SEQ ID NO: 40381 - DNA, 37 bp, Homo sapiens
  chr5:140350-140387
  hypo
ccgagcagcaggaggcggccgccgggggaccccactt

SEQ ID NO: 40382 - DNA, 81 bp, Homo sapiens
  chr5:192215-192296
  hypo
gcccctcgttccgggcggacagcctgagccccagccagctcctgcacgtgctgcgtctggctggcccgggtgccctgcgca

SEQ ID NO: 40383 - DNA, 46 bp, Homo sapiens
  chr5:429731-429777
  hypo
gcagctcagccttgccgcgcgatcctgcagccgccactgggcagcc

SEQ ID NO: 40384 - DNA, 30 bp, Homo sapiens
  chr5:430228-430258
  hypo
cttaagttgcagtcacgtgtgttgccttgt

SEQ ID NO: 40385 - DNA, 75 bp, Homo sapiens
  chr5:435499-435574
  hypo
attagaaatacaacacgcggagaaaggggtccgtgagcccactcatagaggaatctagaacgttccaggcagcag

SEQ ID NO: 40386 - DNA, 30 bp, Homo sapiens
  chr5:478182-478212
  hypo
actgcactcagacctcgccaggtgggcacc

SEQ ID NO: 40387 - DNA, 286 bp, Homo sapiens
  chr5:479388-479674
  hypo
gtgcgggagccagggcggcagtggcctcggggctgggtggggcgcctggcctctggtctctggagcagtcaggggctctgcagacgctgagaggcctgctcatagtggactgggagatgctggagcagcctcagagccatggccggcccacagcgggagacggccctgctgctgcccctctgcctgtgcgtgtgcacctgtgggcacctgcgtgtgctggggcaggcagggctgtattgggaccaggtcccgtaacagcctgcctgcttaccgtctgctcccatcc

SEQ ID NO: 40388 - DNA, 164 bp, Homo sapiens; identical to SEQ ID NO: 14710
  chr5:480880-481044
  hypo

SEQ ID NO: 40389 - DNA, 30 bp, Homo sapiens
  chr5:484548-484578
  hypo
gctggctcgccctgccggacccaggagggt

SEQ ID NO: 40390 - DNA, 30 bp, Homo sapiens
  chr5:488495-488525
  hypo
ggacctcctcaaacacggccaggacggcca

SEQ ID NO: 40391 - DNA, 146 bp, Homo sapiens
  chr5:488846-488992
  hypo
tcatctttgggtgaacggaggcaggtgggtgcaggggcaccgcatgctggggagggatgggggcccatcgcctggagtggcgtcccagcccaggagaagcaagtggggctgacccaggacgggcccggagccgggacacacagcac

SEQ ID NO: 40392 - DNA, 839 bp, Homo sapiens
  chr5:491305-492144
  hypo
aagctgtagcatccccggcagcagcggcgggcatcagggctgcaccgcacctggcatgttgagaggcgccagccacgcgtggtctgggtccggggcgggaggcagtgcccgagagatgaagcatccaagaccaaaaccgcgcagcagttctggctccggctgtggctgcagcggtggccgagcggctccggcacacaggctgggagggacggtgcccgatacaccaggctctgcagtcctcctcctctccctgggacctggtggccggcgagtgtggacggacccctacctctgcccagtgccggaggaagagcggcagcccctggccacctgcagcccccaagccgagctgccgagatgggaactcctccccaagcagaacacgtgctgggacctggggacgcgcaggggactggccttggtcacgagggcctacggggctgccagccacgtttctcacctgacacttaccgcctggaggccagggtgcggcaccccgacctttctgagatgaggcagcgccgcccctcccggaccccaccctgatcccggccggggcaacagtggcgcagactcacccatgagcccactgaggaagacgccgtagagggacagcccggtggtggccgcgttccacacggtacccacgacggcgtacaacaggatggtccccaggttgccgaagaagaggcggttgggcatgaagtagccggcgtccagcacgatggggggcagcaggtagaagaagaagacggtgggcgtcagtgtgaaggacgcgatgtggtcggccgcccagacgatgccgcccagcaccaggcccagcacgatgagcagggcgc

SEQ ID NO: 40393 - DNA, 197 bp, Homo sapiens
  chr5:516758-516955
  hypo
tttaggccaggtgagcgtggtttctctctgggcacatgacccactcctgagagagctctgtgtggggcagatggtgctcaccatgctgagcccagatctgccaaagtgctctgagccgatgctgcaattgcttgtcaatgatcccactttgcaggttaagtctgccactccttggcaggcggcgcctctaaagccat

SEQ ID NO: 40394 - DNA, 30 bp, Homo sapiens
  chr5:519988-520018
  hypo
gaccctgtgccctagcgtcctcctgaccct

SEQ ID NO: 40395 - DNA, 49 bp, Homo sapiens
  chr5:537890-537939
  hypo
gtgtctgcattggcccgagggcctgggggaatcccgttcccacactggt

SEQ ID NO: 40396 - DNA, 265 bp, Homo sapiens; identical to SEQ ID NO: 14714
  chr5:538686-538951
  hypo

SEQ ID NO: 40397 - DNA, 284 bp, Homo sapiens
  chr5:554299-554583
  hypo
ggcaaggaaaataaacgagccgttacctttcaccaaatcgcactgtattttattcatttagggtgtacacacctatctgctcttcaaaggaattttgggcagattgtaaaattacgctcaacatacagcaaggcgactataaatacaaaagcagcactgaggtgctggtgctgcgggtgggtcacgggataaaccaggcgtggggtctgggtcacgggatgacccgagggtgggtcacgggataaaccaggggtggggtctgggtcacaggatgacccgggggt

SEQ ID NO: 40398 - DNA, 120 bp, Homo sapiens
  chr5:554823-554943
  hypo
cgggatgaacggggttgggggctgggtcacgggatgaaccggggggtgggtcacgggatgaacggggggggggtgggtcacgggctaaaccggggttgggggtgggtcacgggatgaacg

SEQ ID NO: 40399 - DNA, 43 bp, Homo sapiens
  chr5:555183-555226
  hypo
cggggtgaggggtgggtcaccggatgaacgggggtgggtcatg

SEQ ID NO: 40400 - DNA, 30 bp, Homo sapiens
  chr5:555668-555698
  hypo
gtccctcgagccctccgcataaacctctgt

SEQ ID NO: 40401 - DNA, 250 bp, Homo sapiens
  chr5:556065-556315
  hypo
cagggaggggtgggccgagaagtgtggatgggtacatggagggtcccgggccctcggggtctggctggtagcactgggaggaggtgaaaagcaaggcttgtgagggctcagctcccagagttgcaactctgcggactgcagcggggccttggctccacctgcgcttctggtctcggctgccctgacagccactgggctccaggcaggcctgggtggtgaggacggcgctgggctgcggccaccagatcca

SEQ ID NO: 40402 - DNA, 30 bp, Homo sapiens
  chr5:583170-583200
  hypo
cctgtgactggggatcgctctgccatcggc

SEQ ID NO: 40403 - DNA, 30 bp, Homo sapiens
  chr5:595300-595330
  hypo
aaagaaaaatcgatgcgagaacacccttcg

SEQ ID NO: 40404 - DNA, 30 bp, Homo sapiens
  chr5:601155-601185
  hypo
gaccagcagtgcatgcggctctggattcat

SEQ ID NO: 40405 - DNA, 47 bp, Homo sapiens
  chr5:676852-676899
  hypo
agaaaacagacaatgcgtgacacggcaacagacgtgtgcacacatga

SEQ ID NO: 40406 - DNA, 195 bp, Homo sapiens
  chr5:677865-678060
  hypo
tgatcttgctgaagacgatgtccacgtcagtgacggtcacgttcctgccgtcgatcacctggcagtccttgcacagcttcgaccagttcttgccgtgcatctccctcccggtggccctggcgtccccgtgcacggcaaagcgccggaaggcctcctccagggcactgagctcaggggatgcggctgccccctcac

SEQ ID NO: 40407 - DNA, 54 bp, Homo sapiens
  chr5:684241-684295
  hypo
ccctccaatgtcccacggccacagtttccaccttgacgccgaagccctgggatg

SEQ ID NO: 40408 - DNA, 30 bp, Homo sapiens
  chr5:891092-891122
  hypo
gacattcagagacaccggaggaaacctcag

SEQ ID NO: 40409 - DNA, 36 bp, Homo sapiens
  chr5:891651-891687
  hypo
cccctcctccagccacgcaggcgcactctgcctggg

SEQ ID NO: 40410 - DNA, 95 bp, Homo sapiens
  chr5:1003105-1003200
  hypo
gtttcacatgttcaccggtgtgtacgcccgggtgtgcttcgaactgagaagccaggagcccagggcttctctgctgcccacgaatcatgccttct

SEQ ID NO: 40411 - DNA, 135 bp, Homo sapiens
  chr5:1021355-1021490
  hypo
cagatatggaggctccgtctgaatgtatctagggcttatgtgggaagcccggctcccctgcccggtccccccggccccccacctcccagcccctttgctcctcccgctgacccggccccccgcccctccacccac

SEQ ID NO: 40412 - DNA, 423 bp, Homo sapiens
  chr5:1034312-1034735
  hypo
taggaggcgaggtcccggcccccacgtccccccacaggcactccagtgcgatgtctcggtggaggaggacgaccgccaggagtggacgttcacgctctatgactttgacaactgcgggaaggtcaccagggaggtaggtgagcttgtgtttgcgtcaggtccacagtagtagacagacggggcagacagactgtgctggcctcgcgatacctcagggggcaggaggggacctgcctgctgcgaggtcctcatgccagctgggcttgcgtctccccagggcccagttcacgtgtgtttctgggccgagcctgcgccgcccatttctgcggctgtgcttcccacactgcaaggctgccctcagggcactggaggcgctcacagggccacctgggcagacccaggctgctccgagaagatgcctgt

SEQ ID NO: 40413 - DNA, 30 bp, Homo sapiens
  chr5:1039154-1039184
  hypo
ggtagcccctggtcccggagccacagcagc

SEQ ID NO: 40414 - DNA, 836 bp, Homo sapiens
  chr5:1073480-1074316
  hypo
ggggctcacccatggcgggaggaggcggtcccagggttcgcccttggaaagctaatggccctcacacctcccaagcttcccggggtgcggctggtgctcccaggccttagcgcgctgctctgagctcaaagccaccgccacggctaaaacacagcagcgccacgcacagcaccgtgttgacacgctgcgatgaggacatgccagggcacgtttcctgtgcagctggggtgggaaagaggcctggcccccagaccccgcccggcccacctcctcggcccgctgagcctccatgtgcttgtccaggtacgtcccctccagcaccgagcccacgatggtcaggcccttgccggccttcagctgcgacgtgaaggacagcaggcgggggtgcttcacggcctgctccgcgtccaggttcagcatcaccagcacctggggcctgcagccagggtggggcggctgttaccacggcaacgcttaccagggcacggcccatcaacaggcagggcagatgggacgggcggggcacacgacacaggtgggacgggagatacatgacaggcgggacaggggacaaaaggggcaggtgacagatgggatggggaaacgtgacacacgtggggtaagttgaacaggtgacaggtgagacaggccacagaagccaggtgggacaggcagggccgatggacaggtgggcactagccaggcaggacaggagaacaggtaggttagacaggtgggacaggtgacatgctagacaggtgagacaatggcccaggacacacacctgaagcccccaccgaggccctgaggggacaatggcccggggcacacccgag

SEQ ID NO: 40415 - DNA, 39 bp, Homo sapiens
  chr5:1131348-1131387
  hypo
gatgtgcagggacaccgtccctcccggccgtcctgctcc

SEQ ID NO: 40416 - DNA, 125 bp, Homo sapiens; identical to SEQ ID NO: 5026
  chr5:1174263-1174388
  hypo

SEQ ID NO: 40417 - DNA, 70 bp, Homo sapiens
  chr5:1189557-1189627
  hypo
tcaaggccaggaggccgccatggggaccccacccagcactgtgctggacacaacgcggcaagacaagaaa

SEQ ID NO: 40418 - DNA, 30 bp, Homo sapiens
  chr5:1193360-1193390
  hypo
agaggagggacaggccgtgagttgagggag

SEQ ID NO: 40419 - DNA, 215 bp, Homo sapiens
  chr5:1193772-1193987
  hypo
tacctcggagaactccgggcatgaatgtgcgaaaggcaggaacagacgtccacggcggctttcatcctcatggcgcaaacgggacccctaccgtcagcaatggagccgtgaaggagctgcagccgtggacctggagcaggcacagcgagccagggtgcgaggcccggacagctctgagcggaacagcgagccacctgcagcgtccagctcgagac

SEQ ID NO: 40420 - DNA, 165 bp, Homo sapiens
  chr5:1221142-1221307
  hypo
ctggcaaggggaggccgggcacctcgcagcacaccatctgttcgggtagcagaacgtacagaaagcttagcgagttgaagcccagctggtagcagcagtgacagctgtctctggccttggcaggttcaataaggacatcgagttcatgatcggccacaagcccaa

SEQ ID NO: 40421 - DNA, 37 bp, Homo sapiens
  chr5:1223271-1223308
  hypo
tctctgcgttctggccgcttcccggcttaatgaatgc

SEQ ID NO: 40422 - DNA, 343 bp, Homo sapiens
  chr5:1232902-1233245
  hypo
gtactacaacaccatcgtggcgtgggtgctgtggtacctcctcaactccttccagcacccgctgccctggagctcctgcccaccggacctcaacagaacaggtgagctgggcgccgcctgctgtgtgggtccgtgcacggccgagagaggcatgtgctgcagcgtgtccagcatcagagcagctgcgggtggcggatgctcaccgcggggggagggccggggaaccggttgctctgtgtgcacatgcacgcgcctcggtctccccaggagcacacgtgcagtccagttcttatgacctccacgctgtgctgtgcttccctgccaggtccggaccaccgaggtc

SEQ ID NO: 40423 - DNA, 886 bp, Homo sapiens; identical to SEQ ID NO: 29363
  chr5:1294557-1295443
  hypo

SEQ ID NO: 40424 - DNA, 50 bp, Homo sapiens
  chr5:1346659-1346709
  hypo
gggtggattgtctcacggcatccagaggcagggaccgaggcagggaccta

SEQ ID NO: 40425 - DNA, 30 bp, Homo sapiens
  chr5:1362773-1362803
  hypo
tatccacaaaaaaagcgagttttcattccc

SEQ ID NO: 40426 - DNA, 27 bp, Homo sapiens
  chr5:1381058-1381085
  hypo
atgggacgccacatccgccagcaccct

SEQ ID NO: 40427 - DNA, 87 bp, Homo sapiens
  chr5:1381145-1381232
  hypo
tcaggcttaggcgtgttgtcacagcagcccgaatggactccagcagcagagcagccagggctgcacgtggtgcgtgaacacacccgc

SEQ ID NO: 40428 - DNA, 41 bp, Homo sapiens
  chr5:1384936-1384977
  hypo
gagcaaaccaggcctcggcatgggcacgggatgaactcagg

SEQ ID NO: 40429 - DNA, 40 bp, Homo sapiens
  chr5:1406427-1406467
  hypo
tgtccatcagggcagcgcattcccccgatgctggacacgt

SEQ ID NO: 40430 - DNA, 30 bp, Homo sapiens
  chr5:1422106-1422136
  hypo
ggtggaggtgcagcacgccacgtctgcaga

SEQ ID NO: 40431 - DNA, 30 bp, Homo sapiens
  chr5:1662561-1662591
  hypo
ctctgcctgcccagccgcccctctgcgccg

SEQ ID NO: 40432 - DNA, 90 bp, Homo sapiens
  chr5:1662801-1662891
  hypo
cgtgtcccacactcccgcaggctggggacacgcagacaaagtgtgtccctgtgtctgtgtgtatctgtctgtgtgcgtccctgtgtctgt

SEQ ID NO: 40433 - DNA, 30 bp, Homo sapiens
  chr5:1704607-1704637
  hypo
gattgtgggccgatccggctccagccccgt

SEQ ID NO: 40434 - DNA, 35 bp, Homo sapiens
  chr5:1746022-1746057
  hypo
tccctgagccgagcacgccccgtccacttggtggg

SEQ ID NO: 40435 - DNA, 724 bp, Homo sapiens
  chr5:1746453-1747177
  hypo
ccaaggagggcagttcgctccggggcacctgtcaggggccccacacggctgcttttaggccaggggtggcaaagacgctgctgccgcctgctctgggctcggctcccatggctgtgaaggaccctcgtcactccccgtcgcctgcctgggctgcccggggaccctcctgctgcgtcagcacagagcctggaaccgcggccaaggcaggaagctcccctgtgaaggcaccaagcacggcagacgccctcacatcgccggggcccgtttccctgtggacgggaagtgggaacgtgacgtggacgtgacgtgggaacgtaacgtgacgtgacgtgacgtgacgtggcatggcgcgaggacagcgcggcgggagcggcgcctcagatccagcagggagggagacgaaaggcggatggaagaggggcccccggaccccgcccctcgaggcttgtgtgccgccctggctgcggcgttctgggcgacgggaaacagagtcaggacacagaccagggagggccggggcagagccagggcacctgcgggcgaggacggctgggtgctgggtccccggcgtcagggcgcaatgccgcctgctgggcgtcaccctttcccagggctgctgggacacgtggccgcagctgcttggctcaccacagcggaagtcggtctctctcatcctggagtccgcgcggctgagggcgaggtgtccttccgggggccctgaggg

SEQ ID NO: 40436 - DNA, 86 bp, Homo sapiens
  chr5:1749854-1749940
  hypo
gaggcagtggaggaccggaaccatgaccacagtgctgtggacacacatatgtacatacactgtaaaaagaaacgctgggaggctaa

SEQ ID NO: 40437 - DNA, 30 bp, Homo sapiens
  chr5:1750588-1750618
  hypo
gcatcacacggttatcgtcacacggacatt

SEQ ID NO: 40438 - DNA, 30 bp, Homo sapiens
  chr5:1780761-1780791
  hypo
ggacaaatcagtttccgttgataaaagaaa

SEQ ID NO: 40439 - DNA, 30 bp, Homo sapiens
  chr5:1794613-1794643
  hypo
gcatgctcatctgtccgggctgcaataaca

SEQ ID NO: 40440 - DNA, 228 bp, Homo sapiens
  chr5:1795233-1795461
  hypo
acagccatgcccactcgcagggaggcagggaagccccagcccccaccggtccggcacaggaaggagacctggaccctgggagtgccggtctcgcctcccactctcctgggtgagtgacagcgacgctgccaggtgggtggtccatcagttagacctggtccgtgagtagcctcctaggtggatacaaacatgacagcgtcccacagagcacctcgcctccttctggaa

SEQ ID NO: 40441 - DNA, 194 bp, Homo sapiens
  chr5:1865547-1865741
  hypo
gaaaaacgaagccaccgcgattatgattatgggaacatagggtttacacgggggagttgctggggagggcatttcaggacagccttgatcaaagggctggggagatggtccaggcgatgccaaccggaagccccagaggaggagaggaaagccatccactaggggaccatcgctggccccgagctctgggtggg

SEQ ID NO: 40442 - DNA, 34 bp, Homo sapiens
  chr5:1869209-1869243
  hypo
ccagacacctggaaccgtccgcgtgcacaggctc

SEQ ID NO: 40443 - DNA, 39 bp, Homo sapiens
  chr5:1923035-1923074
  hypo
ggtctccagtgaatgcggcgtccacgcctgatcggggct

SEQ ID NO: 40444 - DNA, 138 bp, Homo sapiens
  chr5:1949531-1949669
  hypo
tcagtaccctgtctgcggggtggggcgatgcgaacctacaccctgggatgggggtgcccgcccagggcagtgctgtctgtgatcttgccatgcccagggcacccactccatgacgctggctgtcggtgctttccaggg

SEQ ID NO: 40445 - DNA, 471 bp, Homo sapiens
  chr5:1950766-1951237
  hypo
tctgaaacagcccctcggcagcttcacgacctcaccaagtgcccgccgctctcacgagagaggtggttatggttgcgcattgaatatgcttgggagaggcaaagatggatggcgtagtctctaccctcacacccagtgctgagcgcgagtcgtccgctgtgtgtgcatcatctgctgtgcgtgtgtcatctgctgtgcatgcctgcgtcatctgctgtgtatgtgtcatctgttgtgcatgcgtgtgtcgtctgctgtgggcgcgtgagtcatctgctctgtgtgcttgtgccgtctgctgtgcctgcgtcatcgtctgctgtgcgtgtgtcatctgtgcgtgtgtcatctgctgtgcgtgagtcatctgctgtgcgtgtgtcatctgtgcgtgtgtcatctgctgtgcgtgcgtgtgccctctactgtgggtgtgttcatcatctgctgtgcgtgcgttgtctgctgtgc

SEQ ID NO: 40446 - DNA, 110 bp, Homo sapiens
  chr5:1951574-1951684
  hypo
gcatcgtctgctctgcgtgcgtgcgtcatctgctgtgcgtgtgtcatctgctgtgcgtgtgccatctgctgcgggtgcatcatctgctgtgcgtgcgtgtgccatctgtg

SEQ ID NO: 40447 - DNA, 35 bp, Homo sapiens
  chr5:2112239-2112274
  hypo
tgtcaatattaattccgccgcggagattacttgtt

SEQ ID NO: 40448 - DNA, 408 bp, Homo sapiens
  chr5:2136910-2137318
  hypo
agaggtgactgggcccgtgtgtgtgcgtgggcagaagtgactgggcgtgcgtgtgtggacagaagtgaccgggcgcgcctgtgtgggcgggcagaggtgactgggccagcatgcgtgggtgggcagaggtgaccgggcatgcgtgcgtgggcgggcagaggtgaccgggcgtgcgtgggtggacagaggtgactaggcattgcttgcgtgggtgggcagaggtgaccgggcttgcgtgcgtgggtggacagaggtgaccaggcgtgcgtgcgtgggcagaggtgactgggcattgcgtgcgtgggtggacagacgtgactaggcgcgagtgcgtgggtggacagaagtgagtaggcgtgcatgcgtgggtggacagaagtgactaggcacgtgcgtgggtggacagaa

SEQ ID NO: 40449 - DNA, 37 bp, Homo sapiens
  chr5:2180638-2180675
  hypo
gctcgcgtcctctcacgagatacggggctgctctccc

SEQ ID NO: 40450 - DNA, 30 bp, Homo sapiens
  chr5:2199933-2199963
  hypo
ccctggtcagtcctgcgtggggtggccatg

SEQ ID NO: 40451 - DNA, 127 bp, Homo sapiens
  chr5:2261622-2261749
  hypo
ccacgaggccctggtcggacacaggctgcccgcagccccttcccacaggagcaccaccagtaaggcctttactgtccccttatcccttgctgtttccccaccgacaccctgacgctgagcagccgga

SEQ ID NO: 40452 - DNA, 30 bp, Homo sapiens
  chr5:2324383-2324413
  hypo
tgtgtgcatcaggaccgagagctggggtag

SEQ ID NO: 40453 - DNA, 68 bp, Homo sapiens; identical to SEQ ID NO: 14739
  chr5:2369614-2369682
  hypo

SEQ ID NO: 40454 - DNA, 164 bp, Homo sapiens
  chr5:2374826-2374990
  hypo
cctggcctccttttacgcggctcctgtgaaagcagagatgggggccagggctctatttggccttcgcaagctcaagaaagccacctatgggagcacgttgtttgtgtaaaccccctgctcatctctacagggctgccggcgaggggagccgctctctctgcagg

SEQ ID NO: 40455 - DNA, 30 bp, Homo sapiens
  chr5:2493697-2493727
  hypo
gggtatagatgtcagcgcctgactgtgcat

SEQ ID NO: 40456 - DNA, 184 bp, Homo sapiens
  chr5:2523567-2523751
  hypo
ggccacatgcgtgcccgaaagggaaagcataggctgtctccgcggcctcacttgtttctacttccctgacctgtttgtcccactgacttaccgcctctggaatgaacacccgacagcatggaagggagattcctgtccagtgcctgggctgtactctgcatgccgctctcggttccactttcag

SEQ ID NO: 40457 - DNA, 162 bp, Homo sapiens
  chr5:2541481-2541643
  hypo
gtgtgcctgtgtgcacgcatgcgtgtgcaggctctgctgtgtgtgtgtggtgtgtgcctgtgtgcacgcatgcatgtgcgggctctgctgtgcatgtctgtgtatcgtgtgactgcgtgcatgcttgcatgtgccgactctgatgtgcgtgtctatgtattg

SEQ ID NO: 40458 - DNA, 30 bp, Homo sapiens
  chr5:2547162-2547192
  hypo
tttaattagctctggcgtcctcttcataat

SEQ ID NO: 40459 - DNA, 30 bp, Homo sapiens
  chr5:2865625-2865655
  hypo
gttgctattggtgtacgccattttgtttgt

SEQ ID NO: 40460 - DNA, 50 bp, Homo sapiens
  chr5:2890843-2890893
  hypo
ctaccttacacaccacgcacaggccgcaaggccaccgggaaatgatgaaa

SEQ ID NO: 40461 - DNA, 30 bp, Homo sapiens
  chr5:3027341-3027371
  hypo
cacgtctcagtccaccggtgaggggcagtg

SEQ ID NO: 40462 - DNA, 86 bp, Homo sapiens
  chr5:3031843-3031929
  hypo
ctgccaggggttcagcggggaggcagtgagcaggccaagcaccgagggtttcgagggtggtgaaactgttccaagcgacaggtaat

SEQ ID NO: 40463 - DNA, 85 bp, Homo sapiens
  chr5:3031989-3032074
  hypo
ccgcatgtgcactgcggcctttgggtgacaatcacccgtcactgtggctcatcccttgtgaccaagctgccgcacagagcagggt

SEQ ID NO: 40464 - DNA, 134 bp, Homo sapiens
  chr5:3221047-3221181
  hypo
cctttccagcctgcccggcgctagggctccatggaaccccaagctctctggcttcagaactgctccaggcaaatgcgtggcatcattcataaggaggcagcgtcttgcggtgctgagaccgagcccctggctgc

SEQ ID NO: 40465 - DNA, 30 bp, Homo sapiens
  chr5:3269777-3269807
  hypo
aatgtggctgtgagacgtcagaagggcgtc

SEQ ID NO: 40466 - DNA, 275 bp, Homo sapiens; identical to SEQ ID NO: 5028
  chr5:3324844-3325119
  hypo

SEQ ID NO: 40467 - DNA, 30 bp, Homo sapiens
  chr5:3422389-3422419
  hypo
ccttacctggctgctcggtgccaagctgta

SEQ ID NO: 40468 - DNA, 75 bp, Homo sapiens
  chr5:3454354-3454429
  hypo
acgctcccgctagcacggcgggcgtcacccactaacacacgctcccgctagcacggtgggcgtcacccactaaca

SEQ ID NO: 40469 - DNA, 176 bp, Homo sapiens; identical to SEQ ID NO: 14743
  chr5:3674048-3674224
  hypo

SEQ ID NO: 40470 - DNA, 225 bp, Homo sapiens
  chr5:3740792-3741017
  hypo
ctccacaatcttcagcgccgcgtccctgcaggtccacatgtcccccgcgggccctcccctggtttccgatgcccatcacccaacctcttctgtgtcctcagcccggggtgggggtgcagcccctgcaggtgcctcagggtgtctgtgctcccagccctacccactgctcggtcaaaccttcacatcgccttctctcctgcgcgcagctggcggcttctatcttct

SEQ ID NO: 40471 - DNA, 30 bp, Homo sapiens
  chr5:3761119-3761149
  hypo
gagccagaacatgcccgctgaatgcggctc

SEQ ID NO: 40472 - DNA, 30 bp, Homo sapiens
  chr5:3761593-3761623
  hypo
tctccgtgggctttgcgtctctgtgtgggt

SEQ ID NO: 40473 - DNA, 64 bp, Homo sapiens
  chr5:3775375-3775439
  hypo
ggaaggtggccagctcgccatcccctcaggctgacctgccgacctctcccgtggcggttgcctg

SEQ ID NO: 40474 - DNA, 165 bp, Homo sapiens; identical to SEQ ID NO: 14745
  chr5:3806428-3806593
  hypo

SEQ ID NO: 40475 - DNA, 149 bp, Homo sapiens
  chr5:3856433-3856582
  hypo
ttctagaaaaggagccggggacttgcagaaaaggcgctcagggcatttcccctgggcaggagggagagaagcagagggcaggagtgaagtctccgccaacacatgctactgacaaagggtatgaagggcacctgcgcagcaaggaagcc

SEQ ID NO: 40476 - DNA, 165 bp, Homo sapiens
  chr5:3859680-3859845
  hypo
gaatggaagagtgatcgctgattgtttgggctcagagaggcctaccagcctgactgttggaaaagcacattagacagatgggatgtagcggctagaagagcaggtgccagacggaaaatccactcatgaagtcagagctacctgtggcaccggtaccctgttgga

SEQ ID NO: 40477 - DNA, 19 bp, Homo sapiens
  chr5:3945363-3945382
  hypo
taatcccagcagtttcgga

SEQ ID NO: 40478 - DNA, 186 bp, Homo sapiens
  chr5:4083874-4084060
  hypo
cctctcacgctttcccggggtagacaccttgaacgccaacaagcgattgtcacctggaggctgagtgtggcaccctgacaggctttttctggggtcctgaacacctggaaggcacaagtccctctgcagtggaggtgccattaggtgggtacagtgagagtcagggagaaacgccctgcaggctga

SEQ ID NO: 40479 - DNA, 217 bp, Homo sapiens
  chr5:4144299-4144516
  hypo
tcctctcaaagccgtgatattctatgcaagcaacattcatagaagcacagcttactacatgtgttctgtgtgccgtgctcttgcgtgcacctggaatgccaactgcacagtttactgtgtcctgtgtgccgtgctcttgtgtgcatgcagaatgctgaccgcacagttactaagtgttctgtgttccgtgctctcgtgtgcacgtggaatgtggacc

SEQ ID NO: 40480 - DNA, 34 bp, Homo sapiens
  chr5:4278472-4278506
  hypo
tttgaaaaggcaaatcggacgacattcagagaag

SEQ ID NO: 40481 - DNA, 31 bp, Homo sapiens
  chr5:4279105-4279136
  hypo
cgtgagccaccgcgcccggccacaaattctt

SEQ ID NO: 40482 - DNA, 33 bp, Homo sapiens
  chr5:4581296-4581329
  hypo
caggcacacacacagcgacgctcttggagagca

SEQ ID NO: 40483 - DNA, 35 bp, Homo sapiens
  chr5:4629575-4629610
  hypo
catcctttaaccctccgcgccgtacaccacccttt

SEQ ID NO: 40484 - DNA, 30 bp, Homo sapiens
  chr5:4630470-4630500
  hypo
gtcctgacaccttgacgagttctgctctgt

SEQ ID NO: 40485 - DNA, 30 bp, Homo sapiens
  chr5:4866871-4866901
  hypo
tcattgtgacgaggtcgaggctgtaagggg

SEQ ID NO: 40486 - DNA, 30 bp, Homo sapiens
  chr5:4867541-4867571
  hypo
acggctcctggctggcgatggggctgtcag

SEQ ID NO: 40487 - DNA, 178 bp, Homo sapiens
  chr5:5296474-5296652
  hypo
gaggaatcggttgaccggactccccgccctccccagtttttttattgccacatcctagttagtcctcataatgggtaaaaaataaaattagtacaactttaatacaagaaattgacgccacaaaggggaagggagggtagctcagaactttcttggccagtctcggggattttctgaa

SEQ ID NO: 40488 - DNA, 30 bp, Homo sapiens
  chr5:5303702-5303732
  hypo
aaggggtggaggaagcgggcagtggcctgt

SEQ ID NO: 40489 - DNA, 30 bp, Homo sapiens
  chr5:5571405-5571435
  hypo
aagcaggatgtgtgccggctcttcccggtg

SEQ ID NO: 40490 - DNA, 30 bp, Homo sapiens
  chr5:5577581-5577611
  hypo
gagtgtgtttgcacgcggtattgatgaagg

SEQ ID NO: 40491 - DNA, 30 bp, Homo sapiens
  chr5:5652506-5652536
  hypo
tcccatcagctcagccgcagccttaggttc

SEQ ID NO: 40492 - DNA, 211 bp, Homo sapiens
  chr5:5719870-5720081
  hypo
tcagccatcttcatccgaagggcctggtatctctttactctgactgtgataacaaagtgccacaggccgggtgacctcaacaatcaaaatctgtttttgcacatttctggaggctggaagttggagattaaggtgttggcaggtgcgatttcctctgagacctgtctcctggccttgcagatggcagcctcctcgccgtgtcctcccacgg

SEQ ID NO: 40493 - DNA, 30 bp, Homo sapiens
  chr5:6219037-6219067
  hypo
caggcaagctccacacgtcccactgccgct

SEQ ID NO: 40494 - DNA, 30 bp, Homo sapiens
  chr5:6478603-6478633
  hypo
ctttttggtcaaagtcgtgaagctcctgct

SEQ ID NO: 40495 - DNA, 15 bp, Homo sapiens
  chr5:9011746-9011761
  hypo
cgatagggggagact

SEQ ID NO: 40496 - DNA, 86 bp, Homo sapiens
  chr5:10248731-10248817
  hypo
cgcactgtaaactgaactcctgggctccacccatcctcctgcctcagccccagagtagatgggaacacagtcgccaagtctgttct

SEQ ID NO: 40497 - DNA, 167 bp, Homo sapiens; identical to SEQ ID NO: 14749
  chr5:10267279-10267446
  hypo

SEQ ID NO: 40498 - DNA, 30 bp, Homo sapiens
  chr5:10269033-10269063
  hypo
ccaggcatgggctgtcgcatacacagtggc

SEQ ID NO: 40499 - DNA, 30 bp, Homo sapiens
  chr5:10652405-10652435
  hypo
agcgccctaaagctccgcaggtaactgcac

SEQ ID NO: 40500 - DNA, 45 bp, Homo sapiens
  chr5:10675402-10675447
  hypo
gaacataagcctttacggtgacactgcctgcgtgcaagtcccaag

SEQ ID NO: 40501 - DNA, 30 bp, Homo sapiens
  chr5:10864262-10864292
  hypo
gtgtgggaggtatttcgaatttcactttac

SEQ ID NO: 40502 - DNA, 30 bp, Homo sapiens
  chr5:14501805-14501835
  hypo
aggtgaggaagcccacgtgaagatagggat

SEQ ID NO: 40503 - DNA, 32 bp, Homo sapiens
  chr5:14732032-14732064
  hypo
aggcccagggagctgcgcgagtgtcacgtgaa

SEQ ID NO: 40504 - DNA, 30 bp, Homo sapiens
  chr5:14756455-14756485
  hypo
tattacagtcattaccggtgctcactgact

SEQ ID NO: 40505 - DNA, 83 bp, Homo sapiens
  chr5:14764724-14764807
  hypo
gggtggttttttacacgacaataaattgtgagactatactggcactgtctgttcgctcccagcaccctcgttggtttaaatta

SEQ ID NO: 40506 - DNA, 19 bp, Homo sapiens
  chr5:14774559-14774578
  hypo
tcctcaagacacagtcgcg

SEQ ID NO: 40507 - DNA, 19 bp, Homo sapiens
  chr5:14774698-14774717
  hypo
acaacgcctggctaatcat

SEQ ID NO: 40508 - DNA, 27 bp, Homo sapiens
  chr5:15503239-15503266
  hypo
atagctgaggtcgggcgcggtggccca

SEQ ID NO: 40509 - DNA, 79 bp, Homo sapiens
  chr5:16032731-16032810
  hypo
actttcaaaaatagacgtcgatcacagtttcaatatcctgatattcatgtagcatctttattaccgcactctaaaccac

SEQ ID NO: 40510 - DNA, 78 bp, Homo sapiens; identical to SEQ ID NO: 14754
  chr5:16436327-16436405
  hypo

SEQ ID NO: 40511 - DNA, 30 bp, Homo sapiens
  chr5:16744496-16744526
  hypo
gtgatgaggcctgggcgaaacctgggtgca

SEQ ID NO: 40512 - DNA, 182 bp, Homo sapiens
  chr5:16809241-16809423
  hypo
atcatcttttggctacgagtcttgatttcatgtggaaaaaaaaaaaagccaaaaaaacccagaaagtcctgactgtgttcatctgccccaagtgtgttcaaactgcactgcgttcatctgtcccaagggcaccccaatgccaaggcagtgctaaccaaccaaccacgcggccttcaggccac

SEQ ID NO: 40513 - DNA, 141 bp, Homo sapiens
  chr5:17203036-17203177
  hypo
ccgcgcccggctgggagttcttttttttttactgttggtgatgacaggactgtgaagcagtgggaattggagggctcaggctatggagaaggggaagtccttttgcatatggtattaagaaggcggcggacactgggactg

SEQ ID NO: 40514 - DNA, 30 bp, Homo sapiens
  chr5:17327404-17327434
  hypo
aggtgtcagcggaggcggggggggctgggg

SEQ ID NO: 40515 - DNA, 30 bp, Homo sapiens
  chr5:17492138-17492168
  hypo
gccaggagtctccctcgcaggcagtctgtt

SEQ ID NO: 40516 - DNA, 68 bp, Homo sapiens
  chr5:17502391-17502459
  hypo
gtgcccttttgctggcggctttagtggccagggtcttcgtggcgcctgccaggcggtggctttgctgg

SEQ ID NO: 40517 - DNA, 30 bp, Homo sapiens
  chr5:17512058-17512088
  hypo
ctgttctcctgaagtcgccagtggccgcac

SEQ ID NO: 40518 - DNA, 30 bp, Homo sapiens
  chr5:30694338-30694368
  hypo
gtataatttttataacgttgccctctaatt

SEQ ID NO: 40519 - DNA, 147 bp, Homo sapiens
  chr5:31111601-31111748
  hypo
atatgatgtcatatgcgctactaccgacagattggttagggagagcctctctgcaaatgtgacgatgtaatcaacaggtatgtgacagtggagggtgggcacggagtgaatggaggaatgagcagtgcccaccgaggaacaggcctg

SEQ ID NO: 40520 - DNA, 105 bp, Homo sapiens
  chr5:31572171-31572276
  hypo
cacagagcatgtgaccgaaatgagcaaacaggaagaagagggtgtgaaaaaatgcaaagtatgaaagagttaactatgccgggcgcggtggctcacgcctgtaat

SEQ ID NO: 40521 - DNA, 87 bp, Homo sapiens
  chr5:31691593-31691680
  hypo
ttattctcttatctggcgccacctgcttttattctcttatctggcgccacctgcttttattctcttatctggcgccacctgctttta

SEQ ID NO: 40522 - DNA, 30 bp, Homo sapiens
  chr5:31889103-31889133
  hypo
cttgatgctcctccccgagccccctcccct

SEQ ID NO: 40523 - DNA, 30 bp, Homo sapiens
  chr5:31982994-31983024
  hypo
caactcctgatcctacggtacttaaattag

SEQ ID NO: 40524 - DNA, 21 bp, Homo sapiens
  chr5:32526565-32526586
  hypo
cttctccacgccgggcgcggt

SEQ ID NO: 40525 - DNA, 79 bp, Homo sapiens
  chr5:32750220-32750299
  hypo
gtcagttaccttttccgaacttccaacattttgttgatatttctcactctgtcacccaggctggagtgcggtggcgcga

SEQ ID NO: 40526 - DNA, 30 bp, Homo sapiens
  chr5:32855659-32855689
  hypo
ctttaagtatgttttcgttattgtgagcaa

SEQ ID NO: 40527 - DNA, 59 bp, Homo sapiens
  chr5:33162543-33162602
  hypo
aataatgagctggttcgtaccaagaccctggtgaagaattgcatcgtgctcatcgacag

SEQ ID NO: 40528 - DNA, 25 bp, Homo sapiens
  chr5:33234426-33234451
  hypo
tgagctgacacgcctggctgaattt

SEQ ID NO: 40529 - DNA, 38 bp, Homo sapiens
  chr5:33298113-33298151
  hypo
accctgctggcgcaccctgctggcgcaccctgctggcg

SEQ ID NO: 40530 - DNA, 30 bp, Homo sapiens
  chr5:33443001-33443031
  hypo
caaacccagtatccccgtttttttccttcc

SEQ ID NO: 40531 - DNA, 197 bp, Homo sapiens
  chr5:33550087-33550284
  hypo
tgtccttgcctccaccgtcaccattcctcctgcagcaccatcacgtgcagccatcactgagagtcttctcagcacttgcccccgatagccactacacaggccctactcactcccttcctctctgaccccaccccttgtgcagcagcccaggttcaccagcaggctgctgatttcccttggaccgtgataaacactga

SEQ ID NO: 40532 - DNA, 190 bp, Homo sapiens
  chr5:33880065-33880255
  hypo
ccaaggccaaaaacacggactcctccataaccactttcgagactctgggattccttcccctgcagtcactcactccctaaacacacacctcaaaaaatctcaacagaattcctgagcattgtttgccctgcagttgctggtggggccatcactgttgctgcattttgagatatagcgtataatgatagaa

SEQ ID NO: 40533 - DNA, 105 bp, Homo sapiens
  chr5:34839939-34840044
  hypo
ttcgttttgtgcttccgaggtttctcctatcatctaacagcaacaactaaaacagacacatgaatttcattttattgttttattttattttgagacggagtctcg

SEQ ID NO: 40534 - DNA, 35 bp, Homo sapiens; identical to SEQ ID NO: 14761
  chr5:37255512-37255547
  hypo

SEQ ID NO: 40535 - DNA, 36 bp, Homo sapiens
  chr5:39343165-39343201
  hypo
tgaacaggaacagctcgtttacagctcccagcgtga

SEQ ID NO: 40536 - DNA, 23 bp, Homo sapiens
  chr5:40190552-40190575
  hypo
agccgagacggcaccagtatact

SEQ ID NO: 40537 - DNA, 30 bp, Homo sapiens
  chr5:40861757-40861787
  hypo
agagagaattcttggcggggcgcggtggct

SEQ ID NO: 40538 - DNA, 19 bp, Homo sapiens
  chr5:41777231-41777250
  hypo
aaaaggggccgggtgcggt

SEQ ID NO: 40539 - DNA, 25 bp, Homo sapiens
  chr5:43105351-43105376
  hypo
agcaagactccgtcccccccaaaaa

SEQ ID NO: 40540 - DNA, 17 bp, Homo sapiens
  chr5:43402630-43402647
  hypo
aaaattggtgtgtgccg

SEQ ID NO: 40541 - DNA, 106 bp, Homo sapiens
  chr5:44492896-44493002
  hypo
ggcagtgggaatgaacgagagctgtaatacttcctgggttctcagatcttgggactccccaagcagaagctgtaacacctcttggggtctgcggttgctggtgtct

SEQ ID NO: 40542 - DNA, 43 bp, Homo sapiens
  chr5:44637083-44637126
  hypo
aaaaaaaaaaaaaaaaatgggcaattatcgtaaaaggagttca

SEQ ID NO: 40543 - DNA, 21 bp, Homo sapiens
  chr5:44939696-44939717
  hypo
gaaggtggtgctgggcgcggt

SEQ ID NO: 40544 - DNA, 33 bp, Homo sapiens
  chr5:45225683-45225716
  hypo
tggactggccgaggacggagctggctccctctg

SEQ ID NO: 40545 - DNA, 39 bp, Homo sapiens
  chr5:52888052-52888091
  hypo
attacaggtgtgagccgctgcgcccggcattgttgagtt

SEQ ID NO: 40546 - DNA, 30 bp, Homo sapiens
  chr5:55309328-55309358
  hypo
ggttgttgttagcagcggcaacaactggta

SEQ ID NO: 40547 - DNA, 21 bp, Homo sapiens
  chr5:63373765-63373786
  hypo
taatttctggccgggcgagtt

SEQ ID NO: 40548 - DNA, 37 bp, Homo sapiens
  chr5:64860574-64860611
  hypo
cattctaaaatcactcgagaatcggtcttgtactttt

SEQ ID NO: 40549 - DNA, 32 bp, Homo sapiens
  chr5:65181746-65181778
  hypo
gcgtgagccaccgcgcccggttgcaagttatt

SEQ ID NO: 40550 - DNA, 33 bp, Homo sapiens
  chr5:67573348-67573381
  hypo
gactcactttcggaacgtcggcctacctagtgg

SEQ ID NO: 40551 - DNA, 226 bp, Homo sapiens
  chr5:67840329-67840555
  hypo
cttgctacagcttaacgtttcagcacattttgccttgcctaatgatggagttgcggtttgccaggaaggtacttttaacgctttcttcctagaactgggtagaactatccccatgcaaacctcagctagttcaaacaaagcttctgtaatggcgaagggagagaaaagctgctataaatacttttataggctgcataggtgatttacaacccgctttattaatcct

SEQ ID NO: 40552 - DNA, 17 bp, Homo sapiens
  chr5:68391002-68391019
  hypo
gtaatagcattataacg

SEQ ID NO: 40553 - DNA, 17 bp, Homo sapiens
  chr5:68391319-68391336
  hypo
cccgcccaacataagca

SEQ ID NO: 40554 - DNA, 35 bp, Homo sapiens
  chr5:68481446-68481481
  hypo
ggattaaaggtgtgagtcaccgcacctggccagtc

SEQ ID NO: 40555 - DNA, 30 bp, Homo sapiens
  chr5:72175493-72175523
  hypo
cttttatatataaaacgcagctgtttttat

SEQ ID NO: 40556 - DNA, 240 bp, Homo sapiens
  chr5:72236805-72237045
  hypo
ccatctcaaacaaacaaaacaaacttgaagacgtatttttcttcctgttgacgaaacatgagacagcagggcctagagagaagtgaaaagaatgttaaaattagcgaaagtgaacatgatgtacaagcagcacaaaggaaaacagacattgttgaaaacacagtgatgtacacagagggcaggatttttcttttttaaaaagaaaaacattttttaagtgacagaaactttttttttgtt

SEQ ID NO: 40557 - DNA, 21 bp, Homo sapiens
  chr5:74536034-74536055
  hypo
aatttttttttgagacggagt

SEQ ID NO: 40558 - DNA, 30 bp, Homo sapiens
  chr5:75819580-75819610
  hypo
ctcctgattaataatcgcatttcttttaat

SEQ ID NO: 40559 - DNA, 89 bp, Homo sapiens
  chr5:75963986-75964075
  hypo
tgtgagccaccatgcccaagctttgccagtgtctttggacaccagattctactggctacccgccctgttttctgcgtctctacaataaa

SEQ ID NO: 40560 - DNA, 30 bp, Homo sapiens
  chr5:75969716-75969746
  hypo
gttttttcctcactccgccttttttccatt

SEQ ID NO: 40561 - DNA, 30 bp, Homo sapiens
  chr5:76327167-76327197
  hypo
tgtgaacttatataccgagtctcagttccc

SEQ ID NO: 40562 - DNA, 17 bp, Homo sapiens
  chr5:77047294-77047311
  hypo
gccggccagcctgacca

SEQ ID NO: 40563 - DNA, 20 bp, Homo sapiens
  chr5:78469259-78469279
  hypo
agtatttttctatttcgaaa

SEQ ID NO: 40564 - DNA, 115 bp, Homo sapiens
  chr5:78552615-78552730
  hypo
tgacaggttctccatcgcctagggttgcgatcatagttcactgcagtctcaagtcttgagctcaattcatcctcccacctcagcctccctagtaactagccgatattacaggcat

SEQ ID NO: 40565 - DNA, 35 bp, Homo sapiens
  chr5:78881941-78881976
  hypo
atgatctaattcggccgggtgcggtggctcatgcc

SEQ ID NO: 40566 - DNA, 95 bp, Homo sapiens
  chr5:78985096-78985191
  hypo
cttttgagcagggcacgcctagctttgtttctcattgggtcattttactagcaatgacagcctgagctgctggagctcttcggagtctcagtttc

SEQ ID NO: 40567 - DNA, 16 bp, Homo sapiens
  chr5:79783240-79783256
  hypo
acagtctagctctatc

SEQ ID NO: 40568 - DNA, 287 bp, Homo sapiens
  chr5:79947497-79947784
  hypo
cgttaaagccactttcgtagtttattttgtatcaactggagttttttacaactcaggtgaattttagctttattgaggggaattgatctaaaacactctttacgccggtttctattgacttgggttaatcgtgtgaccgcggtggctggcacgaacttgacgaaccctagggttagtatagcttagttaaactttcgtttattgctaaaggtttatcactgctgtctcccgtgggggtgtggctaggctaagcgttttgagctgcgttgctgcgtgcttgatacttg

SEQ ID NO: 40569 - DNA, 32 bp, Homo sapiens
  chr5:81266658-81266690
  hypo
ttttcatctgtgaaatacgtttttaaggtaaa

SEQ ID NO: 40570 - DNA, 16 bp, Homo sapiens
  chr5:81575049-81575065
  hypo
gcgcctggccatttaa

SEQ ID NO: 40571 - DNA, 23 bp, Homo sapiens
  chr5:88304080-88304103
  hypo
cgagagtccgtctcaaaaaaaaa

SEQ ID NO: 40572 - DNA, 19 bp, Homo sapiens
  chr5:88371483-88371502
  hypo
cggatctcctgaggtcggg

SEQ ID NO: 40573 - DNA, 90 bp, Homo sapiens
  chr5:94982142-94982232
  hypo
tacatgggttaccagcatcgcgacgaccttctgcaaatatttttatagggtaaataactgaatgaagtcgctgggcgcatctaaaatttg

SEQ ID NO: 40574 - DNA, 21 bp, Homo sapiens
  chr5:95117541-95117562
  hypo
agactccgtctcaaaaaaaga

SEQ ID NO: 40575 - DNA, 30 bp, Homo sapiens; identical to SEQ ID NO: 14774
  chr5:98201074-98201104
  hypo

SEQ ID NO: 40576 - DNA, 23 bp, Homo sapiens
  chr5:102048048-102048071
  hypo
aagtgtggccgggcgcggtggct

SEQ ID NO: 40577 - DNA, 17 bp, Homo sapiens
  chr5:111306228-111306245
  hypo
gaagtcttactgggtcg

SEQ ID NO: 40578 - DNA, 128 bp, Homo sapiens
  chr5:111813766-111813894
  hypo
aattttgattgtcatcgatagaaactgcgaaacacccacatttgatgcccgtggccccgtgctgtaattttaatagtgaaatgtagcaatgtaaacctcgattgaaattttctcgggtggcatttact

SEQ ID NO: 40579 - DNA, 79 bp, Homo sapiens
  chr5:111875281-111875360
  hypo
cacagtgctcaagctctgctaagggacagccttcctcctcaaggggttccctgactccccgtgccgcctgactgagaca

SEQ ID NO: 40580 - DNA, 22 bp, Homo sapiens
  chr5:111987796-111987818
  hypo
ccgcgcccggcctccaggtcac

SEQ ID NO: 40581 - DNA, 206 bp, Homo sapiens
  chr5:112198294-112198500
  hypo
tggcaccttgatcctcgagggaatggggggtgtcatcctggtcgggccacgtaatcttgttagagccgcagggggttctcttcactgcatttatttagggcttgagaacacagccaagaattggggtgcgttcctcagtgttggtgaaaccagaaaggcattaattcatagctgaagggatatttttttaacgtctcttaatgagc

SEQ ID NO: 40582 - DNA, 32 bp, Homo sapiens
  chr5:115176272-115176304
  hypo
gagtgagccaccgcgcccggccagagaccact

SEQ ID NO: 40583 - DNA, 39 bp, Homo sapiens
  chr5:117258279-117258318
  hypo
attacaggcgtgagccaccgcgcccggccaaaatatccc

SEQ ID NO: 40584 - DNA, 30 bp, Homo sapiens; identical to SEQ ID NO: 14777
  chr5:126200056-126200086
  hypo

SEQ ID NO: 40585 - DNA, 30 bp, Homo sapiens
  chr5:126409452-126409482
  hypo
ccgagccattttaaccgctctgcatgcatc

SEQ ID NO: 40586 - DNA, 30 bp, Homo sapiens
  chr5:126851264-126851294
  hypo
gctcaaaaccctccacgtgcttctcatttc

SEQ ID NO: 40587 - DNA, 92 bp, Homo sapiens
  chr5:131305994-131306086
  hypo
gcttcatgatcagggcgatggagggagggaggtgctctggaggtagataactccaggtgaaactgaacacagacaacaagcatggccacatt

SEQ ID NO: 40588 - DNA, 193 bp, Homo sapiens
  chr5:131610019-131610212
  hypo
tgcccaccctgcctccgctgacttggtcccagccccacccagtcataggtgggagaggagaggatgactggcacccaggaaagcagggaagcattattaagcacaggagtgggtggaaaaataccgggagccatgggccctggcccccacctctcactcccactcacccgcagaaactcgactctcccactgg

SEQ ID NO: 40589 - DNA, 30 bp, Homo sapiens
  chr5:131787174-131787204
  hypo
atgattggcacctcccgggagagctccagg

SEQ ID NO: 40590 - DNA, 83 bp, Homo sapiens
  chr5:132083881-132083964
  hypo
cgctgcgccggggggcgcttactcccagcgggcatgcagaggaagggacttctcactgccccaccccccgcaccttaagcagg

SEQ ID NO: 40591 - DNA, 30 bp, Homo sapiens
  chr5:132201467-132201497
  hypo
caagacacctcagggcgagctgtacattga

SEQ ID NO: 40592 - DNA, 24 bp, Homo sapiens
  chr5:133820020-133820044
  hypo
caacgcgcccggcccgtgttttgt

SEQ ID NO: 40593 - DNA, 46 bp, Homo sapiens
  chr5:134242196-134242242
  hypo
ggaagataggcactccgccgcttcttgtccacgaaggggagaacac

SEQ ID NO: 40594 - DNA, 30 bp, Homo sapiens
  chr5:134583042-134583072
  hypo
agagcaaatgccttacgtttagcggatgcg

SEQ ID NO: 40595 - DNA, 33 bp, Homo sapiens
  chr5:137548023-137548056
  hypo
tttgagacagtgtcccgctctgccctcgggctg

SEQ ID NO: 40596 - DNA, 18 bp, Homo sapiens
  chr5:137769720-137769738
  hypo
gcccgtccaacattggtg

SEQ ID NO: 40597 - DNA, 30 bp, Homo sapiens
  chr5:138273660-138273690
  hypo
gagaaggagctgccacgtgctgggcacctc

SEQ ID NO: 40598 - DNA, 105 bp, Homo sapiens
  chr5:138676299-138676404
  hypo
cacccatttcctagtcggtcatttgccctctccaaagggaagaaattagtttgtgtccctttttcaaagatagtatctacacatttgaacatccagatttgtaaa

SEQ ID NO: 40599 - DNA, 91 bp, Homo sapiens
  chr5:139556302-139556393
  hypo
gtggggcattggattcgctgaaaggagtcccatactatttgttgattgtagatcaaagatctctagacctggcctggtgcggtggctcaca

SEQ ID NO: 40600 - DNA, 29 bp, Homo sapiens
  chr5:139779106-139779135
  hypo
tgagccactgcgcccggccattttttttt

SEQ ID NO: 40601 - DNA, 23 bp, Homo sapiens
  chr5:139779848-139779871
  hypo
acggcgcccgctatagaatctga

SEQ ID NO: 40602 - DNA, 95 bp, Homo sapiens
  chr5:142070580-142070675
  hypo
tgcagcctgaccacccgttctaaatcagccccttatcactgtctttttacatctcccactttctttttcctcatactacttactactttctcaaa

SEQ ID NO: 40603 - DNA, 158 bp, Homo sapiens
  chr5:142625575-142625733
  hypo
ttcaggggcttagaccgccacttggaatgcgtgcattctggcaggtgcggtgcatgcaggggtcagacccctatggtttgatgagataagagcctcctgcacagaatctcattttttctccatctgcaccgccatttgggcctcgggcctcatgactc

SEQ ID NO: 40604 - DNA, 30 bp, Homo sapiens
  chr5:142689842-142689872
  hypo
ctctgtctttgtttccggtggaatataacc

SEQ ID NO: 40605 - DNA, 21 bp, Homo sapiens
  chr5:147003406-147003427
  hypo
gttttgtttttgaaacggaat

SEQ ID NO: 40606 - DNA, 149 bp, Homo sapiens
  chr5:149014648-149014797
  hypo
aatggacacccttcacgcctcagggagctggcctgagctgctgggggatacagaaagaaatcagacagatgaggcccggtcttccagatcccagtctctaaggcaggcagatgaggcacccatcaattacgtgccgtgtaagtgtcagg

SEQ ID NO: 40607 - DNA, 30 bp, Homo sapiens
  chr5:149624264-149624294
  hypo
gctgtccatcctccacgagctttctgggtg

SEQ ID NO: 40608 - DNA, 30 bp, Homo sapiens
  chr5:150901687-150901717
  hypo
cagtgctcttgcgcccgactgaggctgggc

SEQ ID NO: 40609 - DNA, 144 bp, Homo sapiens
  chr5:150911238-150911382
  hypo
cagctgcagcacctccgtgccaggtggggcgtcctcgggcacctgcacgctgtgctcggtgttcaggaacacgggcaggtagtcttctaggcccaccaccgagactgtgacggtgcccagcgtggacagcggtattggggtgcc

SEQ ID NO: 40610 - DNA, 30 bp, Homo sapiens; identical to SEQ ID NO: 14784
  chr5:151383730-151383760
  hypo

SEQ ID NO: 40611 - DNA, 21 bp, Homo sapiens
  chr5:153118296-153118317
  hypo
ttggagaaggcatttcgctct

SEQ ID NO: 40612 - DNA, 78 bp, Homo sapiens
  chr5:153785990-153786068
  hypo
tgcctgaatcaggtgcggccttttattatggtgactaacaaccctcaattacttgcagaccacatttaaaatatttgt

SEQ ID NO: 40613 - DNA, 254 bp, Homo sapiens
  chr5:154209733-154209987
  hypo
ttgtgtaggaaaaggcgagccagactcagggaacagtgggacccacttcccggcgctgtgcaagtcagagttccttgtaagcagggtctgggcctcacttatcatggatttgccctggtgcctttcactattggtcgaattgagtatttcggaaggagaacttgtttaaaagacagccaccgcccacacattcagaatccatactatccgtctattacagtggagttatccattgttttcgcagctgtctccct

SEQ ID NO: 40614 - DNA, 95 bp, Homo sapiens
  chr5:154318088-154318183
  hypo
ccaacgttttttgagcgctatgtgccagggcactttgctagttgtggaggtgttttaaagatatgcacaagaggccgggtgcggtggctcacgcc

SEQ ID NO: 40615 - DNA, 172 bp, Homo sapiens
  chr5:156874508-156874680
  hypo
tatccaggccaggcccgcaaaccagaatttccagtgtgaccgtgttggcagagagttaatgagcagccaaggaagctgtggctgttgctgttgtagacttgccccagagggaaggacagaagaacgccaggtccttccttagcctctctgcttggaacgaggcaggtgggaa

SEQ ID NO: 40616 - DNA, 30 bp, Homo sapiens; identical to SEQ ID NO: 14788
  chr5:157078407-157078437
  hypo

SEQ ID NO: 40617 - DNA, 39 bp, Homo sapiens; identical to SEQ ID NO: 14789
  chr5:158612937-158612976
  hypo

SEQ ID NO: 40618 - DNA, 28 bp, Homo sapiens
  chr5:159672080-159672108
  hypo
ggtaggggctgggtgcggtggctcacgc

SEQ ID NO: 40619 - DNA, 30 bp, Homo sapiens
  chr5:159776532-159776562
  hypo
atgggcagccgctcccgtgggtagctcttg

SEQ ID NO: 40620 - DNA, 17 bp, Homo sapiens
  chr5:160498400-160498417
  hypo
agtgccaagcatgagcg

SEQ ID NO: 40621 - DNA, 18 bp, Homo sapiens
  chr5:166363611-166363629
  hypo
gcaagcagagggagccgg

SEQ ID NO: 40622 - DNA, 146 bp, Homo sapiens
  chr5:166461205-166461351
  hypo
gaggcatgatagattcgcttatacatgttagaatgagatgataaactaattcattgtcctgcattggtatcccaatattgtactccttccaatggtcagtaacaaaagatagctaagagaaaaataggtgtacatgtgaaattatt

SEQ ID NO: 40623 - DNA, 38 bp, Homo sapiens
  chr5:166865441-166865479
  hypo
gctggagtgcagtggcgccatctcggctcactgcaagc

SEQ ID NO: 40624 - DNA, 141 bp, Homo sapiens; identical to SEQ ID NO: 14792
  chr5:168192180-168192321
  hypo

SEQ ID NO: 40625 - DNA, 30 bp, Homo sapiens
  chr5:168231749-168231779
  hypo
tgaagaaagaagaagcgaagtctccactcc

SEQ ID NO: 40626 - DNA, 181 bp, Homo sapiens
  chr5:168233348-168233529
  hypo
tccagcagccccacacgctgatggcctagtgggtgatgggctgggacagggagctgaattctccggcgacagttgttgggggtgtcagacaggtgcacttacatttcgacgatgccctccggcaagttggcaggaatctccatcaagccctttcctcgacagtccacgatgttattgctgc

SEQ ID NO: 40627 - DNA, 30 bp, Homo sapiens
  chr5:168253336-168253366
  hypo
agacgctgattgctacgacagctacagttt

SEQ ID NO: 40628 - DNA, 30 bp, Homo sapiens; identical to SEQ ID NO: 14793
  chr5:168268106-168268136
  hypo

SEQ ID NO: 40629 - DNA, 23 bp, Homo sapiens
  chr5:168289195-168289218
  hypo
tggactttggggactcgggggaa

SEQ ID NO: 40630 - DNA, 33 bp, Homo sapiens
  chr5:168337451-168337484
  hypo
aaccatcacaattgccgccgggcgtggtggctc

SEQ ID NO: 40631 - DNA, 30 bp, Homo sapiens; identical to SEQ ID NO: 14795
  chr5:169157436-169157466
  hypo

SEQ ID NO: 40632 - DNA, 85 bp, Homo sapiens
  chr5:169532927-169533012
  hypo
ccaggcaggtggctccggccagcccagccccagcatgagctccttcgacctgccggcgccctccccacctcgctgcagcccccag

SEQ ID NO: 40633 - DNA, 143 bp, Homo sapiens
  chr5:169658356-169658499
  hypo
cactgcaactggttgcgagcgtatatacatgattaaaatatgccttattttcactgtctttatttttccaatgactttatgagttttgtttgtttgttttgggatggagtctcactctgtcacctggactagagtgcagtggt

SEQ ID NO: 40634 - DNA, 51 bp, Homo sapiens
  chr5:169660169-169660220
  hypo
gggccgagaaggggacggttggctgggtgggcctggcggctggtggctgtc

SEQ ID NO: 40635 - DNA, 30 bp, Homo sapiens
  chr5:169932029-169932059
  hypo
cacactcctcctaggcggctatgccaggtg

SEQ ID NO: 40636 - DNA, 41 bp, Homo sapiens
  chr5:170811632-170811673
  hypo
ggattacaggcgtgagtcaccacacccggccaggaacatgt

SEQ ID NO: 40637 - DNA, 71 bp, Homo sapiens
  chr5:170919575-170919646
  hypo
gttagtttcttcctgcgcctggccgggagaaatgccctatttgcaaggaggactggcggctctcacatgag

SEQ ID NO: 40638 - DNA, 66 bp, Homo sapiens
  chr5:171247586-171247652
  hypo
aatatcaagtgaacacgcaaccagaactgcccgtcatgatccatcaagtcacgaagttggacaggc

SEQ ID NO: 40639 - DNA, 39 bp, Homo sapiens
  chr5:171533619-171533658
  hypo
tcaccacttagagggcgtgagcagcgtgggagggtccga

SEQ ID NO: 40640 - DNA, 85 bp, Homo sapiens
  chr5:172235687-172235772
  hypo
agcccctaaattctttttttatttgatttttgttttgttttgttttcttttcttttcccagatggggtatcgctgtgttgtccag

SEQ ID NO: 40641 - DNA, 21 bp, Homo sapiens
  chr5:172384977-172384998
  hypo
tattagtaggccaggcgcagt

SEQ ID NO: 40642 - DNA, 81 bp, Homo sapiens
  chr5:172385298-172385379
  hypo
taaacgcaggtgtttaacaatgtcaccactacatgtcagggaacactgataaactaagagagagcacgggacctgcctggg

SEQ ID NO: 40643 - DNA, 196 bp, Homo sapiens
  chr5:172704334-172704530
  hypo
tcaatctctatctcacgtgagcactcgatgcctcctatttctgagccttttctggggctctgtagaacaatttgtgggccctgccacccaaccctgaagacgcttgtgtttgccttgctacttctccgctgagtcatttacatttttccagtgctttttatctttctatgttggaattaagcgttatagacgccac

SEQ ID NO: 40644 - DNA, 30 bp, Homo sapiens
  chr5:174110957-174110987
  hypo
ggctattataacagccgggcgcggtgactc

SEQ ID NO: 40645 - DNA, 30 bp, Homo sapiens
  chr5:175115079-175115109
  hypo
ttgcttccaaggtcacgtcaccttctgctc

SEQ ID NO: 40646 - DNA, 136 bp, Homo sapiens
  chr5:175605006-175605142
  hypo
atgaacccatcatgccgccaaaaccccctgagctctgcaagtgtgcctcacattaatgaccacgccagattccactgtaaaatgtagctattcctacgcggtgttaggtgaccactaagaccgtcctgtaatgaca

SEQ ID NO: 40647 - DNA, 30 bp, Homo sapiens; identical to SEQ ID NO: 14798
  chr5:175610717-175610747
  hypo

SEQ ID NO: 40648 - DNA, 17 bp, Homo sapiens
  chr5:175876289-175876306
  hypo
cccccaggccaggagcg

SEQ ID NO: 40649 - DNA, 17 bp, Homo sapiens
  chr5:175876606-175876623
  hypo
ttcgggagatcaaatgg

SEQ ID NO: 40650 - DNA, 19 bp, Homo sapiens
  chr5:175879322-175879341
  hypo
tgctcggattacaggcgtg

SEQ ID NO: 40651 - DNA, 30 bp, Homo sapiens; identical to SEQ ID NO: 14801
  chr5:175924856-175924886
  hypo

SEQ ID NO: 40652 - DNA, 20 bp, Homo sapiens
  chr5:175971447-175971467
  hypo
ctttcctttttttgacggag

SEQ ID NO: 40653 - DNA, 64 bp, Homo sapiens
  chr5:175971806-175971870
  hypo
tgtctgtaagagcaacgaagggactttgtaccctgcaaagtgcaacttccggggatgattggga

SEQ ID NO: 40654 - DNA, 30 bp, Homo sapiens; identical to SEQ ID NO: 14803
  chr5:175975036-175975066
  hypo

SEQ ID NO: 40655 - DNA, 32 bp, Homo sapiens
  chr5:175978988-175979020
  hypo
gcgtgagtcaccgcgcccggttaatagttccc

SEQ ID NO: 40656 - DNA, 106 bp, Homo sapiens
  chr5:176225880-176225986
  hypo
tctccttctaattaccggtttaattaaccttggcacacagtatgtaccagacccgagggacagagtcagaatggctgctctgggtgaacatcgcccatctgctctg

SEQ ID NO: 40657 - DNA, 30 bp, Homo sapiens
  chr5:176289703-176289733
  hypo
cgaggatgtgtacatcgtcaagaacaagcc

SEQ ID NO: 40658 - DNA, 30 bp, Homo sapiens
  chr5:176295217-176295247
  hypo
tggcatggagctcctcgggcaccaccaaga

SEQ ID NO: 40659 - DNA, 188 bp, Homo sapiens
  chr5:176315326-176315514
  hypo
caatacctggggtgccgctcacacactcggcctccggtggccacagcaacctggagtgtttgttgctcccggctgtgctggaggcaggagagaacagcggccagggcggcagcacagagctgggcagcccgcgtgcacacggccgcacagacgtgctgcacaagctcaacatccgaagccccagggct

SEQ ID NO: 40660 - DNA, 34 bp, Homo sapiens
  chr5:176558851-176558885
  hypo
gcggaatttttatggcggccggatccggctttct

SEQ ID NO: 40661 - DNA, 163 bp, Homo sapiens
  chr5:176795125-176795288
  hypo
gctgttcgcgttcatcgctccctcttcactagagctgggcgggactgcaaacgccgccttgcgccgagagtctcagggctccctcaactcctccgccagcctggaccttggcttcctagccttcgtcagcagcaaatctgaggtgagccgactgttggggaag

SEQ ID NO: 40662 - DNA, 99 bp, Homo sapiens
  chr5:177019952-177020051
  hypo
gtaaggatattaaaacgaacggcaaaacccttcagctctcaccttctgtcacttttcgttaaaaaactcatggcggggtgtggtggctcttgcctgtaa

SEQ ID NO: 40663 - DNA, 237 bp, Homo sapiens
  chr5:177031167-177031404
  hypo
cgcttgctccaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgtgcctgccccccagagccgccccctgagcactgggaagaagacgcatcctggggccc

SEQ ID NO: 40664 - DNA, 25 bp, Homo sapiens
  chr5:177513856-177513881
  hypo
tatttttttttgagacggagtctgt

SEQ ID NO: 40665 - DNA, 30 bp, Homo sapiens
  chr5:177673744-177673774
  hypo
ggcccagccacacagcgggaggcagcagag

SEQ ID NO: 40666 - DNA, 43 bp, Homo sapiens; identical to SEQ ID NO: 14809
  chr5:177713462-177713505
  hypo

SEQ ID NO: 40667 - DNA, 181 bp, Homo sapiens
  chr5:177851456-177851637
  hypo
ctctgctgctgcccccggacagacagtaaaatgtgcacatcagttggagagagaacacttcatgctcttctctggagctgaacaaagagggaggcagtgctagggccaggacaagacacaccggcaacgctcagaactggaatataagggcagttgtagtcattcgcggttctgcaggtca

SEQ ID NO: 40668 - DNA, 55 bp, Homo sapiens
  chr5:177890891-177890946
  hypo
agaaaccagcctgggcgtgcagagacctcaggctgcagaacgaacctcttgttgt

SEQ ID NO: 40669 - DNA, 30 bp, Homo sapiens; identical to SEQ ID NO: 14810
  chr5:177982679-177982709
  hypo

SEQ ID NO: 40670 - DNA, 139 bp, Homo sapiens
  chr5:177984059-177984198
  hypo
agtccaaggtgtctgcggggcgggctcctcagggagagtccctcccacacccctccatagctctggtggctgcaggcattttggtgtttcttggctggcacacgcagcacgccaatccccactccgctgtcacctagcc

SEQ ID NO: 40671 - DNA, 153 bp, Homo sapiens
  chr5:178112320-178112473
  hypo
aatcacaaacggtcccgagtctaagcagcttacgttagacaggttttatttctcttacctgctacttgtgagctgcagctccgttcctgtgtaacacacatgtcttctttaccccagtctgaggtattccagtacctgcgctgaatgagcaaa

SEQ ID NO: 40672 - DNA, 165 bp, Homo sapiens
  chr5:178288343-178288508
  hypo
gtcactaagagcaaacgtacacacgtgggaaaaatccctgcctcctccactcacccatgtctccgttcctgtccttcgcaggaatactttctcttttcacccctgagaatcctcataacaccaccccttccccaggcttctccaacgcatcgttgttagtttttt

SEQ ID NO: 40673 - DNA, 30 bp, Homo sapiens
  chr5:178373124-178373154
  hypo
gagaaagcctatcttcgccaccatatatgt

SEQ ID NO: 40674 - DNA, 53 bp, Homo sapiens
  chr5:178409990-178410043
  hypo
cgatgggcttggcctcgttgaaggtctcgggcacgccacgggccttgatggcg

SEQ ID NO: 40675 - DNA, 110 bp, Homo sapiens
  chr5:178411620-178411730
  hypo
aggagcacctcaggccgggacgtagagggcaccttctcaggatgtgcggcacacggagaccctgggcctgaccaggggacactcaggccctgttacgtggaggaagacgg

SEQ ID NO: 40676 - DNA, 143 bp, Homo sapiens
  chr5:178416053-178416196
  hypo
ggcaatggcgtacaccgcatcaatcacaaactgcaccttgccctcctgctcgtaggtggagtcccggccgatgcgttcctcgcctgtcctagggatgcccagagaaagtgtgcccggcccccatgcaccgaacccggcctccc

SEQ ID NO: 40677 - DNA, 99 bp, Homo sapiens
  chr5:178478886-178478985
  hypo
ccacttgaagatcttcaaagggagctgctccacaggcttgtgtgccgggaggaacaggggaccttgctttgcattgtgcatcgccgcgctactgtttta

SEQ ID NO: 40678 - DNA, 90 bp, Homo sapiens
  chr5:178481810-178481900
  hypo
cagtctccttcagtctagcagcccttcggccagattgcacaaagtcccttggtctttatctgtggtcttttgctccgcatcaccttgctt

SEQ ID NO: 40679 - DNA, 130 bp, Homo sapiens
  chr5:178561609-178561739
  hypo
ctgttcttgttttggcgtatttggtgtcgccatctctgagccagctgtatagcccagcctcccggccctgccgaagtcacaggagcaaatgcagagcagccctcgagcaccctcccggctccagctccag

SEQ ID NO: 40680 - DNA, 41 bp, Homo sapiens
  chr5:178565442-178565483
  hypo
ttggcacaaagcagacgcatcacggccgctgggttttctcc

SEQ ID NO: 40681 - DNA, 145 bp, Homo sapiens
  chr5:178576381-178576526
  hypo
ggctctgttgtgtaagccacccagtctgcggtatttctgttagagcagccgaagctgaggaagatggagtgtgagctgtcctggcaccgtggaaggctgcggccggggcagactctaagtcactggtggccgcaggaaccaggag

SEQ ID NO: 40682 - DNA, 210 bp, Homo sapiens
  chr5:178655698-178655908
  hypo
actaaccaaagccagcggacatccactgcctgcggagcatctggggaaggctcctgtggggctccagacccggggcggtgccttcaccacggcctcctcatccagcatccacaactctggagctaggaagcccggtgctccttcccagaggagggagccgaagctctgccagtctgcactgaagtctgtggtgtgcggtcacctgagaac

SEQ ID NO: 40683 - DNA, 78 bp, Homo sapiens
  chr5:178665413-178665491
  hypo
gtgctctgagtatgccggagggcagtgagtgctgcgggaaggggctggagggcacagggtctgcgagtgccagggcag

SEQ ID NO: 40684 - DNA, 30 bp, Homo sapiens
  chr5:178737203-178737233
  hypo
gtgggggcctgtggacggccctcctccccc

SEQ ID NO: 40685 - DNA, 49 bp, Homo sapiens
  chr5:178854790-178854839
  hypo
cacacaacaaaagctcgccatggagagggcgaggcgccaagagggaccc

SEQ ID NO: 40686 - DNA, 30 bp, Homo sapiens; identical to SEQ ID NO: 14816
  chr5:178878685-178878715
  hypo

SEQ ID NO: 40687 - DNA, 30 bp, Homo sapiens
  chr5:178882544-178882574
  hypo
tctgaagaagacttccgatattaggttgcc

SEQ ID NO: 40688 - DNA, 27 bp, Homo sapiens
  chr5:178969579-178969606
  hypo
agaatgggccaggtgcggtggctcacg

SEQ ID NO: 40689 - DNA, 35 bp, Homo sapiens
  chr5:178987430-178987465
  hypo
ttagatgaggctgggcgcggtggctcacgcctgta

SEQ ID NO: 40690 - DNA, 374 bp, Homo sapiens
  chr5:179213904-179214278
  hypo
ctgggcccaacgaaacgcaaatgatccctagcagctgacagcagtctgctgcaaacacagcaaagttgagtcccagttgcagctgcagtgaccaccagccagcctctgtcatggcccccgagtgctgggcccagcaaggcgggctcaagagcagtaagcagcagtggcaggggtggggcccagcgggatcccagcatcgtggctctggctcacccagacaaacccggatctgccacccaagtgcccaagtctccagcctgccagtgacagagaccagcgttggtctcctcaagggactgagtgaggagaccagtcaccacccggtgcaaactgagtcccttccacgcgggaaagggccacgagcaattcatgtt

SEQ ID NO: 40691 - DNA, 50 bp, Homo sapiens
  chr5:179401725-179401775
  hypo
ctggactgggaaatgcgagtgtcacgagatgccggcgagtggagacagaa

SEQ ID NO: 40692 - DNA, 230 bp, Homo sapiens
  chr5:179564509-179564739
  hypo
cccgagaggctgatgcgttgagggcatggcagggcagtgctggtacactctgagaccccctggcctgccctccgcctcaccttgtccagcaccggcttgtccagctgctgctgctcgatgcacaggtggcagacccgggccaggagctcccggggctcgatgaagaggcgagagctcagcaggaaggtgaagatgtaggctttctgggggacacacgagaaagagggcac

SEQ ID NO: 40693 - DNA, 30 bp, Homo sapiens
  chr5:180021394-180021424
  hypo
tggctctgggggccacggctggcgaagcct

SEQ ID NO: 40694 - DNA, 30 bp, Homo sapiens
  chr5:180028510-180028540
  hypo
aacacacacaaagaccggcatcagatttat

SEQ ID NO: 40695 - DNA, 47 bp, Homo sapiens
  chr5:180041104-180041151
  hypo
ccacacgtcactctgcgtggtgtacaccttgtcgaagatgctttcag

SEQ ID NO: 40696 - DNA, 30 bp, Homo sapiens
  chr5:180042128-180042158
  hypo
ccaatcggagcactgcggccccgctggtca

SEQ ID NO: 40697 - DNA, 81 bp, Homo sapiens
  chr5:180057500-180057581
  hypo
tgggccccagctgcccgggaccctgctccagcctggcccgcctccaagtctcacctctcacgaacacgtaggagctggcgg

SEQ ID NO: 40698 - DNA, 88 bp, Homo sapiens
  chr5:180111814-180111902
  hypo
cctgagagctggcagcgctcgctcgatgaaggccgccgaatgacctggaagccaccctgatgggcagggccctcgaggttaatgagac

SEQ ID NO: 40699 - DNA, 30 bp, Homo sapiens
  chr5:180326126-180326156
  hypo
atgacagctgtgtctcgatggagtagactc

SEQ ID NO: 40700 - DNA, 90 bp, Homo sapiens
  chr5:180661538-180661628
  hypo
ggcaccaacggcaaacgctatcaggcccagagctccacagaacagacgctgctgagccccagtgagaaaccaaggcgctttggtgtgtac

SEQ ID NO: 40701 - DNA, 37 bp, Homo sapiens
  chr5:180708092-180708129
  hypo
tgcagggaggccagccgcggtgcgcaaactacagcct

SEQ ID NO: 40702 - DNA, 213 bp, Homo sapiens
  chr5:180708822-180709035
  hypo
ggagcagtaagagggcggcctgagcggtaggaggggggctggagcagtaagagggcggcctgagccgtaggagggtgggtggcagctggagatgctcttgaccggctagaggtctaggagaaggtggggaccgtgtccaacactcgtggctggagccttggccaccgcggttctcctggctgtggttggtggtggcgacggagactgcatctc

SEQ ID NO: 40703 - DNA, 30 bp, Homo sapiens
  chr6:304250-304280
  hypo
gcctgcagtgggcaccgtgtgtgcagtggc

SEQ ID NO: 40704 - DNA, 35 bp, Homo sapiens; identical to SEQ ID NO: 14822
  chr6:348724-348759
  hypo

SEQ ID NO: 40705 - DNA, 48 bp, Homo sapiens
  chr6:448927-448975
  hypo
tgtgttgctgaagcccggagtgcacgcccagcgcgtggtgctcgttaa

SEQ ID NO: 40706 - DNA, 17 bp, Homo sapiens
  chr6:736009-736026
  hypo
aacgtattagctggccg

SEQ ID NO: 40707 - DNA, 49 bp, Homo sapiens
  chr6:1004242-1004291
  hypo
ctgctcccggcaccccgcaagaccctcactcgcccgcctgctcacccac

SEQ ID NO: 40708 - DNA, 30 bp, Homo sapiens
  chr6:1637278-1637308
  hypo
tgcctcctagcccagcgccaggcatggctc

SEQ ID NO: 40709 - DNA, 30 bp, Homo sapiens
  chr6:1708613-1708643
  hypo
tagggggcttgcactcgaaaccacctctga

SEQ ID NO: 40710 - DNA, 175 bp, Homo sapiens
  chr6:1726684-1726859
  hypo
tcacgtgaactttgccggtctctttacatctgcccacttcattttcattctttccttcccacctgtaaggaagataaacactgaatcagctcctaattgcttgggaacatttggccatgctgtagcaccttgggatgccccagccctctccccgcaggagcgcttaagctcatta

SEQ ID NO: 40711 - DNA, 30 bp, Homo sapiens
  chr6:2244454-2244484
  hypo
ctggacacttcccagcggtttaacctcagg

SEQ ID NO: 40712 - DNA, 30 bp, Homo sapiens
  chr6:2684333-2684363
  hypo
acaattataacaacacgccagctgcactac

SEQ ID NO: 40713 - DNA, 72 bp, Homo sapiens
  chr6:2737187-2737259
  hypo
tgacatactgagttgcgttcctccaataaaatagtctctgccttctctcatgttctacgaagcctatgttgc

SEQ ID NO: 40714 - DNA, 30 bp, Homo sapiens
  chr6:2920829-2920859
  hypo
cttggcaagaggggacgtccattcagatgg

SEQ ID NO: 40715 - DNA, 30 bp, Homo sapiens
  chr6:2939086-2939116
  hypo
catctaatgggcatgcgcacaacttcagta

SEQ ID NO: 40716 - DNA, 52 bp, Homo sapiens; identical to SEQ ID NO: 14824
  chr6:3053334-3053386
  hypo

SEQ ID NO: 40717 - DNA, 32 bp, Homo sapiens
  chr6:3065559-3065591
  hypo
gggggtggctgggggtgcgggttgtgttcatt

SEQ ID NO: 40718 - DNA, 94 bp, Homo sapiens
  chr6:3104457-3104551
  hypo
gaaagagtattcaaacgaaaatgcagttgtgaagagaatgcagtctcttcaacttgattgtgtggcagtaccttcaagccggtcaaattcaggt

SEQ ID NO: 40719 - DNA, 35 bp, Homo sapiens
  chr6:3225962-3225997
  hypo
caccacatccaggaccgagtcgaccagctcggctc

SEQ ID NO: 40720 - DNA, 350 bp, Homo sapiens
  chr6:3285139-3285489
  hypo
gaatacaaatgtatccgtatagtgtccaacctacggccaacttcagctgcagttcttggagggcaacggggagaaagagaaaatggaaaccacaggtccgtgagtcttcgagaaaacacccatttagatgtaatatgagacgaggaagcacagcccacgcgcttgggactcacctgagtctgggtgctggctgtactttccaatcactggacccgcagacatgatcgcacccacacggacaagggccaagcaagcgagaagagagaagagagcacattaggtgtggagttagcctagcgtgttcccatgcgacttggttcaagcaaactcccttccgtgtctgggatggc

SEQ ID NO: 40721 - DNA, 30 bp, Homo sapiens
  chr6:3298330-3298360
  hypo
tcacacccttgatgtcgccctcagggttca

SEQ ID NO: 40722 - DNA, 158 bp, Homo sapiens
  chr6:3307337-3307495
  hypo
tgagcagacggcatacggcagcgctacgacatgcacaggtggcacttggttactgacaagctgagggtaggcacaaaacctgcactctcagtggcatgtccaggcaggtgtcctcactggctccgggtctcagttcatctcgacgctctgacccccca

SEQ ID NO: 40723 - DNA, 30 bp, Homo sapiens
  chr6:3333125-3333155
  hypo
tttatgtgactgtcccgtgatgtcgttcac

SEQ ID NO: 40724 - DNA, 197 bp, Homo sapiens
  chr6:3363773-3363970
  hypo
acaggctgctgcctgcggctggccctgggcccagtgtgggcacctggcagtcacgcccaaactaggatgtggcaccttcagcactaaggtgcctgcttgcaattctccagaggacaatgccaccccaaaaagggaaaagcacagcgttccagcctggtccttcctggcttcaaccgctgccacgttctggagagaaa

SEQ ID NO: 40725 - DNA, 43 bp, Homo sapiens
  chr6:4020326-4020369
  hypo
caccgcgcccggccctaacatttcaaaacgtttggaattcagg

SEQ ID NO: 40726 - DNA, 181 bp, Homo sapiens
  chr6:4804543-4804724
  hypo
tgttgaagtgcggggcgctgcctaagaacctagctcctaggctccccacatcactgcagggcaggcattagtcaccacttttagagctgaagagaatgagtctttggttaagtgttgaaatagaagtacagttcagatctcaaaataaagacctttgtcttacgaccgcatctccaggcca

SEQ ID NO: 40727 - DNA, 18 bp, Homo sapiens
  chr6:4836440-4836458
  hypo
attcggccatcttggctc

SEQ ID NO: 40728 - DNA, 33 bp, Homo sapiens
  chr6:4920708-4920741
  hypo
ctgctgccaagcctccggcgggtcatgcaaaca

SEQ ID NO: 40729 - DNA, 137 bp, Homo sapiens
  chr6:4951182-4951319
  hypo
cttgcaaaccctcatgaggagcctgtccccagccctgttttccagcctctgcctgcatgggaggggcagtgagtcagccacgtgtttgctttgccgcctctgcctgtgtgctctccaagctgcgggtttcacatgca

SEQ ID NO: 40730 - DNA, 61 bp, Homo sapiens
  chr6:5783294-5783355
  hypo
agcctccctgcctcacgcctcggggctgactggctctgacgtggttcggctgtgctgttcc

SEQ ID NO: 40731 - DNA, 181 bp, Homo sapiens
  chr6:5892797-5892978
  hypo
acttttgacactgagcgtgaaaggaactcattgaaccaaaatcttccaaaaagactggaacataagagagcggatgaagagcataatagaagagaagtgccagggaggaggattatcttaggcagagcacactgaggatggagagttaccagccctcccgagctgtcgttggcactgaacc

SEQ ID NO: 40732 - DNA, 30 bp, Homo sapiens; identical to SEQ ID NO: 14827
  chr6:6045657-6045687
  hypo

SEQ ID NO: 40733 - DNA, 30 bp, Homo sapiens
  chr6:6055082-6055112
  hypo
ctgaagtatttttcccgatggtatttagct

SEQ ID NO: 40734 - DNA, 37 bp, Homo sapiens; identical to SEQ ID NO: 14828
  chr6:6367079-6367116
  hypo

SEQ ID NO: 40735 - DNA, 130 bp, Homo sapiens
  chr6:6534781-6534911
  hypo
cccgtgggacccaggcgtccaggcaccgcgcccaggagagccagctctgagcatccccggggggccactccttctgccaggagcctgaaacccaaacgcgagagatcaggacccccgagtgcagcctctt

SEQ ID NO: 40736 - DNA, 198 bp, Homo sapiens
  chr6:6891420-6891618
  hypo
tgggggaggaggcagcggcacaacaggttcccacatcacctggagagcaggcgcattacttcctccagcagggctgggcttccaggtacaagagaccagaggtcactgtggtccaatgggctgagccgtagattaggaactcaattgttctttgtttaaatccagctgagacacccaaccttgcgtgaccttgagcca

SEQ ID NO: 40737 - DNA, 30 bp, Homo sapiens
  chr6:7132823-7132853
  hypo
ctgtttcacaggtggcgatattgacacaga

SEQ ID NO: 40738 - DNA, 95 bp, Homo sapiens
  chr6:7204204-7204299
  hypo
ggtggctgcagtgtccggtgcatttcaccaggagcatcctgcgagccctgggagctgcctggctgacggcattcccacagcgagcctacagactg

SEQ ID NO: 40739 - DNA, 27 bp, Homo sapiens
  chr6:7237769-7237796
  hypo
tttaagcgctcgcgttggggcttgcag

SEQ ID NO: 40740 - DNA, 22 bp, Homo sapiens
  chr6:7279451-7279473
  hypo
aatctatcttggggccgggtgc

SEQ ID NO: 40741 - DNA, 30 bp, Homo sapiens
  chr6:7911626-7911656
  hypo
gaaagaaagtcaaagcggcctcttctagac

SEQ ID NO: 40742 - DNA, 32 bp, Homo sapiens
  chr6:7911956-7911988
  hypo
cttggcaacaggggacgcgcccactgtctcac

SEQ ID NO: 40743 - DNA, 30 bp, Homo sapiens
  chr6:7920126-7920156
  hypo
ctctgagagctgtagcgaggaatgcgaagg

SEQ ID NO: 40744 - DNA, 38 bp, Homo sapiens
  chr6:10595814-10595852
  hypo
tgggttgctttcttttcttaagccgtaccatgttccag

SEQ ID NO: 40745 - DNA, 30 bp, Homo sapiens
  chr6:10776300-10776330
  hypo
gtaagccaccacacccgacccaacatgaca

SEQ ID NO: 40746 - DNA, 81 bp, Homo sapiens
  chr6:12287998-12288079
  hypo
gcgcgcgcaggcacacgtcttgcaaattcaggattcaaagagacaggggcaccattatatttggcacggtggggcccttcc

SEQ ID NO: 40747 - DNA, 349 bp, Homo sapiens
  chr6:12288379-12288728
  hypo
tggggagggcatgggcggtggtttccgggtaggggccttgagaacatgttggtcctgactgttgtcagtgtttggtcaaagttgccaaaaggttaaaaaaaaaaaagtagggggagtccctgccaagacatatttcccaggccacctttcttccgcgggagtgttgggggggaggcgctgcttggaacctgtgaatgtgacatcagctctcctctcctctcccaaggtcggctttggagagggaggtcagggcacccttgcctggcacaggcggcagcgctggcttccggctcagtgccgcctgtcctccgggagctgtggcctccctgggccccggggctaggctgag

SEQ ID NO: 40748 - DNA, 159 bp, Homo sapiens
  chr6:13288514-13288673
  hypo
catgatgccagggagcgtgactgtgggtgtgtctctgactgggacacccaggatagggtgtgcgatgaggccaggaccctcctaaaccctaacagcatcctaacgaggcccattgcagctttcgatttccttcataacagagctcgcaggccctcagtt

SEQ ID NO: 40749 - DNA, 30 bp, Homo sapiens; identical to SEQ ID NO: 14834
  chr6:13293172-13293202
  hypo

SEQ ID NO: 40750 - DNA, 156 bp, Homo sapiens
  chr6:14203256-14203412
  hypo
cccacagggacaggacgggatttcccaagaaacaagtctgtacctgccttgtttatgttttatacacaaaggatgctcagatacaaagaatatccttgttttagcctgtctgtccacatggcaaatcattacgcaccaactcgtcactctccgacg

SEQ ID NO: 40751 - DNA, 30 bp, Homo sapiens
  chr6:14999193-14999223
  hypo
cactggctgaagccacggtgtcagctgggg

SEQ ID NO: 40752 - DNA, 75 bp, Homo sapiens
  chr6:15073578-15073653
  hypo
ttcaatgtaaatacacggggaagcagaaacccttggttggtctgagtcaactgggcagctcgctgacaaagaaag

SEQ ID NO: 40753 - DNA, 40 bp, Homo sapiens
  chr6:15456031-15456071
  hypo
tacaggcatgagtcaccatgcccggcgaagccaggttctt

SEQ ID NO: 40754 - DNA, 51 bp, Homo sapiens
  chr6:16197009-16197060
  hypo
agtagaaaacaaaagcgggctgaaccaagccgaggccgctccacagagaaa

SEQ ID NO: 40755 - DNA, 151 bp, Homo sapiens
  chr6:16218420-16218571
  hypo
gctgcctgccagtcccgcaccgtgtgcctgcacaccggggctgtaaatggagctgcctgccagtcctgcatcatgtgctaagtccctcattgcctggggctagccgggccagccaagcccacgcccacccggaactgcagctggcccacaa

SEQ ID NO: 40756 - DNA, 145 bp, Homo sapiens
  chr6:16249815-16249960
  hypo
agtgctgggattacaggcgtaagccaccatgcctgggcaacttaaactgcttaagctccatttatgcccacgaagctaataatgctgttcaaagttgttccaaaaattaaatgaaacgactgacacaaagcgggtcataaatgct

SEQ ID NO: 40757 - DNA, 22 bp, Homo sapiens
  chr6:16288325-16288347
  hypo
agccctcacagccctcgcttgc

SEQ ID NO: 40758 - DNA, 158 bp, Homo sapiens
  chr6:16293407-16293565
  hypo
agtaccttcattttacggatgagcagacttaagcatcagcaaaaaaggaatttgtaaaaggcgacaccaccacttagcagagaagcaacagtgagaatctagaaatttccaagaagccccaggaaggccatggaaatatcttacgaaaatgaaatgtc

SEQ ID NO: 40759 - DNA, 47 bp, Homo sapiens
  chr6:18035850-18035897
  hypo
gtcctcaccactctccgtggagaacactggtacgttctgtcgtctct

SEQ ID NO: 40760 - DNA, 92 bp, Homo sapiens; identical to SEQ ID NO: 14840
  chr6:20239485-20239577
  hypo

SEQ ID NO: 40761 - DNA, 30 bp, Homo sapiens
  chr6:20691518-20691548
  hypo
gcagaccctgagcagcgactgctgctgaga

SEQ ID NO: 40762 - DNA, 86 bp, Homo sapiens
  chr6:20702857-20702943
  hypo
ctctggacgtcctctcgatatccagccacctgtgttttcttcgccgatgtgttcctcatgatgtccagccacttgtgtgttggcct

SEQ ID NO: 40763 - DNA, 16 bp, Homo sapiens
  chr6:21687666-21687682
  hypo
ccgcctcaaaacaaaa

SEQ ID NO: 40764 - DNA, 30 bp, Homo sapiens
  chr6:24465059-24465089
  hypo
acccacatctcaacccggttcaggtcagta

SEQ ID NO: 40765 - DNA, 21 bp, Homo sapiens
  chr6:24647342-24647363
  hypo
aaaaccagctgggtgcggtgg

SEQ ID NO: 40766 - DNA, 30 bp, Homo sapiens
  chr6:25218551-25218581
  hypo
ggggcatggtgggggcgcctttctcacccc

SEQ ID NO: 40767 - DNA, 61 bp, Homo sapiens
  chr6:25668982-25669043
  hypo
gctttcccatcatgtcgggtctcttagaagtcctttcactttcttgcgatctatgctatgt

SEQ ID NO: 40768 - DNA, 30 bp, Homo sapiens
  chr6:25710967-25710997
  hypo
atcttgactctattccgttatgttaaatta

SEQ ID NO: 40769 - DNA, 74 bp, Homo sapiens
  chr6:25727962-25728036
  hypo
atccttgctaggcaccgtgactcgcctgtaatcccagcacttgcagaggtcgaggctggcggttcatgaggtta

SEQ ID NO: 40770 - DNA, 23 bp, Homo sapiens
  chr6:26047695-26047718
  hypo
accgcgcccggcctccttgaagc

SEQ ID NO: 40771 - DNA, 27 bp, Homo sapiens
  chr6:26053446-26053473
  hypo
cgtgagccaccgcgcccagcctttttt

SEQ ID NO: 40772 - DNA, 36 bp, Homo sapiens
  chr6:26214612-26214648
  hypo
gccggcgtgagccaccgcgcccggccaagagaaaaa

SEQ ID NO: 40773 - DNA, 31 bp, Homo sapiens
  chr6:27102699-27102730
  hypo
agtaatcttaagaagacgttaactcattttt

SEQ ID NO: 40774 - DNA, 30 bp, Homo sapiens
  chr6:27719898-27719928
  hypo
ggctgagatggagcacgcaagtattctctt

SEQ ID NO: 40775 - DNA, 51 bp, Homo sapiens
  chr6:27934894-27934945
  hypo
tggacgaggggaatgcggtggcgcctgaaaacttgacgatgccacaatgtc

SEQ ID NO: 40776 - DNA, 30 bp, Homo sapiens
  chr6:28395568-28395598
  hypo
gtatccagctgggcacggtggctccaacct

SEQ ID NO: 40777 - DNA, 245 bp, Homo sapiens
  chr6:33955486-33955731
  hypo
cgcatgtcaccctcacggccactctggaggcaggcgcttttgtcatcaaacccatttcacatgtgagggcgctgaagcccaaagaaagcagcgcctcactctgctgcctcatactctgttaaaaggagaatcatgccaacctccagaaatgaggcgggaaaatgactgcgctccgtgacctgtcaattaccccctggagacagccagcagctgtcctcatccctaggctgcggtcagagaaacat

SEQ ID NO: 40778 - DNA, 150 bp, Homo sapiens
  chr6:33995975-33996125
  hypo
ggacatggtggccgccgtaacgacggctttgaggctgcgcttgcgcttgggcacgttctgctccgggtggaagaggatgatgtagactttgggcatgtagagcattcccagggacaccgaggcgctcagactcaccgagaccgtcagcgt

SEQ ID NO: 40779 - DNA, 30 bp, Homo sapiens
  chr6:34034624-34034654
  hypo
gtgccgcggtcctcacgtggtgccgcctga

SEQ ID NO: 40780 - DNA, 120 bp, Homo sapiens; identical to SEQ ID NO: 5043
  chr6:34170868-34170988
  hypo

SEQ ID NO: 40781 - DNA, 31 bp, Homo sapiens; identical to SEQ ID NO: 5044
  chr6:34171048-34171079
  hypo

SEQ ID NO: 40782 - DNA, 30 bp, Homo sapiens
  chr6:34392006-34392036
  hypo
catatcctttcacatcgtggtatacaccat

SEQ ID NO: 40783 - DNA, 30 bp, Homo sapiens; identical to SEQ ID NO: 14846
  chr6:34514348-34514378
  hypo

SEQ ID NO: 40784 - DNA, 29 bp, Homo sapiens
  chr6:34535577-34535606
  hypo
gccctgccatcatagcgctgacagcggct

SEQ ID NO: 40785 - DNA, 29 bp, Homo sapiens
  chr6:34535906-34535935
  hypo
ggcgtgagtcactgcgcccagccatatcc

SEQ ID NO: 40786 - DNA, 70 bp, Homo sapiens
  chr6:34671603-34671673
  hypo
gcaagcaaatgtctgcgggcttactatgagaaaggctgagttggggacagtggtccggaaagagaaccct

SEQ ID NO: 40787 - DNA, 19 bp, Homo sapiens
  chr6:34723890-34723909
  hypo
gggcgcggtgggtcacgcc

SEQ ID NO: 40788 - DNA, 19 bp, Homo sapiens
  chr6:34724209-34724228
  hypo
aagacgagataacctttct

SEQ ID NO: 40789 - DNA, 23 bp, Homo sapiens
  chr6:34854786-34854809
  hypo
tgggtccctgatcaccgggtgcg

SEQ ID NO: 40790 - DNA, 33 bp, Homo sapiens
  chr6:35026986-35027019
  hypo
aggcaacacttcagacggcgtgctggcccagga

SEQ ID NO: 40791 - DNA, 297 bp, Homo sapiens
  chr6:35149810-35150107
  hypo
caaatgtttcttgagcgctggcaacgtgccaggctccttgctgggccccaaggagggagccacaaacacggacaaattccaggacctgctggagctgttctcgggctctaacgtgaggcaaaactgtgcacaaatcctggggcactctggacactgagctccggaccccgtgcaggcggtagtcgcctctgcgcggagtaggagctttgtgggcctcccacccagcatcaggagaatcagggcccacgtggcgggcgagggatctgcgacgcagccaccgggcgcccagctggggtc

SEQ ID NO: 40792 - DNA, 139 bp, Homo sapiens
  chr6:35309516-35309655
  hypo
ctaggtgtggcctaaggagcttgcggcctacggaaggtgtggccgaaggagaggggaggggtcatctttaatgatgatggaggggaggcattggtcatatacctgagagtcaagctttgttcatcgtcagatgaaagcc

SEQ ID NO: 40793 - DNA, 30 bp, Homo sapiens
  chr6:35454542-35454572
  hypo
ctcctatcccacagccgctggctctggagc

SEQ ID NO: 40794 - DNA, 22 bp, Homo sapiens
  chr6:35895206-35895228
  hypo
tgagccacggtgcccggccccc

SEQ ID NO: 40795 - DNA, 85 bp, Homo sapiens
  chr6:36165588-36165673
  hypo
tctagagtttctccccggtgtctggaggcgtgggtgggacaaaacacgtctgtgtagagtcttgcatggtcgagagatgcttgag

SEQ ID NO: 40796 - DNA, 130 bp, Homo sapiens
  chr6:36214662-36214792
  hypo
atatgtcttcttgaacgccatcgccccatcccagactcaggaccagcctccccgcgctcactgctgtcactgctttccgcactccctgcggattttaggattttagctcccatctcgcgtcctctctcca

SEQ ID NO: 40797 - DNA, 101 bp, Homo sapiens
  chr6:36238341-36238442
  hypo
cgggacctggccccccggatgctggaaacagcccaccgctttgcggggacatcggcaggtgctgtgatcgccgccctggccatctgcgggattgaaatggg

SEQ ID NO: 40798 - DNA, 30 bp, Homo sapiens; identical to SEQ ID NO: 14852
  chr6:36831576-36831606
  hypo

SEQ ID NO: 40799 - DNA, 30 bp, Homo sapiens
  chr6:36881595-36881625
  hypo
accttaccttttcagcggtctccagtgctt

SEQ ID NO: 40800 - DNA, 42 bp, Homo sapiens
  chr6:36949243-36949285
  hypo
atgccagctcgactgcgtgccatgctgcgcagtgagttcccc

SEQ ID NO: 40801 - DNA, 46 bp, Homo sapiens
  chr6:37004177-37004223
  hypo
tgcaaactgagcattcgaggggtctaggctgcgcgctctttatgag

SEQ ID NO: 40802 - DNA, 267 bp, Homo sapiens
  chr6:37024382-37024649
  hypo
ggtctccaggagaggcgggcacttcctccgccccagcccagggtcctgttcaatccttattgaggagtttcctggcgacaggcagtgacctgtcggctgcctgtgtgggaagccgcttggcgtggccctccccatctcattagtggtgattcacctggactcacctggctgtcagggacctgtcccactgcccgctggaaccagctcagcaggcaccctctgaggggcagagacctcgttccctcagctccccgtcctccatggtgt

SEQ ID NO: 40803 - DNA, 44 bp, Homo sapiens
  chr6:37053276-37053320
  hypo
tgataaaacccctaccgatggctgatgactaaaccaatccgcat

SEQ ID NO: 40804 - DNA, 30 bp, Homo sapiens
  chr6:37275453-37275483
  hypo
gtattcttatgagtccggttcaacaacaac

SEQ ID NO: 40805 - DNA, 30 bp, Homo sapiens
  chr6:37358523-37358553
  hypo
gattgttctgaagaccgtgctctaagggca

SEQ ID NO: 40806 - DNA, 180 bp, Homo sapiens
  chr6:37391410-37391590
  hypo
tacctgggtggggttcgtcatctcacgctgagaagattaacaacactgtcacgcactcatgatgtgggttaaggagtggaaagtttaataggcaggagaaaggagagaggagagcaggtctgtcttttgtgagagagaggtgtccaaaagggaaaaggtggcctgcggcagaatgcagca

SEQ ID NO: 40807 - DNA, 30 bp, Homo sapiens
  chr6:37557743-37557773
  hypo
tttcccttctcttatcgcctcccagtgcga

SEQ ID NO: 40808 - DNA, 30 bp, Homo sapiens
  chr6:37776410-37776440
  hypo
ctggggaaacccaaacgaacacaccaatct

SEQ ID NO: 40809 - DNA, 30 bp, Homo sapiens
  chr6:37791835-37791865
  hypo
gccaccgcgcctggccggtatatattaacg

SEQ ID NO: 40810 - DNA, 34 bp, Homo sapiens
  chr6:38018000-38018034
  hypo
gattacaagcgtgagtcaccgtgcctggccaaga

SEQ ID NO: 40811 - DNA, 30 bp, Homo sapiens
  chr6:38137726-38137756
  hypo
ttctgactggaagctcgctgggtgcagcag

SEQ ID NO: 40812 - DNA, 30 bp, Homo sapiens
  chr6:38183151-38183181
  hypo
gtcggcctccgggctcgctaagcaaatagt

SEQ ID NO: 40813 - DNA, 30 bp, Homo sapiens
  chr6:38684078-38684108
  hypo
aaatgcctctccctccggcttatttcccgt

SEQ ID NO: 40814 - DNA, 43 bp, Homo sapiens
  chr6:40244038-40244081
  hypo
gacttccttagcctgcgttctgcatatgcgttatggctctgcc

SEQ ID NO: 40815 - DNA, 133 bp, Homo sapiens
  chr6:41709850-41709983
  hypo
ggctgggagaggattcgagaggaagcccaggaaggaaggccctggagcaagactgactggagccagatgcccgctgggatgcctccaaaccccaaagcattgagcactgagcctcagtcgtccagggcggccg

SEQ ID NO: 40816 - DNA, 35 bp, Homo sapiens
  chr6:41715572-41715607
  hypo
attcctggcatctaccgactcgatgccaggagcag

SEQ ID NO: 40817 - DNA, 185 bp, Homo sapiens
  chr6:41773575-41773760
  hypo
gagcatggcgaagggcgacactagggcccacttcccggaccacatgactcggaagagggtgtgcagttcacggcagagggaaatgtgctttgaactcggctccttgttctggatgagctccagactccgactaatggaggccctgccgttccagcagaagccctcccgctcgcatgcctcggccc

SEQ ID NO: 40818 - DNA, 17 bp, Homo sapiens
  chr6:42062066-42062083
  hypo
gcctgagcaacacagcg

SEQ ID NO: 40819 - DNA, 29 bp, Homo sapiens
  chr6:42090829-42090858
  hypo
gagggacaggccgggcgcggtggctcacg

SEQ ID NO: 40820 - DNA, 88 bp, Homo sapiens
  chr6:42110870-42110958
  hypo
gagaatgtgggatgacgaaatcttggcattctgtgtctgtacatcacattgtttttctttttcttttcttttcttttctttttttttt

SEQ ID NO: 40821 - DNA, 36 bp, Homo sapiens
  chr6:42184577-42184613
  hypo
tctcaaagtgtagtctgaggacgtctgtggggtctg

SEQ ID NO: 40822 - DNA, 176 bp, Homo sapiens
  chr6:42190336-42190512
  hypo
gagcacatctcagctcgctggcggtggctgaggatggtagatagggagtaaatggaattcaggatttacacacacattctctctctgccaaatgcacacatggatgagcgtacctggaggactggcgagttaactcattgaacaaatagttgctgagcacccgctataaattgctg

SEQ ID NO: 40823 - DNA, 41 bp, Homo sapiens
  chr6:42773440-42773481
  hypo
aaagaggacaaggaacgggccaggtgcggtggctcacacct

SEQ ID NO: 40824 - DNA, 224 bp, Homo sapiens
  chr6:42813314-42813538
  hypo
ctctgggcctcttcacgacagcatggccttttagctctccttcattgttctccctccttgttctcctggactaaaatgattgccccaggctatctttacattattccaaaccaagcatttaacagccactggcaggtgcgccggtttccaatacttaacaatacatcagaatcaactggaaagctttaaaaagttatagattcctggccgggcgcggtggctca

SEQ ID NO: 40825 - DNA, 37 bp, Homo sapiens
  chr6:42846392-42846429
  hypo
tttttgagactgtctcgctctgtcgcccaggctggag

SEQ ID NO: 40826 - DNA, 96 bp, Homo sapiens
  chr6:42846609-42846705
  hypo
attacaggtgaaagccaccggcccgacctactgtttttcaggattctatatagactgggagggaagaacgcaaattccgggcgatgagagctgcat

SEQ ID NO: 40827 - DNA, 156 bp, Homo sapiens
  chr6:43424451-43424607
  hypo
cccccgcccccccccaaaaaaagacaaggacccagaacataatttctagtttgtgcaggacaacagggcagaggtcaggaacgctagcgcccatctctagtccttcagattgagatttcaccatctttaaattcaaaacatcggaaggagcagtcg

SEQ ID NO: 40828 - DNA, 69 bp, Homo sapiens
  chr6:43478676-43478745
  hypo
acaccttctcaggtacgcagggcactgttgacatctgagggtgtgtccgtgccgcgagactggggcagc

SEQ ID NO: 40829 - DNA, 30 bp, Homo sapiens; identical to SEQ ID NO: 14862
  chr6:43486338-43486368
  hypo

SEQ ID NO: 40830 - DNA, 111 bp, Homo sapiens
  chr6:43639599-43639710
  hypo
tgtagatgggcttgacggagccaggagcccagcgcgtcaggtacctgtggagggagaacaaagaggtgcctgtgagggctgggggcccaagctggacgtgggagagtggag

SEQ ID NO: 40831 - DNA, 72 bp, Homo sapiens
  chr6:43748463-43748535
  hypo
tccagaaaatcagttcgaggaaagggaaaggggcaaaaacgaaagcgcaagaaatcccggtataagtcctgg

SEQ ID NO: 40832 - DNA, 30 bp, Homo sapiens; identical to SEQ ID NO: 14864
  chr6:44241078-44241108
  hypo

SEQ ID NO: 40833 - DNA, 41 bp, Homo sapiens; identical to SEQ ID NO: 14865
  chr6:44437145-44437186
  hypo

SEQ ID NO: 40834 - DNA, 30 bp, Homo sapiens
  chr6:44443992-44444022
  hypo
agcctgggtctggcacggtgaatcctcctt

SEQ ID NO: 40835 - DNA, 119 bp, Homo sapiens
  chr6:45609047-45609166
  hypo
caagcatttggagagcgcctcagaactgcagatgaagccccggattgactttattgggtgatttcagcacggccaaatatttgtagtgtaaagaaatcataaaacgtgctggtggtccg

SEQ ID NO: 40836 - DNA, 26 bp, Homo sapiens
  chr6:47924456-47924482
  hypo
ctgctcctggccgagagtatggtttt

SEQ ID NO: 40837 - DNA, 172 bp, Homo sapiens
  chr6:49464924-49465096
  hypo
cacctatcaaattgacgaagacgggaaaaagctgaaagaaaattgctgaacatactgaaaaatgggcaccgagtacttgtgctaaaggaaggtgaattggtagaactgttttgagaggcagactttacagatatgttgcagaaccttagtgtaatgtcggccacttcaaatt

SEQ ID NO: 40838 - DNA, 164 bp, Homo sapiens
  chr6:49590413-49590577
  hypo
ccagcagtgtgaaaacgaactaatacaccaactaattcaagaaattgttttatctaatttcataatttctgttagtggaacaattattctgcagatttcaccccccttcccctttgatggaaaaccagactttttttttttttgttttgttttgagacggagtc

SEQ ID NO: 40839 - DNA, 43 bp, Homo sapiens
  chr6:49590817-49590860
  hypo
tgggactacaggcgtgagccaccgcgcccggccattgagacat

SEQ ID NO: 40840 - DNA, 39 bp, Homo sapiens
  chr6:50207691-50207730
  hypo
cacgcctgccaagggcgagcgaggcgtggagcagtgacg

SEQ ID NO: 40841 - DNA, 30 bp, Homo sapiens
  chr6:52102871-52102901
  hypo
catatcttcccagttcgaggcagggggcac

SEQ ID NO: 40842 - DNA, 88 bp, Homo sapiens
  chr6:52156845-52156933
  hypo
agtctcccaaaacatcggtagtcaaaggaagaattcaaccttgacatttagtttcaaaactttggcgccgggcgcggtggctgacgcc

SEQ ID NO: 40843 - DNA, 107 bp, Homo sapiens
  chr6:52268182-52268289
  hypo
acggggcacgagtggcgctactacttcttcagcctctttcagaaacacaacgaggtggtcaacgtctggacccatttactggcagccctggccgtcctcttgcgatt

SEQ ID NO: 40844 - DNA, 180 bp, Homo sapiens
  chr6:52928856-52929036
  hypo
ccagcctgggctacagcgagactctgtctcagcaaaacaaaacacggcatttggacttccttattgtagctcgttctctctccccttcactctctcgctctctcccctccctcagcactttcacctccatttctgtgccaaagatgtactacaattttttttttttttgagacggagtct

SEQ ID NO: 40845 - DNA, 34 bp, Homo sapiens
  chr6:52929276-52929310
  hypo
cgtgggccaccgcgcccagcggatatactgcatt

SEQ ID NO: 40846 - DNA, 30 bp, Homo sapiens
  chr6:57979515-57979545
  hypo
ggtgtactccctcttcgatattgggtgtaa

SEQ ID NO: 40847 - DNA, 35 bp, Homo sapiens
  chr6:58504069-58504104
  hypo
attttaggcgtgagccaccacgccctgcccattta

SEQ ID NO: 40848 - DNA, 148 bp, Homo sapiens
  chr6:64150678-64150826
  hypo
cgcagatagcgagggcggaaacctccgccaccagctggacagcaacaaacaggacctgagcctcagcaacctggatgaagacccggtcaaggagctggctgcccttccaaagactaccacactggatctgtcttgtaataaatgacta

SEQ ID NO: 40849 - DNA, 20 bp, Homo sapiens
  chr6:71277673-71277693
  hypo
caccgcgcccggtccgcaaa

SEQ ID NO: 40850 - DNA, 179 bp, Homo sapiens
  chr6:73764839-73765018
  hypo
gcagatccagcacagcgagagtgagtggaacctggagaaccacttcagcggctggtacgacgccatcctgagcccagcgggccatgaggcggcaaagcaggcacggcgagatgctggctatgagtttgacatctgcttcacctcattgcagaagagagcgatcccgaccttctggacag

SEQ ID NO: 40851 - DNA, 103 bp, Homo sapiens
  chr6:74234126-74234229
  hypo
taccatggcttgccacgtgaaaatgatttttaaatcttttcatctgctgtagctacctctgaagaaaagatgatggcccggtgcggtggctcacgcctgtaat

SEQ ID NO: 40852 - DNA, 104 bp, Homo sapiens
  chr6:74698077-74698181
  hypo
cctttaccttaaaagcgggaaacaaaagattagcattatctctttttggtactaaagagaaaagataacttgtttcaaaaacatttctgacaaattcttttttt

SEQ ID NO: 40853 - DNA, 30 bp, Homo sapiens
  chr6:79699310-79699340
  hypo
ttttgcgaccacagacgctaaaaatatgtg

SEQ ID NO: 40854 - DNA, 23 bp, Homo sapiens
  chr6:82958631-82958654
  hypo
gggcgcggtggctcacgcctgta

SEQ ID NO: 40855 - DNA, 79 bp, Homo sapiens
  chr6:84513478-84513557
  hypo
gctcctcctcctaagctgtaactctattcatttcttatatacgtggctggttctgggtcccttgcggtaaaatgatgta

SEQ ID NO: 40856 - DNA, 77 bp, Homo sapiens
  chr6:86302345-86302422
  hypo
tcaattttaacctttcggaatatttcaggtttttttggggagggtggcatcaagtcctcttaagaatattataggga

SEQ ID NO: 40857 - DNA, 30 bp, Homo sapiens
  chr6:86415082-86415112
  hypo
cttgtgctattggcccggatcccacacctg

SEQ ID NO: 40858 - DNA, 38 bp, Homo sapiens
  chr6:89857352-89857390
  hypo
gtcaagaatgaagagcggtgggcagatcagttgaggtc

SEQ ID NO: 40859 - DNA, 111 bp, Homo sapiens
  chr6:90367322-90367433
  hypo
ttctgaaaaacaacacgaacctgattctcccatctagagctaccagtctaacaactttttcttattatgcacaccacttaaatacagccgatattccggggtttgtcctgg

SEQ ID NO: 40860 - DNA, 51 bp, Homo sapiens
  chr6:90644578-90644629
  hypo
caaggaacaggtctccgacacgggagctgcatgtgccgtaacatgaatgca

SEQ ID NO: 40861 - DNA, 185 bp, Homo sapiens
  chr6:90661223-90661408
  hypo
ctgctacggggatggcggcggcctcaaagctgatgggctctggaagcatctggtccctggggcaagccatcttggccgtctctgaatccatcgtctcctcctcttcatcctcctcctctcctgcagagttctcgcagtcctcgtgtgggcgctggcacgcagcatccttccggcacacaaacagg

SEQ ID NO: 40862 - DNA, 16 bp, Homo sapiens
  chr6:97299315-97299331
  hypo
ccgtctcaaaaaaaaa

SEQ ID NO: 40863 - DNA, 149 bp, Homo sapiens
  chr6:99396329-99396478
  hypo
tcatttccataccaacgttcagaagcctctgaccattacctctgatgaagaagatggtctggcagcctctcttactcattttgatttatttttggtagattcagtatggcactttatttatttatttatgtattttttgagacggagtc

SEQ ID NO: 40864 - DNA, 29 bp, Homo sapiens
  chr6:99396718-99396747
  hypo
tgagccaccgcgcccgcccttggcacttt

SEQ ID NO: 40865 - DNA, 30 bp, Homo sapiens; identical to SEQ ID NO: 14876
  chr6:105750542-105750572
  hypo

SEQ ID NO: 40866 - DNA, 44 bp, Homo sapiens
  chr6:107075561-107075605
  hypo
aacaaagaatacaaacgtagacttcatgagacaatcacagtaaa

SEQ ID NO: 40867 - DNA, 76 bp, Homo sapiens
  chr6:108274499-108274575
  hypo
cccaaaactgtactacgggggtcctcatcttttacttaaaatccttaagaacaaatgtgcttcagaatttttcaga

SEQ ID NO: 40868 - DNA, 94 bp, Homo sapiens
  chr6:108280326-108280420
  hypo
tgagaccggatcgctctccactgggcgacagatttgaatctacgctgtgcccatcttgcagatgaagatttccccaagccgttacagatggttc

SEQ ID NO: 40869 - DNA, 38 bp, Homo sapiens
  chr6:109038585-109038623
  hypo
cccgaagagggtgcccgaggcttcggtgtgctgaggcc

SEQ ID NO: 40870 - DNA, 24 bp, Homo sapiens
  chr6:109057736-109057760
  hypo
tgttaggaatattctcggcccggt

SEQ ID NO: 40871 - DNA, 82 bp, Homo sapiens; identical to SEQ ID NO: 14879
  chr6:109059835-109059917
  hypo

SEQ ID NO: 40872 - DNA, 137 bp, Homo sapiens
  chr6:116574057-116574194
  hypo
tctctgcaattctgtcgaattctagaaggctgtggtctgaaaaccagttgaagaaactagggatagtgttcccttcccggtttctgtggatatgagcctgggggtcttggcctcggtgccagcggattggagtggaa

SEQ ID NO: 40873 - DNA, 30 bp, Homo sapiens
  chr6:118113403-118113433
  hypo
atggacaaatattaacgtggaaaatttata

SEQ ID NO: 40874 - DNA, 30 bp, Homo sapiens
  chr6:119240714-119240744
  hypo
gcccttcaatatatacgtgttttctttact

SEQ ID NO: 40875 - DNA, 30 bp, Homo sapiens
  chr6:119254223-119254253
  hypo
aaggggcaaataaaacgaaacagtgcacta

SEQ ID NO: 40876 - DNA, 42 bp, Homo sapiens
  chr6:119254674-119254716
  hypo
aaaaaaaaaagagagaaacacttatttcgtttggaaagagat

SEQ ID NO: 40877 - DNA, 20 bp, Homo sapiens
  chr6:119560062-119560082
  hypo
ttattatttttgagacggag

SEQ ID NO: 40878 - DNA, 42 bp, Homo sapiens
  chr6:119689647-119689689
  hypo
tctagctttgctgagcgctgtttttttcgtttttgtttttgt

SEQ ID NO: 40879 - DNA, 30 bp, Homo sapiens
  chr6:119824210-119824240
  hypo
ggtgtgaaggctgtccgggattaggtgtat

SEQ ID NO: 40880 - DNA, 28 bp, Homo sapiens
  chr6:119888174-119888202
  hypo
tgtctataaaatccggtgcactctgctg

SEQ ID NO: 40881 - DNA, 30 bp, Homo sapiens
  chr6:119888428-119888458
  hypo
ctctgagaatttcttcgtaaaacacttatt

SEQ ID NO: 40882 - DNA, 30 bp, Homo sapiens
  chr6:119989053-119989083
  hypo
aacccaaaaagttttcgttgtctttaatgc

SEQ ID NO: 40883 - DNA, 30 bp, Homo sapiens
  chr6:121370471-121370501
  hypo
ctgctggccagatcccgcaataataaataa

SEQ ID NO: 40884 - DNA, 17 bp, Homo sapiens
  chr6:125013694-125013711
  hypo
gttcacacctgtaatcg

SEQ ID NO: 40885 - DNA, 77 bp, Homo sapiens
  chr6:125081173-125081250
  hypo
aacagtgaaagcttccgctcagagaatggccctgttaaaaatgggcagtttcataaaaaagaatgagatcatgttct

SEQ ID NO: 40886 - DNA, 36 bp, Homo sapiens
  chr6:125286431-125286467
  hypo
attattggccgggtgcggtggctcacgcctgtaatc

SEQ ID NO: 40887 - DNA, 105 bp, Homo sapiens
  chr6:125397724-125397829
  hypo
gtttcataaaatttgcgattttgctttttaaaaactcagctaactctttccttctccttccctctcttgctgatacagatccacatccagcgaactgaaggatgt

SEQ ID NO: 40888 - DNA, 30 bp, Homo sapiens
  chr6:129480603-129480633
  hypo
gccgggaggatctgccggggagagcggctt

SEQ ID NO: 40889 - DNA, 30 bp, Homo sapiens
  chr6:130182604-130182634
  hypo
tgtttttagatagtgcggcaaataggcagg

SEQ ID NO: 40890 - DNA, 30 bp, Homo sapiens
  chr6:130241934-130241964
  hypo
aggttgagcttctgccgctggtgcccaagt

SEQ ID NO: 40891 - DNA, 149 bp, Homo sapiens
  chr6:130530028-130530177
  hypo
tattctaggggatgccgtgacctccgtatcatatcttacctatgaccatctcagcaccaaatcctacatgtggttctctaagtctacagtttttcctttgtttagttgtaatccatatattgaaatatacattacgtaaaacccagtgt

SEQ ID NO: 40892 - DNA, 30 bp, Homo sapiens
  chr6:130808098-130808128
  hypo
ccctggagagaagggcgtgaacctggaagg

SEQ ID NO: 40893 - DNA, 32 bp, Homo sapiens
  chr6:131389791-131389823
  hypo
ctatagtctcagctcctcgggaggctgaggca

SEQ ID NO: 40894 - DNA, 30 bp, Homo sapiens
  chr6:131455819-131455849
  hypo
gagtaactagtttgccgacttctagtgtgc

SEQ ID NO: 40895 - DNA, 61 bp, Homo sapiens
  chr6:131616389-131616450
  hypo
tcacgccctttgcagcggggaggagcctggcatctctctcctgttccggggtgtggtacct

SEQ ID NO: 40896 - DNA, 93 bp, Homo sapiens
  chr6:134067455-134067548
  hypo
gcgcccagcctgcctggagctctttaaagggctctgagcctgggattcttgggagagttccattgcattgtatggtcacggagattgacacag

SEQ ID NO: 40897 - DNA, 86 bp, Homo sapiens
  chr6:134589500-134589586
  hypo
caactgtttgtgaagcgcattgtaaacaaacatagacggggtgagacatcctctttatcctgaataaatcaagaattcccaggccg

SEQ ID NO: 40898 - DNA, 86 bp, Homo sapiens
  chr6:134589886-134589972
  hypo
cacttggggtttataggagactgttctccaaaccacaccagacttttagaagcaactacctctacagataccggggtgaaccagta

SEQ ID NO: 40899 - DNA, 137 bp, Homo sapiens
  chr6:137144480-137144617
  hypo
cctgtagttgtctaacgaggaatgcacacattcgcaagtaggtgttacagactccagttaattgtctcccgtcgcgcgcattggctcagcctgtggttaaagctgctcaggaggctgaggcgggaggatcgcttgag

SEQ ID NO: 40900 - DNA, 150 bp, Homo sapiens
  chr6:138790432-138790582
  hypo
ttcgcacatgagttacgtagagggacctgcaggaagcggtagagaaaacataaggcttatgcgtttaatttccacaccaatttcaggatctttgtcactgacagcagcactaagacttgttaactttatatagttaagaagaacaaggct

SEQ ID NO: 40901 - DNA, 60 bp, Homo sapiens
  chr6:143557423-143557483
  hypo
gggcagggcctctgccgtgagtttgcagatgcctcattcggactccgagtctgtgactca

SEQ ID NO: 40902 - DNA, 30 bp, Homo sapiens
  chr6:144522041-144522071
  hypo
agatcttgtagatgtcggaaaacatctcat

SEQ ID NO: 40903 - DNA, 30 bp, Homo sapiens
  chr6:147981884-147981914
  hypo
cttcgcgttctacctcgattgaaaattttc

SEQ ID NO: 40904 - DNA, 99 bp, Homo sapiens
  chr6:149177471-149177570
  hypo
tattatgtaaggtaaataggggaaacgttcacaaagatgattcatgctaaacaaataaaaccagagccacatccatcagcataacgtagtgcaataaaa

SEQ ID NO: 40905 - DNA, 30 bp, Homo sapiens
  chr6:149460105-149460135
  hypo
aggttaaatgctcagcgcatctggccagag

SEQ ID NO: 40906 - DNA, 23 bp, Homo sapiens
  chr6:149498669-149498692
  hypo
aattctccatccaatcgagtctt

SEQ ID NO: 40907 - DNA, 34 bp, Homo sapiens
  chr6:149772982-149773016
  hypo
gccaggcttagggagcgggcggtagggagtgggt

SEQ ID NO: 40908 - DNA, 30 bp, Homo sapiens
  chr6:149786129-149786159
  hypo
tgctgtgctctctctcgtatgtgacctttc

SEQ ID NO: 40909 - DNA, 30 bp, Homo sapiens
  chr6:150985942-150985972
  hypo
tcataccacattcatcgcagaattggggga

SEQ ID NO: 40910 - DNA, 151 bp, Homo sapiens
  chr6:152520849-152521000
  hypo
ggcaatggcaattagcggtgctgtctgaggctaacttcccaagcaatttaggcaaacaagattttagcctgaattttccaggtaattgccttgttttgctgctaagggcagtttggggaagagtagcaggactagacgaaaatacattttt

SEQ ID NO: 40911 - DNA, 103 bp, Homo sapiens
  chr6:154970495-154970598
  hypo
gtgtaagcatctaaacgccaaaatgcctcaacttcctacctgagctcaagaagtacaagaagtgaaaaatggcattaccggccgggcgcggtggctcacgccc

SEQ ID NO: 40912 - DNA, 26 bp, Homo sapiens
  chr6:155568751-155568777
  hypo
gcacctggccacgcttcatggctttt

SEQ ID NO: 40913 - DNA, 50 bp, Homo sapiens
  chr6:155569275-155569325
  hypo
gacggaccaggagagcgaggagcactaccacctgacgggtgaggcggcgg

SEQ ID NO: 40914 - DNA, 30 bp, Homo sapiens; identical to SEQ ID NO: 14887
  chr6:155988231-155988261
  hypo

SEQ ID NO: 40915 - DNA, 30 bp, Homo sapiens
  chr6:157283403-157283433
  hypo
gcctgggcgacagggcgaggctctgtctca

SEQ ID NO: 40916 - DNA, 30 bp, Homo sapiens
  chr6:157455406-157455436
  hypo
ttacagcttgaaaagcgagttattatcttg

SEQ ID NO: 40917 - DNA, 39 bp, Homo sapiens; identical to SEQ ID NO: 14888
  chr6:157478299-157478338
  hypo

SEQ ID NO: 40918 - DNA, 48 bp, Homo sapiens
  chr6:157505817-157505865
  hypo
atcaaaacaggctttcgaattctaagccatatacgtttattgcttata

SEQ ID NO: 40919 - DNA, 27 bp, Homo sapiens
  chr6:157637384-157637411
  hypo
cagcttcctgtagctcgtcccaaggtc

SEQ ID NO: 40920 - DNA, 84 bp, Homo sapiens
  chr6:157638362-157638446
  hypo
gcacagggcagcagccggcttggcccgcagtgctcctcccgagcctgcttcattaatgggctggtgcttcgtcaacacgacagc

SEQ ID NO: 40921 - DNA, 105 bp, Homo sapiens
  chr6:157913083-157913188
  hypo
tgccggtgttggttgcggcacctcaggtgctccatccagcagccctccaggcaggtgctgtcactgtcccctctcaccggggaggaaacccggccttttcccttg

SEQ ID NO: 40922 - DNA, 50 bp, Homo sapiens
  chr6:158093775-158093825
  hypo
tcagagcaccaaattcgttttgcaggctgcagccacgcccctgctgcaga

SEQ ID NO: 40923 - DNA, 30 bp, Homo sapiens; identical to SEQ ID NO: 14891
  chr6:158119028-158119058
  hypo

SEQ ID NO: 40924 - DNA, 184 bp, Homo sapiens
  chr6:158489608-158489792
  hypo
ggagccccatgaactcgtaatgcgggacttggcggttctgacttctgtcatctcttgccttgctccccagatgacagcagcccagctgacatatttgctgtggggtttgaagagatggtggaattgagcgcagggaatattgtcaatgccaggtaaggggccaggtgtgcggggccaggcaggg

SEQ ID NO: 40925 - DNA, 30 bp, Homo sapiens
  chr6:158978998-158979028
  hypo
agaaaacgagtatgacgggagaagaggagc

SEQ ID NO: 40926 - DNA, 48 bp, Homo sapiens
  chr6:158982731-158982779
  hypo
ggaggacaagcaaaacgcagcttgaattttgtgcgagtttgaggcctc

SEQ ID NO: 40927 - DNA, 100 bp, Homo sapiens
  chr6:159049783-159049883
  hypo
acccagagaggctggcgctctggagcgtgcccacgccacgctgctttccacccagaggggcaggtgctgtgaggtaaatgaggtgcggttgcctctccac

SEQ ID NO: 40928 - DNA, 30 bp, Homo sapiens
  chr6:159113607-159113637
  hypo
acagggttatgaggacggcatcagattggc

SEQ ID NO: 40929 - DNA, 28 bp, Homo sapiens
  chr6:159151645-159151673
  hypo
actctcagcaacgcggaaagaaagcagc

SEQ ID NO: 40930 - DNA, 30 bp, Homo sapiens
  chr6:159194759-159194789
  hypo
ctcctgggaaggtcacgtgggggaagcgtc

SEQ ID NO: 40931 - DNA, 30 bp, Homo sapiens
  chr6:159253019-159253049
  hypo
cgtgagggtgactgtcgggcctctcctgga

SEQ ID NO: 40932 - DNA, 29 bp, Homo sapiens
  chr6:159270065-159270094
  hypo
catgctggccaggcacggtggctcacacc

SEQ ID NO: 40933 - DNA, 30 bp, Homo sapiens
  chr6:159456960-159456990
  hypo
ggagacggtcctcagcgggaggagctcagg

SEQ ID NO: 40934 - DNA, 154 bp, Homo sapiens
  chr6:159569256-159569410
  hypo
aaacagcgaaatcaccaacaatgaccacaaaaattgtgaaaaccatagcggtaaagaaatagtgaaaaggacacttgtttacactgtcagagctgggacaagaaggcagggtgtcaccttgttagacttcagccgagaacgtgccagttgggtg

SEQ ID NO: 40935 - DNA, 30 bp, Homo sapiens
  chr6:160450704-160450734
  hypo
tgatcactaatgtggcgcacagtagcctgg

SEQ ID NO: 40936 - DNA, 55 bp, Homo sapiens; identical to SEQ ID NO: 14894
  chr6:160511899-160511954
  hypo

SEQ ID NO: 40937 - DNA, 32 bp, Homo sapiens
  chr6:161259532-161259564
  hypo
ttcattttgggaggccgaggcgggcggatcac

SEQ ID NO: 40938 - DNA, 100 bp, Homo sapiens
  chr6:161609814-161609914
  hypo
gggttgagcagccagcggccgtcgaatggggcttccgtaaacatcattccctagaatcccgagagccacctggtgagatcggcatcgctatctcatttca

SEQ ID NO: 40939 - DNA, 63 bp, Homo sapiens
  chr6:161672733-161672796
  hypo
gccaagcccacttcccgggccttacgtttcccattcaaacatgggagacgtgctcttgataca

SEQ ID NO: 40940 - DNA, 162 bp, Homo sapiens
  chr6:161685567-161685729
  hypo
aggtggtccccctggcgtgcccgcgcatccctgccctgcaagtcttatccactgcgtgggaacccctcgctgaggcttccgtcttgccctctgggcagcaggctcctcaaaggcacttgcagggtcggctccctctttgtattcctgcgggctgaatgcacg

SEQ ID NO: 40941 - DNA, 32 bp, Homo sapiens; identical to SEQ ID NO: 14896
  chr6:161690517-161690549
  hypo

SEQ ID NO: 40942 - DNA, 79 bp, Homo sapiens
  chr6:161780140-161780219
  hypo
taggtgcatgccaatcccttcattttctaggagcactgctgcatgcaatggagtaataaggacacgctgggtaaattat

SEQ ID NO: 40943 - DNA, 25 bp, Homo sapiens
  chr6:161795264-161795289
  hypo
tgtgttgtgtatatgcgtatgctgt

SEQ ID NO: 40944 - DNA, 24 bp, Homo sapiens
  chr6:161795349-161795373
  hypo
tgtgtgtaacgcatggtgtgcatg

SEQ ID NO: 40945 - DNA, 36 bp, Homo sapiens
  chr6:161989335-161989371
  hypo
taacactgggctgggcgtgatggctcacgcctgtaa

SEQ ID NO: 40946 - DNA, 166 bp, Homo sapiens
  chr6:162257865-162258031
  hypo
ctcccgagcacaagccgtaaaatgacgggagctgtgtgaggtgccaaggtctcaaatgaatgcgggcagcagcacctgtgaagctgataaaacatcagtttgcatttggctcaccttgcaagagggggttttatgcctctcgttttcgctccgctcccacactcct

SEQ ID NO: 40947 - DNA, 30 bp, Homo sapiens
  chr6:162280335-162280365
  hypo
ttctagaaatgagaacgcaggccagacgcg

SEQ ID NO: 40948 - DNA, 30 bp, Homo sapiens
  chr6:163673402-163673432
  hypo
ggggggcgacatcatcggggaaacaaatca

SEQ ID NO: 40949 - DNA, 30 bp, Homo sapiens
  chr6:163915349-163915379
  hypo
gcactggtagggaggcggtcctgggaccaa

SEQ ID NO: 40950 - DNA, 17 bp, Homo sapiens
  chr6:163945812-163945829
  hypo
tacgatcatctattcta

SEQ ID NO: 40951 - DNA, 43 bp, Homo sapiens
  chr6:163946785-163946828
  hypo
aggtagttgtcaggtcgtcaaaggcagacgagtgtcatctgaa

SEQ ID NO: 40952 - DNA, 30 bp, Homo sapiens
  chr6:164012441-164012471
  hypo
tttttgagttgcagccgaagtcttgatctg

SEQ ID NO: 40953 - DNA, 117 bp, Homo sapiens
  chr6:164064007-164064124
  hypo
aatggtgagtgggctcgggaaaaactccgctggtctgtcaatttccaggtggagaatttgcaatgacttttctggctgactcagctgatcaaagtaggtccacgttgttttcctttt

SEQ ID NO: 40954 - DNA, 18 bp, Homo sapiens
  chr6:164114295-164114313
  hypo
ttatttttttgagaccga

SEQ ID NO: 40955 - DNA, 30 bp, Homo sapiens
  chr6:164121841-164121871
  hypo
aaaaactggatccaacggcttgtttgtgaa

SEQ ID NO: 40956 - DNA, 30 bp, Homo sapiens
  chr6:164143599-164143629
  hypo
gccaggaagctataacgctgctctccaggc

SEQ ID NO: 40957 - DNA, 30 bp, Homo sapiens
  chr6:164145369-164145399
  hypo
tgggtgtgggcagcacgcataggaagagga

SEQ ID NO: 40958 - DNA, 30 bp, Homo sapiens
  chr6:164149978-164150008
  hypo
ggaagccgctaacatcgtgcaatgcacagc

SEQ ID NO: 40959 - DNA, 92 bp, Homo sapiens
  chr6:164165801-164165893
  hypo
tgtggagagtagccacgtcgggcatgcagacatgtgtctcagcagccgtcctcctgcacagcggggcgtatgacaggcgggcagagagtcag

SEQ ID NO: 40960 - DNA, 30 bp, Homo sapiens
  chr6:164173782-164173812
  hypo
tcagaggtagaggaacggggctgccagtga

SEQ ID NO: 40961 - DNA, 77 bp, Homo sapiens
  chr6:164182851-164182928
  hypo
aatcggtttcctttgcggatgctctcctaggtctttttttttttggaatcttgctattcgcctgcctcaggctcccg

SEQ ID NO: 40962 - DNA, 44 bp, Homo sapiens; identical to SEQ ID NO: 14900
  chr6:164183729-164183773
  hypo

SEQ ID NO: 40963 - DNA, 23 bp, Homo sapiens
  chr6:164196995-164197018
  hypo
cctaaaagcgtcttctgacaaac

SEQ ID NO: 40964 - DNA, 133 bp, Homo sapiens
  chr6:164228294-164228427
  hypo
tcttgattggttggtcggaaaattggaggcagaggggcagtgggagtggccgtgcgggcctgctttgggaacagagggaccctccctgctgttctgttcacacggaagcgtgtctcagcgtctgggggcttgg

SEQ ID NO: 40965 - DNA, 30 bp, Homo sapiens
  chr6:164228847-164228877
  hypo
cacaccaccggctttcgagtcacagaccct

SEQ ID NO: 40966 - DNA, 94 bp, Homo sapiens
  chr6:164241357-164241451
  hypo
gtctgtgtcattcaccgctctgcctctgccgcctggagacgtgccgggcacgtaccgggtccttggtaactgcggaattcgctaatgaatgggt

SEQ ID NO: 40967 - DNA, 30 bp, Homo sapiens
  chr6:164243378-164243408
  hypo
ggaagtcttgcttcccgggaggtggtaata

SEQ ID NO: 40968 - DNA, 24 bp, Homo sapiens
  chr6:164246119-164246143
  hypo
gcaccgggccgatatggaatttct

SEQ ID NO: 40969 - DNA, 68 bp, Homo sapiens
  chr6:164283216-164283284
  hypo
gggaggaggcattgccgggaagcatgtccccagcgtggcacagaaaccaggcacgaacctggtgctta

SEQ ID NO: 40970 - DNA, 30 bp, Homo sapiens; identical to SEQ ID NO: 14906
  chr6:164288079-164288109
  hypo

SEQ ID NO: 40971 - DNA, 57 bp, Homo sapiens
  chr6:164314386-164314443
  hypo
tggcctgacagtcaacgaggtggaaaccgtgacaaattcagacgccagggctttatc

SEQ ID NO: 40972 - DNA, 419 bp, Homo sapiens
  chr6:164322356-164322775
  hypo
aagtagaagtcctcacgggcaactccctgccatccacaccaacctccccttcttgttctctccttctcatcttaaactttcgagaggaagaagggttggtcaagggtgaacgttcctgggcatggtgagaggctgctctgtggtgcccactcacactgagagggaccagctggggacgcctgatggtgccactgaggctttggggtcccctttcagaggggggcatcttaacgcgagtcttacggtctttcctgggttcccatgctcggcggcggctcctccacaggcctgtcttccctttgttctggagaatgttctgcctgggcggagcattcggtgcggttacgtgggtgcggttctccagggagagcgcgggggtctcttcagggtaatgccaacctcaccgccaaatgcagcta

SEQ ID NO: 40973 - DNA, 86 bp, Homo sapiens
  chr6:164323845-164323931
  hypo
gccaggataagctggcgcctgagtacagctgggaccacccatgctaatgttttaggataaattcctaaaagcggaatttctgggtc

SEQ ID NO: 40974 - DNA, 108 bp, Homo sapiens
  chr6:164334224-164334332
  hypo
tggagtgggacttagcggtgtgaggcagagctaggcaggaagaaatggaacgcccagtccagcctgggtcagaaatcactcagaagacacccacgctgcaagttgcat

SEQ ID NO: 40975 - DNA, 16 bp, Homo sapiens
  chr6:166487246-166487262
  hypo
gcgcccggccgaagta

SEQ ID NO: 40976 - DNA, 46 bp, Homo sapiens
  chr6:166571891-166571937
  hypo
ccgcggccgccccttcgtacagtggggatcccgaggaagagggcgc

SEQ ID NO: 40977 - DNA, 34 bp, Homo sapiens
  chr6:166635593-166635627
  hypo
gtcggacaggcgtctcggtggacctgcttggttt

SEQ ID NO: 40978 - DNA, 127 bp, Homo sapiens
  chr6:166711375-166711502
  hypo
agggacgagatgtgacggtgacagacgatggccaaggccatcttaccgagtgccaggcacgggcctcggcacctgctgtgctctgtctggggaagcgggcacagagatgaagcggccccacggcggt

SEQ ID NO: 40979 - DNA, 32 bp, Homo sapiens
  chr6:166888304-166888336
  hypo
agcatcacccacaaccgcgagcctctcccatc

SEQ ID NO: 40980 - DNA, 191 bp, Homo sapiens
  chr6:166891668-166891859
  hypo
gcagaggtggggtcgcggtgcctgccacctgaggcggcacgtcccttgcacatatgctcacgtgcttatgttataataagtgtccagatgtcatttgggtgcttgggaatgacaaggcagagactacacagatttccatcataaaagcttggtcttgaaagaggagtttcagccaccggcaaggttcctgg

SEQ ID NO: 40981 - DNA, 156 bp, Homo sapiens
  chr6:166944356-166944512
  hypo
aaaaccgagtgaggccgtcggcctgccggtatcgaggctggtttgtcaggccccatccagcccaacagcctgctcgcagcctgctgctctgctttcccaatgccgctccacggcagaacatatgtgggagaatggtatttacgcaatacagctctt

SEQ ID NO: 40982 - DNA, 30 bp, Homo sapiens
  chr6:166982961-166982991
  hypo
gccctggcctgtcatcggatgcctctgccc

SEQ ID NO: 40983 - DNA, 79 bp, Homo sapiens
  chr6:167038238-167038317
  hypo
ttacatatgctaccccgattttcacaagtatcaaataatagaaagctggggaatgcatttgtaaaaaagagagcattgt

SEQ ID NO: 40984 - DNA, 210 bp, Homo sapiens
  chr6:167139240-167139450
  hypo
tcgggccagcgtggacgttcccgacctgccccacagcacagagactggctccaggtatgccgggcagggaggctcctggcggcgcaggcccagagggaaagcagtgtcagctgaggggtggggaggaggcagagggcgcatcacttgtgattccccagctttgagaggagctcacagaggcagcttttggggaaccgacagatttactaa

SEQ ID NO: 40985 - DNA, 159 bp, Homo sapiens
  chr6:167140362-167140521
  hypo
aggcctggaatctaccgtcctgggtgctgtctcctccaccacgtaagccaaacctgatttccgtgaagaatttcccacttgcactcatgaagacatggccattcccaggtatctaggtgttcctccactgatcagaaacttacacgactttatcagaag

SEQ ID NO: 40986 - DNA, 79 bp, Homo sapiens
  chr6:167835047-167835126
  hypo
cttgctatgccagggcggtgctagagatagactttgccctgggctgggctgttttccccccacgcggatcctcacctcc

SEQ ID NO: 40987 - DNA, 33 bp, Homo sapiens
  chr6:168122617-168122650
  hypo
gtcaaatattgattccgccgcgtattaacatga

SEQ ID NO: 40988 - DNA, 62 bp, Homo sapiens
  chr6:168376121-168376183
  hypo
gggggattctcacggcgatgcagacttgaggctgagttgaaaaagggcgtggagaagcccag

SEQ ID NO: 40989 - DNA, 131 bp, Homo sapiens
  chr6:168377422-168377553
  hypo
gcctctgggaagggccggtccaggagctccgcaagttgcgggagaacctggcgggtccgtggtccagcgaggcctgggattcagaagggatgaaacgttcctcgacgcttgaacaccggcctcctgcccct

SEQ ID NO: 40990 - DNA, 33 bp, Homo sapiens
  chr6:168399961-168399994
  hypo
ttttgatagtgaatccgacgatccagttttgca

SEQ ID NO: 40991 - DNA, 196 bp, Homo sapiens
  chr6:168453289-168453485
  hypo
gtccagttcctgctgcgtgcactggtttgtgacagcagcagtggctgaatggagagaaccacacccctgccagcgggaggcctggctggtcacctgagcacagatgccagggcagagccaggaggggactcaggatgaacactgccaccctggggcggctggagaaccaggcatgggccggcggcgagccgggagg

SEQ ID NO: 40992 - DNA, 30 bp, Homo sapiens
  chr6:168760650-168760680
  hypo
gtcctcccagggtcccgtaattactttaat

SEQ ID NO: 40993 - DNA, 192 bp, Homo sapiens
  chr6:168858122-168858314
  hypo
ctgcagtgacttcatcgccttgtgtttcccgtcgggtgcccagtaatcacaaagtggcctggagtcactgtttgtaaatacacaggagcctgcacccatcatatgtatgcggcagagtaatcctcccagaacatgagccccgcgtcacgtccttccagccgtgcttgtgatcactgccggggtgggagcctg

SEQ ID NO: 40994 - DNA, 157 bp, Homo sapiens
  chr6:168947642-168947799
  hypo
ctgcaggcagcatcgcgttgggtctgtgtggggttgctgttgtggttgatctgtggggactgagtgcaagtcctcagcatccacccgtatgcacacttacttaacttactctcataattgtagtctccttgcaaatcttttccgttctgaattcaga

SEQ ID NO: 40995 - DNA, 30 bp, Homo sapiens
  chr6:169400246-169400276
  hypo
gccccggtgcctctgcggtggaggagctag

SEQ ID NO: 40996 - DNA, 50 bp, Homo sapiens
  chr6:169562391-169562441
  hypo
ccaggtcctccttcacgttctcgccaccccaaatgcgggcaccgcggcgc

SEQ ID NO: 40997 - DNA, 30 bp, Homo sapiens
  chr6:169562792-169562822
  hypo
tcaattgatcaatgccgaggatggggagca

SEQ ID NO: 40998 - DNA, 415 bp, Homo sapiens
  chr6:169632421-169632836
  hypo
agggctttctggacacgcacttgaggtgctgttcgttcctgaggctccgtttgtgactcagccatcgtttctgagcctcggctgcagctcaccaagggctgcgctaacagcggagaggtggcggcctgaccctcacaggcccggctgagcacgccccgcaccccgcgcggagagcagcggcccagccgagcaggtgctcagcttccccgggccagcccctcccatgcctctcccgggccacgccaccccttcctctccttcctcctgctgcttttctgagctcatctgatttttccaaagccgctcgcaacacacaaggaaggccggccttgcgtacttgcttttccgtcttggctgcttccaggccgaccccgacgggctggttccctctgtatcggggcgggcagggcaggca

SEQ ID NO: 40999 - DNA, 35 bp, Homo sapiens
  chr6:169637816-169637851
  hypo
ggtcccagagccacacgtcacggagcactgggtcc

SEQ ID NO: 41000 - DNA, 30 bp, Homo sapiens
  chr6:169713660-169713690
  hypo
ctccgcgcaccatgccgagggcattgtcct

SEQ ID NO: 41001 - DNA, 30 bp, Homo sapiens
  chr6:169740776-169740806
  hypo
gggccgagccaacagcgagcttcgtgcaga

SEQ ID NO: 41002 - DNA, 30 bp, Homo sapiens
  chr6:170065367-170065397
  hypo
cagacccagctcctccgcagaccagggggc

SEQ ID NO: 41003 - DNA, 30 bp, Homo sapiens
  chr6:170201723-170201753
  hypo
aagagccccaggccccgggggcttctctgg

SEQ ID NO: 41004 - DNA, 30 bp, Homo sapiens
  chr6:170240081-170240111
  hypo
atcatgcccactccacgccatgcccacatc

SEQ ID NO: 41005 - DNA, 30 bp, Homo sapiens
  chr6:170263220-170263250
  hypo
agggtcccttccctccgtccctgccaccct

SEQ ID NO: 41006 - DNA, 30 bp, Homo sapiens
  chr6:170361487-170361517
  hypo
cctgggcttcactcccgtttaactttgcat

SEQ ID NO: 41007 - DNA, 30 bp, Homo sapiens
  chr6:170368767-170368797
  hypo
agctgcatttgcaagcgctggtgtccacac

SEQ ID NO: 41008 - DNA, 30 bp, Homo sapiens
  chr6:170402505-170402535
  hypo
ctcagcaggggaggccgagtgtggaggttt

SEQ ID NO: 41009 - DNA, 30 bp, Homo sapiens
  chr6:170408290-170408320
  hypo
ccgcacagctcccaacggcaccgcgcagct

SEQ ID NO: 41010 - DNA, 40 bp, Homo sapiens
  chr6:170454160-170454200
  hypo
tgagcacctggagaacggcagtgcccgtgagcacctggag

SEQ ID NO: 41011 - DNA, 596 bp, Homo sapiens
  chr6:170475028-170475624
  hypo
ttcttgggtgacaatcgaggggtcctgacccagcacccgtgggcacacccttatttggaaattgggcctagcccggagtgatcatgaggccacgtgacatgggcgtgccagtctcaccaacgtgtgttttcacgggcaccacagagtctgttttctatgggtggggcagcggtgaacatatccctcttaatagcggtacgggtacggccagggaggcggcagaacgtagacagaacccgggcactgagagaccggtgccgccccccgccgtccacacaacccgggcctcgggcagcaccagcaggacttttattcctcaccccgcacgccgccgtccatctcctaggccagcgtgattcttctgagtgcagctgggtctcctcctgggagatccggtggctctagcagcgtgggtgctgggaacaggaccagcctcgccggcggacagtgtggacgcctgagggcaaaccctggaccactctctccccgggggactccgttcccgcctccagggagctgcgaacgctccttctgggacacctgttggcaagaaaccagttcaatcgtctcacttccagaaacgattctgtgttttg

SEQ ID NO: 41012 - DNA, 118 bp, Homo sapiens
  chr6:170493059-170493177
  hypo
cctggggcctttgcacggcggctgctgccatctgctcctccctggcgctgtggggccagctcctttcttcgagttctctcactggacgcattgccacctcacacgggacccctgaccc

SEQ ID NO: 41013 - DNA, 30 bp, Homo sapiens
  chr6:170569817-170569847
  hypo
taacttccagtgacacggttttttcaatct

SEQ ID NO: 41014 - DNA, 19 bp, Homo sapiens
  chr6:170894820-170894839
  hypo
tttgagatggagtctcgct

SEQ ID NO: 41015 - DNA, 167 bp, Homo sapiens
  chr7:131076-131243
  hypo
agggtctgcagctggcgcacgaggtgaacacaatgctaaggacaaaattacacaaggaatgtgcaagagttccactgttcacagtgggaatcacctaattcacacacaaccagcttcacaaaatgagctccaggcggccggctggagggacgcggaggccagcaggt

SEQ ID NO: 41016 - DNA, 159 bp, Homo sapiens
  chr7:171340-171499
  hypo
gcactgctgccatctcgcaatttacataaagtctcagctctgtgcgtgggacagcagcgtttgaagctgtccccatcaagggcctgtacaaccacctccttcacagttaggggttggccgtcctgaggctgcccgaccccctcccggctccccgacccc

SEQ ID NO: 41017 - DNA, 30 bp, Homo sapiens
  chr7:306966-306996
  hypo
ggtgcccgctgggcccgtaccagccatacc

SEQ ID NO: 41018 - DNA, 30 bp, Homo sapiens
  chr7:322785-322815
  hypo
cccatcctgtctgcccggggccctgttaac

SEQ ID NO: 41019 - DNA, 44 bp, Homo sapiens
  chr7:328564-328608
  hypo
gtgctggccgcgtttttagttttgacatccgattaaggggacaa

SEQ ID NO: 41020 - DNA, 136 bp, Homo sapiens
  chr7:369844-369980
  hypo
gacaagttagcacaacgtttatggccacgaagttggcaacatcaataaaaatgtaaatgcatctgccctttggcccggcaattctgcttatcctatagataccattgcgcacaggtgaggccgtctatgtgtgaaa

SEQ ID NO: 41021 - DNA, 30 bp, Homo sapiens
  chr7:381568-381598
  hypo
tggtccagagctgcccgaggagacaggaca

SEQ ID NO: 41022 - DNA, 30 bp, Homo sapiens
  chr7:389663-389693
  hypo
accagcagggtgtcacggggcaagtacctc

SEQ ID NO: 41023 - DNA, 179 bp, Homo sapiens
  chr7:409602-409781
  hypo
ggccgcctaccccagcggtgccaccaaggccgctctcaggctgccccacagctgcgtgccaagcccctgacgggcactttatggcacgttatctcgcctgtgccccacaacaacccggccgggtgggaattccgctcccattaaacagataaggaaccgggattcggagaggcgagggc

SEQ ID NO: 41024 - DNA, 30 bp, Homo sapiens
  chr7:410011-410041
  hypo
ccaggcctggcctcccgactcccaccacca

SEQ ID NO: 41025 - DNA, 37 bp, Homo sapiens
  chr7:430257-430294
  hypo
aagggagacacaaggcggaaggcgtgagggcaggagg

SEQ ID NO: 41026 - DNA, 291 bp, Homo sapiens
  chr7:431429-431720
  hypo
tgaagccaccaggcacggggctgtgtgtgcagaagcagccaggcagggcggcccagcagacgcagggagcggccgccagccgctaggatcccgatgccgccgcaagtaaggacaggcccgggtgctgccgcaggaggccaggcctgcgctcgccgctgtggaatgtgtgtttgtctgatgagcatccctgcagggccccagatggagggtgtgacaaggatgggggctgagtctccagggcccgggggcacctgcacgctgcccctggcaggggcccgggcatcccacctg

SEQ ID NO: 41027 - DNA, 45 bp, Homo sapiens
  chr7:476438-476483
  hypo
caaggctgcaggaaccgtctctgctggtcacgtctggagtgtgag

SEQ ID NO: 41028 - DNA, 30 bp, Homo sapiens
  chr7:494982-495012
  hypo
gggctgcagatgggacggtgccctggggac

SEQ ID NO: 41029 - DNA, 167 bp, Homo sapiens
  chr7:497742-497909
  hypo
ctgggttaagagcagcgacaactgttcctattcataccgcctggcctcaggtccacggctgcggccacagagcccatccaggaattctgctgctctcagtttacatttaaaataaatgtttccttaactcgcatctcatggccggcggtgaacggcaggaattgtga

SEQ ID NO: 41030 - DNA, 30 bp, Homo sapiens
  chr7:502286-502316
  hypo
ccgcccgcagtgggacggagccggccccac

SEQ ID NO: 41031 - DNA, 279 bp, Homo sapiens
  chr7:502708-502987
  hypo
ctgatacagcggggtcgtgggtgctctggcgggacggcccccaggcagccccgggccaggccagcccagaagggcctaggaggcagccgcgtggttaaagtgggggtgctgtttttgttgcgggatgtctgtgggtttgaacccccttgccctcatcacactggtggtgtgagccttgctcggaaagctggatttgaacgtcgtctgggtttggcgttggccctcagggcccggcgtccttccccggcgctgggacccagcctccggggagccgtgaag

SEQ ID NO: 41032 - DNA, 232 bp, Homo sapiens
  chr7:503676-503908
  hypo
cagcccgggagggagcgtgaagtggaggatctcggcaggcgtggctgtgtccaggcaggcgggtgctgccgcgtccccggctgcagggtcttggttccccggagccacaggacggcagggcttcacggctccccggaggctgggtcccagcgctggggaaggacaccgggccctgagggccaacgccaaacccagacgacgttcaaatccagctttccgagcaaggctcaca

SEQ ID NO: 41033 - DNA, 30 bp, Homo sapiens
  chr7:543015-543045
  hypo
aggctagaaaggaaacggaggccgggtcac

SEQ ID NO: 41034 - DNA, 112 bp, Homo sapiens
  chr7:551572-551684
  hypo
caccagttcagcagccggcgcaggagcacgatgcccacactgcgaattggaaattaggcgcgaccacgtttccggcaaggctcctggggacaggccccgacaagacagggcg

SEQ ID NO: 41035 - DNA, 47 bp, Homo sapiens
  chr7:551972-552019
  hypo
gcctcctggactcaccgatgcttctcttcctccgaatgggcaggggc

SEQ ID NO: 41036 - DNA, 126 bp, Homo sapiens
  chr7:578922-579048
  hypo
accacctctgggggccggtgtgaagccagactcctagccagccctgcagcctgtcccaggggccagtagaaccgggagggggccgggtgtgtaactgcctcctgaggccggcgagtagattcctga

SEQ ID NO: 41037 - DNA, 70 bp, Homo sapiens
  chr7:803490-803560
  hypo
tgccaggacctctaccgcaagcacattggtcccctcctggagcgggtgaccgcgtcgcaccttgactgga

SEQ ID NO: 41038 - DNA, 30 bp, Homo sapiens
  chr7:808547-808577
  hypo
gttctcgtggcagggcggcacttggcccaa

SEQ ID NO: 41039 - DNA, 75 bp, Homo sapiens
  chr7:819623-819698
  hypo
tgtgaggatggcagccgcctccaccttggtcacctggctgcagtgtgtcaagggtgccaacgcaaaatcctacta

SEQ ID NO: 41040 - DNA, 520 bp, Homo sapiens
  chr7:834330-834850
  hypo
cagagatgtgggatgcggaagggttccccgcagggatccaggtccgggggcaggaggagcccagagggtggcaccatcacgcaaaggcctccagaggcgtggcccgggacaagcacagcgccagccgcctgcgctgccagggcagggtccacacccacagactgtaacctggacccgggcagggcggggtccacacccacagactgtaacctggacccaggtggggtccacacccgcggactgtaacctggacctgggcagggcagggtccacacccgcggactgtaacctggacccgggcagggcggggtccacacccttggactgtaacctggacccgggcagggcggggtccgcacccgcggactgtaacctggacccgggcagggcggggtccgcacccgcggactctaacctggacccaggcagggcagggtccatccacacccacagaatctaacctggactggggcagggcctaaacccagggactctaacctggacccgggcaggggaaggg

SEQ ID NO: 41041 - DNA, 30 bp, Homo sapiens
  chr7:907656-907686
  hypo
ttcaaggctcagctccgtcttcacagcgcg

SEQ ID NO: 41042 - DNA, 59 bp, Homo sapiens
  chr7:915323-915382
  hypo
cagggaaggaccgcaggtggcctttcaaagaggaggaacgcccctcagcgatcctaaga

SEQ ID NO: 41043 - DNA, 68 bp, Homo sapiens
  chr7:959576-959644
  hypo
aggccccaccccacccgggtggcctcacctgccgagtagggctcctgcttctccgggtagatgaactc

SEQ ID NO: 41044 - DNA, 73 bp, Homo sapiens
  chr7:959899-959972
  hypo
tgtgcgttcggcccccggagcatcaggcctcacgttctgcacaagcgttcccggtggacgggctggtgcctcc

SEQ ID NO: 41045 - DNA, 44 bp, Homo sapiens
  chr7:966875-966919
  hypo
gctgcaggaggctgtcgttccaggaggctcgtgctccaggaggc

SEQ ID NO: 41046 - DNA, 60 bp, Homo sapiens
  chr7:986276-986336
  hypo
ggacccaccctgtcccggagcccactctctggggcccccaccccgcgcccctccaggctc

SEQ ID NO: 41047 - DNA, 34 bp, Homo sapiens
  chr7:1022042-1022076
  hypo
tgtgcaaagcaggcccggccgcttctgctgccag

SEQ ID NO: 41048 - DNA, 48 bp, Homo sapiens
  chr7:1022919-1022967
  hypo
ccctccccagctgcccggtggcccccggggcctcgcccgctgccgctc

SEQ ID NO: 41049 - DNA, 30 bp, Homo sapiens
  chr7:1023349-1023379
  hypo
agggcctgggcctgtcggctgcctgctcag

SEQ ID NO: 41050 - DNA, 54 bp, Homo sapiens
  chr7:1026923-1026977
  hypo
ggggacccccagggacgagggatggcgctgccacccaagcggcccaccctttgc

SEQ ID NO: 41051 - DNA, 190 bp, Homo sapiens
  chr7:1027200-1027390
  hypo
ctctggggtaggcctcggcgggggtccaggggcactgggacggctgagcgtctggtgggtgcctgatggcccagcgctccccgaccggaggcaataaagggcgtccagccaggagcaggagggaggcagccctctcaccccacagcccagcacttggcctggccagcagacctggcgcctccctgcatgt

SEQ ID NO: 41052 - DNA, 214 bp, Homo sapiens
  chr7:1030005-1030219
  hypo
tggcgcgtgtgctgggggcggtgtgatgggacacctgctgtctgagacggccctggcccccgtcccagcgctgaccatgcacgtgagcggcaggcggcccctcaccgagaagagaggataagccgtggcacattcccacctgcgccacgtgaagcggcgccccaaggccaggacgtggtggccgggacacacgggtgcacggcaggcctcacac

SEQ ID NO: 41053 - DNA, 72 bp, Homo sapiens
  chr7:1037234-1037306
  hypo
agcggccccgccccgcgctgaacccactaggagagcagctgcagcacctgtcggatgcgctgggccctcccc

SEQ ID NO: 41054 - DNA, 252 bp, Homo sapiens
  chr7:1054444-1054696
  hypo
gccacggcagcgttccggttggtgtcaccctgtcccggcctgagcccagctctcagatccgagcaccaattctgtctacagccccttcctgcctgcgggccctccctgccctgcagggacggtgcagtgagcacaggtgtgcaggctgtgcggtgagagccccagggctgggaggagcaggcagccttggtccagcaggtcctgtgtgggggccgcgttgccgggcagggcctgacacggctgctgtgggct

SEQ ID NO: 41055 - DNA, 350 bp, Homo sapiens
  chr7:1066042-1066392
  hypo
gctccctgccaggcccgtgtccttcctagctgtgagaacactaacctgcctgggcttcacctgtggaagccaccgctaactagcagtcggaggcggcgttgtttctaagacaggcaggcagctccggcaggagcagccgctaagcacaaggacggccaaccacacaaagcctgcttctcaaccactcgcaggaaatcggctcacagttgctccccattcttcaatgctgatcctgccactttactgaaaatcacattattaacgtttaaaaaacgtatgggaaccatgcaaagacatccacgcccctcagttgctgccgctccagcacctggctccgaagtctgtgcaga

SEQ ID NO: 41056 - DNA, 53 bp, Homo sapiens; identical to SEQ ID NO: 14929
  chr7:1086266-1086319
  hypo

SEQ ID NO: 41057 - DNA, 30 bp, Homo sapiens
  chr7:1115722-1115752
  hypo
cccatccatgcccagcgccttgtcaaaaac

SEQ ID NO: 41058 - DNA, 37 bp, Homo sapiens
  chr7:1303471-1303508
  hypo
ttcactccagaatggcgctgcccgtgcctgtacagac

SEQ ID NO: 41059 - DNA, 184 bp, Homo sapiens
  chr7:1308351-1308535
  hypo
ccaccctggcccttccggctgccggctggggacgcgggcgtggtgcggcaggcctgccttgattgtgtcgatgggagatgattttcaaggtgaaatttctagttcactagagtcactttcgttcaaggcgacgcacaaaatgtcatcccggcctgttccgcgtgcaacgcgctgttctcccatc

SEQ ID NO: 41060 - DNA, 30 bp, Homo sapiens
  chr7:1313980-1314010
  hypo
ggggtatgtgagccccgctggaggacagct

SEQ ID NO: 41061 - DNA, 68 bp, Homo sapiens
  chr7:1315892-1315960
  hypo
ccctggcatgatcatcgcaccggcctgcggggtcagcagccccactggctcgccggggcctgggcctg

SEQ ID NO: 41062 - DNA, 30 bp, Homo sapiens
  chr7:1318952-1318982
  hypo
gcaactctatctctacgaaaaatacaaaga

SEQ ID NO: 41063 - DNA, 298 bp, Homo sapiens
  chr7:1325643-1325941
  hypo
tcgcctggggacacacgtggtgcgtgtggcttttcagctgctcaacactcacttctgaggcccccgcggcgtggcacggcctgggcgttggatgcagcagtgaacgggacccacgcggggactcagggtatgacgggcagaggggtaggtggggtgggggcaggtgaggcgggggtgcccagcggtcagggaggggctctcgggaggtgacattcggccgagaccgagtgacggtgtggaacccgggcgcactgggaggcacgatccaggcggagggagcagccgtgccagggccctg

SEQ ID NO: 41064 - DNA, 33 bp, Homo sapiens
  chr7:1331244-1331277
  hypo
cctccagagcgggaacgccgagctccttctgag

SEQ ID NO: 41065 - DNA, 82 bp, Homo sapiens
  chr7:1333580-1333662
  hypo
gggaaggatgctcctcgccgtcataaacccgcgtgcaccgcgtcactccccgggcgccgagttccgccggcctggcacgggc

SEQ ID NO: 41066 - DNA, 83 bp, Homo sapiens
  chr7:1351523-1351606
  hypo
ggcctgctgttgtggcgtctggccgcggcccagcaccgccgtcatctgggctcagctctctctgtccgcggggctgtctccct

SEQ ID NO: 41067 - DNA, 34 bp, Homo sapiens
  chr7:1363593-1363627
  hypo
gggcggcaggtaccccgtccggtagcgcgaagcc

SEQ ID NO: 41068 - DNA, 144 bp, Homo sapiens
  chr7:1365367-1365511
  hypo
tggtgtggcccagggcgtgggtaccagggccccccatgcaggtcagtgtgaggccagctgcgatgcgcgatgcactgccctccgccccatccaggtgccccaagggtacggccggcatttaagggccctcgcttcctgggggtg

SEQ ID NO: 41069 - DNA, 81 bp, Homo sapiens
  chr7:1368971-1369052
  hypo
tagaccaggcccacccggctaaccagggtcatttcctggacctaaagtcgccggaccgtaggtgtccgccgtatctacagg

SEQ ID NO: 41070 - DNA, 61 bp, Homo sapiens
  chr7:1384815-1384876
  hypo
ttctggataggggcacggtggatgggcaggctgcgccgggctgatccgctgtgaacagcgg

SEQ ID NO: 41071 - DNA, 185 bp, Homo sapiens
  chr7:1395730-1395915
  hypo
ctccttgctgcctcccgccttgtcctcaacagccctgaagtccgtcctccactcagcttctcaggtggttctcaaaggttaacacaaccatgtccctcctgctccaaaccctccatggctcctgagtgcccctggaatagagcccaggctcctccgggatctgcaggtgccgcctgcctctgcca

SEQ ID NO: 41072 - DNA, 200 bp, Homo sapiens
  chr7:1416020-1416220
  hypo
gtggtgggttcgggacgttcaccgcagtgttgtttgtaacagccaaaggctggaaatcagctggcagcccatcagaggacttgggtaagtaaatggcggccatccaccagcagggcatcgtgcaggcactaaactcaatgctacaggagaattcctcgtggcacaggaaaggtctcatcgtataccgttgcgggaaaagg

SEQ ID NO: 41073 - DNA, 30 bp, Homo sapiens
  chr7:1423606-1423636
  hypo
ttgctgccttccccccgcccagtccctgct

SEQ ID NO: 41074 - DNA, 79 bp, Homo sapiens
  chr7:1451244-1451323
  hypo
tcttttctgctggggcgcccggcgggccctgcctgtggttcgccctgtgtgcgggcggtgtgggcgtctttgccgcagg

SEQ ID NO: 41075 - DNA, 30 bp, Homo sapiens
  chr7:1453817-1453847
  hypo
gtggggaggccttgccgggggccctggggc

SEQ ID NO: 41076 - DNA, 121 bp, Homo sapiens
  chr7:1458959-1459080
  hypo
cagctcccataaccccgtctcctcctcctcctcgccctcctcctcctcgctgtctctgcaccacttccacctgcccgggcctttgcacctgcaggttcgtaccctacggggtgtgccctgc

SEQ ID NO: 41077 - DNA, 63 bp, Homo sapiens
  chr7:1460807-1460870
  hypo
ggactgtgcagaaggcggctctgtgcctcggaaggcagggtgcagaggcgtgcagcgctcacc

SEQ ID NO: 41078 - DNA, 30 bp, Homo sapiens
  chr7:1503320-1503350
  hypo
catggcctgaggcatcgctcatttcagtcc

SEQ ID NO: 41079 - DNA, 201 bp, Homo sapiens
  chr7:1503566-1503767
  hypo
cgggaatgcagagggcgtgagagagaaccaagggaggtgtcctggccgagtggtgtttcccgcgggacttctcagagccttcatcacctgatacgcacctccactcttccagggagaggacacactgcacagtggttcccaaactgacttgcccacaggacccctgtggacggttgtggggcaccacgtcagcccccctgc

SEQ ID NO: 41080 - DNA, 63 bp, Homo sapiens
  chr7:1516637-1516700
  hypo
agccactcagagagccgaggcttggggtgctgccggtaacaccggccccgtcatggtgctgga

SEQ ID NO: 41081 - DNA, 42 bp, Homo sapiens
  chr7:1532979-1533021
  hypo
gtagggaggtgaggacgggggtgtggccggcagggtggggac

SEQ ID NO: 41082 - DNA, 197 bp, Homo sapiens
  chr7:1547262-1547459
  hypo
gggcaggaccacaggcgttccgtcatcctgggggggtgtgcagggtctgccctgtgctcttcatcggcgtctccctgatgagtaatgatgagcgttttctcatctttttttgtcatccgtgtatctgcattattggtgtctgttcaaattgtttgctcactttttgaaaatattttttatggccaggcgcgatggct

SEQ ID NO: 41083 - DNA, 58 bp, Homo sapiens
  chr7:1598639-1598697
  hypo
agtcgggaggttgaccgctctgccacctgctcacagggctcgccggctgatcgaggcc

SEQ ID NO: 41084 - DNA, 30 bp, Homo sapiens; identical to SEQ ID NO: 14938
  chr7:1598982-1599012
  hypo

SEQ ID NO: 41085 - DNA, 159 bp, Homo sapiens
  chr7:1600538-1600697
  hypo
tgggtacagctggcacggaccacaccctccaccttcccccctgcccggattttgggacccacatctgtccacgtgccacccctgcctcctgccatcccagcgggtgtgagcctggaccaatctccctgtccggtggatttcagacgtgggaccacaagt

SEQ ID NO: 41086 - DNA, 30 bp, Homo sapiens
  chr7:1607585-1607615
  hypo
cacaccaccattaaccgccacataagtcca

SEQ ID NO: 41087 - DNA, 30 bp, Homo sapiens; identical to SEQ ID NO: 14939
  chr7:1607971-1608001
  hypo

SEQ ID NO: 41088 - DNA, 73 bp, Homo sapiens
  chr7:1624815-1624888
  hypo
gggtgccaccaggcacgacttcctaaacacccacagagcaaaaacctggaaattcagccgaggcactgggacc

SEQ ID NO: 41089 - DNA, 249 bp, Homo sapiens
  chr7:1641708-1641957
  hypo
ctcgggatgcacctccgcactgtggggccatctgggtcagcccggacgcaccggcctctgtctgggtcccagtcttctcaccgccaggcgggcaggtcagcagaccaggcaggaccgagcccgtcgcccggggctcttgttgtctgtgccatttcggtgccttttgtccttgcttcccgccgctccttgaggatgtttaccggctgctggggccgtgccttccaggtgaggcctcggtcattccaggtg

SEQ ID NO: 41090 - DNA, 30 bp, Homo sapiens
  chr7:1680203-1680233
  hypo
tggcagcagagccagcgcgctgcagccctc

SEQ ID NO: 41091 - DNA, 30 bp, Homo sapiens
  chr7:1681209-1681239
  hypo
cccagctctttccatcgcattgccatggtt

SEQ ID NO: 41092 - DNA, 100 bp, Homo sapiens
  chr7:1684968-1685068
  hypo
caggctgatgggctccgggaacagcacgttctctctgattcttctttccaatgctccattgtgtggggacaaagccgagaagctccggttccccaggggt

SEQ ID NO: 41093 - DNA, 158 bp, Homo sapiens
  chr7:1688950-1689108
  hypo
cctccctggatctcacgtcctcatttggcaaacagggatagtcgtgatccctcccttagggccggtgcttggaaagaatgaacgaacatgggtaaggtgtgcctggtgagcgctgtctgggctgaaggaggagtttgagaaggcggctttatgaaggg

SEQ ID NO: 41094 - DNA, 65 bp, Homo sapiens
  chr7:1694007-1694072
  hypo
gctgtttgctgagggcgtgctttgaggaagagcatacccgggttccaaagcgcctacagtgaaca

SEQ ID NO: 41095 - DNA, 34 bp, Homo sapiens
  chr7:1694952-1694986
  hypo
ccggggctacacacccgcacggcaggtgactgca

SEQ ID NO: 41096 - DNA, 50 bp, Homo sapiens
  chr7:1714947-1714997
  hypo
tggcggccgagggctcgggggcgggggtctgtccacgtgacaggtgcaca

SEQ ID NO: 41097 - DNA, 57 bp, Homo sapiens
  chr7:1718027-1718084
  hypo
gttgtgggtaaggcccgcgccactgggaatcttcacacagcccggagggaggtgctg

SEQ ID NO: 41098 - DNA, 206 bp, Homo sapiens
  chr7:1731744-1731950
  hypo
gctatttcctgccttcgtgaccttcgacgagacactttttgctgctgggcctcagtttctccactttcactgtggtctgtgtgccaagtagcactcctatttttagaagcagaagctggttataaactgcacagatctgtctggcctgccctgccaaggccggattgccagagggttctgtgagtaccgatcgtggctgcagggac

SEQ ID NO: 41099 - DNA, 271 bp, Homo sapiens
  chr7:1733166-1733437
  hypo
gcaagaacacatacacgcctgtggacgtagccttgctgggtgtgtgcacatctgcagaggggtcggtgtacaccgctgtgtgaacacctccggcggtgcccagtccgtgtgaacacatgcaggtgagcacagacacatgcgtgcatgccctctgtgtgtctacagacagctgtgtgcgccacactcaccctcccgctcgtccccatggcaaccccagagcaggtgtctgggagaccctgatcagtgctgacagacacggggtgcgggacac

SEQ ID NO: 41100 - DNA, 286 bp, Homo sapiens
  chr7:1734709-1734995
  hypo
acggctccggatgcacgtggctgtgccaggcagcagacgtggccgacaggcacatggtgggacctgctctgtggctccagagctcatgcgcagcccgctggggctgtgagggttctgtccatccaccaggaaggccaccaggaccctgctcctgcctgagaaccccaggaagtagtagcgtgccaggtgcgtggccggcctcccagcccttcccagcaccagctgcgtcctcctcctccagggctgcagctcagggctcaggtgtccgcgtcgagggcactcccta

SEQ ID NO: 41101 - DNA, 210 bp, Homo sapiens
  chr7:1775651-1775861
  hypo
cagcaggtgcacaggcgggccccccacctgctcctagctgggccgggtcaccgtggcaggccttgcggctcgaggcccaactgccctgatatgcctatcacagcctcatgggctctgcggcagagcccagggagacagacagggcgagagccaagctgcagaggcaggcagacgttagcagtaaacatgatctatcggcaaaacattgga

SEQ ID NO: 41102 - DNA, 30 bp, Homo sapiens
  chr7:1779654-1779684
  hypo
gagccacaggggacccgtggccaccctgtt

SEQ ID NO: 41103 - DNA, 90 bp, Homo sapiens
  chr7:1783212-1783302
  hypo
gccagggacacagggcgggcgagctcagaccgagacctggcagacacgagtccccggacaggccagaatacctcccggtgcctccctccc

SEQ ID NO: 41104 - DNA, 69 bp, Homo sapiens
  chr7:1784330-1784399
  hypo
gggcgacaagggcttcgtgtggctggccatctgcagccagaaccaacccccctacgaggccatcccaca

SEQ ID NO: 41105 - DNA, 186 bp, Homo sapiens
  chr7:1784690-1784876
  hypo
ggagtgtcccaacatcgtcaacatcgacctgtccatgaaccgcatccagcagctcaacagcggcaccttcgccggcctggccaagctgtcggtgtgcgagctctacagcaaccccttctactgctcctgcgagctgctgggcttcctgcgctggctggccgccttcaccaacgccacacagacgta

SEQ ID NO: 41106 - DNA, 489 bp, Homo sapiens
  chr7:1786410-1786899
  hypo
cacgagggcctggggcgcaaggcgtccatcctggagccactcacccggccgcggccccgcgacctcgcctactcgcagctgtccccgcagtaccacagcctgagctactcctccagccccgagtacacctgccgggcctcccagagcatctgggagcgcttcagactgagccgccggcggcacaaggaggaagaggagttcatggccgcgggccatgccctgcgcaagaaggttcagttcgccaaagacgaggatctgcacgacatcctggactactggaagggcgtgtcggcccagcacaagtcctgagccccccaagaccggcgatgcccactggaccaaaaaggatgcaggatccacccagagactcagcaccaaacccaacacacgcacgccaccacagcaactgtgacagcggggggccctgcagaggcgaggggggagcgagtggggacagacaagggggacacgtcccgagctcctgtggcc

SEQ ID NO: 41107 - DNA, 267 bp, Homo sapiens
  chr7:1787152-1787419
  hypo
cgtggggggtgtggccggcgtggccacctcggggcccctcacgtgatctcctcggtccgtggttttctgtggattctctgtccagtccgtctcttcattgccgcctccggagtccactgcagaggggcagagtgaatgccggcggccaagtggcctccgggacaggtcctggagccctgctggactcagggtgggtggaggctgtgcctgtggacggccggggtggccaggacggccaagggctgggaggcacgtcccccagcccag

SEQ ID NO: 41108 - DNA, 30 bp, Homo sapiens
  chr7:1795180-1795210
  hypo
taagtccaaagtgttcgtgattcttccttt

SEQ ID NO: 41109 - DNA, 30 bp, Homo sapiens
  chr7:1800882-1800912
  hypo
ccagagactaaacgccggcagcggtgaaga

SEQ ID NO: 41110 - DNA, 30 bp, Homo sapiens
  chr7:1838908-1838938
  hypo
gaggacatggaggaccggcattcccaaaca

SEQ ID NO: 41111 - DNA, 42 bp, Homo sapiens
  chr7:1849747-1849789
  hypo
gccaggactgtcaggcgccagctccctcggtgaacgtgacaa

SEQ ID NO: 41112 - DNA, 53 bp, Homo sapiens
  chr7:1931869-1931922
  hypo
tgcggcccaagggtgcgggaggctgcacggcccaggctcgtacaagtcattct

SEQ ID NO: 41113 - DNA, 138 bp, Homo sapiens
  chr7:1962373-1962511
  hypo
ctgcggtgagctgcacggtttctgcagatgctctttggcaaacttgggggttctcggcttctcctggtttgccgagtttccccatgaacgtgtgttgggcctcgctgactgcatttgtgcatccgttggtttggccat

SEQ ID NO: 41114 - DNA, 30 bp, Homo sapiens
  chr7:2024812-2024842
  hypo
ctcagcagacggccccgggcagcatgggta

SEQ ID NO: 41115 - DNA, 113 bp, Homo sapiens
  chr7:2056573-2056686
  hypo
gacgccgcgcaaggccggggcgggggacttcccttggtaaacaagctgtaattgtctcttttattgatcagtaaatctctgagagcttctcttcgtgacggctctcttcagcc

SEQ ID NO: 41116 - DNA, 104 bp, Homo sapiens
  chr7:2110154-2110258
  hypo
gaagagaggccacaccggggagggtgcgagtccgcggagggagggcccatccctactcagacagcccaggcaggcgcagagcggaacggcgctggaacacggga

SEQ ID NO: 41117 - DNA, 65 bp, Homo sapiens
  chr7:2163332-2163397
  hypo
tttcagagtgcacttcgcaggcggcgctgaatcgatagatcctccggcggcgtggtgctgcaggt

SEQ ID NO: 41118 - DNA, 135 bp, Homo sapiens
  chr7:2206533-2206668
  hypo
ctgggcggcgcactccgctcacaaagcactcttccaggaagggccccgggctgctggagactgaaccggaatctgcctaactggtggaatccccttttacaaagaagtgcctgtagctcacggggctagaaccca

SEQ ID NO: 41119 - DNA, 30 bp, Homo sapiens
  chr7:2208778-2208808
  hypo
ggcagaaaggacattcgggacctatgacgc

SEQ ID NO: 41120 - DNA, 132 bp, Homo sapiens
  chr7:2232918-2233050
  hypo
agggccacccagctccgacagccaccacgtcctggagagaaagcgtccccgcccagaggacggtccttgtcctagaacagcaaggccctccaactcttggtcctcaaagcccttccccgcctccgcacccag

SEQ ID NO: 41121 - DNA, 96 bp, Homo sapiens
  chr7:2233318-2233414
  hypo
aactccagattcctccggaaaacctcactgtgcactgccaaggctccagccagagcaggtgctgagccgcgatccgggagacgccagtctcaccct

SEQ ID NO: 41122 - DNA, 154 bp, Homo sapiens
  chr7:2238153-2238307
  hypo
ggagcccgtgatggccgtccacccgggacagcaatcgcgctctgcggcacgaggctttcaacagaggcgagtgcttcctgggggtcaagagcatggaacacacacttcaggccccctctccaggctgcaggccaacaggcgtccatgagacaga

SEQ ID NO: 41123 - DNA, 85 bp, Homo sapiens
  chr7:2265530-2265615
  hypo
aaaaatcaatgcagtcggccaggacatgttctcacgtggagctcagagatggagaatgaggtctccttcccgactggctgccagc

SEQ ID NO: 41124 - DNA, 16 bp, Homo sapiens
  chr7:2300787-2300803
  hypo
ctgggcacagaggctc

SEQ ID NO: 41125 - DNA, 30 bp, Homo sapiens
  chr7:2349402-2349432
  hypo
atgaattctgaccaacgtattcacacagag

SEQ ID NO: 41126 - DNA, 83 bp, Homo sapiens
  chr7:2420313-2420396
  hypo
cgtgcaggttgtggccggttttctccgcaggttgaacatggaaataaaagcaaacttgtatgaaaaaccggtctttctcctct

SEQ ID NO: 41127 - DNA, 30 bp, Homo sapiens
  chr7:2480354-2480384
  hypo
caagaagaatgccgccgctcaggtttatct

SEQ ID NO: 41128 - DNA, 30 bp, Homo sapiens
  chr7:2499688-2499718
  hypo
ccgtgcctcggacaccggcctctgcagctt

SEQ ID NO: 41129 - DNA, 38 bp, Homo sapiens
  chr7:2544589-2544627
  hypo
aagaggcggaggaaccggctgtgcgggacacctgagcc

SEQ ID NO: 41130 - DNA, 194 bp, Homo sapiens
  chr7:2564711-2564905
  hypo
gggtgggggaggctacggccgccgggcccagcttgaactagggggcttttctcgagcccctgggccctgtggcgtcccccaggccaggcccctctctgggagccggctcagacctactcacagccgctcccctgtccacaggcaacgtggtcatcacaaactgctcggccgcccacagccgccaggcgctgtcc

SEQ ID NO: 41131 - DNA, 186 bp, Homo sapiens
  chr7:2566041-2566227
  hypo
aggtgcaccatcctccgggccccgccaggactccgagagcacaggaagggacgtgtggctgccgagaggggcgcagtggggtggggcactgttctaaacagggaggccaggcagcactccactgtcagccagggggggtcactcctgccatgagctcaaagctgtttatggcgggttgttttcctg

SEQ ID NO: 41132 - DNA, 171 bp, Homo sapiens
  chr7:2566487-2566658
  hypo
atgtttgaaaacaagcggaacgccgtccacgtgaaggggcccttctcggtggaggccgacccatccaggtaaggaaaccccggcccagatgggcttgcgtagggtggcctaggggcgtcagggggcctcgtggagctgcagcagggtctctctaagcggcatgactctaca

SEQ ID NO: 41133 - DNA, 372 bp, Homo sapiens
  chr7:2686448-2686820
  hypo
ggtccacccctccagcgccgcttcctgcctgccctcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcaggtgagcgcggtggggcggggacggagggcggggccagagggggcggcccgagggggcggggctggagtggggtgtgtgtgggtgggcggggctacatctcacgggcccgccctctccagcgccggcatcgcagtgggattctacggcaacggggagaccagtga

SEQ ID NO: 41134 - DNA, 54 bp, Homo sapiens
  chr7:2700087-2700141
  hypo
acgtgccggcgagcacgtgagcttctcccgctggccccacggtggtgcgggtgc

SEQ ID NO: 41135 - DNA, 182 bp, Homo sapiens
  chr7:2718487-2718669
  hypo
tttagcctcaggattcgactccgagcctcttgcgagaccacgtcttgggcagcatcgtagacccggctgtgagcacagagtggctcttccagaaagtttgttgaatgactgactaagtcagcccctgtgccaggcagcccagagggaccagcccagagcctccttctcggggtgcaagcctg

SEQ ID NO: 41136 - DNA, 30 bp, Homo sapiens
  chr7:2720013-2720043
  hypo
aggcactggagaccccgggagaccccggat

SEQ ID NO: 41137 - DNA, 28 bp, Homo sapiens
  chr7:2731870-2731898
  hypo
gggttgaaagaggaccgagcttggccgg

SEQ ID NO: 41138 - DNA, 30 bp, Homo sapiens
  chr7:2747171-2747201
  hypo
tccacactcatgctccggggaaccatgcta

SEQ ID NO: 41139 - DNA, 35 bp, Homo sapiens; identical to SEQ ID NO: 14955
  chr7:2798456-2798491
  hypo

SEQ ID NO: 41140 - DNA, 30 bp, Homo sapiens
  chr7:2916072-2916102
  hypo
ggcttcccagcggggcgctgcctgaggccc

SEQ ID NO: 41141 - DNA, 180 bp, Homo sapiens
  chr7:2923749-2923929
  hypo
acacagcaagggagtcgggaagttggaaggaggaggatgtggaagacgcagtttgctcctgggtcctcagaaaggaggctgggtgtcaaattctacccttaggaattttagtgagcaggcggtgcctttgtgcatagaaaaagatgccccatcctctgggtggcccggcccagcaccagg

SEQ ID NO: 41142 - DNA, 30 bp, Homo sapiens
  chr7:2958507-2958537
  hypo
gatgatgcttgccttcgaggactggcctga

SEQ ID NO: 41143 - DNA, 73 bp, Homo sapiens
  chr7:2966469-2966542
  hypo
gtgtgtgtgtgcacacgcaggcaagggagagagaagcttctggaaggttccaggcttccgagtggccttgctt

SEQ ID NO: 41144 - DNA, 30 bp, Homo sapiens
  chr7:2976839-2976869
  hypo
gtctgagcttcatctcgggagtggaaggcc

SEQ ID NO: 41145 - DNA, 46 bp, Homo sapiens
  chr7:3026293-3026339
  hypo
cctcactcaaagtgtcgcccatcggccgcagcgtcagcaggtgctt

SEQ ID NO: 41146 - DNA, 321 bp, Homo sapiens
  chr7:3033477-3033798
  hypo
gtctcccttctagctcgccaaatgctcagggttcctatattttaaaaaatcttgtcccatcaaactctgctttcaggaatggcacgaagagccgacacgcacggtgagcagctgccttctgcagatggaacgcctcacctgggacgcctcacctgggacgcctcacctgggacgcaggcgttcctgttcctagtcacgccctgagccctggattcctgcccaagctcacatagcagggactggcccagccccattcactcatgcatgtctgaccccaaggcagggctggtggcctctaaatcctcccgctagggtttcagc

SEQ ID NO: 41147 - DNA, 396 bp, Homo sapiens
  chr7:3283498-3283894
  hypo
aatggagaaacagcccagagaggaaaagcgatttgcacagagtcacgcagctgaagactggcagatccaggctgtttgctgtcagtctgagctctcgaattctaagacgagccacttctctcgggaagccaggaaggctcctcgcaaatcctggtggagaagtggttacctcaaagccctttaagcacagtcataaacttaccttgaagggccaggtaatccgatcatagagtcggcgttcaaaaaaaaaatgaggtattgatatgtttatcctcaccctcataacctgttctattcaaataaattcagtgtgctcagttctgcagggagtgacagagctgccccgaatcagatggtgccacgcacatcccatttctcttgcgggatcattcctgg

SEQ ID NO: 41148 - DNA, 38 bp, Homo sapiens
  chr7:3727142-3727180
  hypo
atctgtaatgtgggacgctgcttcgcactgaaaaggtg

SEQ ID NO: 41149 - DNA, 34 bp, Homo sapiens
  chr7:4096353-4096387
  hypo
acgctgcaccccacacgcccgagcccagagcagc

SEQ ID NO: 41150 - DNA, 30 bp, Homo sapiens
  chr7:4187836-4187866
  hypo
gctgatgaagtgagacgggagccctcctcc

SEQ ID NO: 41151 - DNA, 93 bp, Homo sapiens
  chr7:4214921-4215014
  hypo
ctccctgggctctgtcgcaaaatcaaaacagcacagtagaagggccccgggatgcggctgggcttacgcacctggtcgcgcagctctccctga

SEQ ID NO: 41152 - DNA, 30 bp, Homo sapiens
  chr7:4260867-4260897
  hypo
caggatccccgggctcgcctagagatgtcc

SEQ ID NO: 41153 - DNA, 30 bp, Homo sapiens
  chr7:4275488-4275518
  hypo
cagggtgtcctgccccgtatgagagtcctc

SEQ ID NO: 41154 - DNA, 86 bp, Homo sapiens
  chr7:4342691-4342777
  hypo
ttccaacccactgtgtctctgctcttctgtgcaaacaatcccagcaccaggaaggagccagccctgccccccgctgcggccctctc

SEQ ID NO: 41155 - DNA, 73 bp, Homo sapiens
  chr7:4751426-4751499
  hypo
accgtagagaagcaacgcaaggtcagagagaaaagattgcggccggccggtgtcaaggcgggggacctgtgag

SEQ ID NO: 41156 - DNA, 30 bp, Homo sapiens
  chr7:4771572-4771602
  hypo
aggccacacggaggccgggctggccagggc

SEQ ID NO: 41157 - DNA, 90 bp, Homo sapiens
  chr7:4781955-4782045
  hypo
ctccctgctgatctgcgcactctgctgaaccccggccgcaccttggcttgcttttttctttttttcctcttgcagctgtaggagaagaaa

SEQ ID NO: 41158 - DNA, 87 bp, Homo sapiens; identical to SEQ ID NO: 14961
  chr7:4813783-4813870
  hypo

SEQ ID NO: 41159 - DNA, 114 bp, Homo sapiens
  chr7:4839337-4839451
  hypo
cgctgcggggctgcccgggagcagggtctggatgtagagcccgggggcgcccaggtgcgtgtgctggggacaagcagaggcctcagagctccgcaggcccgactggctgtcccc

SEQ ID NO: 41160 - DNA, 175 bp, Homo sapiens
  chr7:4840176-4840351
  hypo
cagtcccaggacactcgcccctctgggggcggctgttttccagctccagggacccacgcggttctgtgccacctcctcagcaatctctgctcctcctcctcctccctccacacccagatgtggccatgtgcaccctgagggttcccaccgctgaccagaccggggccccaggccc

SEQ ID NO: 41161 - DNA, 30 bp, Homo sapiens
  chr7:4840692-4840722
  hypo
gcatgcccatgcacacgtgcacttacaccc

SEQ ID NO: 41162 - DNA, 104 bp, Homo sapiens
  chr7:4841057-4841161
  hypo
agtatctgcccaagacgtgtcagcgactgagcgaccgtgtggcccagctgctgggggctgagcagccctgagccctctccatctggccccgtctcaggttgcag

SEQ ID NO: 41163 - DNA, 205 bp, Homo sapiens
  chr7:4856843-4857048
  hypo
tgcagaagcagagcccgtccgtgcaccttggagacatagtagacgcactgctggaaggcgtacagcaccacctcctccagcaccgccatggcctcctcgctggccgtcagcgtgcaggagaacagcgattccttcgagcctgccgggagacagccacgccaatggtcacaacgggcacagcgctcaggaacgcagcaactcagcc

SEQ ID NO: 41164 - DNA, 144 bp, Homo sapiens
  chr7:4858153-4858297
  hypo
cagctggagggaccccggggtccggggcagtaaggggctctcgggctctgccaacctcaacactgtgcccagaagcctccaggcctgtggagacacacaaggtggcccgacggcgcccacagcgagtgccggcaaaggatattc

SEQ ID NO: 41165 - DNA, 59 bp, Homo sapiens
  chr7:4875008-4875067
  hypo
acaccagaaccccgacggctctcaggaacccgcccctcgatgtccgggcccatcccaga

SEQ ID NO: 41166 - DNA, 30 bp, Homo sapiens
  chr7:4876594-4876624
  hypo
atagcgcccatgtcccgggtccttctgagt

SEQ ID NO: 41167 - DNA, 111 bp, Homo sapiens
  chr7:4918378-4918489
  hypo
ctggaaagtgctgggcgcagcgcccgtgtgcagtgagcatcaaggagcgccccacccggagccggccccagcaccatcacagccacagaagagcagcgggcagcccaaggg

SEQ ID NO: 41168 - DNA, 39 bp, Homo sapiens
  chr7:4931853-4931892
  hypo
tatttcaaaacatcacgccatagacgataaatacaaaca

SEQ ID NO: 41169 - DNA, 22 bp, Homo sapiens
  chr7:4985877-4985899
  hypo
cccaccccgtgcacacaatccc

SEQ ID NO: 41170 - DNA, 30 bp, Homo sapiens; identical to SEQ ID NO: 14965
  chr7:5316401-5316431
  hypo

SEQ ID NO: 41171 - DNA, 30 bp, Homo sapiens
  chr7:5342905-5342935
  hypo
aggacagcagacacccgccagagtgtgcgc

SEQ ID NO: 41172 - DNA, 30 bp, Homo sapiens
  chr7:5343856-5343886
  hypo
ttggtttgtgggcagcgctgggtagtgggg

SEQ ID NO: 41173 - DNA, 142 bp, Homo sapiens
  chr7:5441304-5441446
  hypo
tttacaaaaacaagacgtgggccacatttggctagactgctcaccccagcattactaggtatgctacgagttattttttattcctagtcctatgctgcacatcggaggtactcaagtagtatttacggtaggaactgggcac

SEQ ID NO: 41174 - DNA, 116 bp, Homo sapiens
  chr7:5529839-5529955
  hypo
ccacctgcagggacacgaacactcagggcgttcatgtcctgctgcccccttggccgggcgcacgcctctctcaggagccctgatcactccagcagtcagcccgtcctcctgagagg

SEQ ID NO: 41175 - DNA, 34 bp, Homo sapiens
  chr7:5589502-5589536
  hypo
agtaagtgaagaggccgggcgcggtggctcacgc

SEQ ID NO: 41176 - DNA, 30 bp, Homo sapiens
  chr7:5626228-5626258
  hypo
cagaggcaggaggaccgttcaagactgagg

SEQ ID NO: 41177 - DNA, 30 bp, Homo sapiens
  chr7:5629903-5629933
  hypo
ctcgtgccacgccctcgtaccaaggtggct

SEQ ID NO: 41178 - DNA, 201 bp, Homo sapiens
  chr7:5647869-5648070
  hypo
gtcccaggtgagatgcgggtcgagggagccaggccacggttctccagactcgcgtggaggccacgagcgtcttctggaggagcgggcactgcgcggaccggcagactctggggcgctcaggctccccatctcctgaccttttcctaccttcagttccctcctgtcaggacaggttctggggctcgccggggcagggagcca

SEQ ID NO: 41179 - DNA, 56 bp, Homo sapiens; identical to SEQ ID NO: 14968
  chr7:5648363-5648419
  hypo

SEQ ID NO: 41180 - DNA, 56 bp, Homo sapiens
  chr7:6060716-6060772
  hypo
gcactcagagccccacgagttaacaccaagggcgtcaaagtcgtctacttgccccc

SEQ ID NO: 41181 - DNA, 37 bp, Homo sapiens
  chr7:6099217-6099254
  hypo
tatgccacaaaaaaacgggagatgccgccgggcgcgg

SEQ ID NO: 41182 - DNA, 94 bp, Homo sapiens
  chr7:6124620-6124714
  hypo
attacaggtgcgagccaccgcacccagccaaggactcttaagtgtaactgatccaccctacttttctccctggcatgaacgactgtgcccagcc

SEQ ID NO: 41183 - DNA, 36 bp, Homo sapiens
  chr7:6143243-6143279
  hypo
gcatcaggtcttgggcggtggctccggagtgtaatc

SEQ ID NO: 41184 - DNA, 64 bp, Homo sapiens
  chr7:6241990-6242054
  hypo
agctgaatatgacaacgtgggtgaacccagacaagagcagcacgtgaaccgccagccaacttgg

SEQ ID NO: 41185 - DNA, 157 bp, Homo sapiens
  chr7:6443279-6443436
  hypo
gtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaa

SEQ ID NO: 41186 - DNA, 34 bp, Homo sapiens
  chr7:6443956-6443990
  hypo
tccagaggctgagtgcgtggcttacgcctctaag

SEQ ID NO: 41187 - DNA, 93 bp, Homo sapiens
  chr7:6444050-6444143
  hypo
ctggacaagaaagagacctacccaaaaaaaaaatgcaagagcctgaacttgtactacataaaggttcatgttagaattcgttttcttaatatt

SEQ ID NO: 41188 - DNA, 273 bp, Homo sapiens
  chr7:6499118-6499391
  hypo
atatgtactatgttacgctgcaaatggcttttaaagtgcagggacaaaaggaattgtttcaaaactggagaaacacccacagcacttccagcagattccaggctacagattccagttaacccagatagttgtgaggatggctgggtggtacgaggacagaggcacacagaaaacacccacgcagatccaatcaagctagcctcagatgggtggctgcttttggaaggtaccaaggagtcaatttctttcttttttttttttttttttttgaga

SEQ ID NO: 41189 - DNA, 38 bp, Homo sapiens
  chr7:6524573-6524611
  hypo
aggtagaaaagtgaacgtctgaccgggcgcggtggctc

SEQ ID NO: 41190 - DNA, 180 bp, Homo sapiens
  chr7:6524911-6525091
  hypo
ttgaatatttctacgggatggggacgtcacaagaaattgcaaacaaaaaaagctgacaaacaggatctgctacataatttgcgggacggagtgcaaaacaaaaacgcacagttcgcagttcaaaaagcagggcgggggcgaggacctggtgcggtggctcatgcctgtagtcccaacact

SEQ ID NO: 41191 - DNA, 166 bp, Homo sapiens
  chr7:6545837-6546003
  hypo
caagtaaggggctaccggaggtggctcaggggtctggctctgtcatcaggtctccttggagagcggtgagttcaccagggctgccctgggcagagtgagctggtgctgagagaactgcaactgtgacagcctaggggccagacgctggacacgtggctgtgatgaa

SEQ ID NO: 41192 - DNA, 228 bp, Homo sapiens
  chr7:6560173-6560401
  hypo
agggcagggccccaccgcggctttggcccggccacctgtgctggaagaagctctcgagggcccggcagaccccatagcgctcaggaggtgtgagtaggtgctccagctgctggctgaaggtcctcccttggacccggatgctggacggcaggatctccgccacccactgcagggaggtgagcgccgacgacgggttgggtgagtccagagaatcggagtctgctggga

SEQ ID NO: 41193 - DNA, 30 bp, Homo sapiens; identical to SEQ ID NO: 14975
  chr7:7102938-7102968
  hypo

SEQ ID NO: 41194 - DNA, 30 bp, Homo sapiens
  chr7:7105800-7105830
  hypo
cccagtatcgaagggcgtgtaccccctctc

SEQ ID NO: 41195 - DNA, 61 bp, Homo sapiens
  chr7:7109343-7109404
  hypo
caaggggggagatgacgttgctcccagagtcgcagagagtgtaacccgtctgtgatattgc

SEQ ID NO: 41196 - DNA, 52 bp, Homo sapiens
  chr7:7111788-7111840
  hypo
tacttttaataatatcgtaaggggtgtaccccctctgcgagattcttcgtaa

SEQ ID NO: 41197 - DNA, 42 bp, Homo sapiens
  chr7:7113636-7113678
  hypo
ctctgtgatattattcgtaacaatatccacgggaggagatga

SEQ ID NO: 41198 - DNA, 279 bp, Homo sapiens
  chr7:7605145-7605424
  hypo
atctgaagactgcctcgaggtcagactcgtgacacctgaggcagcaccattcactcagttttgggaacaaaaaacttggaatcctctttcaccgtcattcacttggtcagtcaccaagctctgttcatcccgccttctaagtattccccagggcccccacttctctccatgcccactctccgtgccactggtaacctgcgtttctatcatccctcattctgatactctatccctccagctctctgcgcaaaaactgatcatactggccgggcacagtgg

SEQ ID NO: 41199 - DNA, 158 bp, Homo sapiens
  chr7:7605664-7605822
  hypo
ggcgatatagccagactccgtctcaaaaaaaacaaaacaaaacaaaaaactgatcataccacttgcctgattaaaaactttcgatgactctaacattgcctttaggtaaatgccatccaaactcactaaactggtttccaacccgtttctgaaagcac

SEQ ID NO: 41200 - DNA, 32 bp, Homo sapiens
  chr7:8391330-8391362
  hypo
aaacttaggattgggcggggggtgggggagga

SEQ ID NO: 41201 - DNA, 23 bp, Homo sapiens
  chr7:10730863-10730886
  hypo
aaacatttgggaggccgggtgcg

SEQ ID NO: 41202 - DNA, 37 bp, Homo sapiens
  chr7:10819400-10819437
  hypo
cggcctctgaggccacggaccacgctgccccatgctc

SEQ ID NO: 41203 - DNA, 30 bp, Homo sapiens
  chr7:10929379-10929409
  hypo
cttgcccaactctgacgctcatcaagagtt

SEQ ID NO: 41204 - DNA, 37 bp, Homo sapiens
  chr7:12776917-12776954
  hypo
ggattacagccatgagtcactgcgcctggccagtgtt

SEQ ID NO: 41205 - DNA, 43 bp, Homo sapiens
  chr7:16566510-16566553
  hypo
tctcttcggtgccaccggcgggcgaggccggattaatcaccgc

SEQ ID NO: 41206 - DNA, 180 bp, Homo sapiens
  chr7:16844151-16844331
  hypo
tccaagcgggcaatccgagctgaggtgtcatagtggagaagcctatggggctttgctttagcccgtgggaaagaaagctttagatggtgactgagacgaaaatccctggaccctgtcccaggcttgaaaaatcctaggattcacctactcttggaaattttgtttcgcaaaagagaaagc

SEQ ID NO: 41207 - DNA, 27 bp, Homo sapiens
  chr7:17413241-17413268
  hypo
tgtgagccgccgcgcccaaccgcaaag

SEQ ID NO: 41208 - DNA, 24 bp, Homo sapiens
  chr7:20710238-20710262
  hypo
aagaagcaagctggccgggtgcgg

SEQ ID NO: 41209 - DNA, 18 bp, Homo sapiens
  chr7:20719888-20719906
  hypo
agagtgacttgaggccga

SEQ ID NO: 41210 - DNA, 139 bp, Homo sapiens
  chr7:20720174-20720313
  hypo
agagccagactccgtctcaaaaaaaaaaaaaaaaaccgactgacttgaaaagagcatgagatggacttgtgggtgctggtaatgatgggattcttgacctggataccatgatacgggcaaattccgtttgaaatgcact

SEQ ID NO: 41211 - DNA, 43 bp, Homo sapiens
  chr7:20757794-20757837
  hypo
gtcctgggattccaggcgtgagccacggcgcctggcccaaata

SEQ ID NO: 41212 - DNA, 173 bp, Homo sapiens
  chr7:22981026-22981199
  hypo
aaaaatagccaaagtcgtcgtttattctttaggaatgtaaactctaggaatacaattagaaacaaatatatttactatgaaaagattagtatcactaaatgattagaaataaaggtaagaggtacacaataagttccatataagagaaagcaacaatacgtgaaataaaatct

SEQ ID NO: 41213 - DNA, 30 bp, Homo sapiens
  chr7:23220685-23220715
  hypo
gaggctgcttctctgcgtcaaagagactta

SEQ ID NO: 41214 - DNA, 36 bp, Homo sapiens
  chr7:23525036-23525072
  hypo
attgttggccgggcacggtggctcacgcctgtaatc

SEQ ID NO: 41215 - DNA, 30 bp, Homo sapiens
  chr7:23568103-23568133
  hypo
cgtgagccaccgggccggccttgttttgtt

SEQ ID NO: 41216 - DNA, 30 bp, Homo sapiens
  chr7:23569271-23569301
  hypo
ataaaaactaaaagacgaaaaataaaaaga

SEQ ID NO: 41217 - DNA, 16 bp, Homo sapiens
  chr7:23578805-23578821
  hypo
ccgcacccagccattt

SEQ ID NO: 41218 - DNA, 48 bp, Homo sapiens
  chr7:23749757-23749805
  hypo
aggccgtggctgccacgtgactcccgctaacaccggatgatggcgcag

SEQ ID NO: 41219 - DNA, 120 bp, Homo sapiens
  chr7:24099277-24099397
  hypo
gagacagcctaagactactgagttcccagggggaggggcggctgccatcaccgcagctccgccattgacagagttggggaggctgggcagtatggactagggaggtattccccacagcac

SEQ ID NO: 41220 - DNA, 20 bp, Homo sapiens
  chr7:24580784-24580804
  hypo
gccttcgcgcccagccacaa

SEQ ID NO: 41221 - DNA, 224 bp, Homo sapiens
  chr7:24761204-24761428
  hypo
gccattagggtgtgccgagcacagagttaaatgccacacaaacactagctggctccgcccaccttcccgtgtccctctatgaggctcacaaaacaaagccacagtgtgtgccctgcatgggaattatggggcactgaattgaatcagaggtacgtttccacatcactcccttcttaaaagccttcaatggctatatcccatgtccagtgcgttcccaggctgag

SEQ ID NO: 41222 - DNA, 30 bp, Homo sapiens
  chr7:24799881-24799911
  hypo
taccgggatttatttcgtaaatgaatacac

SEQ ID NO: 41223 - DNA, 30 bp, Homo sapiens
  chr7:24845483-24845513
  hypo
catgagttgcagatacggacttctccgttt

SEQ ID NO: 41224 - DNA, 190 bp, Homo sapiens
  chr7:25495487-25495677
  hypo
cgaactagtcagtcccgtggtgacgtcaggattatctttctctcacttcagtgcctctgggacttaataggtgcacgaagaatatttataggtgcctgagaaatgcttgccgagaaatgactggctgttccaaggcatttccagggcaaggcagtccagtctgtgccgggccgggcggttgtagaggagg

SEQ ID NO: 41225 - DNA, 84 bp, Homo sapiens
  chr7:25530809-25530893
  hypo
taactcttttctgcacggttatatagcatgtttatttcttaaatcactctaggaattggccacttgcgtgctgctctgaggtgt

SEQ ID NO: 41226 - DNA, 186 bp, Homo sapiens
  chr7:25802276-25802462
  hypo
ggttggaaatgcaaacgcatagccaattagtggaagacaaggtgagcttgccaatcgataatcaccacaccacctgttgcgctttgaaaaattacctcacaacattcttgggtccttaggtaaatccttaaacttcatcctgaagaaaatgaatcacatatgtgtcttcctcgccatgggatatgc

SEQ ID NO: 41227 - DNA, 42 bp, Homo sapiens
  chr7:26217181-26217223
  hypo
agtccaggctcagcaatggagggagaccgtcgaaaggaggga

SEQ ID NO: 41228 - DNA, 17 bp, Homo sapiens
  chr7:26222458-26222475
  hypo
gctggagtgtggcagcg

SEQ ID NO: 41229 - DNA, 78 bp, Homo sapiens
  chr7:26283775-26283853
  hypo
taacagggaaaaattcgcatggcctctcggtttcttcggtccgaaaatccaacgttggtccaagaaggctctggtgtg

SEQ ID NO: 41230 - DNA, 129 bp, Homo sapiens
  chr7:26652555-26652684
  hypo
caatgctaccccggccgcatgatgcagaaatgggagccaaagctgggacaaggtagagaggagggaaggagccccagtgcctgcagaaagagcagagggttggaagactactgtcggctagctcaggcc

SEQ ID NO: 41231 - DNA, 35 bp, Homo sapiens
  chr7:26762298-26762333
  hypo
attacaggcgtgagccactgcgcccagcccattgc

SEQ ID NO: 41232 - DNA, 30 bp, Homo sapiens
  chr7:27531223-27531253
  hypo
gagttgtctgagcagcggcctgaggtgctg

SEQ ID NO: 41233 - DNA, 170 bp, Homo sapiens
  chr7:27555618-27555788
  hypo
tctctctggaaataccggtcttgccatctttcaagcaaatagcggctcactggtaggaatttcaaaacctgtgcttaaactgccaaattcctttcctctgctgttcccatttctctgtaatgatggccccagaagggaggcttggtgcaggctgacgctttctctgcctt

SEQ ID NO: 41234 - DNA, 16 bp, Homo sapiens
  chr7:27686784-27686800
  hypo
gcgatatcacaacacc

SEQ ID NO: 41235 - DNA, 32 bp, Homo sapiens
  chr7:27903816-27903848
  hypo
cctaattccatggcccgcgatttaatttgagg

SEQ ID NO: 41236 - DNA, 43 bp, Homo sapiens
  chr7:27907997-27908040
  hypo
tgtggggttgactgccgcttgcttctcccgctcccatccccct

SEQ ID NO: 41237 - DNA, 93 bp, Homo sapiens
  chr7:27916674-27916767
  hypo
agaagggcaggctaccgagagggcgctagactttggcagaggccgctgctggaaagccagcatccccagctttatcaccgaccacgtttattt

SEQ ID NO: 41238 - DNA, 30 bp, Homo sapiens
  chr7:28050662-28050692
  hypo
gggtgtttctgcttacgatgctaatgagat

SEQ ID NO: 41239 - DNA, 30 bp, Homo sapiens
  chr7:28055637-28055667
  hypo
tcttccagacagtgacggcattttaatgag

SEQ ID NO: 41240 - DNA, 30 bp, Homo sapiens
  chr7:28266792-28266822
  hypo
aggcgtgagccatcgcgcctggcccagagt

SEQ ID NO: 41241 - DNA, 22 bp, Homo sapiens
  chr7:28988955-28988977
  hypo
gggcgcagtggctcacgcctgt

SEQ ID NO: 41242 - DNA, 141 bp, Homo sapiens
  chr7:28989217-28989358
  hypo
caaaaaaaaaaaaaaaagtacagctgaccttcctgagtctcggattatgtatctgtgaattcattttctcaccaaaatttgtttgtgaccctagaatcaacactccatagcactgtcatggtcattcgctgacatgcttag

SEQ ID NO: 41243 - DNA, 30 bp, Homo sapiens
  chr7:29482512-29482542
  hypo
ccacttaatccccatcgctttcaatttcat

SEQ ID NO: 41244 - DNA, 38 bp, Homo sapiens
  chr7:29876677-29876715
  hypo
aacacacattttggccgggcatggtggctcacacctgt

SEQ ID NO: 41245 - DNA, 30 bp, Homo sapiens
  chr7:30206504-30206534
  hypo
ggatcatctctgccacgattttctccattc

SEQ ID NO: 41246 - DNA, 30 bp, Homo sapiens
  chr7:30603406-30603436
  hypo
cgctgggggaggctccgtgtagtttctggg

SEQ ID NO: 41247 - DNA, 163 bp, Homo sapiens
  chr7:30687826-30687989
  hypo
tgtatgggagggccccgaggcctaaacaaacaaatacctaagaggaaaatctggcagaaactcagtcaacacagggcagtgatgccctctgcccattcctcctgctaattaacatgtctaagtggcacagccccctcaggaaaattaacggcaccttcgaggc

SEQ ID NO: 41248 - DNA, 30 bp, Homo sapiens
  chr7:30699730-30699760
  hypo
cattatgctgcatcccggtattcaccgctt

SEQ ID NO: 41249 - DNA, 133 bp, Homo sapiens
  chr7:30744677-30744810
  hypo
gagtctaaggaaagccggcacctgtcgagaaacggacctctgccctgcatttggggccaccacacagaccacatctctgcctgtgactaagactgctcagacccagtgccataggagacgaggtgccttgggt

SEQ ID NO: 41250 - DNA, 92 bp, Homo sapiens
  chr7:30899935-30900027
  hypo
ggggctctgtggcctcgtgcgccaggctgcctgctgcttgctgcttctgaccttattaaatgcgtgtgagtacacagcgctttccaacttct

SEQ ID NO: 41251 - DNA, 84 bp, Homo sapiens
  chr7:31116600-31116684
  hypo
gcagctgtggggctgcgggtcttcgggggtgtggggcggtgtaaaaacaggtgagggctccctccttcccgacccaggagctcc

SEQ ID NO: 41252 - DNA, 238 bp, Homo sapiens
  chr7:31118297-31118535
  hypo
gctggcgcacactcacgtttgctcagcagagcattttctgggccctagctgccctcaggcagttacacgggctcaagatgggaggagctggaccttgggctacctggggagagggtgccacacacggggagcagtgccacagtgctgtcggtgacttgtggacgtgggcttggaggcgcgggtgtgcgatggcgcctccctgagagggaaggctgggtgggtgcggtgtcctgcagac

SEQ ID NO: 41253 - DNA, 158 bp, Homo sapiens
  chr7:32128181-32128339
  hypo
caatatcccatcagacgacgctttgctggcaacaattgcaattgatggcgctcgcaaggctgtgtgatgtcgctgggtgtttgcaaagcagaggaaaatccctctatgcacaagcggttctgacctcactccagtgagccactcgcctgtctttagtg

SEQ ID NO: 41254 - DNA, 15 bp, Homo sapiens
  chr7:32276919-32276934
  hypo
cgatctcctgacctc

SEQ ID NO: 41255 - DNA, 30 bp, Homo sapiens
  chr7:32323599-32323629
  hypo
cgggaagaagcatcccgaggacatttatta

SEQ ID NO: 41256 - DNA, 25 bp, Homo sapiens
  chr7:35190140-35190165
  hypo
atcttttttttgagacggggtcttg

SEQ ID NO: 41257 - DNA, 88 bp, Homo sapiens
  chr7:36428640-36428728
  hypo
gctactgaaggccaacgggctagcagcacctgaaacacaagggctctttgtctggctctgtagcccaggctggaatgcagtggtgtga

SEQ ID NO: 41258 - DNA, 26 bp, Homo sapiens
  chr7:37025520-37025546
  hypo
tactcaccaagctcccgtaagtccat

SEQ ID NO: 41259 - DNA, 30 bp, Homo sapiens; identical to SEQ ID NO: 14984
  chr7:37264509-37264539
  hypo

SEQ ID NO: 41260 - DNA, 181 bp, Homo sapiens; identical to SEQ ID NO: 14985
  chr7:37279183-37279364
  hypo

SEQ ID NO: 41261 - DNA, 119 bp, Homo sapiens
  chr7:37399153-37399272
  hypo
gccccgtgacaaaggcgctatcataatccccaccctaaacatgggtagatggagtcactgaggaaactggtcacttatttggctagtcagcaatctagcccatccgaaggcagtgttct

SEQ ID NO: 41262 - DNA, 17 bp, Homo sapiens
  chr7:37423714-37423731
  hypo
gccgaaacatacaggtt

SEQ ID NO: 41263 - DNA, 146 bp, Homo sapiens
  chr7:37424328-37424474
  hypo
aaaaaaaagaactttccagtttgtttatttgtcaagaaaacagtaagttctagatctacttgagaggttgcctcagaaatctgacctcaacaaattacttctttcactctaatctgcaataaaactagcaacggttgtacacacaa

SEQ ID NO: 41264 - DNA, 30 bp, Homo sapiens
  chr7:37446822-37446852
  hypo
tggatgagggtctggcgcggtggctcacgt

SEQ ID NO: 41265 - DNA, 30 bp, Homo sapiens
  chr7:37686948-37686978
  hypo
acttgagattgtcaacgaattaagagataa

SEQ ID NO: 41266 - DNA, 148 bp, Homo sapiens
  chr7:37770953-37771101
  hypo
caagcaagtcatgcacgtggagaacgaggtgtctctctgaaagaaatgtagagagaaaattttaggtcaactaattaaaaattcccatcaatctctagaatagcatcccatatgcaaaggaatactctgtcgcccaggctggagtgca

SEQ ID NO: 41267 - DNA, 175 bp, Homo sapiens
  chr7:37868787-37868962
  hypo
ctcagtagaaggctgcggtggttttgcttgccctcaggctgtatacccagttcttcatacctctcccaggctcctccagatctgcctcctgctgaccttgtacccagctgcagcgacaccgagctcctcacagcttcccaaagtgggctggcccctctcacgacagggtcatcgc

SEQ ID NO: 41268 - DNA, 30 bp, Homo sapiens
  chr7:37907440-37907470
  hypo
ggatcaacctgaggtcgaagcccaggttac

SEQ ID NO: 41269 - DNA, 30 bp, Homo sapiens
  chr7:37969938-37969968
  hypo
cacagctctgcctgacgcagcattgtcagc

SEQ ID NO: 41270 - DNA, 37 bp, Homo sapiens
  chr7:38170685-38170722
  hypo
aaaatgaatgaaggccgggcacggtggctcacgcctg

SEQ ID NO: 41271 - DNA, 24 bp, Homo sapiens
  chr7:38508456-38508480
  hypo
agtagaacatacagacggccgggc

SEQ ID NO: 41272 - DNA, 189 bp, Homo sapiens
  chr7:38740329-38740518
  hypo
cttgttttctgagctcgctgggggattgatgctccacggagcgctgctgggaaacgctggaccagagccagttccaaagacttccttctgaaaatcctaggtttgttctgcaggtgtggcctaacagctccatcttttttgtgttcagaaacattcatcctgtgctatcacatgcggcatcgcctcagg

SEQ ID NO: 41273 - DNA, 30 bp, Homo sapiens
  chr7:39192698-39192728
  hypo
ttctgcggtgatgtgcgttggacaaaggtg

SEQ ID NO: 41274 - DNA, 30 bp, Homo sapiens
  chr7:39317801-39317831
  hypo
gcagagaaggcgtttcggaaaagctcctga

SEQ ID NO: 41275 - DNA, 101 bp, Homo sapiens
  chr7:39921805-39921906
  hypo
tttgtcttggctaaagattaacaaccagctggtgttaatttctgcttacacttaacagcactcacattagaaacaacttttggtgccgcaaaagaaatagc

SEQ ID NO: 41276 - DNA, 91 bp, Homo sapiens
  chr7:40157087-40157178
  hypo
tgataacatggtatacgtattgttatgaaagtgaccgtgtccataaataggagaaatcccataactcctactacatcggttctaccttttg

SEQ ID NO: 41277 - DNA, 93 bp, Homo sapiens
  chr7:40407726-40407819
  hypo
ttcctgcttttccctcgtaagtcagatctcacattataacattttagtctatacttttttattttgtgattatttatttatttatttttgaga

SEQ ID NO: 41278 - DNA, 30 bp, Homo sapiens
  chr7:40943582-40943612
  hypo
gctgcccaagcttggcgcagcttacatcac

SEQ ID NO: 41279 - DNA, 27 bp, Homo sapiens
  chr7:41814148-41814175
  hypo
ggaggccgaggtgggcggatcacgagg

SEQ ID NO: 41280 - DNA, 30 bp, Homo sapiens
  chr7:41923780-41923810
  hypo
aaatgtcccacactccgaagctctgctacc

SEQ ID NO: 41281 - DNA, 30 bp, Homo sapiens
  chr7:41943672-41943702
  hypo
ttcatggattactgacggaaatacacaatg

SEQ ID NO: 41282 - DNA, 17 bp, Homo sapiens
  chr7:41981795-41981812
  hypo
gggcgtggtggctcacg

SEQ ID NO: 41283 - DNA, 30 bp, Homo sapiens
  chr7:42005469-42005499
  hypo
gggaggacagggggacgagtggaagtttcg

SEQ ID NO: 41284 - DNA, 177 bp, Homo sapiens
  chr7:43237814-43237991
  hypo
cacacccaccatagtcgcacatcccacagtctctcacacacccactcacacacaccccacactcacacaccacacacattcgcacactcaccctacactgtcacttacacacacatcctacatacactcatcatagtcacacaccccacgctctcacacacacgtcttacacacact

SEQ ID NO: 41285 - DNA, 25 bp, Homo sapiens
  chr7:43767877-43767902
  hypo
gtgaactctacggtaggtgaactat

SEQ ID NO: 41286 - DNA, 202 bp, Homo sapiens
  chr7:43865061-43865263
  hypo
gtaaagatggaaaagcggctgtctagtagagaccacataattcaatcactcgatctgagtttactagccccagagagctaaggttactctgtttatttattaaagaacttttacaaccttaaactcactctggactttccagccttatgttgggggttacaagtggcgccccgaacagcaacaggatcgggtgctctgcatt

SEQ ID NO: 41287 - DNA, 25 bp, Homo sapiens
  chr7:44083435-44083460
  hypo
ccaccgtgcccggcaggatttatat

SEQ ID NO: 41288 - DNA, 442 bp, Homo sapiens
  chr7:44151285-44151727
  hypo
gcctcccgcctgttccggagcctctctggggattctggcttgtcttacagggccctaggagccccagctgtcccccagaccctcgggtatgaggtgggtctgggtccttcctcagctgccctgggcctcgggagactgagtgctcactgaggctcccgcccttgcaggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatggtgggttgaagggtgaggctggccagggtccaggcagctgggggttgtgggggtgtgggtagccgatgcctaccctgc

SEQ ID NO: 41289 - DNA, 61 bp, Homo sapiens
  chr7:44152191-44152252
  hypo
ggagaagaaccccttcgtgctgggagcaaatctgaacggcggcgagcggctagtatcctac

SEQ ID NO: 41290 - DNA, 30 bp, Homo sapiens
  chr7:44193301-44193331
  hypo
aaatgcagcccacagcgtgttggaggggtg

SEQ ID NO: 41291 - DNA, 183 bp, Homo sapiens
  chr7:44258471-44258654
  hypo
tggggataccgggcacggaaaacccacacctagcccttcaggggatgaaaggaagggaagggaaagcaggaacaacagcaactctcaggcacaactagcgggaaaggaggcagcccagcgggcccccacagcccctcccaagagacagctgacagtcacgacagccagcgagcacaccacgtg

SEQ ID NO: 41292 - DNA, 53 bp, Homo sapiens
  chr7:44259286-44259339
  hypo
actgggctctgggcccgctgcacccaccacctggggaacgcccatctggggct

SEQ ID NO: 41293 - DNA, 30 bp, Homo sapiens
  chr7:44275594-44275624
  hypo
cagcagcagcagaatcgccctgtacagtca

SEQ ID NO: 41294 - DNA, 30 bp, Homo sapiens
  chr7:44431004-44431034
  hypo
taatacgtgctgtaccggaaggtaagacta

SEQ ID NO: 41295 - DNA, 34 bp, Homo sapiens
  chr7:44517861-44517895
  hypo
actttgggccgggcgcggtggctcacgcctgtaa

SEQ ID NO: 41296 - DNA, 30 bp, Homo sapiens
  chr7:44717883-44717913
  hypo
cttggctaggacactcgcccaggcatttgg

SEQ ID NO: 41297 - DNA, 30 bp, Homo sapiens
  chr7:44801185-44801215
  hypo
taatgaggtgagctccgcctggcccccacc

SEQ ID NO: 41298 - DNA, 264 bp, Homo sapiens; identical to SEQ ID NO: 1574
  chr7:44835120-44835384
  hypo

SEQ ID NO: 41299 - DNA, 27 bp, Homo sapiens
  chr7:45027184-45027211
  hypo
attgttaagggacgaaagggccaagag

SEQ ID NO: 41300 - DNA, 16 bp, Homo sapiens
  chr7:45038548-45038564
  hypo
gggcgcggtggctcac

SEQ ID NO: 41301 - DNA, 34 bp, Homo sapiens
  chr7:45125675-45125709
  hypo
ggatggtggtggcagcggccgcatcgcaggacag

SEQ ID NO: 41302 - DNA, 61 bp, Homo sapiens
  chr7:45222910-45222971
  hypo
acgaggttctcatcccgctgatcgttatacccgtcgttctgactgtcgccatggctggcct

SEQ ID NO: 41303 - DNA, 44 bp, Homo sapiens
  chr7:45807457-45807501
  hypo
aaaatgctgggattaggggcgtgagccaccgggcctggcccaat

SEQ ID NO: 41304 - DNA, 113 bp, Homo sapiens
  chr7:47394819-47394932
  hypo
aggacaccgagcctgcgaggcaggaggacgctcagtcattccggccccacaggaggagctggggatggtggggcctcagccccaggtgcatcctatgacgtaccttatccaaa

SEQ ID NO: 41305 - DNA, 30 bp, Homo sapiens
  chr7:47409179-47409209
  hypo
cgtaaaggctgccatcgacagggccctgcg

SEQ ID NO: 41306 - DNA, 203 bp, Homo sapiens
  chr7:47420119-47420322
  hypo
tggacaagtcctgagcgacattccttcttgcccggttaaagcatccgttctgctgattattccactccataacgccctctcctcctggctagtaccagctcttttcctctggaagtcttggcaagttggtaaatctcagcaggcacacagctcagtttcaggtctttgtagcattacagaagccacacacatgcacacacaca

SEQ ID NO: 41307 - DNA, 142 bp, Homo sapiens
  chr7:47420382-47420524
  hypo
acaaatgctctctgcttaccttccttcaaaacagcccagcggctctctcagtctgcacctctgagcccagttttccttgacacaggctttcacagcaggacagtggcatgccagaggagggcgggggcgtgccacctccctc

SEQ ID NO: 41308 - DNA, 30 bp, Homo sapiens
  chr7:47449194-47449224
  hypo
caaacaagatgagggcgggtgcaaatccta

SEQ ID NO: 41309 - DNA, 61 bp, Homo sapiens
  chr7:47586473-47586534
  hypo
gctcaacaggcgctgcggatggaatgactaaaatgacaaagacagacgccaggttttaagg

SEQ ID NO: 41310 - DNA, 30 bp, Homo sapiens
  chr7:47702782-47702812
  hypo
gccaggtgtgaggctcggtgtttggattgt

SEQ ID NO: 41311 - DNA, 16 bp, Homo sapiens
  chr7:49700766-49700782
  hypo
gcgcccccggccggtc

SEQ ID NO: 41312 - DNA, 171 bp, Homo sapiens
  chr7:49740620-49740791
  hypo
ctggcagcgctgcggcgacgcatccccagaggagcagcagcctctgacagcaacaccaagtgcaggagcggagggcgggggaagtcacctgctgccagggttccaccgtggggatgataagagggaacagcatgcaccactaagtgtgggagtcaacgataggtaggtttc

SEQ ID NO: 41313 - DNA, 30 bp, Homo sapiens
  chr7:50241354-50241384
  hypo
gcgatacagtgcctgcgtgggcattcctgc

SEQ ID NO: 41314 - DNA, 153 bp, Homo sapiens
  chr7:50243557-50243710
  hypo
gtatgataggttcctcgccttcataatattctcagttgtaaccatacagtcatttatgtgatactttggttaatctccatctccctccacgaggctctatgctttctgcaaacaagcaccatggtcattttctctcagcgccctatttccagt

SEQ ID NO: 41315 - DNA, 30 bp, Homo sapiens
  chr7:50251382-50251412
  hypo
tccacacgctggcatcgggaggcaggtatc

SEQ ID NO: 41316 - DNA, 80 bp, Homo sapiens
  chr7:50294401-50294481
  hypo
agactccatctcaaaaaaaaaaaaaaaaaaagattcctagtttcctaagaatttttatcatgaatcggtattcaattgta

SEQ ID NO: 41317 - DNA, 30 bp, Homo sapiens
  chr7:50337681-50337711
  hypo
tcctgagagaggtgacgtaactcagctgag

SEQ ID NO: 41318 - DNA, 17 bp, Homo sapiens
  chr7:50365076-50365093
  hypo
tttctatttataggccg

SEQ ID NO: 41319 - DNA, 30 bp, Homo sapiens
  chr7:50423094-50423124
  hypo
gtaccggccaacgcccgccttgaggcctgg

SEQ ID NO: 41320 - DNA, 166 bp, Homo sapiens
  chr7:50438618-50438784
  hypo
aagcagttccagctccgagtaacagaggaaggagtgagcgatttaggaactcacagaagggcacggccaggcaactcgggccctggcaaatgttccatagagacagcatccatggggttgaaccaagcacaatgcctgcaaatcgggcaggcgggttcatggaatt

SEQ ID NO: 41321 - DNA, 139 bp, Homo sapiens
  chr7:50444259-50444398
  hypo
gatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggca

SEQ ID NO: 41322 - DNA, 30 bp, Homo sapiens
  chr7:50471189-50471219
  hypo
cgctgtgtcttgttccgccccctccctgac

SEQ ID NO: 41323 - DNA, 106 bp, Homo sapiens
  chr7:50560557-50560663
  hypo
gcatcagctctgcagcgtctgcggcagcctcggggcatcagctctgcggcaggcactccacgtcccgaaaggctcaactccttctcaccaccgcactgactaagca

SEQ ID NO: 41324 - DNA, 19 bp, Homo sapiens
  chr7:52268638-52268657
  hypo
tttgtttgtttgagacgga

SEQ ID NO: 41325 - DNA, 30 bp, Homo sapiens
  chr7:52499272-52499302
  hypo
cccacgagggtcacacgcagcctctgttcc

SEQ ID NO: 41326 - DNA, 43 bp, Homo sapiens
  chr7:52736850-52736893
  hypo
ccatgcctgaggagtcgggcaggcggcccgcccaggccacgct

SEQ ID NO: 41327 - DNA, 30 bp, Homo sapiens
  chr7:53364402-53364432
  hypo
ctccaggccatggaccgatactgttaggaa

SEQ ID NO: 41328 - DNA, 58 bp, Homo sapiens
  chr7:54794734-54794792
  hypo
accgatgcctccgcccggctctctccgtgtcctgcacacagtacgccactacccgggg

SEQ ID NO: 41329 - DNA, 30 bp, Homo sapiens
  chr7:54866907-54866937
  hypo
cccagtggaatccagcggtgtgcatgctca

SEQ ID NO: 41330 - DNA, 37 bp, Homo sapiens; identical to SEQ ID NO: 15001
  chr7:55145943-55145980
  hypo

SEQ ID NO: 41331 - DNA, 42 bp, Homo sapiens
  chr7:55410245-55410287
  hypo
ctcaaaaactgatgccgccaaggagcccgccatggccagccc

SEQ ID NO: 41332 - DNA, 30 bp, Homo sapiens
  chr7:55838624-55838654
  hypo
gcctcccaggcagggcggtgcctgttctgg

SEQ ID NO: 41333 - DNA, 360 bp, Homo sapiens
  chr7:56017856-56018216
  hypo
gcagagcttgcagtgagccgagattgtgagcgagactccgtctgaaaaaaaaaaaaaaatctaattgtatagaatattgttacaaccacacagaagaaaaaaaaagaatcccaagaaatgttgaacacagtgctgtcattgtacactctaaggacaaaaagaaccacaaaaaataatctcacgcatcacttagaaagtttgtttttagtcgggatattgttagtacaactccaaaagcatatagtgtatactataggatttagcattaatcattgatgttgtcggggtagggaccagagttctaactgtggaagaaaggagataaaaatacggaactggtgaagcaaaagaagaaaccca

SEQ ID NO: 41334 - DNA, 30 bp, Homo sapiens
  chr7:56144506-56144536
  hypo
cctccttgctctcctcgcaggtcaagttta

SEQ ID NO: 41335 - DNA, 42 bp, Homo sapiens
  chr7:57247720-57247762
  hypo
agcacacagcaacagcggcccaaacgccgtgcaggccacacc

SEQ ID NO: 41336 - DNA, 21 bp, Homo sapiens
  chr7:57655640-57655661
  hypo
ccaccgcgcctggcccatata

SEQ ID NO: 41337 - DNA, 30 bp, Homo sapiens
  chr7:63393332-63393362
  hypo
gccactgtgcctggccggtttggaagaaat

SEQ ID NO: 41338 - DNA, 30 bp, Homo sapiens
  chr7:63574716-63574746
  hypo
cagcatcaacaagcacgaggatgcggacct

SEQ ID NO: 41339 - DNA, 151 bp, Homo sapiens
  chr7:63666590-63666741
  hypo
agaaccgggaaggtggggaggggagatgtgccacatttttaaaccatcgggtatcttgagagctcccttattatcccaagaacaggatgaggataatccaccccaatgatccaatcacctcttacacagtccctaccgtgacacatgggaa

SEQ ID NO: 41340 - DNA, 28 bp, Homo sapiens
  chr7:65236287-65236315
  hypo
tgaggctccctgggccgtgctatcccgg

SEQ ID NO: 41341 - DNA, 42 bp, Homo sapiens
  chr7:65879595-65879637
  hypo
gtaaagtaattgggccggccccgtggctcaggggcccttaat

SEQ ID NO: 41342 - DNA, 81 bp, Homo sapiens
  chr7:65880043-65880124
  hypo
ttcagtttactgcttcgatatcttttcctaattgattgttaattaagttctgcctagcaagtataaaaacctctgcctcct

SEQ ID NO: 41343 - DNA, 30 bp, Homo sapiens
  chr7:65969625-65969655
  hypo
gaaaatatcagttcccgagtctccatgcgt

SEQ ID NO: 41344 - DNA, 40 bp, Homo sapiens
  chr7:66215014-66215054
  hypo
ataactggtgtctcacgagataatacgtttgggtcctgtt

SEQ ID NO: 41345 - DNA, 40 bp, Homo sapiens
  chr7:67161739-67161779
  hypo
cacctgcagatcaaacgtgcacacccggtgccagtcaaaa

SEQ ID NO: 41346 - DNA, 49 bp, Homo sapiens
  chr7:68000342-68000391
  hypo
ccctgccagggctggcggggctggctggtggctccgactgtggggccct

SEQ ID NO: 41347 - DNA, 190 bp, Homo sapiens
  chr7:68204758-68204948
  hypo
ttcagaagtgactttcgaggaaatttggtcccgttcccaagcaataaagccgtcgcatcataatcagcttagaacaatttgccaatgatagttttctgtgttgcgccatcagagattctgattcagcaagtcctcgttggatctcatacatctcaattaaaaatcaacaatagatcgggcgtggtggctc

SEQ ID NO: 41348 - DNA, 27 bp, Homo sapiens
  chr7:68982718-68982745
  hypo
tgtgagccaccgcgcctggccattgct

SEQ ID NO: 41349 - DNA, 100 bp, Homo sapiens
  chr7:69032251-69032351
  hypo
tggataaataaaatacggtaaatatctatgacgaaatattatttggcaacaaaagggaattaagaatacatgctactgtatggatgaatcctgaaaacgc

SEQ ID NO: 41350 - DNA, 42 bp, Homo sapiens; identical to SEQ ID NO: 15004
  chr7:69036110-69036152
  hypo

SEQ ID NO: 41351 - DNA, 179 bp, Homo sapiens; identical to SEQ ID NO: 15005
  chr7:69313694-69313873
  hypo

SEQ ID NO: 41352 - DNA, 30 bp, Homo sapiens
  chr7:69698849-69698879
  hypo
ctatactggctttaccgcaagggttaaatt

SEQ ID NO: 41353 - DNA, 18 bp, Homo sapiens
  chr7:70728615-70728633
  hypo
cctcagtgatctggccgg

SEQ ID NO: 41354 - DNA, 19 bp, Homo sapiens
  chr7:71256983-71257002
  hypo
actccgtctcaaaaaaaga

SEQ ID NO: 41355 - DNA, 30 bp, Homo sapiens
  chr7:71296085-71296115
  hypo
gccactaactagttgcgtaccctgaagcag

SEQ ID NO: 41356 - DNA, 30 bp, Homo sapiens
  chr7:71880817-71880847
  hypo
ctgcaggtaccaccacgctccttcacctag

SEQ ID NO: 41357 - DNA, 30 bp, Homo sapiens
  chr7:75975426-75975456
  hypo
gtcgtcactgtcttccgaccccaggcatcc

SEQ ID NO: 41358 - DNA, 49 bp, Homo sapiens
  chr7:76106331-76106380
  hypo
gatgatggaggcggccgtggctgcccgagagatgcgtgacacccaggag

SEQ ID NO: 41359 - DNA, 28 bp, Homo sapiens
  chr7:77309374-77309402
  hypo
tggagtgcagtggtccgcctcccgggtt

SEQ ID NO: 41360 - DNA, 28 bp, Homo sapiens
  chr7:77309582-77309610
  hypo
aggcgtgagccatcgtgcccggccagac

SEQ ID NO: 41361 - DNA, 28 bp, Homo sapiens
  chr7:77928410-77928438
  hypo
aggcgtgagctaccgtgcctggctataa

SEQ ID NO: 41362 - DNA, 23 bp, Homo sapiens
  chr7:84936791-84936814
  hypo
accgcgctcggccttgtttacca

SEQ ID NO: 41363 - DNA, 39 bp, Homo sapiens
  chr7:86228129-86228168
  hypo
aggaggctgaatccacggggctgagcagcgaccatctgc

SEQ ID NO: 41364 - DNA, 42 bp, Homo sapiens
  chr7:86416083-86416125
  hypo
gcctcccagcctgtccgccagttcgaccgctacttccagagc

SEQ ID NO: 41365 - DNA, 16 bp, Homo sapiens
  chr7:90269563-90269579
  hypo
tcggccatcttggctc

SEQ ID NO: 41366 - DNA, 30 bp, Homo sapiens
  chr7:91510852-91510882
  hypo
gttatcctcaggagacgatggtgatttggt

SEQ ID NO: 41367 - DNA, 30 bp, Homo sapiens
  chr7:93055830-93055860
  hypo
gggcgcctcccccaacgctggttccactga

SEQ ID NO: 41368 - DNA, 83 bp, Homo sapiens
  chr7:94138070-94138153
  hypo
aaccaacgttagtagcggggatgattgtcataagcacattaagaaaaattttttttggctaggcttggtggctcatgcctgta

SEQ ID NO: 41369 - DNA, 30 bp, Homo sapiens
  chr7:97591443-97591473
  hypo
tatttcttatatcctcgggcaatgttgctt

SEQ ID NO: 41370 - DNA, 90 bp, Homo sapiens
  chr7:97600089-97600179
  hypo
cttagctattgaaaacgctaagttcagtgtcgacctcttgtgtcgcacatgctaatgacaaaaccaaagaaaaaccggttttagaaaaac

SEQ ID NO: 41371 - DNA, 41 bp, Homo sapiens; identical to SEQ ID NO: 15007
  chr7:97797757-97797798
  hypo

SEQ ID NO: 41372 - DNA, 30 bp, Homo sapiens
  chr7:97804272-97804302
  hypo
catgcatttgcagaacgttctgtgagtagt

SEQ ID NO: 41373 - DNA, 30 bp, Homo sapiens
  chr7:97807742-97807772
  hypo
atcgctctgctcatgcggccctgagtctca

SEQ ID NO: 41374 - DNA, 30 bp, Homo sapiens
  chr7:97834167-97834197
  hypo
gctcttcagcaggctcgtaagagcacttga

SEQ ID NO: 41375 - DNA, 27 bp, Homo sapiens
  chr7:97869134-97869161
  hypo
gtgactggccaggcacggtggctcatg

SEQ ID NO: 41376 - DNA, 266 bp, Homo sapiens
  chr7:97869401-97869667
  hypo
cagagcgacactccgtctcaaaaaaaacaaacaaaagaaaaaccctgtgagtaatcggaaatcggctggttttattggacttgccgctgataagatgcaaaagacaagcagtgactagaggatggggaggcgcttggttaatcaagggcttcaggaaattcgcttccgattcttcgaaatgttgcagcctattaggtgatacttgcagttgctgcatttgggtaccagcgtgtgggtggaagaggattttacggcacaaaacgtcc

SEQ ID NO: 41377 - DNA, 42 bp, Homo sapiens
  chr7:97882348-97882390
  hypo
aaaaaagaaagatgtcggccaggtgcggcggttcatacctgt

SEQ ID NO: 41378 - DNA, 48 bp, Homo sapiens
  chr7:97899729-97899777
  hypo
ctgtccagttcctcccgggcctcccaacgcccccgatggctccttccc

SEQ ID NO: 41379 - DNA, 48 bp, Homo sapiens
  chr7:98121881-98121929
  hypo
ttttgcttggagcatcgacttataaccccagcccgagagagccgtggc

SEQ ID NO: 41380 - DNA, 198 bp, Homo sapiens; identical to SEQ ID NO: 15009
  chr7:98183080-98183278
  hypo

SEQ ID NO: 41381 - DNA, 30 bp, Homo sapiens
  chr7:98970776-98970806
  hypo
actaccctagggggtcgaattcagtggaaa

SEQ ID NO: 41382 - DNA, 43 bp, Homo sapiens
  chr7:98971547-98971590
  hypo
tcactggggtctcttccatctgcctggccgccaggccacgtat

SEQ ID NO: 41383 - DNA, 263 bp, Homo sapiens
  chr7:98991519-98991782
  hypo
cccactacaccccctcggtacttctcactaaagcccgctccccaagaagtctgggagcgcctggtggacagggtgggcctgagcccagcgccagcacaggttgaattcataagctcctcttcctctttgcagccagatctcggtgctcagcggcggcaaggccaagtgctcgcagttctgcaccactggcatggatggcggcatgagtatctgggatgtgaaggtgaggcttgcccctcctggcttcccgccatgcctcccag

SEQ ID NO: 41384 - DNA, 389 bp, Homo sapiens
  chr7:99020748-99021137
  hypo
tgcagtggcgcgatcttggctcacaacaaatctcaggtattcaccccagacaatgacaccacttcactgcctgcccagtccctgagcaagcgacaacctgtttggagtacccagcaacgtgcaggtgctggggacccagatgagcacagcagacagcctctgcctccagaagcctgatacagggaaggccagggctgcccatgagcacatgatccaagactgtaggacacggcataaaggaacagagtgggaagggggaggggagactttcatcccaggtcagagcggcagccagctgggcatgtctgagggccacttaagcagagacctccaggaaaagtgggtgccacctgaggcagcgggaacaccaatcccgaagcaggcaagag

SEQ ID NO: 41385 - DNA, 30 bp, Homo sapiens
  chr7:99591732-99591762
  hypo
gcactccagcttgggcgacagagactctgg

SEQ ID NO: 41386 - DNA, 22 bp, Homo sapiens
  chr7:99649204-99649226
  hypo
acggcgccgggccccctaggga

SEQ ID NO: 41387 - DNA, 43 bp, Homo sapiens
  chr7:99691859-99691902
  hypo
ctagcccaagcctctcgcctcatctccacgtatgctgctgtga

SEQ ID NO: 41388 - DNA, 37 bp, Homo sapiens; identical to SEQ ID NO: 15013
  chr7:99700198-99700235
  hypo

SEQ ID NO: 41389 - DNA, 87 bp, Homo sapiens
  chr7:99723146-99723233
  hypo
gtttcaaacaacagccgggcacacatagctagctggtcgatgaggcagcacccagaatggccgctgtcttgttaagctcaagctcca

SEQ ID NO: 41390 - DNA, 41 bp, Homo sapiens
  chr7:99839918-99839959
  hypo
ctgcaactggaagggcgatcctgaacaggagttattttgcc

SEQ ID NO: 41391 - DNA, 21 bp, Homo sapiens
  chr7:99934962-99934983
  hypo
ccaccacgcccagctgccttg

SEQ ID NO: 41392 - DNA, 189 bp, Homo sapiens
  chr7:100088128-100088317
  hypo
catcccagcagaggtcgaggacggtgcccgggcctggaatggcagtgccgagggtccaggcaaggtggagcgtgaggacaggggccctgggacatcggggatcccagtgagaagccagggggcagagggactgctggccaggatccaccatggagaccgaggagggagccgcaccgcgctgcccattcc

SEQ ID NO: 41393 - DNA, 89 bp, Homo sapiens
  chr7:100104071-100104160
  hypo
agtgctgggattataggtttgagcactcgtgtccagccagtgttacaacttttattgaagcttcagtgcacagccgcagcaaaggtacg

SEQ ID NO: 41394 - DNA, 30 bp, Homo sapiens
  chr7:100118785-100118815
  hypo
tatcttttggtttgccgatgtttctaggta

SEQ ID NO: 41395 - DNA, 89 bp, Homo sapiens
  chr7:100179713-100179802
  hypo
gcttgttgttgctgacgatgaggaccctcaggggcagctggcagatgtagggtggcagcagcgacagctggtttcggctgtggaaggga

SEQ ID NO: 41396 - DNA, 83 bp, Homo sapiens
  chr7:100279918-100280001
  hypo
ccacctcctgggagccgctcgcccaccgtccaggctgcccgtggcgctcagcgtgtgcagcatctgctcgcaccactgggtga

SEQ ID NO: 41397 - DNA, 39 bp, Homo sapiens
  chr7:100391505-100391544
  hypo
caacctggcagaccccggggactgcgagggcccctgcgt

SEQ ID NO: 41398 - DNA, 300 bp, Homo sapiens
  chr7:100490045-100490345
  hypo
tcccaaagatgaactcgatctcgtagccgtggggcacccccatccacaggggccaggagagcgtggaagcacggtgttcaaagacgtaggcgtagacccgggcaccctgggcagccagtcgcccagccagctgggccacggggcacacgacattgtggtcgcccaccacatcgctcagggcctccctcaggcgtgccgggtcctcgggatgcagccagtctgtgtaatgcaggaccacagcctcggctgccaggtcacttacctggggaaccccgacccgcaccccggccaggaactcgg

SEQ ID NO: 41399 - DNA, 22 bp, Homo sapiens
  chr7:100495308-100495330
  hypo
agcactctgggaggccgagaca

SEQ ID NO: 41400 - DNA, 17 bp, Homo sapiens
  chr7:100723832-100723849
  hypo
gtttgttttttgagacg

SEQ ID NO: 41401 - DNA, 145 bp, Homo sapiens
  chr7:100799106-100799251
  hypo
caggcatttctttggcgtcggttactgtcgtcttgtcactgtgctaggcattttacttacctttagaaagcagaccagaaagcaagaggtcagggaatcatggtaataatagtaataactaacggccgggcgcagtggctcatgc

SEQ ID NO: 41402 - DNA, 30 bp, Homo sapiens
  chr7:100858230-100858260
  hypo
aaccagccactcagacgcctgacaaaacca

SEQ ID NO: 41403 - DNA, 39 bp, Homo sapiens
  chr7:100894771-100894810
  hypo
aaatacagcctaggccggccgtggtggctcacgcctgta

SEQ ID NO: 41404 - DNA, 34 bp, Homo sapiens
  chr7:100897086-100897120
  hypo
attcattcattcattcgcccgttcatttagcaaa

SEQ ID NO: 41405 - DNA, 30 bp, Homo sapiens
  chr7:100967105-100967135
  hypo
gcttcctcacctcagcgtttacttcattgc

SEQ ID NO: 41406 - DNA, 16 bp, Homo sapiens
  chr7:101056509-101056525
  hypo
agacttgtggccgggc

SEQ ID NO: 41407 - DNA, 87 bp, Homo sapiens
  chr7:101131936-101132023
  hypo
gtaagccaccgcgcccgaactttaaccagttttaagcgttcaattcagccgtgttaggtaccgtcacactgtcgtccagccatctcc

SEQ ID NO: 41408 - DNA, 177 bp, Homo sapiens
  chr7:101241846-101242023
  hypo
cggaaactggcaagccgccggagggcctcgtcaaggctttgatgaccctgtgctgaggacgcaaatcctaggcctggccgacaccctgctccaaggaccaatgactgaggccagagagggtcccagatggagcctgggtaggggtgaaactgcacaggcggacgggcagagcgtcca

SEQ ID NO: 41409 - DNA, 30 bp, Homo sapiens
  chr7:101475790-101475820
  hypo
caaacacaagtggggcgacaggacccacac

SEQ ID NO: 41410 - DNA, 30 bp, Homo sapiens
  chr7:101627816-101627846
  hypo
ccctgcactctcaggcgagctgttgggtgc

SEQ ID NO: 41411 - DNA, 34 bp, Homo sapiens
  chr7:101630517-101630551
  hypo
gcttgcacagaagtccgtgcgtgagccacgacgg

SEQ ID NO: 41412 - DNA, 115 bp, Homo sapiens
  chr7:101652590-101652705
  hypo
gttaggatccctccacggatgtggccaggtgacacccctcacctaggccgcacagcaccctaatgtacacactgaagaaaggctgcgtggggctgcagagcggctcatttctaag

SEQ ID NO: 41413 - DNA, 78 bp, Homo sapiens; identical to SEQ ID NO: 15018
  chr7:101656381-101656459
  hypo

SEQ ID NO: 41414 - DNA, 30 bp, Homo sapiens
  chr7:101707051-101707081
  hypo
tgcagttggccattgcggaagatattaaaa

SEQ ID NO: 41415 - DNA, 38 bp, Homo sapiens
  chr7:101707502-101707540
  hypo
agagtgtgtgtgaaacggagttttgctgtgttgcccag

SEQ ID NO: 41416 - DNA, 38 bp, Homo sapiens
  chr7:101707600-101707638
  hypo
attacaggcatgagcaacggtgccggctctaaatggtt

SEQ ID NO: 41417 - DNA, 97 bp, Homo sapiens
  chr7:102097002-102097099
  hypo
cctacttgttaacagcgttatggggctggaaggaggctctcagatttccctgccctcctcacatcccccaaccctccctgggcgtgggggtgtcaag

SEQ ID NO: 41418 - DNA, 29 bp, Homo sapiens
  chr7:102232246-102232275
  hypo
acaacctggtaaggtcggatcaacttcct

SEQ ID NO: 41419 - DNA, 204 bp, Homo sapiens
  chr7:105279467-105279671
  hypo
atacagggctttgggcgacccaatggcggccgccttgggtcagctgttcccctggccaccccggtgtggctggatcaggggcgcggcatatcatcctcccctccagggctgcctttcagggcgctgccgccgccgccgccgccgctgccgctgctcctgcatacattaaaacgtagcaggctttagaaccgcctgtgagtgcct

SEQ ID NO: 41420 - DNA, 30 bp, Homo sapiens
  chr7:105280417-105280447
  hypo
ccacctgagacccaacgacccctttcctgg

SEQ ID NO: 41421 - DNA, 30 bp, Homo sapiens
  chr7:105288193-105288223
  hypo
cttaaggcagccccacgagcacaggtgcac

SEQ ID NO: 41422 - DNA, 30 bp, Homo sapiens
  chr7:106123211-106123241
  hypo
gtctgctggagctgccgtagtaaaatgcta

SEQ ID NO: 41423 - DNA, 90 bp, Homo sapiens
  chr7:106123301-106123391
  hypo
caagatcaaggtgctggtgaggcaggttttattctgagttctcttctcttagccagtaggcagctgcgacctcaccgtgtgctcacgtga

SEQ ID NO: 41424 - DNA, 290 bp, Homo sapiens
  chr7:106508656-106508946
  hypo
caactgcatcttcatcgtcattcaccgcagcaccaccagccagaccattaaggtctcacccgacgacacccccggcgccatcctgcagagcttcttcaccaagatggccaagaagaaatctctgatggatattcccgaaagccaaagcgaacaggattttgtgctgcgcgtctgtggccgggatgagtacctggtgggcgaaacgcccatcaaaaacttccagtgggtgaggcactgcctcaagaacggagaagagattcacgtggtactggacacgcctccagacccgg

SEQ ID NO: 41425 - DNA, 32 bp, Homo sapiens
  chr7:106609365-106609397
  hypo
cgggtgcatggctcacgcctgtaatcccagca

SEQ ID NO: 41426 - DNA, 42 bp, Homo sapiens
  chr7:106651496-106651538
  hypo
tgtcccatagtgggccgggcgtggtggctcacgcctgtaatc

SEQ ID NO: 41427 - DNA, 37 bp, Homo sapiens
  chr7:106748373-106748410
  hypo
tacaggcgtgagatgctgtgcccggccaagagatgtt

SEQ ID NO: 41428 - DNA, 43 bp, Homo sapiens
  chr7:106796956-106796999
  hypo
ctcttcatttagggccgggctcggtggctcacgcctgtaatcc

SEQ ID NO: 41429 - DNA, 41 bp, Homo sapiens
  chr7:106797653-106797694
  hypo
tggtgcagtagaaatcgctcgatgctcgcggggacagtact

SEQ ID NO: 41430 - DNA, 24 bp, Homo sapiens
  chr7:106802882-106802906
  hypo
gcgagactccgtccataaaacaaa

SEQ ID NO: 41431 - DNA, 121 bp, Homo sapiens
  chr7:106837489-106837610
  hypo
ccagagttgtcaaaacggtgaacttaagagctgtcctcagtagaagctggaaataaaaatcaactcaagtccttcctactctgttgcctgtacccttactcatctccgagtcctctactgc

SEQ ID NO: 41432 - DNA, 90 bp, Homo sapiens
  chr7:107148303-107148393
  hypo
ataatgcttctatgacgtatttggttttaagaatattctctcatggggtgggtggagctaagatggctgaacaggaacagctcccagcgt

SEQ ID NO: 41433 - DNA, 173 bp, Homo sapiens
  chr7:107483694-107483867
  hypo
atttcagcagagacccgcaggtacaaggacaccacccaggcgaggagccagaaagagcagccgcagcaggtggagcgcatgggcagaggggcggtggtgggacacgcgactgtttgggattgagcgaggccacctaagcagattgcggtgagtgagcgcggaatgacgtcact

SEQ ID NO: 41434 - DNA, 150 bp, Homo sapiens
  chr7:108515007-108515157
  hypo
gtgtacggtgcatggcggcttccctccttgccccctcccctcctggctcaggcacctgggcatacccgcagcatgcaacaaccacacccaattgtcacgaggggtgggagaaaactgaggctgccaatgggacctcgtgtggctggctgg

SEQ ID NO: 41435 - DNA, 30 bp, Homo sapiens
  chr7:111662581-111662611
  hypo
gctacttattaacgacgtgagcccagccag

SEQ ID NO: 41436 - DNA, 33 bp, Homo sapiens
  chr7:115738436-115738469
  hypo
tgaaccactgcgcccagccgcaaccaagaataa

SEQ ID NO: 41437 - DNA, 16 bp, Homo sapiens
  chr7:116492607-116492623
  hypo
ccgagtagctggaact

SEQ ID NO: 41438 - DNA, 16 bp, Homo sapiens
  chr7:123175665-123175681
  hypo
agagtcttgctctgtc

SEQ ID NO: 41439 - DNA, 30 bp, Homo sapiens
  chr7:127371129-127371159
  hypo
gtctgggaggagctgcgtagccagggctcc

SEQ ID NO: 41440 - DNA, 102 bp, Homo sapiens
  chr7:128096987-128097089
  hypo
ttacaggtatgagccaccgcgcctggcctaagaaagtaaaagttttaagaagtgttcttgaattagtccaagaagcaacactggctccgcagccatgaagtt

SEQ ID NO: 41441 - DNA, 30 bp, Homo sapiens; identical to SEQ ID NO: 1575
  chr7:128097589-128097619
  hypo

SEQ ID NO: 41442 - DNA, 103 bp, Homo sapiens
  chr7:128315917-128316020
  hypo
aggcttgagggagggcgggaagggatggaatgattgactgggatatgcattgctttgtagctggattttagatcaaaagaaaagatagcgttctttagtgcat

SEQ ID NO: 41443 - DNA, 30 bp, Homo sapiens
  chr7:128483019-128483049
  hypo
cctgggtactcacagcgacatgcacctgcc

SEQ ID NO: 41444 - DNA, 54 bp, Homo sapiens
  chr7:128486164-128486218
  hypo
gacagacaatggggacggcacctaccgagtgcagtacaccgcctacgaggaggg

SEQ ID NO: 41445 - DNA, 40 bp, Homo sapiens
  chr7:128493190-128493230
  hypo
ttcctgaccagtctgcgtcaggattcgcattctggggccc

SEQ ID NO: 41446 - DNA, 30 bp, Homo sapiens
  chr7:128525170-128525200
  hypo
tcatggggcccttggcggggctgggcgcaa

SEQ ID NO: 41447 - DNA, 47 bp, Homo sapiens
  chr7:128528840-128528887
  hypo
ggaggaaagtggaatcggtgagaaaggcaccccgggagccccagcag

SEQ ID NO: 41448 - DNA, 30 bp, Homo sapiens; identical to SEQ ID NO: 15026
  chr7:128529102-128529132
  hypo

SEQ ID NO: 41449 - DNA, 30 bp, Homo sapiens
  chr7:128533290-128533320
  hypo
cctgggcagagctggcggccagaggcaggc

SEQ ID NO: 41450 - DNA, 27 bp, Homo sapiens
  chr7:129229604-129229631
  hypo
agtcaccgcgcccggccagtcttttct

SEQ ID NO: 41451 - DNA, 30 bp, Homo sapiens
  chr7:129297274-129297304
  hypo
tgtggctacttacaccgagcatagtatgct

SEQ ID NO: 41452 - DNA, 30 bp, Homo sapiens
  chr7:129330294-129330324
  hypo
cagaacacgcccctgcgccacaggaggtta

SEQ ID NO: 41453 - DNA, 258 bp, Homo sapiens
  chr7:129381062-129381320
  hypo
tcaggtcagggcttccggacagattcccaaggtccctgccatctggcagatggacaccactgactgtggtctcctctccatccacggtgtcctcaaggccaagttacatgcttctttgtctcattctccttccctttaggtccgcagatctttcggagtctttgtatgtaaaggcagattttggtcttagattattccagctccttataaaccaagactgaatcttgtgcctgtcattgtgagcgctattctgtaaag

SEQ ID NO: 41454 - DNA, 30 bp, Homo sapiens
  chr7:129782524-129782554
  hypo
gggataggagaaaaacggcacagagggagg

SEQ ID NO: 41455 - DNA, 313 bp, Homo sapiens
  chr7:129794426-129794739
  hypo
tccaagtgccagctgcgcagcctggcccagagtccgggcccaggagggcccgcagtgcctgcagctgcctggggaccacatgcgtgactggctggccccctgctcatcccgcctctctcctccgcctggcttcgcgccgcctgcctgccctcggggacaagcgtgcccatctgacacctcagcgcctgcccattccccgggaccaggccatctggcctcgctgctgcctctgctctgtgcaacccccatgccgcagcccgtcgcctcctgctccagcctccgccaggactgtcctgtgcgcccatcagggtgt

SEQ ID NO: 41456 - DNA, 30 bp, Homo sapiens
  chr7:129846079-129846109
  hypo
ggagctcaaccccagcggaggcccacagat

SEQ ID NO: 41457 - DNA, 28 bp, Homo sapiens
  chr7:131011379-131011407
  hypo
aggtgtgagccaccgtgccgggcctggc

SEQ ID NO: 41458 - DNA, 51 bp, Homo sapiens
  chr7:131041515-131041566
  hypo
ggaatgtatccaaatcgtgtgcgccaaatatgttgccggtggcagataccc

SEQ ID NO: 41459 - DNA, 30 bp, Homo sapiens; identical to SEQ ID NO: 15029
  chr7:131231034-131231064
  hypo

SEQ ID NO: 41460 - DNA, 35 bp, Homo sapiens
  chr7:132155933-132155968
  hypo
tgcctgctctcgattcgccttctgccatgactgta

SEQ ID NO: 41461 - DNA, 34 bp, Homo sapiens
  chr7:132156088-132156122
  hypo
cggtgtaatacaaatagaccgttgtgtgtgttgt

SEQ ID NO: 41462 - DNA, 117 bp, Homo sapiens
  chr7:132418949-132419066
  hypo
acggtgagaggaacacgttggcggaagaagacaagcagctggatatcgaggggacatcgaggggagcatgctggcagaagaacacaccaacagagggacacccgcactctggctggt

SEQ ID NO: 41463 - DNA, 30 bp, Homo sapiens
  chr7:134116597-134116627
  hypo
tggtcatagatctgccgaggagcacaagaa

SEQ ID NO: 41464 - DNA, 30 bp, Homo sapiens
  chr7:134880911-134880941
  hypo
atgagtggtgttccccgtactcctcctgtc

SEQ ID NO: 41465 - DNA, 104 bp, Homo sapiens
  chr7:134885144-134885248
  hypo
gagagtgaaagatgccggcagaactgtgtactctctagacaatgacacttgcacacagagaagcttgcacccttctggaagcttcttctactgtgaccctacct

SEQ ID NO: 41466 - DNA, 57 bp, Homo sapiens; identical to SEQ ID NO: 15030
  chr7:134918564-134918621
  hypo

SEQ ID NO: 41467 - DNA, 30 bp, Homo sapiens
  chr7:134953117-134953147
  hypo
cccaacacagagggtcggaataaacatccc

SEQ ID NO: 41468 - DNA, 37 bp, Homo sapiens
  chr7:135125375-135125412
  hypo
tagaaaactgcaggccgggtgcagtggctcacgccta

SEQ ID NO: 41469 - DNA, 84 bp, Homo sapiens
  chr7:135196033-135196117
  hypo
gcagttttaaatttacgaacttaatttcataataagccctcaattcattgttttttctttttttttttttttgagacggagtct

SEQ ID NO: 41470 - DNA, 24 bp, Homo sapiens
  chr7:135196357-135196381
  hypo
gattacagacgtgagccagggcac

SEQ ID NO: 41471 - DNA, 37 bp, Homo sapiens
  chr7:135234576-135234613
  hypo
atcttctttctctgccgggcacggtggctcatacctg

SEQ ID NO: 41472 - DNA, 30 bp, Homo sapiens
  chr7:135391578-135391608
  hypo
gtcacagaagtgtcccgtgtcactgtgtgc

SEQ ID NO: 41473 - DNA, 135 bp, Homo sapiens; identical to SEQ ID NO: 15032
  chr7:135401363-135401498
  hypo

SEQ ID NO: 41474 - DNA, 30 bp, Homo sapiens
  chr7:135898077-135898107
  hypo
agggacacagacattcgaagcatagcaaga

SEQ ID NO: 41475 - DNA, 23 bp, Homo sapiens
  chr7:135965324-135965347
  hypo
accatgcccggcatgactgctct

SEQ ID NO: 41476 - DNA, 36 bp, Homo sapiens
  chr7:137092635-137092671
  hypo
atttcacaatctccccgttgccggttttagctgcgt

SEQ ID NO: 41477 - DNA, 30 bp, Homo sapiens; identical to SEQ ID NO: 15033
  chr7:137664095-137664125
  hypo

SEQ ID NO: 41478 - DNA, 18 bp, Homo sapiens
  chr7:137693378-137693396
  hypo
acacggcctcggtgtgtt

SEQ ID NO: 41479 - DNA, 32 bp, Homo sapiens
  chr7:138845459-138845491
  hypo
gcatgagccactgcgcccggcccaagtcactt

SEQ ID NO: 41480 - DNA, 55 bp, Homo sapiens
  chr7:138912533-138912588
  hypo
tcctgtatttaccaacgattccaacttcttggtttagccacgttgctgtgaacta

SEQ ID NO: 41481 - DNA, 18 bp, Homo sapiens
  chr7:138913068-138913086
  hypo
gctgaggcaggagaacgg

SEQ ID NO: 41482 - DNA, 17 bp, Homo sapiens
  chr7:138913146-138913163
  hypo
ggcgacagagcaagact

SEQ ID NO: 41483 - DNA, 30 bp, Homo sapiens
  chr7:138957222-138957252
  hypo
tgagaagtgtatgtacgttatgtatgtatg

SEQ ID NO: 41484 - DNA, 38 bp, Homo sapiens
  chr7:139027295-139027333
  hypo
cctcccaggttcaagcgattctcctgcctcagcctccc

SEQ ID NO: 41485 - DNA, 30 bp, Homo sapiens
  chr7:139112625-139112655
  hypo
aatcctgtggttactcgaagggaccatatt

SEQ ID NO: 41486 - DNA, 30 bp, Homo sapiens
  chr7:139245499-139245529
  hypo
cccagcaggatgtggcgtttcttaggcttg

SEQ ID NO: 41487 - DNA, 148 bp, Homo sapiens
  chr7:139650638-139650786
  hypo
tctacgggaccccctcgccctccatctacgggaccccctcgccctccatctacaggacccactccttcagcagaggagttgggcccctggtaacacaattctttccttacacccagagcacgtaggactgactcggaggaaactgcag

SEQ ID NO: 41488 - DNA, 30 bp, Homo sapiens
  chr7:139919897-139919927
  hypo
gaaccaaacctggatcgtatttcagcattc

SEQ ID NO: 41489 - DNA, 30 bp, Homo sapiens
  chr7:139939160-139939190
  hypo
gtggctccttccttgcggggcagcctgaat

SEQ ID NO: 41490 - DNA, 68 bp, Homo sapiens
  chr7:140007275-140007343
  hypo
agaatgaattcccatcgcacataggatagagaagcagggcagccggcaggtgccgcatgcacataaag

SEQ ID NO: 41491 - DNA, 21 bp, Homo sapiens
  chr7:140026923-140026944
  hypo
acggagcgagattctgtctca

SEQ ID NO: 41492 - DNA, 31 bp, Homo sapiens
  chr7:140096707-140096738
  hypo
gacagagtctgaggccgggcgcagtggctca

SEQ ID NO: 41493 - DNA, 30 bp, Homo sapiens
  chr7:140097278-140097308
  hypo
acaccgcgcccaacccgaagctcaatttcc

SEQ ID NO: 41494 - DNA, 80 bp, Homo sapiens
  chr7:140156598-140156678
  hypo
accatgtccttgctgcgctgcacggcaaatgagagctccatgtccttctcatgggcctcaatgcacgactagagaaggtg

SEQ ID NO: 41495 - DNA, 50 bp, Homo sapiens
  chr7:140192162-140192212
  hypo
ccactggtgccactgcgagcccagcgggggcagagcgagattacagcccc

SEQ ID NO: 41496 - DNA, 30 bp, Homo sapiens
  chr7:144488206-144488236
  hypo
ctactaccttatcaacgttcaatcatattt

SEQ ID NO: 41497 - DNA, 20 bp, Homo sapiens
  chr7:144565939-144565959
  hypo
acaggcgtgagccaccgcgc

SEQ ID NO: 41498 - DNA, 22 bp, Homo sapiens
  chr7:146300226-146300248
  hypo
gggcgaggtggctcacgcctgt

SEQ ID NO: 41499 - DNA, 30 bp, Homo sapiens
  chr7:148500594-148500624
  hypo
attcctcacggtaagcgaaggtgagctgag

SEQ ID NO: 41500 - DNA, 95 bp, Homo sapiens; identical to SEQ ID NO: 5071
  chr7:148640241-148640336
  hypo

SEQ ID NO: 41501 - DNA, 53 bp, Homo sapiens
  chr7:148842138-148842191
  hypo
gtaaatcccaaattacggactgcatatgtagccacaggcgaaaagtaacttag

SEQ ID NO: 41502 - DNA, 149 bp, Homo sapiens
  chr7:148846075-148846224
  hypo
cttaaattctctaggcgtcacgtttaaaaagtaaaaagccaggcgctgtgttgtgcacgcctgtagtcccagctaggccgggggctgaggcggaagaatcacttgagtccaggagttcgaggcagtccacaccgcgtctctaaaataaa

SEQ ID NO: 41503 - DNA, 38 bp, Homo sapiens
  chr7:148883975-148884013
  hypo
gggattacaggagtgagccaccgcgcccggcccgcgta

SEQ ID NO: 41504 - DNA, 93 bp, Homo sapiens
  chr7:150049533-150049626
  hypo
accagaatgtcttatcgttgaaattattttttacttccttttgaaatgcttgagtttttttgtttgttttggtttggtttttgagacggagtc

SEQ ID NO: 41505 - DNA, 56 bp, Homo sapiens
  chr7:150068969-150069025
  hypo
ccccggcccaggggccgccccgcggtgaccgccccccggcccggtggagatgccgt

SEQ ID NO: 41506 - DNA, 82 bp, Homo sapiens
  chr7:150069445-150069527
  hypo
ctccctctacagctgcgacgactgcggcaggagcttccggctggagcgcttcctgcgggcccaccagcggcagcacaccggg

SEQ ID NO: 41507 - DNA, 143 bp, Homo sapiens
  chr7:150070146-150070289
  hypo
agaggggatggaagacgcggggagtgagctgggtgggccctgctagcgagagaggtcaaccccggtggccagggaacccacttccaagcgcagggacgccggcctccagctggtgtgtgctaaggctccgtcctgactgccct

SEQ ID NO: 41508 - DNA, 45 bp, Homo sapiens
  chr7:150081206-150081251
  hypo
aactgcagcctgacccggtgcgcggagggccgggccagggccagg

SEQ ID NO: 41509 - DNA, 76 bp, Homo sapiens; identical to SEQ ID NO: 15042
  chr7:150746248-150746324
  hypo

SEQ ID NO: 41510 - DNA, 193 bp, Homo sapiens
  chr7:150758966-150759159
  hypo
ccctcccagggctctcgatggtgatcaggcctctcccccatccaggttatgcctccgcctcgttgccctgaaagccgcagcgacagcgaaaagggctaagattcggccatgagcagcgcccctcggcgccccgccaagggcgcagattctttctgtacggtgagtgtggcccccaggtcgccagcccaacctt

SEQ ID NO: 41511 - DNA, 142 bp, Homo sapiens
  chr7:150773923-150774065
  hypo
ggggagaggagagggcggcaggttacccgcaggctgggagtgaggatgcgccacgggccaggccagggccactcaccggcaggagctggtagcccatcaggcctaggtgccgctccctcagggccctcgagcccagcagcac

SEQ ID NO: 41512 - DNA, 33 bp, Homo sapiens
  chr7:150774325-150774358
  hypo
ggaggggagcagggccggcggccttagccaggg

SEQ ID NO: 41513 - DNA, 99 bp, Homo sapiens; identical to SEQ ID NO: 15043
  chr7:150774704-150774803
  hypo

SEQ ID NO: 41514 - DNA, 73 bp, Homo sapiens
  chr7:150811286-150811359
  hypo
aagacaggaccacctcgttgaagctcgcgtgctgcagacgaggacacgcgcgcagacccggcatggctgcctc

SEQ ID NO: 41515 - DNA, 330 bp, Homo sapiens
  chr7:150823565-150823895
  hypo
tggggtgaggggagtcgggacgggggcggggagccgggtccatccctcacacttggttatttctttggtttgtgtgctgggggcggggcggggggtattggggatgactccaaggcatctccagagcctgagggacttagagccttcgagcacgctagtcccatggctggtcgcagcgggagggggaacagctgactgcttctgagctctcagtgcacctggcccctggccagtgacaggaataccacacccagaggcaggtcaccaaggcccagcctacctggaagactccttcgcagaccaagaggcagggcccgcttgccttgtgga

SEQ ID NO: 41516 - DNA, 383 bp, Homo sapiens
  chr7:150870816-150871199
  hypo
ctccaaactctttcccgcaccagcgagcccgcactcgcatgatacccagacctgcgctcgacctggccccagatccccgtgccaagggccacagcctctgagatgcttcctaggcggctccagtgccatctccccagcaacggccttctgcttcccgttacttcctcgtcttccccatcttagcatctggcaccaccgtccaggggtccaagccaaaaacctgcgagtcgccctagacagcgctattctgcagccccctacatcccccccagcggcggccccccagttcttcccagggatcccgaatctcgcccgccgcgaccacctctggcctggaccaccgccgcaggtgccccccgacccacgcccgcagccaggacggt

SEQ ID NO: 41517 - DNA, 84 bp, Homo sapiens
  chr7:150872928-150873012
  hypo
atccacacctgcctgcggagctgggcctcctgctgccagggctacctggcctgagttagtgcagaggcgcgccctctgcaggct

SEQ ID NO: 41518 - DNA, 47 bp, Homo sapiens
  chr7:151082165-151082212
  hypo
tcacttacaggtgcccgcgtggtacttgagggcgctcacgttgcgtc

SEQ ID NO: 41519 - DNA, 151 bp, Homo sapiens
  chr7:151553602-151553753
  hypo
ttcaattggcctcgccgtggcccttaggcaaacaactcattctatctgagcctccgtttctccaactgtaaaaaccgggtgaatactaggaacaggcagagttgctgatgagttaaatggcaaaatatgtgaaagacgttaagtctggcac

SEQ ID NO: 41520 - DNA, 30 bp, Homo sapiens
  chr7:151585396-151585426
  hypo
tccttgccatcagaccgtcgaggagtctgt

SEQ ID NO: 41521 - DNA, 30 bp, Homo sapiens; identical to SEQ ID NO: 15047
  chr7:151591649-151591679
  hypo

SEQ ID NO: 41522 - DNA, 30 bp, Homo sapiens
  chr7:152159631-152159661
  hypo
tagccaagggtttctcgtgtttgatgccaa

SEQ ID NO: 41523 - DNA, 40 bp, Homo sapiens
  chr7:152337514-152337554
  hypo
tactgggattacaggcgtgaaccaccgaccctggctgaaa

SEQ ID NO: 41524 - DNA, 175 bp, Homo sapiens; identical to SEQ ID NO: 15049
  chr7:152693809-152693984
  hypo

SEQ ID NO: 41525 - DNA, 206 bp, Homo sapiens
  chr7:152782995-152783201
  hypo
ggagttaagttaacccgaggtcttaattttattaaatgatcactgcggtgcagtgggttgaatatgggattcagaaatagaaggtttggcttcatttggtccacaaatagtcattgctgtgttcacagattggtacacagtgatgtataatagcggagacagacagattgcaagctctgtgacagcgatgacgaacgtgggacgtg

SEQ ID NO: 41526 - DNA, 34 bp, Homo sapiens
  chr7:152984071-152984105
  hypo
gagcaaagtgcacatcgctcgtggaacagggaaa

SEQ ID NO: 41527 - DNA, 24 bp, Homo sapiens
  chr7:153041593-153041617
  hypo
tttttttttttgagacggagtctc

SEQ ID NO: 41528 - DNA, 38 bp, Homo sapiens
  chr7:153102258-153102296
  hypo
cagtgcccaaacaatcggctccccgttctcttacgtca

SEQ ID NO: 41529 - DNA, 80 bp, Homo sapiens
  chr7:153540019-153540099
  hypo
ttattggaagaaaatcgatgcccccactcacccacctgcgcatgtgtgcatgtgtgtgtgcacgcacatacacacataca

SEQ ID NO: 41530 - DNA, 30 bp, Homo sapiens
  chr7:153641678-153641708
  hypo
aggcctcacaacacacggggccttgcaggc

SEQ ID NO: 41531 - DNA, 30 bp, Homo sapiens
  chr7:153896397-153896427
  hypo
tgctcctaaaatgcacgttaatattgatgc

SEQ ID NO: 41532 - DNA, 40 bp, Homo sapiens
  chr7:154088244-154088284
  hypo
tcatacacagtgccacgcgtgggggcggttctcagtcaga

SEQ ID NO: 41533 - DNA, 30 bp, Homo sapiens
  chr7:154186455-154186485
  hypo
tgagtatttgcaggacgctgttctgagatt

SEQ ID NO: 41534 - DNA, 39 bp, Homo sapiens; identical to SEQ ID NO: 15050
  chr7:154561150-154561189
  hypo

SEQ ID NO: 41535 - DNA, 45 bp, Homo sapiens
  chr7:154665013-154665058
  hypo
tctaggtgatgtccacgcgctgacaccgcacggggaggcagtgca

SEQ ID NO: 41536 - DNA, 41 bp, Homo sapiens
  chr7:154670093-154670134
  hypo
ctcaaagaatgggagcgtgtggacaacggcaaagcttagag

SEQ ID NO: 41537 - DNA, 43 bp, Homo sapiens
  chr7:154922507-154922550
  hypo
tggatgttgtgtcaccgtccacactccccgctggtcccaccaa

SEQ ID NO: 41538 - DNA, 30 bp, Homo sapiens
  chr7:155130764-155130794
  hypo
gtgcagggaggccagcggctgggacagagg

SEQ ID NO: 41539 - DNA, 44 bp, Homo sapiens
  chr7:155133192-155133236
  hypo
tcctctgctgcacagcgtgggttgggtcccgtggctgagcaccc

SEQ ID NO: 41540 - DNA, 30 bp, Homo sapiens
  chr7:155144931-155144961
  hypo
cctcctgatgtgtaccggggcgaggcttac

SEQ ID NO: 41541 - DNA, 43 bp, Homo sapiens
  chr7:155202839-155202882
  hypo
catgcggggagggggcgcggggagggggcgcaggacgggcctg

SEQ ID NO: 41542 - DNA, 216 bp, Homo sapiens
  chr7:155363288-155363504
  hypo
tccacagaacacctccgggtcccgggcactccgggccagcgcaggccccagcagcagggccagcagagccagaggcagcagcatgggccccatgccagctgtgccgccgcacaccggcctccttccaggcccctcacaggcccctccgcgagtgctgggcgtgcagcagacaaatggcatacaaaggtcctcgggccgcaccgccctagatacccg

SEQ ID NO: 41543 - DNA, 165 bp, Homo sapiens
  chr7:155580762-155580927
  hypo
caccatctgtgtccacgcagagggtcgggccgtgggagccgcgagtgtctggcccacacttctgttcttaacctcgcaatgtattcaggtttccccaggcggagcgctcagcatatcgacagctaaaaatccaaccaaggccgggcgcggtggttcacgcctgta

SEQ ID NO: 41544 - DNA, 547 bp, Homo sapiens
  chr7:155581330-155581877
  hypo
ggtccactgcccagccggggatgcaaggacggccatggggctccagcacagggaccgggccccgcgggctttgagtgacgcggtaggccaggacgagccccatccacacttggacaatgagcaaccgcagccggccgcgcagcctgggggccgtctccctctccagcccccgtgtcctctggtccacgactggctcttgccctcattccgttggggctgagtcacagccagggaaagggctgaggcagagcaacgctgggtgaaccccgtcttcctgaggccacgtttgcaccgggaagagaacacagtgaaccccctgagcaccaacacgctcccacaccccccacgagcagcccagccctggggaggagcccgtccttctccctgcttgccacaccggccacgtccgtaaccctgcccagcatcccacccaggttgtgtgggtccccacgtggtcaccagcgtcctttcaggacaagagaaaactgagcaggaccagggcttccgcctgccgcattcatctgccccccttcggctgtgccaggtg

SEQ ID NO: 41545 - DNA, 84 bp, Homo sapiens
  chr7:155582232-155582316
  hypo
gcggcctttgcttcccggtgctggctgtgcccagacgcctgggcttgtgcgtgtttaacccgcccagagactggtgctgccgca

SEQ ID NO: 41546 - DNA, 37 bp, Homo sapiens
  chr7:155752556-155752593
  hypo
cctgactcagtgaagcggccagcgtgtcttccaatac

SEQ ID NO: 41547 - DNA, 105 bp, Homo sapiens
  chr7:155753582-155753687
  hypo
tgcctgagcgtgtgtgtgtgtgtgtgtgtgtgtgtgtgtgttagaatcctgccctgagctggccttcaggaaggtgaattccggtttctgcgcactctgcactct

SEQ ID NO: 41548 - DNA, 34 bp, Homo sapiens
  chr7:155786790-155786824
  hypo
ctgcatctcacctggcggccgtggggcaccttca

SEQ ID NO: 41549 - DNA, 52 bp, Homo sapiens
  chr7:155854343-155854395
  hypo
gtcctcctggcccaccgtgattgttcagagaccgccgcgggtgcagagtgca

SEQ ID NO: 41550 - DNA, 30 bp, Homo sapiens
  chr7:155871902-155871932
  hypo
tgtttccctctggcccgcagcgttgcccat

SEQ ID NO: 41551 - DNA, 175 bp, Homo sapiens
  chr7:155898977-155899152
  hypo
cagcaggcagggcaccggtccggcgtaagctcactctcagctttcagttagatcgcagctcctggattgagctgtatacccaaacccagctatatgctctttacaagcacatacaataaagtgacagaaagggatccaaaaagtgtactgggtgcgtgcacggagggaagaggag

SEQ ID NO: 41552 - DNA, 24 bp, Homo sapiens
  chr7:155920548-155920572
  hypo
acttcttacctggctcgctgcaaa

SEQ ID NO: 41553 - DNA, 38 bp, Homo sapiens
  chr7:156012968-156013006
  hypo
cagagcatgtgaatgcggtgagccgcaggctgtgtgct

SEQ ID NO: 41554 - DNA, 173 bp, Homo sapiens
  chr7:156025663-156025836
  hypo
aggtggagtggggaccgtagtgcccagtgtccacattagaaccctgctgttccgtgacccagaaccaggacaggagccacctgtggttcaggtgagggcaagagtccacggagcccggacaggagcggcagagcaggccgcacctcccgggcaccttccggggctgagcaccc

SEQ ID NO: 41555 - DNA, 44 bp, Homo sapiens
  chr7:156138347-156138391
  hypo
ttccttgtttgccagcgagcggggaacagcggcctcgtgctctc

SEQ ID NO: 41556 - DNA, 102 bp, Homo sapiens
  chr7:156177626-156177728
  hypo
aagggacgtgccagccgtgttgtgtactcattcgtctccactgctagcaaggtcctgggcacacaggcagcggtcagtaatgtttgtcgaaagaagaaaagt

SEQ ID NO: 41557 - DNA, 105 bp, Homo sapiens
  chr7:156744694-156744799
  hypo
cggccggttttgatttttatcatataaacttagatattacttttaaacaagtttgaaattgtttttaggacactttccctccaaaattagcggtttgtttaattt

SEQ ID NO: 41558 - DNA, 33 bp, Homo sapiens; identical to SEQ ID NO: 15061
  chr7:156832223-156832256
  hypo

SEQ ID NO: 41559 - DNA, 482 bp, Homo sapiens
  chr7:156832680-156833162
  hypo
caagtgtgctgaagacgcaaacctaacacgcaggaggcaggaaccgtctgaggcagcccccggcaaacgtcaggctgtgtggctcagacccggcacagcctccgcgatgggagctccggggggggctggctggggacaaggacaagcggacttgggagcgacggggtttgggcatctgggagacgggaactccttcccgggaggaagaccgtgagggaggcgtggaagtggatgtgagccggtgtgcactgggctgcagtgcgcgctgctgggccggtccgggagcccacactgttgggtgctggctgctagaagcccacagcaggggcccgaggcccaccccctagcctcagggcacagcttcccctgtccagccaaggctgccttacccaagccctggtcctgcctgttccgtgccttctcccgcaaggcttcttcaacagcacaccgcgaaaacgtgcaggcatcgcccccagcacaag

SEQ ID NO: 41560 - DNA, 68 bp, Homo sapiens
  chr7:156880531-156880599
  hypo
ccggcaactacaaggcggtgctcacggacagcacggccctcggcgtggatatccggaaggcagccacc

SEQ ID NO: 41561 - DNA, 50 bp, Homo sapiens
  chr7:156883354-156883404
  hypo
ccccaaggtcaggggcgcctggcctgggccctggacgtcattctgaggac

SEQ ID NO: 41562 - DNA, 30 bp, Homo sapiens
  chr7:156924103-156924133
  hypo
cggagctctgatgcccgcagacagaagatg

SEQ ID NO: 41563 - DNA, 21 bp, Homo sapiens
  chr7:156929628-156929649
  hypo
ttatttattttgagacggagt

SEQ ID NO: 41564 - DNA, 81 bp, Homo sapiens
  chr7:157075212-157075293
  hypo
ccatggcggataacccgcctgaccccttccactcggctgtcggtacccacctgtcagccccacctgcgtgtccccctggaa

SEQ ID NO: 41565 - DNA, 171 bp, Homo sapiens
  chr7:157084426-157084597
  hypo
gcgcgcctggaggagcgtttggcatcactcaacactaaagtgcaaacgtgggctccaagagcaagtcaagggtgttaccagctgggctctgggagcaaagacaaaggccagtggcctcccacccgccgtggcaggacaagcagagtgtggtctccacgcaagaggctggag

SEQ ID NO: 41566 - DNA, 252 bp, Homo sapiens
  chr7:157085343-157085595
  hypo
gggggaggccaggaccgtggagttctagagggggcaccaagggcccgtgtgtccgcgtggagctggacatgcttctgtgggccaggcaccctgaccctgatcctctccagtgaagaggccgggggcaggcggaactgggtcaggctccaggacacagcctcaccctatcagggcagcgagggctggggcggacaggggagccgtagacagcccgtccctgggtgggcctggccttcccggccctgactcagc

SEQ ID NO: 41567 - DNA, 221 bp, Homo sapiens
  chr7:157085926-157086147
  hypo
gggagagctgctgcccggccgagcctctgctcccacggtctcaggccctccccgccctgatgagtctccgctcccaacacaagggccacgtggtctggagggaccttttgcccagctgcaggggccatctcagggagaccccgccttggaggacttgttctccggatctccagacgtttaggctgaaagtgcagagatttagaagtcggacagggagttgg

SEQ ID NO: 41568 - DNA, 71 bp, Homo sapiens
  chr7:157099869-157099940
  hypo
caaactttgaaaagtcgattctgcacatatactatggttctgttccatcccatctccggagggtaggcagc

SEQ ID NO: 41569 - DNA, 30 bp, Homo sapiens
  chr7:157147812-157147842
  hypo
gccttgagcctttagcgttcccgtagtttc

SEQ ID NO: 41570 - DNA, 48 bp, Homo sapiens
  chr7:157217366-157217414
  hypo
gcagtgagtctcacccgtgccactgcactccagcgtgggagacaccgt

SEQ ID NO: 41571 - DNA, 46 bp, Homo sapiens
  chr7:157218481-157218527
  hypo
gaggctcaattcagccggatgtttgtgctcacgtgctcacagcggc

SEQ ID NO: 41572 - DNA, 30 bp, Homo sapiens
  chr7:157220595-157220625
  hypo
gcctggggggacccccgggggctgctgagg

SEQ ID NO: 41573 - DNA, 30 bp, Homo sapiens
  chr7:157233964-157233994
  hypo
ccctccactgtggaccgcagagtaatggcc

SEQ ID NO: 41574 - DNA, 36 bp, Homo sapiens
  chr7:157235760-157235796
  hypo
aggctctaatgcttgcggcaccgccactcacctcct

SEQ ID NO: 41575 - DNA, 261 bp, Homo sapiens
  chr7:157255061-157255322
  hypo
catgacagtgggacacggggtctggggcgaggctggacgctgccatccagcacccagctcgtttcggcctgggctgccctcagcactgcgcagacccgcgagctcctcatttccccggaagatgaacgagaaggttcgcgcgagattctctgcaaagccctggcacaggccccgtccctgcagctgtttattgacgctgtggcggccgagacggcatgtttggaaatctgcttggcatggagactgcggtgccctgaccac

SEQ ID NO: 41576 - DNA, 892 bp, Homo sapiens
  chr7:157262579-157263471
  hypo
actccagggtgaacccgggactcctgagtgggcgcccaggcccctctagtgctggccgcctctgcttccctctccaggcccacctgccggccaccacagtggcccccagcgcccagcccaggtcccccacgccggcttctctcggcccaggtcactctcttcacactgtcatctgccagtcacttgcacactctgattcccaaggcgactctgctgcaggcacacgccctcagcaagacctggctgagtgccgtctgtgcccgtggatgcacgcgcagctctcctggggacactggccctggctccactccctggacagatctgtgcccggcactgggtctgctccctgcacagacccacacctggtgctggcgccactccccggacacacctgcccctggcgctggcctgggttgggtgtgtccgtgtgtccagcgctggcctggattgggtgtgtccgtgtgtccggcactggcctgcgttgggtgtgtccgtgtgtccggcgctggcctgggttgggtgtgtccgtgtgtccggcgctggcctgggttgggtgtgtccatgtgtccggcgctggcctgggttgggtgtgtccgtgtgtccggcgctggcctgggttgggtgtgtccgtgtgtccggcgctggcctgggttgggtgtgtccgtgtgtccggcgctggcctgggttgggtgtgtccgtgtgtccggcgctggcctgggttgggtgtgtccgtgtgtccggtgttggcctgtgttgggtgtgtccggcgctggcctgcattgggtgtgtctgtgtgtccggcgctggcctgggttgggtgtgtccgtgtgcccggtgctggcctgcgttgggtgtgtctgtgtgtctggcgctccagcggggagtctgtggg

SEQ ID NO: 41577 - DNA, 30 bp, Homo sapiens
  chr7:157276023-157276053
  hypo
gctgtttttaattcccgagcgttcttttgg

SEQ ID NO: 41578 - DNA, 143 bp, Homo sapiens
  chr7:157280216-157280359
  hypo
agatgaagaccagggcgggcaggggcctggcccaggttctggagaagcaaggggtgcttctcggatatcacggtggatgagagtgacccagagtcgttaaccagagtgtctatgcggccgtgacgaggcgtggactcggctgt

SEQ ID NO: 41579 - DNA, 108 bp, Homo sapiens
  chr7:157280626-157280734
  hypo
ggcacacgggagagccggggagggcacacgggagagccggggagggaacacgggagagccggggagagcacacgggagagccggggcggcacacgggagagcagatga

SEQ ID NO: 41580 - DNA, 30 bp, Homo sapiens
  chr7:157291421-157291451
  hypo
tgggcctggtgaagacgggcacaaaacagc

SEQ ID NO: 41581 - DNA, 33 bp, Homo sapiens
  chr7:157294288-157294321
  hypo
gcacacagcttttgccgtcgtttggagaattac

SEQ ID NO: 41582 - DNA, 30 bp, Homo sapiens
  chr7:157319640-157319670
  hypo
tcgcctggcccctcacgtgcggagcacgtc

SEQ ID NO: 41583 - DNA, 30 bp, Homo sapiens
  chr7:157320767-157320797
  hypo
ttcagggttaggccccggaacctcacacat

SEQ ID NO: 41584 - DNA, 142 bp, Homo sapiens
  chr7:157337964-157338106
  hypo
tgtgagcagtgtgcacggctgtatgtgggtgtgtaccacatgcgtgggtgtgtaggtgtgtgtggggggtgtgcctgggtgtgtgcatggggatgcgcagtgtgtggctgagtgtgggtgtgcactgcgtgagtgggtgtgt

SEQ ID NO: 41585 - DNA, 83 bp, Homo sapiens
  chr7:157338308-157338391
  hypo
gatggagtttgtggtcggggactgagttgccaaatgctcaggtgggcgctggtgaaacattttctattcgacccaaattccag

SEQ ID NO: 41586 - DNA, 30 bp, Homo sapiens
  chr7:157346704-157346734
  hypo
tgggtgcggccaggccgggcgccggatcct

SEQ ID NO: 41587 - DNA, 151 bp, Homo sapiens
  chr7:157346983-157347134
  hypo
tgcggccaggccgggcgccggatcctgcccgctctcgtgccctcctgggcatgggtgcggccaggccgggcgctggatcctgcccgctcttgtgccctcctgagcatgggtgtggccaggccgggcaggggcacaacgttggcattgataa

SEQ ID NO: 41588 - DNA, 37 bp, Homo sapiens
  chr7:157347797-157347834
  hypo
agacaccaggctctgcgtgctccgctggcacccgaat

SEQ ID NO: 41589 - DNA, 129 bp, Homo sapiens
  chr7:157352962-157353091
  hypo
tacactcagtgaggacggctccatgcacagggacgaagacccccgaggagaccatcgaaggatggtgggcagtgctgcccacacggatgcccagagcgtgttccccaagaccagcgggtctcatgctgt

SEQ ID NO: 41590 - DNA, 69 bp, Homo sapiens
  chr7:157370495-157370564
  hypo
gggtgactcagcctccgtcccctgaacatggggtgcgctgagcctccctgcatgcggccctcgggggtg

SEQ ID NO: 41591 - DNA, 209 bp, Homo sapiens
  chr7:157396449-157396658
  hypo
atgttctacaagtcacggaacccaccgcccagcgtgagccgggacccacacggctcataaacagccccgctggtgaaggaacaggggagtggcgggagcccaatgggcagagtcggccctgtccaccgcagagacgctgagctgggtggggacgtgatttcccccgagaaccttcccacgtgatttgccgcgtccgtgccacccaaggg

SEQ ID NO: 41592 - DNA, 189 bp, Homo sapiens
  chr7:157403604-157403793
  hypo
gtcattcagggcctccgcagctcagcatacaatgctgcatctgggcagactgggacaggctggggctcatatccagaaagccctgctacatccagagatggtcatgaaaatgagacctgccccacccaccactcaggaggcacgctgctcaccgctgagctgaataaccgagcgcgaggctggtgtccg

SEQ ID NO: 41593 - DNA, 152 bp, Homo sapiens
  chr7:157408585-157408737
  hypo
ggcctcagaatcagccggcgctgagatgtgcacctggcaggatgaacgtaacttctggtggataaagtgggaggcctgatccaggaagaagcacaccgtggcctggggcccctctggagggtaggtcttccaagtcacgggaaacagggcgc

SEQ ID NO: 41594 - DNA, 101 bp, Homo sapiens
  chr7:157437497-157437598
  hypo
aaaaaaaaaacaaaaaacaaaagaaaacaaaacaaaagcagcagcactgtctgctctgagctacaatcctatgcacgatttccacccgtgggaaccacacg

SEQ ID NO: 41595 - DNA, 77 bp, Homo sapiens
  chr7:157443179-157443256
  hypo
ggagagttcgccctgcggcctggtttactcatcaggcctccgcgccagcacccgagccagagcgagaacggccagcc

SEQ ID NO: 41596 - DNA, 88 bp, Homo sapiens
  chr7:157448438-157448526
  hypo
tgtcctaataacacccggacattcattatgtatggagtggcaatgcacggccacacacgcgtgatcactccagcgaggaccctggaaa

SEQ ID NO: 41597 - DNA, 160 bp, Homo sapiens
  chr7:157449174-157449334
  hypo
gatgcgtgacgtgtgcgggccctcaggtcggtctggtggccgcgtggccatacgctggcggcacagctcctgcaggacagggggaggaagagcagggggttagtggcattggggacacccagcaggacgagggccacggcacccacgtggcacaacccct

SEQ ID NO: 41598 - DNA, 93 bp, Homo sapiens
  chr7:157455478-157455571
  hypo
tgtgcttttccagggcgagccttctttttggacatgggatgtacccgatgtctacaagcttgaagtaacattgccgaccgtgtgcttcttgtg

SEQ ID NO: 41599 - DNA, 30 bp, Homo sapiens
  chr7:157455840-157455870
  hypo
tgggaagaagttccccgggcatcggcgact

SEQ ID NO: 41600 - DNA, 44 bp, Homo sapiens
  chr7:157511451-157511495
  hypo
gggtgagtctcagcacgtccaggcgtccgcggtgacactgcagc

SEQ ID NO: 41601 - DNA, 152 bp, Homo sapiens
  chr7:157512238-157512390
  hypo
ccagttcttggcatccgggagctccagctggcatgaaggcagaaagaataacagccagtggcagtggaaggcatgagcgcccccggagagcagggccagaccatcagcagggcccctccaagaggagctctgtatgccgggggagtgggctc

SEQ ID NO: 41602 - DNA, 52 bp, Homo sapiens
  chr7:157527557-157527609
  hypo
tcggccatgtgcctgcgttttccaatattgatgtcgacgtgggaggcaagtt

SEQ ID NO: 41603 - DNA, 30 bp, Homo sapiens
  chr7:157530181-157530211
  hypo
tgcccgggcagggggcgcaggcaggagggc

SEQ ID NO: 41604 - DNA, 30 bp, Homo sapiens
  chr7:157536702-157536732
  hypo
acgtgctccggggcacgactctgacgcagc

SEQ ID NO: 41605 - DNA, 103 bp, Homo sapiens
  chr7:157551220-157551323
  hypo
gaggctaaagggagccgaggcaggtggcagctgctgtgctgggaaggctgcgtgcgcggggcatcctctcttggcccgggtgggcggacgcaggggtccctgg

SEQ ID NO: 41606 - DNA, 48 bp, Homo sapiens; identical to SEQ ID NO: 15075
  chr7:157565500-157565548
  hypo

SEQ ID NO: 41607 - DNA, 30 bp, Homo sapiens; identical to SEQ ID NO: 15076
  chr7:157568187-157568217
  hypo

SEQ ID NO: 41608 - DNA, 30 bp, Homo sapiens
  chr7:157578615-157578645
  hypo
gcagggtgggagggccgggtggggatggct

SEQ ID NO: 41609 - DNA, 341 bp, Homo sapiens
  chr7:157583900-157584241
  hypo
aagaagaatgagatacgtccatttgctgtgataagaaaagatattccacagtttcgtatttgttaagtattttcagcaaatcatggaacacgatgcaacacccgattccatgtttgaaaacagaacagaacaaaattcaacaagaaataagcgcccgcgtccacatattctcgtgcctggcgtgttttacgtgcttgggaagcggagcggccgctgggcttggctctgaggtcgggactggtgcaggcggatgcatgtatgtgcccgggtcccgcctccacacgcctgcctggcgccagcctgcctgtcctccctgcacccgcccccgctccctgcaccca

SEQ ID NO: 41610 - DNA, 30 bp, Homo sapiens
  chr7:157584643-157584673
  hypo
ccgaccaggcctccacgaagtgcttcgata

SEQ ID NO: 41611 - DNA, 30 bp, Homo sapiens
  chr7:157585079-157585109
  hypo
ttgctgtggctctggcggacattagccagc

SEQ ID NO: 41612 - DNA, 407 bp, Homo sapiens
  chr7:157588586-157588993
  hypo
cacatgtgatgctgacgccctcagaaacctggggctaaggccacacctgatcaccgtgatggaggggggcaggcgccgaggcgaacttgggagaggccctatggtgcacacccctacccttcctggctggagaaaaatggcccgccccgtgaaacagcaaataaacacacgcgttccaggacgtgagatacggcctccacatcaatcagagggacctgcccagtcctgtcaattttccatctaaattacataactgtcctccttagagacgcggggatgcccaggcacaggcatgaaagatcggccttgaggttattttgtctctgcaagtattgatgcgaggacttgtggcgcttttctttcccggtgaactttcccaactgctgatgttacgtgcactaagcaca

SEQ ID NO: 41613 - DNA, 30 bp, Homo sapiens
  chr7:157601854-157601884
  hypo
cagtccaaagaggaacgtgttgcgacaagc

SEQ ID NO: 41614 - DNA, 270 bp, Homo sapiens
  chr7:157606494-157606764
  hypo
cagaatggcctggagcgcgggtaaaacagctcggggccagccagagcttctgagccagggctgggcccaagaacgtgcatttgcgttgttccccaggtgatgctgctggtgaccccggggaccccgccgtgagagccccgacacaagtcgcggtttgtggtgctttggaggagtttgctccttagagtgagggggattgttctgccccaatggcctcttcagagctgcgagactgtgcccacgcgaggcagtggtcgccacacccacact

SEQ ID NO: 41615 - DNA, 123 bp, Homo sapiens
  chr7:157633412-157633535
  hypo
atccagagcctccagcgttttcacccagtgggttgctgctgctcagcagtcagggggacaggttgtttcttcctggtctcaggccacaggacccctgaagaggagccccgtcctcagacccct

SEQ ID NO: 41616 - DNA, 30 bp, Homo sapiens
  chr7:157642058-157642088
  hypo
gctcatgtgggtgtgcgtcctctcagggtc

SEQ ID NO: 41617 - DNA, 30 bp, Homo sapiens
  chr7:157654407-157654437
  hypo
gactcccagcctctgcgttgccagcagccc

SEQ ID NO: 41618 - DNA, 30 bp, Homo sapiens
  chr7:157656677-157656707
  hypo
tacaggctccaaaaacgctctctgcatgtg

SEQ ID NO: 41619 - DNA, 213 bp, Homo sapiens
  chr7:157659256-157659469
  hypo
ggtctgcaggaaacacgtccatagaggtggagctgaggctggtgtgcattctcccaggcacccagcatgagtgcccagctcagggtctgcaccgaggctgtctggcccgagtcccaggctcgccccagtgcttgccacacacaccctggggtctcctcagaagcagtgcctgtgccccgagatgcacggccaccaccccgcccctgaggccct

SEQ ID NO: 41620 - DNA, 30 bp, Homo sapiens
  chr7:157660091-157660121
  hypo
gacgccctggatacacggccacctggatac

SEQ ID NO: 41621 - DNA, 30 bp, Homo sapiens
  chr7:157690247-157690277
  hypo
ccagtttccatcagtcgccggctgctctcc

SEQ ID NO: 41622 - DNA, 30 bp, Homo sapiens
  chr7:157718446-157718476
  hypo
tcagtcctagagacgcgtcacagagaaacg

SEQ ID NO: 41623 - DNA, 30 bp, Homo sapiens
  chr7:157722621-157722651
  hypo
ttcagtccacatcagcgggtccaagcctgg

SEQ ID NO: 41624 - DNA, 161 bp, Homo sapiens; identical to SEQ ID NO: 15083
  chr7:157776781-157776942
  hypo

SEQ ID NO: 41625 - DNA, 17 bp, Homo sapiens
  chr7:157793339-157793356
  hypo
gtgggggctggtgtccg

SEQ ID NO: 41626 - DNA, 23 bp, Homo sapiens
  chr7:157793865-157793888
  hypo
tggtgcaacgtggggctggggtc

SEQ ID NO: 41627 - DNA, 81 bp, Homo sapiens
  chr7:157794503-157794584
  hypo
tgttgtgccctcacccggaaccgtgccaggcaccgaggaggtgctcagtaaactatggggttgcatcgtatttgaggtcat

SEQ ID NO: 41628 - DNA, 30 bp, Homo sapiens; identical to SEQ ID NO: 15085
  chr7:157877477-157877507
  hypo

SEQ ID NO: 41629 - DNA, 90 bp, Homo sapiens
  chr7:157958578-157958668
  hypo
gcagagcagtcacctcgaggccgacactgttcagctagtgcatggtgagcagcatgaaatccagacagggggcttcggaggatgtggcaa

SEQ ID NO: 41630 - DNA, 78 bp, Homo sapiens
  chr7:157987024-157987102
  hypo
atgtccataaaagaacgggcatcaccattaaaaagatgggccagtctgggggcccttgctgtccggctctgctgccca

SEQ ID NO: 41631 - DNA, 30 bp, Homo sapiens
  chr7:158040286-158040316
  hypo
ggacttgggtgtctgcggtttttttgtttg

SEQ ID NO: 41632 - DNA, 50 bp, Homo sapiens
  chr7:158059313-158059363
  hypo
gggacccagcagcagcggcctcaggacaggcacaacggccacttcccggc

SEQ ID NO: 41633 - DNA, 30 bp, Homo sapiens
  chr7:158059960-158059990
  hypo
ggtgctggagttgaccggctggcccggcag

SEQ ID NO: 41634 - DNA, 39 bp, Homo sapiens
  chr7:158065365-158065404
  hypo
gaggggaggtctcagcgccactgccgggataagccctca

SEQ ID NO: 41635 - DNA, 30 bp, Homo sapiens
  chr7:158113225-158113255
  hypo
gtgttcccgcgtcctcggcagcgccgggtg

SEQ ID NO: 41636 - DNA, 30 bp, Homo sapiens
  chr7:158144262-158144292
  hypo
aaacatggttacctacgagtgaaatggcag

SEQ ID NO: 41637 - DNA, 132 bp, Homo sapiens
  chr7:158187607-158187739
  hypo
gccgcatctctgcaacgcgtcagccagagaaagccgggggcaccccagccagcactcaggaggccctgcccgtccacacgacacctgggccaaccagccctttctgctgtaaaacttcggctcctctacctg

SEQ ID NO: 41638 - DNA, 30 bp, Homo sapiens
  chr7:158249183-158249213
  hypo
gagaacataacggcacggatgccatcggcc

SEQ ID NO: 41639 - DNA, 44 bp, Homo sapiens
  chr7:158283192-158283236
  hypo
gcaaaggttggcgttcggctccacgtccacgcctgtcttaaaca

SEQ ID NO: 41640 - DNA, 436 bp, Homo sapiens
  chr7:158301251-158301687
  hypo
ggagaggagcaggtgcggaagtggctccgctcctgtgggtgtcggggcaacgtgggacgctcggagcaggtgcggaagtggctccgctcctgtgggtgtcggggcaacgtgggacgctcggagcaggtgcggaagtggctctgctcctgtgggtgtcggggcaacgtgggacgctcggagcaggtgcggaagtggctctgctcctgtgggtgtcggggcaacgtgggacgctcggagcaggtgcggaagtggctctgctcctgtgggtgtcggggcaacgtgggacgctcggagcaggtgcggaagtggctccgctcctgtgggtgtcggggcaacgtgggacgctcggagcaggtgcggaagtggctctgctcctgtgggtgtcagggcaacgtgggatgctcaggagggggcctcagcacgcaggaagctgagc

SEQ ID NO: 41641 - DNA, 30 bp, Homo sapiens
  chr7:158332352-158332382
  hypo
tctagcgccgagtcccgggtcctgagggac

SEQ ID NO: 41642 - DNA, 65 bp, Homo sapiens
  chr7:158349464-158349529
  hypo
cgcaggtcgctcccacgcaggtcaggcggctcccgcgcaggtcgctcccacgcaggtcaggcagc

SEQ ID NO: 41643 - DNA, 240 bp, Homo sapiens
  chr7:158550099-158550339
  hypo
acccaaagtttccctcgtagatgcccttagggcagtggagccaggggagaaagcagagaacggtggattgtggtcaatgagagcaccaggagcaccacagacagtgagaggcagagccaaaggatcccagagctcgcgggacgccccttaatccagcgccaaaggatcccagagctcgcgggacgccccttaatccagagccaaaggatcctagagcccgcgggacgccccttaatcccg

SEQ ID NO: 41644 - DNA, 30 bp, Homo sapiens
  chr7:158564374-158564404
  hypo
gtccctcagaagacacgccagctttccagc

SEQ ID NO: 41645 - DNA, 35 bp, Homo sapiens
  chr7:158857187-158857222
  hypo
actgtggtctcaagtcggggcggccagctgggtgc

SEQ ID NO: 41646 - DNA, 30 bp, Homo sapiens
  chr7:158868457-158868487
  hypo
cggcacccacggacccgctgcatcagtgag

SEQ ID NO: 41647 - DNA, 30 bp, Homo sapiens
  chr7:158963513-158963543
  hypo
ggccactgtgaggatcgcgtgagcagaaac

SEQ ID NO: 41648 - DNA, 128 bp, Homo sapiens
  chr8:245097-245225
  hypo
gaagcaagaaagcatcgtatgcctttgccttcacaaggtccggcctccagccattgtgacaatgataacgccgacccagaggagatgtggagaggactctggctccacttctgcggctctgtgcccat

SEQ ID NO: 41649 - DNA, 52 bp, Homo sapiens
  chr8:644647-644699
  hypo
ccacgaggggcctcacggcttgctcgtctgtgaatcacggtgaccatgtaac

SEQ ID NO: 41650 - DNA, 30 bp, Homo sapiens
  chr8:700159-700189
  hypo
ggctgcatgggcgaacgttcctgagtctgg

SEQ ID NO: 41651 - DNA, 30 bp, Homo sapiens
  chr8:854787-854817
  hypo
ttctcagctgctaaacgctgctgtagaaca

SEQ ID NO: 41652 - DNA, 30 bp, Homo sapiens
  chr8:889984-890014
  hypo
gcccatgagagaatccgggaatagaaggag

SEQ ID NO: 41653 - DNA, 164 bp, Homo sapiens
  chr8:914966-915130
  hypo
acccccgcgtgcacacggcactgttcacctcacatggctcctgagtctgacccctgcgctgcacatggcactgttcaccacacagagctcctgagtctgaccccgcactgcacacggcagtgttcatcacacacgcggctccagagcccgacccccgcatgcac

SEQ ID NO: 41654 - DNA, 70 bp, Homo sapiens
  chr8:962490-962560
  hypo
agccccccacttcagcggcagtgtggacaacgtccgaccagcccccccacttcagcggcagtgtagacac

SEQ ID NO: 41655 - DNA, 145 bp, Homo sapiens
  chr8:972705-972850
  hypo
gggggtggacagtaccgtgccgaggtagatgctccaaccacaatccaccctccctgggagtggacagtcccatgccgaggtagacactccagccgccacccatcccccccgggagtggatggttccgtgccgaggtagacactcc

SEQ ID NO: 41656 - DNA, 126 bp, Homo sapiens
  chr8:976259-976385
  hypo
gaccctctgagatggcgcgcttgccccatgaccccaacgctttgctcttcacgtctcctttgacaaaccactgtgacttcagattgccgttcacatggaagctccacttcacggttggtgttgtac

SEQ ID NO: 41657 - DNA, 30 bp, Homo sapiens
  chr8:1043872-1043902
  hypo
acgatgggtgccagccgaggggtctgtctg

SEQ ID NO: 41658 - DNA, 47 bp, Homo sapiens
  chr8:1048584-1048631
  hypo
cccacaccaggctcccggccgcccacgggcgccgccacccacgccag

SEQ ID NO: 41659 - DNA, 115 bp, Homo sapiens
  chr8:1051541-1051656
  hypo
tttcatggcggcagacgctcagtctgggaagatggaagagttccggagatggtgacacgacaatgggaaggtcctcatcacccctgagccaaacatgacacgacgatgggaaggt

SEQ ID NO: 41660 - DNA, 53 bp, Homo sapiens
  chr8:1066123-1066176
  hypo
ggccttgatgcggtacgcaatcccatccccatggggtgcgcaggcgtcagctg

SEQ ID NO: 41661 - DNA, 34 bp, Homo sapiens
  chr8:1133089-1133123
  hypo
acacaaatgcattcacgttcgattccctcgagat

SEQ ID NO: 41662 - DNA, 39 bp, Homo sapiens
  chr8:1136184-1136223
  hypo
atgggtcggtggcaccgagggcagcgctgcagtctgtgg

SEQ ID NO: 41663 - DNA, 19 bp, Homo sapiens
  chr8:1137245-1137264
  hypo
ggaatctcacacacacggg

SEQ ID NO: 41664 - DNA, 79 bp, Homo sapiens
  chr8:1139165-1139244
  hypo
gccccaggccgattccgcggttggggttgaccttacacaggatttgggccccaggccggttccgcggttggggttgagc

SEQ ID NO: 41665 - DNA, 58 bp, Homo sapiens
  chr8:1151131-1151189
  hypo
aagaggaggatgccacggagccctgtggaggctgaagccgctgcgtagggagcccctt

SEQ ID NO: 41666 - DNA, 53 bp, Homo sapiens
  chr8:1153026-1153079
  hypo
gggcacccacatccacgccggttccgtaagctgctctccggctctcccaaatg

SEQ ID NO: 41667 - DNA, 118 bp, Homo sapiens
  chr8:1153298-1153416
  hypo
aatccatgagactggcgtgtccttcggtgacgaggccacccacccctcggtgttagaatccatgagactggcgtgtccttcggtgacgaggccgcccacccttcggtgttagaaccca

SEQ ID NO: 41668 - DNA, 30 bp, Homo sapiens
  chr8:1201984-1202014
  hypo
actgtggtgttgtcacgtgggtgtgttgtg

SEQ ID NO: 41669 - DNA, 162 bp, Homo sapiens
  chr8:1246678-1246840
  hypo
gatcacagtgtgacacgttctgtactggggtataaatacggtttcatggggacacacaggagggagctgagtgtgctcctctggccccggagagtgctgagaggcagcgtaccctgcagaagagtggcagtcgctgagcgtgggggacggctcagtaggtac

SEQ ID NO: 41670 - DNA, 30 bp, Homo sapiens
  chr8:1269400-1269430
  hypo
gtctctgcatgtgcacgtgcatctgtgcca

SEQ ID NO: 41671 - DNA, 42 bp, Homo sapiens
  chr8:1281668-1281710
  hypo
caggggttcacaccccgtttctcctcccgtgagtcctgtgtg

SEQ ID NO: 41672 - DNA, 142 bp, Homo sapiens
  chr8:1302672-1302814
  hypo
tgtctcagaaaaaaagaaagaacgaaaagaaaataccttggaatgaaagactgtggggccattaagatgatgctgtgggtgaaggtggaaagtcacggatgatgctgcggatgaaggtggaaagtcacggatgatgctgcgg

SEQ ID NO: 41673 - DNA, 30 bp, Homo sapiens
  chr8:1303386-1303416
  hypo
cagcggtgacacctgcgtgccagtgtgcac

SEQ ID NO: 41674 - DNA, 30 bp, Homo sapiens
  chr8:1306844-1306874
  hypo
tgtctttaggagaaacgtgttatccccact

SEQ ID NO: 41675 - DNA, 30 bp, Homo sapiens
  chr8:1340176-1340206
  hypo
aagaactgtttgaatcgccttatctatccc

SEQ ID NO: 41676 - DNA, 30 bp, Homo sapiens
  chr8:1362767-1362797
  hypo
ctgagcggagctgcccggcagctgtctctg

SEQ ID NO: 41677 - DNA, 49 bp, Homo sapiens
  chr8:1380107-1380156
  hypo
catgccagccagcaccgctacggctgccatccatcggggctgaatcctg

SEQ ID NO: 41678 - DNA, 150 bp, Homo sapiens
  chr8:1423699-1423849
  hypo
gtgaggatcaatgagcggctgggagtaaacgtcttccatactgggtcaggtcaccaccctaaagccctacaaagtcgttgacccccataattcaggaacattgcttgtcatcccgggacccaccgcaaggccgagcggagaggaagacag

SEQ ID NO: 41679 - DNA, 30 bp, Homo sapiens
  chr8:1443699-1443729
  hypo
ctggcccggcgaggtcggtgtgctgagacc

SEQ ID NO: 41680 - DNA, 101 bp, Homo sapiens
  chr8:1471545-1471646
  hypo
gatttgccggcctcacgccggccgagccactgctgacttcacgcagccccagccatgcccccacgcagacacacggagccccaaggcgggccagatctcag

SEQ ID NO: 41681 - DNA, 74 bp, Homo sapiens
  chr8:1501600-1501674
  hypo
cagccctgttttattcggcgtgttcacggtcagcagccccgttgtgcttggcgtgttcacgggcagccccgtta

SEQ ID NO: 41682 - DNA, 156 bp, Homo sapiens
  chr8:1574846-1575002
  hypo
acctctgccctgcagcgggtgctcacagaatgccttttctcctttcttctttcctgtagccagacctacctgcaagctgcaagcgatgtgcctgtgggacacagcctggaccccgctgcgaactacaactccccgaaattccgctcccggaaccag

SEQ ID NO: 41683 - DNA, 30 bp, Homo sapiens
  chr8:1588688-1588718
  hypo
tgatccccattagaacgtctcagaaactgc

SEQ ID NO: 41684 - DNA, 69 bp, Homo sapiens
  chr8:1588920-1588989
  hypo
aagtctcacgtggcccgcccccccgcatctagacttgtgttttacagtaaatgacgaaatgcagtccag

SEQ ID NO: 41685 - DNA, 30 bp, Homo sapiens
  chr8:1616193-1616223
  hypo
tgctgctggatttgtcggtatttttaaatg

SEQ ID NO: 41686 - DNA, 38 bp, Homo sapiens
  chr8:1645305-1645343
  hypo
tccccaggaccccagcgccatgccgaggccgacgtcgc

SEQ ID NO: 41687 - DNA, 76 bp, Homo sapiens
  chr8:1778994-1779070
  hypo
aggagccatggcaggcgaggcgccaagagaatggggtcattgcctgaaatgccactggagccgagagatgagctga

SEQ ID NO: 41688 - DNA, 30 bp, Homo sapiens
  chr8:2536020-2536050
  hypo
tcggttagaaattgtcgatggaagagcatt

SEQ ID NO: 41689 - DNA, 56 bp, Homo sapiens
  chr8:2652772-2652828
  hypo
atactatgggaacagcggactgaaggcatccactgccagaccgtgagttatcaact

SEQ ID NO: 41690 - DNA, 37 bp, Homo sapiens
  chr8:3769062-3769099
  hypo
aaaaaaaagaagaagaagaaaacgaaggctatataac

SEQ ID NO: 41691 - DNA, 24 bp, Homo sapiens
  chr8:5949419-5949443
  hypo
ggcaaactccgtcttttctatccg

SEQ ID NO: 41692 - DNA, 21 bp, Homo sapiens
  chr8:6063185-6063206
  hypo
ataagacgatgaacaaggatc

SEQ ID NO: 41693 - DNA, 196 bp, Homo sapiens
  chr8:6434295-6434491
  hypo
tgacctcaggtgatccgtccgcaggtgagccacccgcctcggcctcctaaagtgctgggagaggcacaggcgtcagccacagtgcctggcctactgtcttctctaaaatggcatctgtgcattcatctcagccgcccctgctcagataaaagcaatggcgcctcctttgaaatctgagagacgcagggccctgccc

SEQ ID NO: 41694 - DNA, 30 bp, Homo sapiens
  chr8:6542607-6542637
  hypo
tcagttgaacaaatccgtgtccaaaagaaa

SEQ ID NO: 41695 - DNA, 30 bp, Homo sapiens
  chr8:6932550-6932580
  hypo
gttgtacaccacctgcgatatttggagtca

SEQ ID NO: 41696 - DNA, 360 bp, Homo sapiens
  chr8:8639451-8639811
  hypo
ctgtcacctctcagcgggatgcagccgtagggccagccacacctctcccacgtgggacgcacctcttgtgacacttcttttggaaattctagttgcctcctgctttcctctgttctgttggcaaaagtggctttgaattctgcacaccccacggttctacctgccttgtcaggagtcttgcagtgaggccctcctggtctgaagcgatcccttcttccctgtattgcgctgtcttcagggcagggctcctcttgttacagtaggtagtcaggcacacataagcagggcagaagaacgccccccagcaaccatcaggtgagatggtcaggtggttgttacactgtctctctaaaataattg

SEQ ID NO: 41697 - DNA, 75 bp, Homo sapiens
  chr8:8748377-8748452
  hypo
tgaggttgtggaagacgtgctccttgagagccggactgtcctcaaagtagagtagcttgccgctctcatgcaggt

SEQ ID NO: 41698 - DNA, 335 bp, Homo sapiens
  chr8:8748683-8749018
  hypo
agctaacaggcaacacgggggagaggatctgcagccggtggttgagcaggtattgaaaatgggccttgcgccgtcgaaggttcttgtccgaaacgccatagtaggctgcgtgggggctggcagagcgcagctcgaagtcccgggccagtgcctcgtccaccaccttggccaagcggctcagtccctccgcgtcgtgcttctcctgcagggcgatctggcggtgaatgtccagacatttctcctccagctcacgctctccgcacaggtctgcgtgggtgcccacgatgcacaccaccgcgtggggcactctcgccccgacccgatgcaagaaggag

SEQ ID NO: 41699 - DNA, 30 bp, Homo sapiens
  chr8:8898369-8898399
  hypo
gcctctccatcagcccgccagcaccaagcc

SEQ ID NO: 41700 - DNA, 30 bp, Homo sapiens
  chr8:8898687-8898717
  hypo
aattccaagcaacaacgtattagggatgat

SEQ ID NO: 41701 - DNA, 115 bp, Homo sapiens
  chr8:10005445-10005560
  hypo
cgactttagagggaccggaaaggggaagcgagtctcccatggtttgaggtgttgctgcccgtacctgtgcacttggccacagtccaaagtgactccattgcgggcacagccgtgg

SEQ ID NO: 41702 - DNA, 32 bp, Homo sapiens
  chr8:10192893-10192925
  hypo
ccgtggctccaaagccgcgaggacagcactcc

SEQ ID NO: 41703 - DNA, 30 bp, Homo sapiens
  chr8:10261847-10261877
  hypo
cagccccgtgacaaacgacagtcaagcttg

SEQ ID NO: 41704 - DNA, 142 bp, Homo sapiens
  chr8:10528983-10529125
  hypo
acactcagaagcccccgaggacccctggacaccccacaggcggcgcaggtccgcaggtatccgttctttggggagaggtgtggtgagtcgcacactccaagacagagaggggtgaacaccgccactgcgtaaatgtgtgagt

SEQ ID NO: 41705 - DNA, 56 bp, Homo sapiens
  chr8:10548206-10548262
  hypo
gcccagcccagactccgggtatgagggcccaaggaagccaccggagccccctggtc

SEQ ID NO: 41706 - DNA, 30 bp, Homo sapiens
  chr8:11704567-11704597
  hypo
gtagagcaggaagtccgaatacacagagaa

SEQ ID NO: 41707 - DNA, 238 bp, Homo sapiens
  chr8:11705917-11706155
  hypo
taccagaccaggctacgagtgcccttccgggtagaacactgattctcaactgagcagacgctaaacttccctaaggtacttaaaaacaccaccagttctctgaaatgagaatcgccagtgattcccatttaactagttaggggagaagcccatgcatttttttaagccctcaggcatttcggatctgcagccgccagtgaacaccgctactgcggaaccaaggcgaggctgcaggcag

SEQ ID NO: 41708 - DNA, 37 bp, Homo sapiens
  chr8:11708426-11708463
  hypo
tgtggccattgttcccgtgcatcgaagcttgcaggca

SEQ ID NO: 41709 - DNA, 29 bp, Homo sapiens
  chr8:11726469-11726498
  hypo
cagaggggctgggttcggtggctcacgcc

SEQ ID NO: 41710 - DNA, 120 bp, Homo sapiens
  chr8:11726738-11726858
  hypo
aagagtgaaactctgtattaaaaaaaaaaaaaaggctcagaagaatcgtattttatccaggctgtggcgacagtaagaaggcagtagccgggtgcagtggctcacgcctgtaatcccagc

SEQ ID NO: 41711 - DNA, 149 bp, Homo sapiens
  chr8:12671777-12671926
  hypo
ccaaggggtgggtggcgagggccagcagttggcggcacccactccctgtctcctctcacttggtatctccctggcctcacgctcaatcaggtcttccgtgaccacacagggaaatgaagaatactgttcgcttacgaagaatctgggaa

SEQ ID NO: 41712 - DNA, 86 bp, Homo sapiens
  chr8:12831656-12831742
  hypo
gtgacaagcaagaccctgtcccttaaaaaagaaaagaaaaggacttttctggctccctaacctctccttgccggctcccttcacca

SEQ ID NO: 41713 - DNA, 89 bp, Homo sapiens
  chr8:12949930-12950019
  hypo
ctattttctcatgcacgccaacagaccagtctcaggtatgtctttattagcggtgtgagaatggactaatatagcggtctaaccttctt

SEQ ID NO: 41714 - DNA, 108 bp, Homo sapiens
  chr8:12952416-12952524
  hypo
cgcagagcctgaatccgggacttgacccccgattttctgaagagcccaacctgtcggaagagcaacactaagtgtggggtacattcacgtggacgcagtgtttacacc

SEQ ID NO: 41715 - DNA, 90 bp, Homo sapiens
  chr8:12956998-12957088
  hypo
ctgttttggagaggacgggcagggagagaccgagtccagggctgagtccgaatctccctcatcagaaaacttctccgaccactgattgac

SEQ ID NO: 41716 - DNA, 20 bp, Homo sapiens
  chr8:13003493-13003513
  hypo
aatatactgtagggccgggc

SEQ ID NO: 41717 - DNA, 30 bp, Homo sapiens
  chr8:13319931-13319961
  hypo
agtctggctggctggcgacagcccaggctg

SEQ ID NO: 41718 - DNA, 30 bp, Homo sapiens
  chr8:13654931-13654961
  hypo
agaatagttatgggccgggtgcggtggctc

SEQ ID NO: 41719 - DNA, 80 bp, Homo sapiens
  chr8:14898122-14898202
  hypo
tctatctcaaaacaaaaaagtgatttcacttccaagtaaaatgaatatgattatatttagttgatcgtactgcttttatt

SEQ ID NO: 41720 - DNA, 95 bp, Homo sapiens
  chr8:20317378-20317473
  hypo
gcacacacacacacacgcgcgcacacacacacacacacacgggcatgcacacatgcatgctagaaactcacagaaatttccgagcaaaaccctta

SEQ ID NO: 41721 - DNA, 125 bp, Homo sapiens
  chr8:20431789-20431914
  hypo
aaagggcgtttctttcgcaggtaggagagagactgtcttccctctccctgcctttctgggtatgaggaagggagcacattggctgcaggggctgcaggcagccatcttgacgccacgtgggaaac

SEQ ID NO: 41722 - DNA, 33 bp, Homo sapiens
  chr8:21302252-21302285
  hypo
tgtcacactcctgctcgccgtgcacctggagag

SEQ ID NO: 41723 - DNA, 173 bp, Homo sapiens
  chr8:21393876-21394049
  hypo
caaaacaaaaagtaacgtaaaggcattttcagatcactgaaagtagaaagaattcattaccaacagacccacaccacaagaaatgctaaccgaagttatttgggctcaatagaaattatgcgagatggaaatttggaaatacaggaaggaatgaagaacgctgaaaattatca

SEQ ID NO: 41724 - DNA, 30 bp, Homo sapiens
  chr8:21563318-21563348
  hypo
tgatgcagagaaggccgggctcaggctgtc

SEQ ID NO: 41725 - DNA, 101 bp, Homo sapiens
  chr8:21608043-21608144
  hypo
gcctggcaatgcaagcgccctcctgccagcaccaccggggctgccgcggcactcaccgacacaggtggtcagtccggcacacgccacgcaggtccaggcag

SEQ ID NO: 41726 - DNA, 15 bp, Homo sapiens
  chr8:22101753-22101768
  hypo
cgaaattgtgatacg

SEQ ID NO: 41727 - DNA, 233 bp, Homo sapiens
  chr8:23290404-23290637
  hypo
ttccttttgagtcttcgtggagctgtgagctggatcacaaggtccccggggcattctgggcgggaaggccctcctccatccagagggcggcggccgagctgctccggggagtgcgcctgtggatgcgccgcagccgcagcaggtacagcaggatggccagcagcaccaccaggaagcagccagagaacaggtagtggttgtagacaaaggaaacgccccgccagtgggtgtga

SEQ ID NO: 41728 - DNA, 30 bp, Homo sapiens
  chr8:23331189-23331219
  hypo
cctcaaacagagctccgtttcttgaattct

SEQ ID NO: 41729 - DNA, 30 bp, Homo sapiens
  chr8:23340639-23340669
  hypo
cccgcagcacagcagcggttgaagcagcac

SEQ ID NO: 41730 - DNA, 30 bp, Homo sapiens
  chr8:23380796-23380826
  hypo
ttcaggtagagctgccgggaggcacatgaa

SEQ ID NO: 41731 - DNA, 30 bp, Homo sapiens
  chr8:23395420-23395450
  hypo
cttgcatgtaaagcccgacctttgcatggc

SEQ ID NO: 41732 - DNA, 38 bp, Homo sapiens; identical to SEQ ID NO: 15103
  chr8:23399594-23399632
  hypo

SEQ ID NO: 41733 - DNA, 152 bp, Homo sapiens; identical to SEQ ID NO: 15104
  chr8:23423918-23424070
  hypo

SEQ ID NO: 41734 - DNA, 30 bp, Homo sapiens
  chr8:23430870-23430900
  hypo
gctctgccaggctgccgtgcaagggaatac

SEQ ID NO: 41735 - DNA, 41 bp, Homo sapiens
  chr8:25318815-25318856
  hypo
gaagattgattctggctaatgtccttcgagcagtagaaatg

SEQ ID NO: 41736 - DNA, 216 bp, Homo sapiens
  chr8:25397045-25397261
  hypo
gggagaggagatggccggcccagttcaacagactgtgagcccggctggctgctgggcgtgtagcgatcactgaggacaggtcagcctggggatttggagcgcagctacctgcagtacctgttctaactccgtctgtgtcggagcgcccttctgttatcctcagtgcattagcatggctatttttttttttttttgagacggagtctcgctcttccg

SEQ ID NO: 41737 - DNA, 30 bp, Homo sapiens
  chr8:26267175-26267205
  hypo
gtgtctataccttgccgtctctctttcagt

SEQ ID NO: 41738 - DNA, 18 bp, Homo sapiens
  chr8:27914784-27914802
  hypo
tgctattgataaatacgg

SEQ ID NO: 41739 - DNA, 30 bp, Homo sapiens
  chr8:27931084-27931114
  hypo
ttatatccctgtcatcgtcctatagggaag

SEQ ID NO: 41740 - DNA, 30 bp, Homo sapiens
  chr8:28938557-28938587
  hypo
cagcagacagggaaacgctggcaggtcctg

SEQ ID NO: 41741 - DNA, 30 bp, Homo sapiens
  chr8:29157762-29157792
  hypo
cccttagctattgctcgtagtatccagggg

SEQ ID NO: 41742 - DNA, 28 bp, Homo sapiens
  chr8:29596408-29596436
  hypo
tttttaggctgggcacggtagttcatgc

SEQ ID NO: 41743 - DNA, 28 bp, Homo sapiens
  chr8:29596676-29596704
  hypo
cagaacaagactccgtctcaaaaaaaaa

SEQ ID NO: 41744 - DNA, 148 bp, Homo sapiens
  chr8:32987430-32987578
  hypo
gcgccttgttgctgccgcagcctcacatgtggaaagacaagagggcaagagctaactgaatgtggtgtgaagcctcttttataatggccttaatcccactttggaggaagaagctcgcaggacctaatcacctctcaaaggccccacc

SEQ ID NO: 41745 - DNA, 30 bp, Homo sapiens
  chr8:37706125-37706155
  hypo
tgcgactaacttgttcgttttcccctgtgc

SEQ ID NO: 41746 - DNA, 22 bp, Homo sapiens
  chr8:37961880-37961902
  hypo
aattctgcgaccatatgttaaa

SEQ ID NO: 41747 - DNA, 30 bp, Homo sapiens
  chr8:38005823-38005853
  hypo
agagtctcttctagccgagaacctggatac

SEQ ID NO: 41748 - DNA, 31 bp, Homo sapiens
  chr8:38786050-38786081
  hypo
atcaccgcgcccggcccgacctggtctttaa

SEQ ID NO: 41749 - DNA, 148 bp, Homo sapiens
  chr8:41146864-41147012
  hypo
acagttcagtagcagcgcagaaattagatgccaggactccagaatctgtgttatttttttcttactccatattttatcttctaacgcagaagtctttgtttttgtttcttaacaggtgggtaaactgagccaccgagtgcttcagtga

SEQ ID NO: 41750 - DNA, 30 bp, Homo sapiens
  chr8:41510183-41510213
  hypo
ggcgttggtgtctggcgcccctaggatgag

SEQ ID NO: 41751 - DNA, 82 bp, Homo sapiens
  chr8:41523651-41523733
  hypo
ctcatctgtgaagcacggattaaagtgctctccccaccctttctcaaggctgctgggacaatcatgccgcttatgaatgcta

SEQ ID NO: 41752 - DNA, 137 bp, Homo sapiens
  chr8:41554224-41554361
  hypo
tgttgtctgaggtctcggtggccgggctgctggggatgagggagtcctcatcatactctttagatgcctgaggagagagaaagggtcctcctgtcccacctcctcccgggccagctggatgccgtgccagggcgtgg

SEQ ID NO: 41753 - DNA, 61 bp, Homo sapiens
  chr8:41566351-41566412
  hypo
cgtggccctcctgggcggccaggtgaaggggcgtcacaccttgcaccgactcggcgtttgc

SEQ ID NO: 41754 - DNA, 52 bp, Homo sapiens
  chr8:41594902-41594954
  hypo
gaagcttagagctaacgaatggatctgattgtgacctcggcaattgatctct

SEQ ID NO: 41755 - DNA, 64 bp, Homo sapiens
  chr8:41611241-41611305
  hypo
ctgttcccatctttacgtccctgtctctgtcgctgagtgttgtgactctcgcccctacctgtaa

SEQ ID NO: 41756 - DNA, 53 bp, Homo sapiens
  chr8:41668167-41668220
  hypo
ggccttccagagcaacgtgccgccgaagcgtaatagcccgatgggttcatctt

SEQ ID NO: 41757 - DNA, 30 bp, Homo sapiens
  chr8:41689306-41689336
  hypo
cccacacgtcctcagcgtgtgaatgaatag

SEQ ID NO: 41758 - DNA, 32 bp, Homo sapiens
  chr8:41910307-41910339
  hypo
acagctagtatgtggcgcgcacctgagcctgg

SEQ ID NO: 41759 - DNA, 33 bp, Homo sapiens
  chr8:42036407-42036440
  hypo
tggttacctggcaggcgtcgtgcaagtttgcct

SEQ ID NO: 41760 - DNA, 127 bp, Homo sapiens
  chr8:42144632-42144759
  hypo
ggcagctggagtgcccgaggccagagccgctttccctgctgcccgtgccacagcctcagggcctgcccgtctccagtgtccccactcatgcaccagggagaagaggggaggccgccaggagccagtg

SEQ ID NO: 41761 - DNA, 23 bp, Homo sapiens
  chr8:42333901-42333924
  hypo
tgagccaccgtgcccggccggtt

SEQ ID NO: 41762 - DNA, 30 bp, Homo sapiens; identical to SEQ ID NO: 15108
  chr8:42699267-42699297
  hypo

SEQ ID NO: 41763 - DNA, 35 bp, Homo sapiens
  chr8:42749967-42750002
  hypo
attacaggcgcgagacaccgcgcctggccacgtat

SEQ ID NO: 41764 - DNA, 42 bp, Homo sapiens
  chr8:43401723-43401765
  hypo
tctgccaagatctggcgcagggcctgacgggaaggcactggc

SEQ ID NO: 41765 - DNA, 153 bp, Homo sapiens
  chr8:43416676-43416829
  hypo
cccccccgtcacctccgggagagagacatgcaccctggggtgaaagccagggactccacagcctgcccatgtttagcgcagggcctgccgggaaggcactggcctcgggggggatgaacccagcctcctcttctgcctcgctgctttttttcc

SEQ ID NO: 41766 - DNA, 30 bp, Homo sapiens
  chr8:47016307-47016337
  hypo
gaccacgctaccctgcggctctgctttcac

SEQ ID NO: 41767 - DNA, 124 bp, Homo sapiens
  chr8:47093290-47093414
  hypo
tcccaccattccctgcggcctcgctgctacccccatctgccagcctcaacatccccatgagtccctatgtcctgtccacaccgcaccgaggccaagttttcgctagtggcggccttctgctaga

SEQ ID NO: 41768 - DNA, 183 bp, Homo sapiens
  chr8:47155037-47155220
  hypo
gtggcaaaggctcagcgctttgtttaggcaggcagaggagaaaagcagcaagaccgcagggaatgctgagagctcccaaatatgcctctcacatttcagcagcacccagggctgtcccgggcgggcagtaaagccccagactttggagcatgctgcctgtgtctgtcgcgaaaggcccccaca

SEQ ID NO: 41769 - DNA, 108 bp, Homo sapiens
  chr8:47334490-47334598
  hypo
aggcctgcagaagggcgaagcagcgagaccgcggagaatgctgggatactgccaaggaggcctctaccatccaagaagcccgcagggatgtcccgaactggttgtaaa

SEQ ID NO: 41770 - DNA, 30 bp, Homo sapiens
  chr8:47355877-47355907
  hypo
cttgtgggggctttccgtgacagatacagg

SEQ ID NO: 41771 - DNA, 37 bp, Homo sapiens
  chr8:48045032-48045069
  hypo
ggaggggcagcctggcggaactcgctgcaaatggcct

SEQ ID NO: 41772 - DNA, 168 bp, Homo sapiens; identical to SEQ ID NO: 15113
  chr8:48294168-48294336
  hypo

SEQ ID NO: 41773 - DNA, 30 bp, Homo sapiens
  chr8:48676823-48676853
  hypo
gggcctagcccctgacgctctgcagcgttg

SEQ ID NO: 41774 - DNA, 45 bp, Homo sapiens
  chr8:48796372-48796417
  hypo
cagttgcctgtgtcccgctacgccctctggcgtccctttcctcag

SEQ ID NO: 41775 - DNA, 251 bp, Homo sapiens
  chr8:49334991-49335242
  hypo
gggctgcgctgccttcgggggcacgtgacgccacgtgggaagtgctgtgaggctggtgcggagagcaaacctcctgcaactcttagcgagtaaatgggcacatccacactggagttgaacacaggggcgccggccacgggttcaggctagcccgggcgtctggcttccctgccaggatggctgcctcgttactgagatggaacacacaacacagccgcgtgggcagtgggaggctgcgaggttagcctggc

SEQ ID NO: 41776 - DNA, 45 bp, Homo sapiens
  chr8:49496375-49496420
  hypo
agcggtgccatcaaccgacactcgtcctcccgcccttccctgccc

SEQ ID NO: 41777 - DNA, 59 bp, Homo sapiens
  chr8:49572124-49572183
  hypo
gacctgcgaggctgtcgggggtgcgcctgggactgagctgggctcgtcttcatttccct

SEQ ID NO: 41778 - DNA, 267 bp, Homo sapiens
  chr8:49608941-49609208
  hypo
gacatggggtcctgacggaggtcgggaggcacagggtgtgggtgctgcttgtctccccagcttctccaccgcaccatgtgtctgggtctgtgattaccggaggcgactcgcaacaggcccagactcgcctgtgtgcatagcactaagggtaatgacaactcctctgtgtgtgcaggtgcctgttggagacgcagagctctgcagcagcaggtgagctgatgctgcaacctgctaaacgccgctcctgcggagcgccagggcccagag

SEQ ID NO: 41779 - DNA, 30 bp, Homo sapiens
  chr8:49773216-49773246
  hypo
ctctgctttacgaggcgcaccttaaacccc

SEQ ID NO: 41780 - DNA, 137 bp, Homo sapiens
  chr8:49808681-49808818
  hypo
tgggagtgacccctgcggagctgacaagccaatgctggagaagtgcacgggcaggctcaggcgcagccactcaatgggcctgtctgtgtcgggggcaggggcacagagaggggcaggtgagtcgaagctgattgggt

SEQ ID NO: 41781 - DNA, 222 bp, Homo sapiens
  chr8:49959230-49959452
  hypo
attatggaggaggaacgggaagttctaccaggagtcgctgtactgtattcacggctcttgttatatgatttatgctggcattatctaaactgagaagcggacaatcctttattcaaaggcgagctccctctattttgtgttgccgctcatggagtcctaaggtcggagccccataggagctgccagcagagtcccaatggaggtgagcggctcatttcagct

SEQ ID NO: 41782 - DNA, 120 bp, Homo sapiens
  chr8:50015598-50015718
  hypo
cttggagcagggggctttgctcctcggggaggctcaggctgtgcaagagcccatggcctgggtggggcgcgggaaggctcaggcatggggcactgcaggtcccgagccctgccccacggg

SEQ ID NO: 41783 - DNA, 156 bp, Homo sapiens
  chr8:50314445-50314601
  hypo
aggtaactaataaaacgacagcattcatttttaaaagttactaaaatgaaagcaaacaaaataaattgcgttatataaatactgacggagatagaaaaacctgatgtttgttagtttacatttaaattctgagtttagaggtaattacccctataa

SEQ ID NO: 41784 - DNA, 58 bp, Homo sapiens
  chr8:50377787-50377845
  hypo
aggcagacacacaggcggctgaacatcgaggggagcacaccaacggagaagacacaag

SEQ ID NO: 41785 - DNA, 34 bp, Homo sapiens; identical to SEQ ID NO: 15119
  chr8:52432891-52432925
  hypo

SEQ ID NO: 41786 - DNA, 97 bp, Homo sapiens
  chr8:53352314-53352411
  hypo
ggatgctgaggtttgcgtgcagaggacagagaccagtaacacccagatcctaggcctgagaaactggagaatgaaattaccacgtactgacacagta

SEQ ID NO: 41787 - DNA, 30 bp, Homo sapiens
  chr8:53805607-53805637
  hypo
tgcccagcaggaagacggagtgacccagcg

SEQ ID NO: 41788 - DNA, 40 bp, Homo sapiens
  chr8:55191496-55191536
  hypo
cactcatactgggaccgtttagacacgccaatgaaccttt

SEQ ID NO: 41789 - DNA, 30 bp, Homo sapiens
  chr8:55285908-55285938
  hypo
gcagggcctggcctccggaaaggaccctgg

SEQ ID NO: 41790 - DNA, 30 bp, Homo sapiens; identical to SEQ ID NO: 15120
  chr8:55689465-55689495
  hypo

SEQ ID NO: 41791 - DNA, 32 bp, Homo sapiens
  chr8:55787831-55787863
  hypo
gcggttccgggtgggcgcgggctgggcaggcc

SEQ ID NO: 41792 - DNA, 30 bp, Homo sapiens
  chr8:56362016-56362046
  hypo
cctagtggtcggtaacgactggaagcagag

SEQ ID NO: 41793 - DNA, 78 bp, Homo sapiens
  chr8:56364255-56364333
  hypo
tagatggcatgcatgcggttgaccagagaaatgcggaaggattcagacttggcccggctcaggcggctgctcaggggg

SEQ ID NO: 41794 - DNA, 95 bp, Homo sapiens
  chr8:56539998-56540093
  hypo
cagcaaacgggaccacgggtgtgtgatcctaacgcatctaaaaacagttcaaatcattaatgtacattttttatgaggcgcgacaggggagcaaa

SEQ ID NO: 41795 - DNA, 27 bp, Homo sapiens
  chr8:56688545-56688572
  hypo
ctaaatcccttggatcgattgactgta

SEQ ID NO: 41796 - DNA, 30 bp, Homo sapiens
  chr8:56883198-56883228
  hypo
gttaggaaattgctacggccttcttgggaa

SEQ ID NO: 41797 - DNA, 78 bp, Homo sapiens
  chr8:56929748-56929826
  hypo
ggcagcgtgaggccacgccttggagagaaggtactgtcccaggtgagcgtgagcttctcataccgtgctggtggcagc

SEQ ID NO: 41798 - DNA, 39 bp, Homo sapiens
  chr8:57566358-57566397
  hypo
gagctaccgcgccgggcctcaagtcgcccttcttaaaac

SEQ ID NO: 41799 - DNA, 30 bp, Homo sapiens
  chr8:57995953-57995983
  hypo
gcaggtttccaagcccgtgtagctctccgc

SEQ ID NO: 41800 - DNA, 234 bp, Homo sapiens
  chr8:58105946-58106180
  hypo
ggtggtgcagtcaagcgggccctggggcaggcctggcccagcgctccgttcttgggagccctgccagcccacaggcccatctgcggcaggcacgtggtgccgcgagaacttggctcagggacggtttttccgccatgcgcagattctcgcctctcgcgggggcgccagggggcagctggttgaggtgcgcatgcgcactggcacctaacggctcttcttcgagtcttctcagag

SEQ ID NO: 41801 - DNA, 35 bp, Homo sapiens
  chr8:58106674-58106709
  hypo
gaaagaatgggtgtgcggagcgggccgttctggtg

SEQ ID NO: 41802 - DNA, 129 bp, Homo sapiens
  chr8:58116950-58117079
  hypo
cagaaacgttgcagccgatggcacggcagtggggaggaaaacgtaggaagcatggaagtgcatggcttgcgaaagaagcatctgaagccatggcatgtctgagagaggacacatcgggcaagattccac

SEQ ID NO: 41803 - DNA, 514 bp, Homo sapiens
  chr8:58130301-58130815
  hypo
ggaagacacatctgacgagatcgaatgttttgcagaagagccatgtgaccagatccctggtttggcagaggagacatgcgagaagacggaacgttttggccgaggagacatctggcagggtggaacggagggaacaggtgtggcagagagaatatctgagaagctcgcaggattcccagaaggagcactgggagtagattgcctgttttcccgaaggaacggcaagttccaaaggtcagaggctcatgtgaactctgtcgggttcaggagcagctcagtgttgctggtggcaagagtgtggtacgagagtggttgggcgtggtttgaatatctagaaaaggcgagctgagggtagatttttgaacagtccggagtaggaggggtagagacatattctatgggccacagccacattctcaggatgctcgtggctgtaaatagtagatgacccaagtaagagcggctgaagccataggcaccagaattgtgttggcatcgtcgtgtcacgctcacg

SEQ ID NO: 41804 - DNA, 38 bp, Homo sapiens
  chr8:58716351-58716389
  hypo
tggattacagacgtgagccatagcgcccagccttgtat

SEQ ID NO: 41805 - DNA, 62 bp, Homo sapiens
  chr8:59059044-59059106
  hypo
tgcccggctgccaagcgcgcactgggcagccccacgctcaaagtgttcggcaaccacgccaa

SEQ ID NO: 41806 - DNA, 30 bp, Homo sapiens
  chr8:61272270-61272300
  hypo
cgatgagtgcatttgcggagggctgagaag

SEQ ID NO: 41807 - DNA, 30 bp, Homo sapiens
  chr8:61777517-61777547
  hypo
agatcaagttgtcttcgacagcctttatag

SEQ ID NO: 41808 - DNA, 108 bp, Homo sapiens
  chr8:61789877-61789985
  hypo
tggtcgcaataatgacgacgaggcggatggcggcggggaggctagagcccatttcagaagcctgcagtgaggattccaccagttcacatgcatcgggcactgagccct

SEQ ID NO: 41809 - DNA, 30 bp, Homo sapiens
  chr8:63056935-63056965
  hypo
aggagagacctccggcggcagggctccaac

SEQ ID NO: 41810 - DNA, 37 bp, Homo sapiens
  chr8:64023507-64023544
  hypo
tacaggcgtgagccaccgcgcccggccttaagtgttt

SEQ ID NO: 41811 - DNA, 22 bp, Homo sapiens
  chr8:64511304-64511326
  hypo
aatagaacgaagaaaggaggac

SEQ ID NO: 41812 - DNA, 23 bp, Homo sapiens
  chr8:65385213-65385236
  hypo
cgagactccgtctcaaaaaaaaa

SEQ ID NO: 41813 - DNA, 30 bp, Homo sapiens
  chr8:65519445-65519475
  hypo
ccaccagccccagtacgaatgcaggcagag

SEQ ID NO: 41814 - DNA, 90 bp, Homo sapiens; identical to SEQ ID NO: 15127
  chr8:65749819-65749909
  hypo

SEQ ID NO: 41815 - DNA, 33 bp, Homo sapiens
  chr8:66055590-66055623
  hypo
tgaccatctggaccccgccgattctccccatac

SEQ ID NO: 41816 - DNA, 42 bp, Homo sapiens
  chr8:66548717-66548759
  hypo
atgtctaaacttggccgggcgtggtggctcaagcctgtaatc

SEQ ID NO: 41817 - DNA, 22 bp, Homo sapiens
  chr8:66560523-66560545
  hypo
ttacaggcgtgagtcaccatgc

SEQ ID NO: 41818 - DNA, 162 bp, Homo sapiens
  chr8:67117765-67117927
  hypo
gttcactactctagccgtgacaaattctctcttcacattgggcacgctgtatcaattatcttgtcaactgttatattgtctatcgtgtcatcaatgggtatttccttcttttggctgtagatttgtgggggataagatgaagacttccgtgcattaagaacc

SEQ ID NO: 41819 - DNA, 68 bp, Homo sapiens
  chr8:68347722-68347790
  hypo
gtgatggggaggagacggcaggtgcggggaggctccggccttccttggtgccccgccctttgtttgca

SEQ ID NO: 41820 - DNA, 260 bp, Homo sapiens
  chr8:71017232-71017492
  hypo
ttggcttcttaatcacgcatccagaggtgctggctggctcctgagccgggagacatctgtgggaaacttcgcttgcttcttgacgttactcactgcttgccattcagctttccaggggctacaaaatgagtcaccacccttttatcagctttcaacttacattttgttgctgttgtttcatctcctattatccttgtccttgtgggtttatgcctttataaaaaggcatttgggccaggcgcggtggctcatgcttataa

SEQ ID NO: 41821 - DNA, 213 bp, Homo sapiens
  chr8:71368455-71368668
  hypo
cactaacattctacacgtctaaacttcgaggaacttttctaaagcaagaaaaagaataagggctaaatttaattcgtcagagtggaaagagaacaaagagagaggactgggagtgggagattaaaaggctgtggaaagtggtcttgagatagatgttattggggaccaaccttctcaatgcactggtcaagcgccggacgttgttgagaacag

SEQ ID NO: 41822 - DNA, 43 bp, Homo sapiens
  chr8:74086196-74086239
  hypo
agtggcattgctggccgggcgcggtggctcccgcctgtaatcc

SEQ ID NO: 41823 - DNA, 32 bp, Homo sapiens; identical to SEQ ID NO: 15130
  chr8:74332813-74332845
  hypo

SEQ ID NO: 41824 - DNA, 30 bp, Homo sapiens
  chr8:74674435-74674465
  hypo
ctactcgttgtccaccgaaattcattctcc

SEQ ID NO: 41825 - DNA, 101 bp, Homo sapiens
  chr8:74759410-74759511
  hypo
aactaaccaaacagaaaaataagcaaaagtctagaattcgtaattcacaaaaacaccataatggctaataaaaacaggaaaagaaacgcaacctcactggt

SEQ ID NO: 41826 - DNA, 44 bp, Homo sapiens
  chr8:74759819-74759863
  hypo
aatgtccatcatcaacggtaaaacgggtatattgcggccgggtg

SEQ ID NO: 41827 - DNA, 145 bp, Homo sapiens
  chr8:78532944-78533089
  hypo
ctcgttccacccactcggcggcaggctgcgctcagctcacactactggcctggatcctatgcccattgcagctctgccctcagcctgcagctggtccagccatgccgcaactggcttcctccttgggtgccgacatctagacgag

SEQ ID NO: 41828 - DNA, 162 bp, Homo sapiens
  chr8:80483857-80484019
  hypo
cctcagcggatcttgcgggacagcttcttggtgtgccaatgactggtgacccctttgtagcctttgctctttgtcaccccaatgacatcaatcatctcgtcctgcccaaacacctggttcacaggtacctgctgctcaagcctctcgcgggcccagtccagc

SEQ ID NO: 41829 - DNA, 22 bp, Homo sapiens
  chr8:82903036-82903058
  hypo
tggcagacgctcctccctcagc

SEQ ID NO: 41830 - DNA, 30 bp, Homo sapiens
  chr8:83282016-83282046
  hypo
atcatccactttccccgtgcatattgcgaa

SEQ ID NO: 41831 - DNA, 114 bp, Homo sapiens
  chr8:86370822-86370936
  hypo
cccttcgccccgttccgcccagtccccatttacaaataaagcatgtgaagttcagagggattgcttagtttgctgaaggtgatgcagcaagtaagtgttcgagtcagagtatga

SEQ ID NO: 41832 - DNA, 30 bp, Homo sapiens
  chr8:86389645-86389675
  hypo
ctagcaaataaacagcgttcagtaaatctt

SEQ ID NO: 41833 - DNA, 40 bp, Homo sapiens
  chr8:86405563-86405603
  hypo
tgcacgggggatgggcgcggtgcctcaagcctataatccc

SEQ ID NO: 41834 - DNA, 36 bp, Homo sapiens
  chr8:86406813-86406849
  hypo
acattattcccgttttacaaacggagacttgggggc

SEQ ID NO: 41835 - DNA, 26 bp, Homo sapiens
  chr8:86417676-86417702
  hypo
agaatcacaagcgtgagccactgtgc

SEQ ID NO: 41836 - DNA, 37 bp, Homo sapiens
  chr8:86436621-86436658
  hypo
gcatccaacctgactcggcccgcgtggcagcctgtgg

SEQ ID NO: 41837 - DNA, 30 bp, Homo sapiens
  chr8:86849611-86849641
  hypo
tgtttgtcacaccagcgtatagaaaaatca

SEQ ID NO: 41838 - DNA, 19 bp, Homo sapiens
  chr8:86926063-86926082
  hypo
accacgcctggctaatttt

SEQ ID NO: 41839 - DNA, 498 bp, Homo sapiens
  chr8:88885698-88886196
  hypo
gctacctatgaacagcgacgctgggagcagcacggcacagcttggagtatctgcaagtcccacgaagcacagcagaaggtgggaatccaagtgattcagtgaggcccagcacatagaattcaccttccgattagggacgtagagggttttgtgcgggtatacccggagctcaggggtcgtcaggcctcgcatggtgatgatgccgtacttggagcctccagcttcgacttggttcactgtgaagagctggtcagtgttggtattcgccagtatgcggttaaatcggtcgcttgccaaagaggagggatcccagctatgaatctggacctttttcctctgcatgcagcttacacgcagctcgcgagctatacggcaatagttggcgaatctgaggaaacctagctggttctttcgtagcatggaaggtgcattgagtcccactctgactgtctttttctgcttgtctgcttcctcgagcagtcgcggtcttttgctctc

SEQ ID NO: 41840 - DNA, 17 bp, Homo sapiens
  chr8:89830498-89830515
  hypo
gccggaaaacatatgtc

SEQ ID NO: 41841 - DNA, 36 bp, Homo sapiens
  chr8:90768546-90768582
  hypo
aaaaagcttattggccgggcgcggtggctcacgcct

SEQ ID NO: 41842 - DNA, 35 bp, Homo sapiens
  chr8:90768822-90768857
  hypo
gacagagcacgactccctctcgaaaagaaaaaaaa

SEQ ID NO: 41843 - DNA, 137 bp, Homo sapiens; identical to SEQ ID NO: 1578
  chr8:90913516-90913653
  hypo

SEQ ID NO: 41844 - DNA, 30 bp, Homo sapiens; identical to SEQ ID NO: 15135
  chr8:91130098-91130128
  hypo

SEQ ID NO: 41845 - DNA, 22 bp, Homo sapiens
  chr8:91163928-91163950
  hypo
gtaatccctgcacttcggcagg

SEQ ID NO: 41846 - DNA, 195 bp, Homo sapiens
  chr8:91865364-91865559
  hypo
cctggctcctgtaaccgctcacctgcatgctgcctcctgtgaggggtggagtgcagcgggtctgagtgagtggaggtaactcctgccagtgcagaagcagccagctggttccagcactcgtggactccagttcctgcctctttctctcacatgctctctcccacaaggagttgaaagctgcgggctgggtaaatg

SEQ ID NO: 41847 - DNA, 99 bp, Homo sapiens; identical to SEQ ID NO: 5080
  chr8:92083523-92083622
  hypo

SEQ ID NO: 41848 - DNA, 30 bp, Homo sapiens
  chr8:93449207-93449237
  hypo
catcgcaaactatgtcgttattgaatatag

SEQ ID NO: 41849 - DNA, 226 bp, Homo sapiens
  chr8:93848232-93848458
  hypo
tgtgctgtcagccatcgctgacaggtgagagccactggcccaagatcagaaagattgcttgcatagcgaaaggacacacctcacctgtcagctgtcacagacactctttttacattactccactccaggaaaggtgatatctcgttcaggggtttaacagtccagagttatgaagtacaaatgaagtgacggctgtgcatttattagatcacgtgtagtgtttctt

SEQ ID NO: 41850 - DNA, 174 bp, Homo sapiens
  chr8:95211968-95212142
  hypo
atctaccacaccatgcggttgttaggagcatagacccaggagttagactggctggcttgggtcttaactcctccaccggctgactcgtggccctatctactcatctataaagcagggataataataataatacctaccttcgagagttaagagattcagcgagttaatatttgg

SEQ ID NO: 41851 - DNA, 77 bp, Homo sapiens; identical to SEQ ID NO: 15137
  chr8:95416054-95416131
  hypo

SEQ ID NO: 41852 - DNA, 30 bp, Homo sapiens
  chr8:95622883-95622913
  hypo
acaagagcgaaactccgcctcaaaaaaccc

SEQ ID NO: 41853 - DNA, 25 bp, Homo sapiens
  chr8:95816428-95816453
  hypo
tcaaaaaattaaatgcgggccgggc

SEQ ID NO: 41854 - DNA, 28 bp, Homo sapiens
  chr8:95837639-95837667
  hypo
atagagtaagactcggaaaaaaaaaaaa

SEQ ID NO: 41855 - DNA, 30 bp, Homo sapiens
  chr8:95904181-95904211
  hypo
tcggattaactcacacgtgatctctccctg

SEQ ID NO: 41856 - DNA, 172 bp, Homo sapiens
  chr8:96208663-96208835
  hypo
atgtaatatggtggccgagttaagcgcttggattctgccactgaacttgttttcttggagatctgactcgttgccatcagcaacatgggcggggtggagctggctttctctgcatctgttctcctctacacctgatgttaacagaatgcctggattccggggacttccaggt

SEQ ID NO: 41857 - DNA, 30 bp, Homo sapiens
  chr8:97039387-97039417
  hypo
aaatatttcaatcatcgaagagtcaattga

SEQ ID NO: 41858 - DNA, 23 bp, Homo sapiens
  chr8:97272415-97272438
  hypo
actgcgctcggcccattctgcga

SEQ ID NO: 41859 - DNA, 362 bp, Homo sapiens
  chr8:97339840-97340202
  hypo
ggcctggtaagagagcgcacacggagcttgagattaatgcagaagcaaagatcccgggtgctggttaataagcttttccaggagcgtggttgtctgctcggccgtcattaatttgaatgctcattaccataatgtagaagccaagctggggtcctgcgccctccttgccgccagccccgtggtcctggacagcctggctctcatcccacgtagtttcttctcgcccccccgccctttctttaaacgaagtgtgcaattgctattttaaatctgagccttgacattttcagtgggtacgtgcctagatttccacaggtgtgattgcaaacctgtaaattaccggcttccgtttgctgggacaa

SEQ ID NO: 41860 - DNA, 37 bp, Homo sapiens
  chr8:97977869-97977906
  hypo
tagaggcgtgagccaccgcacccggccaagccaattt

SEQ ID NO: 41861 - DNA, 30 bp, Homo sapiens
  chr8:97982654-97982684
  hypo
aagcagtaggtaactcgtgttatattcatt

SEQ ID NO: 41862 - DNA, 39 bp, Homo sapiens
  chr8:98404793-98404832
  hypo
attataggtgtgatccaccacgcccggccacctctaacc

SEQ ID NO: 41863 - DNA, 30 bp, Homo sapiens; identical to SEQ ID NO: 15140
  chr8:98738336-98738366
  hypo

SEQ ID NO: 41864 - DNA, 22 bp, Homo sapiens
  chr8:98748478-98748500
  hypo
gactgggcgacggagggagact

SEQ ID NO: 41865 - DNA, 79 bp, Homo sapiens
  chr8:99130932-99131011
  hypo
tgtaaccattatgcccggcctcattttttttctttcccttgtcctgtttcctattgtgctgtaccgcataatttagtat

SEQ ID NO: 41866 - DNA, 95 bp, Homo sapiens
  chr8:100026644-100026739
  hypo
ctgcataatttttaaaaatagtttgttcccagttttggtatattagaatgggattacttaaagttgctttgacagaaagacgatttcattgttca

SEQ ID NO: 41867 - DNA, 36 bp, Homo sapiens
  chr8:100245127-100245163
  hypo
tgcagagtccctggccgcctccgcagacttctcatt

SEQ ID NO: 41868 - DNA, 32 bp, Homo sapiens
  chr8:100359795-100359827
  hypo
tggtactccacagtacgcgtgtgccaccttca

SEQ ID NO: 41869 - DNA, 103 bp, Homo sapiens
  chr8:100904181-100904284
  hypo
atatgatttcgcagacgcctggccagaaggccacgcatccgaggttttggcaaaacttcgggagccatggtagttactgtccttgatacgtatgctaacctta

SEQ ID NO: 41870 - DNA, 216 bp, Homo sapiens
  chr8:100906569-100906785
  hypo
tgcatgatattgagtcgatatatacactgagtacctactatgtgccagattctgctaaacaagaggacagatcttcggggagtctcattctgatcagggagtctttgtcctcaacctattaaccaacactctggagggtgaaacctggccacaaagaaaggtgctcaattgaggttcaaaagtaggtttggactttaccaacgtttttcaggcctc

SEQ ID NO: 41871 - DNA, 150 bp, Homo sapiens
  chr8:101156747-101156897
  hypo
ggactcaacagttcacggataaatcaatcaagcctcttcgatattcatttttaaaaactaggcttctgataaaaggctgagaaaacttattcctaaagtgttctttaagaaaaaaaaaaaaaaaagcagcggccgggcgcggtggctcac

SEQ ID NO: 41872 - DNA, 23 bp, Homo sapiens
  chr8:101241341-101241364
  hypo
aatgaggaagtaggccgggcgtg

SEQ ID NO: 41873 - DNA, 30 bp, Homo sapiens
  chr8:101299821-101299851
  hypo
tcacttaatatcaagcgaatatcatgggga

SEQ ID NO: 41874 - DNA, 30 bp, Homo sapiens
  chr8:101438141-101438171
  hypo
ccttgtttcacaggccgctgttacacatga

SEQ ID NO: 41875 - DNA, 78 bp, Homo sapiens
  chr8:101693784-101693862
  hypo
acggatgcagacttgcgagggtttgctaagttcttgtaaaggggcaggggtggctgcaagtttcgtcatgcagaggat

SEQ ID NO: 41876 - DNA, 30 bp, Homo sapiens
  chr8:101717092-101717122
  hypo
ccccataaaaagccacgtaataactgtgta

SEQ ID NO: 41877 - DNA, 42 bp, Homo sapiens
  chr8:101729504-101729546
  hypo
ggatttacaggcatgagccaccgcgcccggacttgtgagtaa

SEQ ID NO: 41878 - DNA, 40 bp, Homo sapiens
  chr8:101872226-101872266
  hypo
gcctccctggctttccgtcctacctcgcacccgtttcacg

SEQ ID NO: 41879 - DNA, 51 bp, Homo sapiens
  chr8:102039492-102039543
  hypo
cttcaggtcactaaccgccccattggagagggttcacgcagctcacgtgta

SEQ ID NO: 41880 - DNA, 213 bp, Homo sapiens
  chr8:102155655-102155868
  hypo
gcaagccccagggcccgggaccccaaatgcagaagaaatgcctagtagccacagggcccagaggggtgtgcagtactgggagacagagatggcactaattcccaggacagtggcggccaccagggcatgcccaggagctcaggggtcttggtggtacccgggaagctccttccctcacccagcaagcagctgaggctgcggagaccaggtacc

SEQ ID NO: 41881 - DNA, 30 bp, Homo sapiens
  chr8:103403324-103403354
  hypo
aggttgatgctgcagcgtacagtgatggtg

SEQ ID NO: 41882 - DNA, 41 bp, Homo sapiens
  chr8:103629841-103629882
  hypo
actctcttaaaggctttgctggatcacgtagacctaacaaa

SEQ ID NO: 41883 - DNA, 20 bp, Homo sapiens
  chr8:104235237-104235257
  hypo
tttaaaactttttggcgggc

SEQ ID NO: 41884 - DNA, 165 bp, Homo sapiens
  chr8:104382635-104382800
  hypo
cacttatgaaaacagcgtttatatatcatttgggtcatgggactcttggaaaacctgatgatacctatggtttcttcctgcctccgccccacccccaccttccagcctccaaaaatgtcacctccaaaaaacaaataaggcagggcgcggtggctcacgcctgta

SEQ ID NO: 41885 - DNA, 23 bp, Homo sapiens
  chr8:104488605-104488628
  hypo
actgcgcccggcccataatatat

SEQ ID NO: 41886 - DNA, 30 bp, Homo sapiens
  chr8:105386063-105386093
  hypo
ttctcagcagcagagcgacccccacctgga

SEQ ID NO: 41887 - DNA, 30 bp, Homo sapiens
  chr8:105456591-105456621
  hypo
tccactgcctctgggcggcacagctcgtgg

SEQ ID NO: 41888 - DNA, 20 bp, Homo sapiens
  chr8:105645632-105645652
  hypo
gcgagcgagggctgttggca

SEQ ID NO: 41889 - DNA, 30 bp, Homo sapiens
  chr8:106433918-106433948
  hypo
aatttttctcagtgacgcataattatgttt

SEQ ID NO: 41890 - DNA, 30 bp, Homo sapiens; identical to SEQ ID NO: 15145
  chr8:106500552-106500582
  hypo

SEQ ID NO: 41891 - DNA, 16 bp, Homo sapiens
  chr8:106706503-106706519
  hypo
gcgcccagcctctcca

SEQ ID NO: 41892 - DNA, 30 bp, Homo sapiens
  chr8:107359293-107359323
  hypo
aagctctttggtgttcgattttaattaagc

SEQ ID NO: 41893 - DNA, 185 bp, Homo sapiens
  chr8:107531614-107531799
  hypo
atatacgtacatatacgtacacatatactatctctctctctcttaggtttttcaatttttaactttgtgtgctattttcattttagccattgttcagccagcacctttcttgttttttgtttttgttattttcattttcccttcaggctcccaggtctctgaacctgttccgtcaggttgttaag

SEQ ID NO: 41894 - DNA, 150 bp, Homo sapiens
  chr8:108134676-108134826
  hypo
ccgtgtgggaggtgccgctggggctgcctgctccatggagcctgcaggatccaggacaggtaggagccccgcccctttctgagtgggaggggcaggagccccaccctcccaggggtagctgcagccacccagccacggttgtggacctgg

SEQ ID NO: 41895 - DNA, 77 bp, Homo sapiens
  chr8:108582504-108582581
  hypo
tattactcccaatgtcgcagagagtgtacaccccccgtgatgtttttatttaatatccaggaagggagaagttggca

SEQ ID NO: 41896 - DNA, 17 bp, Homo sapiens
  chr8:108582641-108582658
  hypo
ggcggagaaaatattac

SEQ ID NO: 41897 - DNA, 30 bp, Homo sapiens
  chr8:108588091-108588121
  hypo
gttcctaatatgtggcggggagaggatgat

SEQ ID NO: 41898 - DNA, 41 bp, Homo sapiens
  chr8:108593714-108593755
  hypo
tgtacacttcccctgcgatattgttcctaatatccaggatg

SEQ ID NO: 41899 - DNA, 30 bp, Homo sapiens
  chr8:108601942-108601972
  hypo
tgtatacacgttccccgtgataatgttcct

SEQ ID NO: 41900 - DNA, 30 bp, Homo sapiens
  chr8:108957755-108957785
  hypo
atgagccaccgtgctcggcttctttttcct

SEQ ID NO: 41901 - DNA, 31 bp, Homo sapiens
  chr8:110274990-110275021
  hypo
aaacctgaatgtggccgggtgtggtagctca

SEQ ID NO: 41902 - DNA, 36 bp, Homo sapiens
  chr8:110406111-110406147
  hypo
aatcaactgtagggccgggcgcggtggctcacgcct

SEQ ID NO: 41903 - DNA, 171 bp, Homo sapiens; identical to SEQ ID NO: 15148
  chr8:110548417-110548588
  hypo

SEQ ID NO: 41904 - DNA, 30 bp, Homo sapiens; identical to SEQ ID NO: 15149
  chr8:110961977-110962007
  hypo

SEQ ID NO: 41905 - DNA, 30 bp, Homo sapiens
  chr8:111586661-111586691
  hypo
gtgagccaccgtgcccggcctttcccatta

SEQ ID NO: 41906 - DNA, 34 bp, Homo sapiens
  chr8:112636593-112636627
  hypo
gggcgtgctcttccacgggcgtgctcttccacgg

SEQ ID NO: 41907 - DNA, 30 bp, Homo sapiens
  chr8:113146243-113146273
  hypo
tggattaggactacacgattaagaccttat

SEQ ID NO: 41908 - DNA, 191 bp, Homo sapiens
  chr8:113175066-113175257
  hypo
ttcactgtaaagtgccgagcatatctgtagactccagaaagtgtcccacctgtgcttacaaacaaggtgggtgttgagggttctgccgctgctgcacttttgtggggccagtctcctgctgcatccgataaggatctgcaggtgagctgagaagccctcctccattcacccagtgtcgctgtctcccccga

SEQ ID NO: 41909 - DNA, 38 bp, Homo sapiens
  chr8:113221643-113221681
  hypo
aagattaaacctggccgggcgcggtggcttcacgcttg

SEQ ID NO: 41910 - DNA, 30 bp, Homo sapiens
  chr8:115649508-115649538
  hypo
tgggctgttcctattcggccatcttggctc

SEQ ID NO: 41911 - DNA, 170 bp, Homo sapiens
  chr8:116710279-116710449
  hypo
gtcttatttgaaatgcgtaatacattcagctaaaacatgctgatgtcagctacaatcacagatgaggtaaaaaacaaagtttgggcttccttctgactgtgttggatgacttattaaaatgtgcaggtacggaaatggccctattggtagatcggcggctgcacattttg

SEQ ID NO: 41912 - DNA, 30 bp, Homo sapiens; identical to SEQ ID NO: 15150
  chr8:117824014-117824044
  hypo

SEQ ID NO: 41913 - DNA, 16 bp, Homo sapiens
  chr8:120695441-120695457
  hypo
gcgcccagcctttata

SEQ ID NO: 41914 - DNA, 18 bp, Homo sapiens
  chr8:120844122-120844140
  hypo
tggtgcggtggctcacgc

SEQ ID NO: 41915 - DNA, 38 bp, Homo sapiens; identical to SEQ ID NO: 15151
  chr8:121206396-121206434
  hypo

SEQ ID NO: 41916 - DNA, 30 bp, Homo sapiens
  chr8:121354745-121354775
  hypo
ttcttttcccatgagcgtaccactaaggaa

SEQ ID NO: 41917 - DNA, 30 bp, Homo sapiens
  chr8:121566445-121566475
  hypo
cgttcggtgacaaggcgtttctacatggtc

SEQ ID NO: 41918 - DNA, 30 bp, Homo sapiens
  chr8:121573169-121573199
  hypo
gagaatttgaacccacggctatatgactac

SEQ ID NO: 41919 - DNA, 75 bp, Homo sapiens
  chr8:121712263-121712338
  hypo
ccccctttggtcattcgcccaaagtcagtgttggaaaatggcagaagcatgaggtgaatccgggtagactggctc

SEQ ID NO: 41920 - DNA, 183 bp, Homo sapiens
  chr8:121732132-121732315
  hypo
cacttacatgaatggcgggcaaggctcaaaaagcctcgccttcctatttgtaaaatgacttcaaactgtctacatagttcaattaaaattttatacttccttccaggattagaacacagcttccaaattctcttaaatgcctgggcagccatcaaaccttccagtgatcggtgatgcagtaaa

SEQ ID NO: 41921 - DNA, 89 bp, Homo sapiens
  chr8:121825686-121825775
  hypo
tgactccctaaagagcggagtcccagccaggtcaaggaatgaaatgaaaacatttggacattttcttgagaaggcggagtcactgcagg

SEQ ID NO: 41922 - DNA, 144 bp, Homo sapiens
  chr8:121982491-121982635
  hypo
ctcaagtgacttttccggatcctcagtaccggtgccaggtcacctacactaccttacgttccagcccctggggccttttggcctgttctctattaaacaaacatgtcacaccaccgtatttttcttctccggtttcccaaagat

SEQ ID NO: 41923 - DNA, 210 bp, Homo sapiens
  chr8:123695489-123695699
  hypo
gagaaatttaaagggcgagagatggcggcaggccagttgcgccgaaggtggagtgagacgaggtgatcgcgttgagggagacttgcttttcccgagtctgtcagggcaaagcatgtgtgagtttcccatggagcagaactggcctgggaggtgcggcgccagatgctagggggtgagggagaagcagtggaggaacggtcagaagagatg

SEQ ID NO: 41924 - DNA, 347 bp, Homo sapiens
  chr8:123966045-123966392
  hypo
gaggccacctcagaccggtcagagggcagcagccgggacggccagggtagcgacgagaacgaggagtcgagcgttgtggattacgtggaggtgacggtcggggaggaggatgcgatctcagatagatcagatagctggagtcaggctgcggcagaaggtgtgtcggaactggctgaatcagactccgactgcgtccctgcagaggctggccaggcctagacaggtaattccacctgctcacccaggcagcaggggagaacgcagcttgctttcttttcgttgccagggttaatatagattgtagggtacagagatgttgacacagatggtggcgtctttttcttgta

SEQ ID NO: 41925 - DNA, 105 bp, Homo sapiens
  chr8:124055130-124055235
  hypo
tgcacagagaaaagccgctctaactaggttggaatgttggaggaactaaaagccaaaatgatccatcttgtctaattcaacttgtataagaaggaatctttaaga

SEQ ID NO: 41926 - DNA, 45 bp, Homo sapiens
  chr8:124055535-124055580
  hypo
aaaaaagaaaagatactgagtagagtttcccgttgttttgggatt

SEQ ID NO: 41927 - DNA, 17 bp, Homo sapiens
  chr8:124288888-124288905
  hypo
gccgatgactaggtttt

SEQ ID NO: 41928 - DNA, 20 bp, Homo sapiens
  chr8:124428122-124428142
  hypo
gcacccggccctaaacacta

SEQ ID NO: 41929 - DNA, 97 bp, Homo sapiens
  chr8:125452302-125452399
  hypo
tgccaaacacactcacgcacctgactatcctgtcagtaagggattgttttttggtgtttgtttgttttttgtttttgttcgtttgttttgagacgga

SEQ ID NO: 41930 - DNA, 36 bp, Homo sapiens
  chr8:125452639-125452675
  hypo
gattacaggcataagccaccgcgctaggccataagg

SEQ ID NO: 41931 - DNA, 30 bp, Homo sapiens
  chr8:125568984-125569014
  hypo
gtctgaagggaccagcgctccttaacaacc

SEQ ID NO: 41932 - DNA, 121 bp, Homo sapiens
  chr8:126267003-126267124
  hypo
tgactgagactgtgacgttctatggaagcagtttggtccgggaatgaatcctttcattcagcaaacaaatgccatgccagctgagtcctgaaagagctcatgggcacgtaaaggaatatag

SEQ ID NO: 41933 - DNA, 30 bp, Homo sapiens
  chr8:126284175-126284205
  hypo
aaacccagagatattcggtgacttggccaa

SEQ ID NO: 41934 - DNA, 97 bp, Homo sapiens; identical to SEQ ID NO: 15154
  chr8:127305217-127305314
  hypo

SEQ ID NO: 41935 - DNA, 80 bp, Homo sapiens
  chr8:128745542-128745622
  hypo
agccaaggccaggagcgatgactcgcacttgtattcccagcagtttcagaggcaaaggccgaaggatcgctttaaccgag

SEQ ID NO: 41936 - DNA, 39 bp, Homo sapiens
  chr8:128864120-128864159
  hypo
tcacattctctagaccggttgccacgccatgctcacagt

SEQ ID NO: 41937 - DNA, 117 bp, Homo sapiens
  chr8:128872322-128872439
  hypo
cagggctaccaggaacggtgtgtgtgcctctgggcagggccacttcctagaaccatggggctgctctgtgaagagaaccggctcccagtgagctccaggagacgaggagcaggtcct

SEQ ID NO: 41938 - DNA, 265 bp, Homo sapiens
  chr8:128888983-128889248
  hypo
acaactcctgtcctccgtggcgcttgggtgacagcagagcagagccgatgtgcctgctcctggtcatgggctgttcgtgctgtcatcgctttcatttgccccatccccccaatttggacttacccagaatccttgggcaagctagatggctgccaaagtttacttagcgagatgtgcctgcgtgacttgagtagagacctgcttctgagaaagtcagaagtgcattccaaagtcaggagcgtgacctccccggaagcccagctaa

SEQ ID NO: 41939 - DNA, 30 bp, Homo sapiens
  chr8:128931231-128931261
  hypo
tctctgggttctgatcgttggggctgtcct

SEQ ID NO: 41940 - DNA, 35 bp, Homo sapiens
  chr8:128962506-128962541
  hypo
agcacccaatagccccgtggcggcatgctgttatt

SEQ ID NO: 41941 - DNA, 202 bp, Homo sapiens
  chr8:129069803-129070005
  hypo
cctggcactggctgacgtgggaggtacagaatgaggtgtccgtccctccaaggcacggtgacctagaatcccactgctcactgcctgtctctgttcagcctttcagttcataaacatgctttcctccctgcattttgacatccatcatcgtttaaattccaggtcgtcatccttgtagaacgaggttcggatctcggcatta

SEQ ID NO: 41942 - DNA, 30 bp, Homo sapiens
  chr8:130080387-130080417
  hypo
gtgacccactgcgcccggccagcatttgaa

SEQ ID NO: 41943 - DNA, 30 bp, Homo sapiens; identical to SEQ ID NO: 15159
  chr8:130116433-130116463
  hypo

SEQ ID NO: 41944 - DNA, 203 bp, Homo sapiens
  chr8:130288699-130288902
  hypo
catctatgaatatgtcgatgttcctgactgtctggaagtttcgttttctttctcttaaagtcatgttttccattgtcttgcagatcttttagccaaagctagggcatttgttgtggggatcaccttatggcctcccctcccatagtaagctgtcccagtggctctccaaggacatgctgcatttactgcgtatccatttcaaa

SEQ ID NO: 41945 - DNA, 209 bp, Homo sapiens
  chr8:130368840-130369049
  hypo
tgagcatacctgaatcgagatttaagcattagtaatgaattgaattcccccatttgacaaaggtggtatcagctttcagtataacagagacagtattactttcaaaggaaaatttgggaactggagcaacagaggtgcttggccatgagaatggggccatttgtgagaatgacggctttttgttttgttttgtttttattgagacggag

SEQ ID NO: 41946 - DNA, 89 bp, Homo sapiens
  chr8:130369289-130369378
  hypo
taaggaagcagtacactgcagtggagagtgctggagtcacgatacagatgctagttcagccgctggccaagtgtcgaccctgagaagtt

SEQ ID NO: 41947 - DNA, 31 bp, Homo sapiens
  chr8:130461175-130461206
  hypo
cgtgagccaccgcgcccggccaggaatctgt

SEQ ID NO: 41948 - DNA, 201 bp, Homo sapiens
  chr8:130583277-130583478
  hypo
aacgtatttccaaatcgtttatctgataagggatttgtatctagaatatatttttaaaagtgttacaactcagtagtaaatatcttagaacccagttttaaaatgagtaaagaatttggataggcatttttccaaatgatcaataagcacacgaaaagatgctcaacattaagtcattaggaaatgcgaatcaaagcagca

SEQ ID NO: 41949 - DNA, 23 bp, Homo sapiens
  chr8:131922190-131922213
  hypo
tttttttttttgagacggagttt

SEQ ID NO: 41950 - DNA, 30 bp, Homo sapiens
  chr8:132284091-132284121
  hypo
agatgttagtggacacgacacaagcaaagg

SEQ ID NO: 41951 - DNA, 30 bp, Homo sapiens
  chr8:132783128-132783158
  hypo
ttgtcacccagaacccgatacaatggggca

SEQ ID NO: 41952 - DNA, 36 bp, Homo sapiens
  chr8:133062829-133062865
  hypo
ccggctgtgagacttcgggcacgtgttctttcctcg

SEQ ID NO: 41953 - DNA, 101 bp, Homo sapiens
  chr8:133686745-133686846
  hypo
tggggagctcaaaaacgttgtcgatatcaaaatggttcatacaatataaataacttacccgcatcaccttgcagtttgttagtatattcttaaagaaacac

SEQ ID NO: 41954 - DNA, 132 bp, Homo sapiens; identical to SEQ ID NO: 15163
  chr8:133811037-133811169
  hypo

SEQ ID NO: 41955 - DNA, 179 bp, Homo sapiens
  chr8:134470121-134470300
  hypo
accaggaaaaagtcacgcctcctcaaagcagcagcgaccttttcagggatattttcaacaagaaagtggtttttctgcttaaacattagtaactggagccaacaatcaccgtcccccacattcctgtcactctccactccacacccagcagcaataaggtttcacggagttttggagac

SEQ ID NO: 41956 - DNA, 45 bp, Homo sapiens
  chr8:134541589-134541634
  hypo
tgggagcttataggtcgaaggtgctgctaccgagcaaatgtacaa

SEQ ID NO: 41957 - DNA, 34 bp, Homo sapiens
  chr8:135301251-135301285
  hypo
aatatctctggccagatcccgcaatagagtatta

SEQ ID NO: 41958 - DNA, 154 bp, Homo sapiens
  chr8:138910227-138910381
  hypo
aacatgcacctttaaatgaatatttcgttttattaatttatttcaataagttgagttccatctcccaactttatttgaacagaattaaccaaactggttaaaacttaagagagttaacaaagcacgaatgattttcttccgcactgcacacccc

SEQ ID NO: 41959 - DNA, 30 bp, Homo sapiens
  chr8:140630956-140630986
  hypo
aaaggccacgtagagcggcttcttctgcag

SEQ ID NO: 41960 - DNA, 37 bp, Homo sapiens
  chr8:140691457-140691494
  hypo
tgccaggtgggttcccggagagcgcctgtgtccctga

SEQ ID NO: 41961 - DNA, 119 bp, Homo sapiens; identical to SEQ ID NO: 5084
  chr8:140834148-140834267
  hypo

SEQ ID NO: 41962 - DNA, 130 bp, Homo sapiens
  chr8:140834841-140834971
  hypo
ctgagagccaagagccgtaggatggcgggggggggctgccttgcctccatgggaaggacagcagaggggctgccatctgccagaggcctgctgagtgcatgcgtcctctcagacacgctgcctgccgctg

SEQ ID NO: 41963 - DNA, 70 bp, Homo sapiens
  chr8:140963292-140963362
  hypo
tgcctcacctgctcacggcttggagtcagccagacccaggcgcgcacatccccaccgccacctccccacc

SEQ ID NO: 41964 - DNA, 30 bp, Homo sapiens
  chr8:141018127-141018157
  hypo
tcaacctgctcctgccgtgtgaaggctggg

SEQ ID NO: 41965 - DNA, 30 bp, Homo sapiens
  chr8:141054547-141054577
  hypo
gaatttggttccatacgtgcccaactttga

SEQ ID NO: 41966 - DNA, 41 bp, Homo sapiens
  chr8:141106960-141107001
  hypo
ggactaggacagggacgtggactggacgtgagacattccta

SEQ ID NO: 41967 - DNA, 133 bp, Homo sapiens
  chr8:141107540-141107673
  hypo
cctgagtcctggctgcgcagcctgtgttgccagtcgcagggtaatacactcgcctgcatcgtgggtgccccgccaccgccctgccacagtctacaaggcaagaacgcccgtctgggtccgtagtgtgcagccg

SEQ ID NO: 41968 - DNA, 30 bp, Homo sapiens
  chr8:141159919-141159949
  hypo
catgaagtacgagtgcgagcagtggagcct

SEQ ID NO: 41969 - DNA, 218 bp, Homo sapiens
  chr8:141202517-141202735
  hypo
gtcaacaggcccaatcgtccacagagcaaggtgatctgcagaaacctcctggcacagtgcctggggcgtgttttctagcagtaaaaacaggcagcatggtgcaggggaggagcaagctgcccgcccacagccctcgcaccagctgtgcagtcagggcagccccattatgcagagcctcgcttcaatacctgcaaaacctgctccgacgaggtttaaga

SEQ ID NO: 41970 - DNA, 30 bp, Homo sapiens
  chr8:141249579-141249609
  hypo
aaacaagtaagactccggccctgcccgcga

SEQ ID NO: 41971 - DNA, 196 bp, Homo sapiens
  chr8:141466557-141466753
  hypo
gtggattttatggcaggtaatcgaggctcaatgaagctgttatttttgacacactagatttctgaaacatttattgtttacatgtttccggacaactgtttttccctctacactactagtcctccacacaattaaaaaaacgaacaaacacacacaacaaaacctagccagatctttaggacggcaatgttcctgg

SEQ ID NO: 41972 - DNA, 30 bp, Homo sapiens
  chr8:141566854-141566884
  hypo
gatttttcaaagagtcgtgatgttagagga

SEQ ID NO: 41973 - DNA, 77 bp, Homo sapiens
  chr8:141588102-141588179
  hypo
gctacaatgcacacccgtggagtcggctggcagacaatcctggccaccactcaggcctccgccgcccagagagagca

SEQ ID NO: 41974 - DNA, 30 bp, Homo sapiens
  chr8:141594857-141594887
  hypo
cacacatcagaatgccgtgactttaggggc

SEQ ID NO: 41975 - DNA, 278 bp, Homo sapiens
  chr8:141596819-141597097
  hypo
ctctctacgccacaccggagtagaacaaagcacttgccaacacgtggccctgttctcaggtggctccaaccacccagtgagacggctcccaggaaacgtctaggacagagcccgggaatctggccctgtggccaatctcgatttcagggtcgggcacgctcctctcggggaggagagtcactgtccttcggtgactcccagcttacaaggtgctcatgcagttacttaaccgagcctcacaaccataccacaaaggggcacaccgctggctgcaagaa

SEQ ID NO: 41976 - DNA, 30 bp, Homo sapiens
  chr8:141600227-141600257
  hypo
gcctcacccagcccacgttcacagagacgc

SEQ ID NO: 41977 - DNA, 30 bp, Homo sapiens
  chr8:141602372-141602402
  hypo
tggtccagggctgctcgaagcctgacacct

SEQ ID NO: 41978 - DNA, 35 bp, Homo sapiens
  chr8:141624396-141624431
  hypo
taggagacagagtgagactccgtctcaaaacaaaa

SEQ ID NO: 41979 - DNA, 30 bp, Homo sapiens
  chr8:142231672-142231702
  hypo
taccgatggcagagccgttaaggaaaagtg

SEQ ID NO: 41980 - DNA, 30 bp, Homo sapiens
  chr8:142243948-142243978
  hypo
ggtccagcaggtctgcggctggacctgact

SEQ ID NO: 41981 - DNA, 30 bp, Homo sapiens
  chr8:142244184-142244214
  hypo
aatcgtcgccaacatcggggcctgcatcgc

SEQ ID NO: 41982 - DNA, 56 bp, Homo sapiens
  chr8:142292571-142292627
  hypo
gccctccctccaggccgccgctcagggcacgccgcctccatcgctgccctctctcc

SEQ ID NO: 41983 - DNA, 22 bp, Homo sapiens
  chr8:142313512-142313534
  hypo
gcaggaacgagcctctgtgccc

SEQ ID NO: 41984 - DNA, 30 bp, Homo sapiens
  chr8:142323052-142323082
  hypo
caccaggtgactgtccgtgccacccttttg

SEQ ID NO: 41985 - DNA, 58 bp, Homo sapiens
  chr8:142367766-142367824
  hypo
gtcttggcccgggtgcggcagcagaagacgtacagcgccagcccgttgagcaccagcc

SEQ ID NO: 41986 - DNA, 72 bp, Homo sapiens
  chr8:142432225-142432297
  hypo
caagcacagggatctcgttctcctcattttttgggggtgtgtggggacttctcaggtcgtgtccccagcctt

SEQ ID NO: 41987 - DNA, 30 bp, Homo sapiens
  chr8:142439319-142439349
  hypo
cacggtggagccacacggggcacctgcagc

SEQ ID NO: 41988 - DNA, 42 bp, Homo sapiens
  chr8:142452256-142452298
  hypo
gtgggagactcagggcgtgtggcgtagcggagcccagagaag

SEQ ID NO: 41989 - DNA, 30 bp, Homo sapiens
  chr8:142501450-142501480
  hypo
tgaaactaaaggtgacgtggttttagaagt

SEQ ID NO: 41990 - DNA, 179 bp, Homo sapiens
  chr8:142535328-142535507
  hypo
gagagagggtcaggacggcaaggctggggccggggcggcgggaagggtgaggtttctgtgcactgagatggggctgctggggctgtctggggagtccgaggtgcccaggggcaggcggtgggctcagtacacgaacgctgcgggcaaacaggccgggggaggagcgaggacctgcctgc

SEQ ID NO: 41991 - DNA, 144 bp, Homo sapiens
  chr8:142553829-142553973
  hypo
gatggggctgagccccggcgcaggctgccactgatcctggttccaccttgtgtgtccgcttccatcagcctcttcccccatcccattctgaaccttcccctgccatgcctgggcctttgccattccttccgctgcagggtcctt

SEQ ID NO: 41992 - DNA, 37 bp, Homo sapiens
  chr8:142560165-142560202
  hypo
taccctgtgagtccccggcaggcgtcactgcccccag

SEQ ID NO: 41993 - DNA, 30 bp, Homo sapiens
  chr8:142568598-142568628
  hypo
ccacctgcctgaggtcgcacagctggcctg

SEQ ID NO: 41994 - DNA, 124 bp, Homo sapiens
  chr8:142583056-142583180
  hypo
cagctgtgtgcagggcggggtggcggggggggacggggagggcggaggagccattggagtgattatgatggagctggcactggtcataaactttaatcaacttaaaacccgcttttggtattaa

SEQ ID NO: 41995 - DNA, 144 bp, Homo sapiens
  chr8:142593584-142593728
  hypo
cgctttctggaaagccgtggtgaagcatcacccggtaccagccgcctcgctagctcttgccatagcagcagcgtgaacaagcgtcccgccatttagtggctcaaaacaacaaggtgccgtggtttctcccgagcctcgggtggg

SEQ ID NO: 41996 - DNA, 30 bp, Homo sapiens
  chr8:142680135-142680165
  hypo
actcctccagacggccgggagggcttcaca

SEQ ID NO: 41997 - DNA, 30 bp, Homo sapiens; identical to SEQ ID NO: 15174
  chr8:142694812-142694842
  hypo

SEQ ID NO: 41998 - DNA, 193 bp, Homo sapiens
  chr8:142706678-142706871
  hypo
taggaagagagatgccgggaagaaaactgcgtctgctcacgtcctttccttctgcccccatgctccctccaccttccttccagcctggacatggagcctcatttccgcagaggtgagccttgagtcacaagggtgtcccccacaaactctaggaagcaagcgccttgagcgccatgggcggtactggggaagt

SEQ ID NO: 41999 - DNA, 114 bp, Homo sapiens
  chr8:142939132-142939246
  hypo
tattagcaccaccatcgtcatccccatccttgtcatcatcaccagtactatcatcatcatcatcgtcatcatcatagctattaccatcaacatcaatgccgttactgtcatcat

SEQ ID NO: 42000 - DNA, 97 bp, Homo sapiens
  chr8:143054769-143054866
  hypo
actgtacttgcctcacgtgtgcctgggctcacggtgcctgcgctcacgggtgcctgccctcacggtgcctgcgttcacgggtgcctgccctcacggg

SEQ ID NO: 42001 - DNA, 97 bp, Homo sapiens
  chr8:143054986-143055083
  hypo
cggtgcctgggctcacggtgcctgcgctcacgggtgcctgccctcacgagcctgcgctcacgggtgcctgtgcttacaggtgcgcaccaccccccac

SEQ ID NO: 42002 - DNA, 33 bp, Homo sapiens
  chr8:143088493-143088526
  hypo
ccaccgcagcgtgtacgccgttttctacattta

SEQ ID NO: 42003 - DNA, 68 bp, Homo sapiens
  chr8:143088999-143089067
  hypo
ggactaaagtcccctcgagcgcctcagggtcggcttcccaggccttcgcagcccgtgtgaagctagag

SEQ ID NO: 42004 - DNA, 30 bp, Homo sapiens
  chr8:143090706-143090736
  hypo
ggacgccaaatctgccggcaccttgatctt

SEQ ID NO: 42005 - DNA, 33 bp, Homo sapiens; identical to SEQ ID NO: 15178
  chr8:143097424-143097457
  hypo

SEQ ID NO: 42006 - DNA, 166 bp, Homo sapiens
  chr8:143105211-143105377
  hypo
ctgcgccagctcagccgtctgtctcaggcaggcaccgtctgctgtggccggcgggtggtgtgtctgggccggctctgctctagatgccgctaaggtgcaggaggcatggctgctgccctctgggagctcgtcctggggtgtccgtgtgacacggacctgcccatgc

SEQ ID NO: 42007 - DNA, 30 bp, Homo sapiens
  chr8:143128771-143128801
  hypo
gcgtgatggcaaactcgagtccggccagaa

SEQ ID NO: 42008 - DNA, 30 bp, Homo sapiens
  chr8:143156215-143156245
  hypo
gcttgtgctggccaacggaatgttactgga

SEQ ID NO: 42009 - DNA, 102 bp, Homo sapiens
  chr8:143171156-143171258
  hypo
gagtcaacagagagccgcagctgctcgtaccgggcaagtctctgcggggtgggaccctgtcccaggacgcaggattggcgctgagctcgggatctctgtgtg

SEQ ID NO: 42010 - DNA, 39 bp, Homo sapiens
  chr8:143198927-143198966
  hypo
aggccacagctactccgcagctcacggcagttgggaccc

SEQ ID NO: 42011 - DNA, 144 bp, Homo sapiens
  chr8:143210699-143210843
  hypo
aagtcggagggaacccggaacaggaaacaacgcacaggctcaggacaggggacaccggtgtgtgtgacccattgctgccacccaccagccgtgtggccctggggacccccatcgccctctgtgcctcggcgtcctcgtctgcag

SEQ ID NO: 42012 - DNA, 66 bp, Homo sapiens
  chr8:143217605-143217671
  hypo
ccggaacctaagctccgaagccaggccgtgctctcttcccagcgccgcttccgcatctcccacttg

SEQ ID NO: 42013 - DNA, 30 bp, Homo sapiens
  chr8:143265172-143265202
  hypo
tggtgggtccttcatcggactcaccactca

SEQ ID NO: 42014 - DNA, 43 bp, Homo sapiens
  chr8:143314664-143314707
  hypo
ggcctaggacccaagcggggtttttggacgggtgatggtcaag

SEQ ID NO: 42015 - DNA, 365 bp, Homo sapiens
  chr8:143317093-143317458
  hypo
actttaggccaaaggcggcagcgggtgagagcacatggcgttgggtccactgtcctgaaagggaagcggccctgagcgtttcctctgtgccagggcctgccaggggcacgggagtcctgtcttttagggagggcttcatgcagggtgggggatggacaagttgaggagcatggcggggcaggaggaggtgggcacgcaggaggggcttcacctggcgaggtgggggcacagaaggctgcaagtcccccaggggagacgggctcacctctcccaattagccccaggctgtgcaggatgctggagcttcagggcaaggactccgcagccaggctccagccacagcctcaccgcgtggccatgaggct

SEQ ID NO: 42016 - DNA, 30 bp, Homo sapiens
  chr8:143326109-143326139
  hypo
acgcagggagagagacgcttaccgcagccc

SEQ ID NO: 42017 - DNA, 32 bp, Homo sapiens
  chr8:143333080-143333112
  hypo
catgtacccgccacccgcgatctctgtctgca

SEQ ID NO: 42018 - DNA, 278 bp, Homo sapiens
  chr8:143333390-143333668
  hypo
tgtacccgccgcccacgttctctatctgcagggcccgggcaccatgtacccaccgctcgcgttctctatctgcagggcccgggcaccatgtacccgccgcccgcgttctctgtctgcagggcacgcacgttgagagagagcttgtttgatatctgggcggtttgtttggtttaattttgttgttttccctttctgctgtcaagaggtaaacagacggctgcttcatcttcttaagcaggcctacattcgtaatgcatgggttgcgggtgggaggagga

SEQ ID NO: 42019 - DNA, 76 bp, Homo sapiens
  chr8:143334563-143334639
  hypo
aggagggccggtagccgtggagtcacagcagtggtgacggcggtgcctgcagaagcagggccgctgggccacctcc

SEQ ID NO: 42020 - DNA, 30 bp, Homo sapiens
  chr8:143386910-143386940
  hypo
tcgggggcctggtgccgctctccccagcag

SEQ ID NO: 42021 - DNA, 179 bp, Homo sapiens
  chr8:143405792-143405971
  hypo
tgactgaggagtctgcgaggcctgcctggggggtgtgtcacctgaggcccatttgccctagcgccctgccctagtctgccggggccagaaccgacctgagtacggaggctctcgcatttgcttgtcattacttaagatgccgtttagaagcacctcatgtcccgcgtatctcatacctg

SEQ ID NO: 42022 - DNA, 241 bp, Homo sapiens
  chr8:143436977-143437218
  hypo
gcaggggtccctgtgcgggcagcttctgactggcctacaccctaatgctatcactacggaacctgctggccaggccacaccttaagttctaaacacctcagggcaagggctccacccgcccacacaaacacctgaagtgcgaaggcaggtttcagagcaaagtgagcctcacgccagctgagtacagacccaagtccctagggccggggaaggcggtgtgaccccacgttccctctgagca

SEQ ID NO: 42023 - DNA, 52 bp, Homo sapiens
  chr8:143463629-143463681
  hypo
cacccccaggcacctcgtagaccacgcccagaatcagcggtggagaagcacc

SEQ ID NO: 42024 - DNA, 355 bp, Homo sapiens
  chr8:143509189-143509544
  hypo
cgctccctttctccacggcacctctgtgattctcgtcacctgccaacaccagcaccagggctgcccctcctgacggccccctcgccgtctttctgggcacactccatcggcacagcgtcttcactgtcctcctgacaaacctcgtgccacccccatcagcttcagcaccacctccacagcagccgtggccagcaccgacgtccttttccgtcaccgtcaagcctcaaaactgggaccgtgggtaatggcgtcaccccatccgccgtctctctctagctgccaacggcgccttcaccagacacgcccggcaccaccttccaggtcagcagtcccagccctgcgtatcggaggcctg

SEQ ID NO: 42025 - DNA, 64 bp, Homo sapiens
  chr8:143511468-143511532
  hypo
aatgcccatccacaccgctgggcaggactggctaaaataacacgtgcgacgcatgcacctgctg

SEQ ID NO: 42026 - DNA, 40 bp, Homo sapiens
  chr8:143535787-143535827
  hypo
accgtgaggtgcacacgggtgcacacggcacccccgcccc

SEQ ID NO: 42027 - DNA, 49 bp, Homo sapiens
  chr8:143538439-143538488
  hypo
atgagccctagactacgggagatgcagtgaggcccggaacctgagggcc

SEQ ID NO: 42028 - DNA, 205 bp, Homo sapiens
  chr8:143556064-143556269
  hypo
ggtccatgaaggccgcggggactgtcggggcagggatggagaaagactcactagagaagctgaacagagcggccggggtcagggcaggggcgtggcggggaggcgcctgcaggcatttatcccaggctccctcctcgggtggccagctggccaggtccagggcaggctccgtcaggctgtgccctgggttcgaggccctggttgg

SEQ ID NO: 42029 - DNA, 357 bp, Homo sapiens
  chr8:143557723-143558080
  hypo
cagtgagggaggtggcgcggggtatgggagacaggacccacaggaagggtcccctggtgaccagatgagggctggtgccaggctgggcactctggtccctggctcccagctgcccagtggagccaggtggcccagtgctgccgaactcagagcactgtggccacagagagagaggacgggggcaaagaaccgctcctgtgctgacctaagcccgtcctgcagccgctgggcgcaccagctcccggagccagtccctgcggtccacagatgcccggcggcgcgaggagctgggggacgagctgcagcagtttgggttcccagccccccagaccggtgagctggcgggaggggggtggg

SEQ ID NO: 42030 - DNA, 80 bp, Homo sapiens
  chr8:143558389-143558469
  hypo
gcagccctcctgctgcggggtctggccccggtctgactgcagccccatgggcggcaggcctgtgacgctgtagtggggcc

SEQ ID NO: 42031 - DNA, 294 bp, Homo sapiens
  chr8:143561118-143561412
  hypo
gaggtggctgctgtccggtgtccccgcaacgccacaggtgagggctggagagcacgtggtgtatgggggctcccgtcctgtcctcacggtgatgcccacgctgaggtgctgtcagcactgggaggcggcccagacacggagcccagacagcctgcgtgtgctggcgcggggtggtggggccgcgagcccagggcaccgtgtgagaactctgtggcagctgctgttctgagcactcgctaggggctggcacccatgctcagccctaacgcaagatgtccacggagtctaagcaac

SEQ ID NO: 42032 - DNA, 150 bp, Homo sapiens
  chr8:143567944-143568094
  hypo
caggcggcattcagacgtgtctggtggaaaccatagcttcgtgcctattgtacttgaacaagtcccactaaaacatgtccaagacggatcgacattcttattataatgtctttgggaggctaactagcattaaccttttaaattaaagac

SEQ ID NO: 42033 - DNA, 30 bp, Homo sapiens
  chr8:143573208-143573238
  hypo
tctgtgagtggcaggcgttggaggacaagg

SEQ ID NO: 42034 - DNA, 123 bp, Homo sapiens
  chr8:143587368-143587491
  hypo
gccctaccttagtggcgcctgtgggcgcctgtgggactgtcatgcaccagaatgtgtccctggggccacatgtgtgagcagcgtgctgactgagcacctgggcgaccccgaggtggagtaaac

SEQ ID NO: 42035 - DNA, 242 bp, Homo sapiens
  chr8:143595579-143595821
  hypo
agatggtggtagaggcgggtacgtgggcaccccgggagccagggtgggatgagatccgggcagggtggtagagcgaggggaggtgagacccacgagtcctcctctagagctggcctggagccagggtgtcggcgcagatgcgggctgcgcagatgccggctctgcggctgcagcaggcctacgacggccggaaggttgagtaaccgctctgagtcacacctgtgaggcggatgatgccacct

SEQ ID NO: 42036 - DNA, 30 bp, Homo sapiens
  chr8:143599108-143599138
  hypo
cccaagaggactgtgcgtgtgggtgggcct

SEQ ID NO: 42037 - DNA, 30 bp, Homo sapiens
  chr8:143599572-143599602
  hypo
gctggtcatcatctacgtgtccgtgtggag

SEQ ID NO: 42038 - DNA, 47 bp, Homo sapiens
  chr8:143618365-143618412
  hypo
tgccgtgtggttgaccggcaggaggagggcaacggggactcaggggg

SEQ ID NO: 42039 - DNA, 34 bp, Homo sapiens
  chr8:143620764-143620798
  hypo
tgtagatcaggtgagcgcccgacaggtgagagga

SEQ ID NO: 42040 - DNA, 161 bp, Homo sapiens; identical to SEQ ID NO: 15189
  chr8:143621956-143622117
  hypo

SEQ ID NO: 42041 - DNA, 61 bp, Homo sapiens
  chr8:143623394-143623455
  hypo
cccatgccaaggggccgcccaccaatttcaacagcctgccggccaacgtgtccaagctgca

SEQ ID NO: 42042 - DNA, 30 bp, Homo sapiens
  chr8:143623905-143623935
  hypo
cagcctgggggatcccggggagcctgccgc

SEQ ID NO: 42043 - DNA, 30 bp, Homo sapiens
  chr8:143624997-143625027
  hypo
ttccaggacctgaaccggaagctgcagcac

SEQ ID NO: 42044 - DNA, 34 bp, Homo sapiens
  chr8:143631480-143631514
  hypo
cgaatagctggtgaacgtgcgagccgcccacccc

SEQ ID NO: 42045 - DNA, 30 bp, Homo sapiens
  chr8:143656193-143656223
  hypo
catgttcccgggactcgtgccagtcccctc

SEQ ID NO: 42046 - DNA, 30 bp, Homo sapiens
  chr8:143702052-143702082
  hypo
ggcaggaacagcaggcggggctgagctcag

SEQ ID NO: 42047 - DNA, 30 bp, Homo sapiens
  chr8:143819384-143819414
  hypo
tgagtgtatccagtgcgcatatggatgtgc

SEQ ID NO: 42048 - DNA, 30 bp, Homo sapiens
  chr8:143827179-143827209
  hypo
aggactctcaccccacgttctttcatctat

SEQ ID NO: 42049 - DNA, 61 bp, Homo sapiens
  chr8:143833212-143833273
  hypo
ctgcacagctaggcccgactcctctgtccccactgtggggatgcagcggggcctctgcccc

SEQ ID NO: 42050 - DNA, 99 bp, Homo sapiens
  chr8:143855667-143855766
  hypo
aacccccagcctgtgcgcgcatcccccagtcctgcgtcttttgccttgctcggctgggtcctgctgtggttggggaccaggactcgggggaccacctgc

SEQ ID NO: 42051 - DNA, 36 bp, Homo sapiens; identical to SEQ ID NO: 15190
  chr8:143876928-143876964
  hypo

SEQ ID NO: 42052 - DNA, 33 bp, Homo sapiens
  chr8:143879185-143879218
  hypo
agtgctgttggggcacgtcggggagcaggactt

SEQ ID NO: 42053 - DNA, 30 bp, Homo sapiens
  chr8:143882149-143882179
  hypo
ctcccaggagggctgcgttttccaggcttc

SEQ ID NO: 42054 - DNA, 138 bp, Homo sapiens
  chr8:143960027-143960165
  hypo
ccctgagggaggctgcggccccggcgaacaccaggctcagtactcagcctgtgacctgggccagtgggagtacccttctcagggcctcagttttctgacctatgggaaggacagtccccagaccgcaagagaaagcat

SEQ ID NO: 42055 - DNA, 198 bp, Homo sapiens; identical to SEQ ID NO: 5086
  chr8:143993967-143994165
  hypo

SEQ ID NO: 42056 - DNA, 34 bp, Homo sapiens
  chr8:143996499-143996533
  hypo
agggtcaggctcccccgggcgttctgcagcacct

SEQ ID NO: 42057 - DNA, 33 bp, Homo sapiens
  chr8:144015246-144015279
  hypo
atgcgaaggtaagctcggcggtgggtgccacct

SEQ ID NO: 42058 - DNA, 141 bp, Homo sapiens
  chr8:144027680-144027821
  hypo
cacgcctccccaccacggcaccaggggccggcagtgctgctgtctgcttctccctagggtgcatcaccctcagctcagccaccatcgcaaaggccacaggccaggtgccagaatggcagctgtgtgcgtctcacagctctg

SEQ ID NO: 42059 - DNA, 30 bp, Homo sapiens
  chr8:144069635-144069665
  hypo
gcgagttacaggctgcggtgcaggtggcat

SEQ ID NO: 42060 - DNA, 151 bp, Homo sapiens
  chr8:144070508-144070659
  hypo
ctccccgggctgctgcggcccccagggtgccacctccctctgcaacagcctttaacagctctgcaagttctgtggggctgtcccacggagaggtgaggtctgagaagggagtggaggcacagggctcctgcggccacgtcagaaacgccct

SEQ ID NO: 42061 - DNA, 30 bp, Homo sapiens
  chr8:144090641-144090671
  hypo
gttgtctctgcccctcggtggcagctgttt

SEQ ID NO: 42062 - DNA, 128 bp, Homo sapiens
  chr8:144164496-144164624
  hypo
gggtgatgggaaggacggtacctccggtgtgggtgacgggaagaatggtgcctccagtgtgggtgatgggaaggatggtgcctctgatgggcaatggggaaggatggtgcctccggtgttgggtgatg

SEQ ID NO: 42063 - DNA, 54 bp, Homo sapiens
  chr8:144190378-144190432
  hypo
taatccagctctgaccgtctcacctgccctcctcttccgcgatggtccctgagc

SEQ ID NO: 42064 - DNA, 241 bp, Homo sapiens
  chr8:144203701-144203942
  hypo
gagtggggaaggagccgactcaaggctgagtcccgcagccccgtgagggcggagtggaggttacggggcgggagcgggacgggaatctgagctcccagcagccgagccgagaggaaacccctgctcctgcccatgagcccagcagagcacatgccctggatgtcgagacgcggtccacagagagatgggctcctgtgactgtcctcggataggcctctggacgccacgccctagtgcagct

SEQ ID NO: 42065 - DNA, 30 bp, Homo sapiens; identical to SEQ ID NO: 15194
  chr8:144208784-144208814
  hypo

SEQ ID NO: 42066 - DNA, 50 bp, Homo sapiens
  chr8:144226154-144226204
  hypo
tggctcagcgctgcccgcacatgcccacgctgctccgtactgtggcttgc

SEQ ID NO: 42067 - DNA, 227 bp, Homo sapiens
  chr8:144238806-144239033
  hypo
agacatgggcatgcacgtgtgggtgtgggcacgtgcactgggacacgccagtttgtgccagttatgtgcatgccccagcacgtgtgcgcggggcacctggggtgtgtgtgtgtgaaggagcagggcgggcacgggtgtgtgtgcacatgctggctgcgtgggcaccgtttgtatgcttgtctgggcatgagtgtgtgtgcacatgctggctgcgtgggcaccactgt

SEQ ID NO: 42068 - DNA, 67 bp, Homo sapiens
  chr8:144292403-144292470
  hypo
atttaattcaatctgcgaatcaaatgtgctctgattgtccctaggtgattctcgcaataagcacttg

SEQ ID NO: 42069 - DNA, 184 bp, Homo sapiens
  chr8:144293655-144293839
  hypo
cggggcggggcggggcgggacggggctgggggggacaggcatcaggtatgaagagtttggggctggcggggcgtgtccggctgtggcgtgggcaccactatgggagaccctggcttggcaagtgaccttgcagccttggctggggaagggctagatgctgggtgggtgccggtagagtggaaag

SEQ ID NO: 42070 - DNA, 147 bp, Homo sapiens
  chr8:144312859-144313006
  hypo
tacaacatggacaaacgacgtaaagagctatttccctgacgaggacacgcagaaggcaaacgtgcacaggaacagatgttcgacaccacgcaccctcagcgttccgacactagaaccacggtgaggctgcagcgatggctcactcat

SEQ ID NO: 42071 - DNA, 214 bp, Homo sapiens
  chr8:144326825-144327039
  hypo
taaggctggcaggggcgaggccggggctggcacagaggagctcgaacaggtggagtcttaaaaagcaggaaagggtctgtcaggcggaggcggagcgggggtgttcaaggcccagggttgaggcatgcagccgatgctgtgtggcagggcaagcacttgctgctgagtctcctggaaggggaaagggtggtgagaggggcggcctgcaagtctg

SEQ ID NO: 42072 - DNA, 149 bp, Homo sapiens
  chr8:144330269-144330418
  hypo
gagccaccgcgcccggccagtccactctgcttttaagaaatattttatttctcagggtgggcagcgtgtagagaagtgagtcattccagtctctgccggttagcacctgccagcctaagttgagtcgacagagccgttatggagaatgt

SEQ ID NO: 42073 - DNA, 511 bp, Homo sapiens
  chr8:144343481-144343992
  hypo
gggccctgggggcagcgagctgcgcctctgcaccgggagaaaggccgtgtccccagagctgaggcggtggtgggcagggctcctgagaagccggggcagggcagggtgtctctgaggtcaatgaggaacagctgaggtccagggacgcaggaaggatggggtgaactccgggatggggccggcagggagcctcacgcttacagagcctggtgttggcactctcctggcttcctccgcaaacctagccacgtggtcagggagcccgggcctagcagacggcccccaccttgacagaatccccagggtcgtgcgtggcggtgggggcgacttcacagccgagaccgggcctaacgctgctgtctcgcagtcacccctgcaggccgctcagggcagggctctggcctgacgggggttcctggacacgcctctgagccggcagcccctacccgcacccgtgcaccttccacgcccgtctccagcagcccctgcccccacccgcacccctgcacct

SEQ ID NO: 42074 - DNA, 299 bp, Homo sapiens
  chr8:144344244-144344543
  hypo
cctctgcacctcccacgcccctctccggcagcccctgcccacacccgcacccctgcacctcccacgcccgtcttgccctggggcccaggtgcaggtctgtgaggagggcagccccgtgctcccgtggccaccgctcagccaaatggattcagcgagggtttttagtgtttgtgcctgtgtccccgtgtgcctgtttcctggtgaggctggatgcctggcatgtctgaacactcacattccccaggcatgcatgtgcagccgccgccgccacccatgtactgtggcgctgacccctcctg

SEQ ID NO: 42075 - DNA, 30 bp, Homo sapiens
  chr8:144347029-144347059
  hypo
cagcttcccgtgatgcgctggatgcacagg

SEQ ID NO: 42076 - DNA, 243 bp, Homo sapiens
  chr8:144360302-144360545
  hypo
ccctatggccaccagcgctctggacgccccactctgccaggtgagaacgagtttaggggtgcgggctggaggtcagtgtgtctgtccgaagtcagctgggaggcaggcgcctacttgaggcgtccttgctggtgtgcggtgggcctggggttcagactgtctgcctgaaaggtaagggtgaggacgcctgcattctccttgttcagtaacacgcgtgggcagccaggccgaggtgctggctct

SEQ ID NO: 42077 - DNA, 77 bp, Homo sapiens
  chr8:144361758-144361835
  hypo
acttatccttcctcacggagcctgtttctgcctctgacaatggtggttagcgcagcccgctccgcaccgcacatggc

SEQ ID NO: 42078 - DNA, 30 bp, Homo sapiens; identical to SEQ ID NO: 15203
  chr8:144372473-144372503
  hypo

SEQ ID NO: 42079 - DNA, 57 bp, Homo sapiens; identical to SEQ ID NO: 15204
  chr8:144383350-144383407
  hypo

SEQ ID NO: 42080 - DNA, 35 bp, Homo sapiens
  chr8:144386583-144386618
  hypo
tcttgctcatgtgaccgtcccgtgtgtgctcctgg

SEQ ID NO: 42081 - DNA, 30 bp, Homo sapiens
  chr8:144452062-144452092
  hypo
tcctagaggaggaggcggtgctatcagcca

SEQ ID NO: 42082 - DNA, 34 bp, Homo sapiens
  chr8:144457801-144457835
  hypo
agctgcagatgcggacgggcgctgagaacctcta

SEQ ID NO: 42083 - DNA, 179 bp, Homo sapiens; identical to SEQ ID NO: 15205
  chr8:144471637-144471816
  hypo

SEQ ID NO: 42084 - DNA, 32 bp, Homo sapiens
  chr8:144552577-144552609
  hypo
gtgcggagggaccaacgcgggggtgctcaggg

SEQ ID NO: 42085 - DNA, 30 bp, Homo sapiens
  chr8:144573375-144573405
  hypo
tcccacaggaacccccggggggcccttgag

SEQ ID NO: 42086 - DNA, 83 bp, Homo sapiens; identical to SEQ ID NO: 15206
  chr8:144589999-144590082
  hypo

SEQ ID NO: 42087 - DNA, 175 bp, Homo sapiens
  chr8:144656770-144656945
  hypo
ctcctcactgcccttcgggcttcagcacagggctgtctcccacgccggcagggcctgtgctttcactgggatgcaaatcttcctgctacctcgagctcagattcccgactccagcccagccgcagcccgggaggcgcagcccgtgggctgggtgaacaaacgacacaaacaacac

SEQ ID NO: 42088 - DNA, 158 bp, Homo sapiens
  chr8:144668814-144668972
  hypo
tggcctggctgaatccgctttgtgtgccccggccactcctgtcgggcagcagagccgcccagccgccccacgtgcagctctcacctggcgggaggcacctgccacaggcccgttcatctgctcgtagaatctcctttctgcgtcgtcatatttgaact

SEQ ID NO: 42089 - DNA, 37 bp, Homo sapiens
  chr8:144675999-144676036
  hypo
acctcctcatttccccgcttcccgcattcccaagcat

SEQ ID NO: 42090 - DNA, 177 bp, Homo sapiens
  chr8:144677837-144678014
  hypo
gccccgccccaaccacgtcttttcttaaatgccactgcaggccagctccatggccagccctgcttgaggggctctggccgacctgcctgcccggcgcagcccctgtgcctcctgggtgactccagcacggcacaggctttctggaaccccagacaatacccacgccacacctcacac

SEQ ID NO: 42091 - DNA, 79 bp, Homo sapiens
  chr8:144681634-144681713
  hypo
acaagtgcctggctccggaggaggttgcggagtggctgcacctggacgatgatgggggtccgcccgagggctgcaggga

SEQ ID NO: 42092 - DNA, 122 bp, Homo sapiens
  chr8:144685577-144685699
  hypo
cctggctcaccacaacgctccctgccgtgccgagaactgagcccgtgtctttgtcacaggccctcaccagctgggccaggagtggctggcttgggatctccacctcccgagctgagctcacc

SEQ ID NO: 42093 - DNA, 185 bp, Homo sapiens
  chr8:145739768-145739953
  hypo
cacagcccaggtgcccgcccgctgcctccctcacccctaggcccatgaggcccccaccttctgcaggacagattcccgttgcttcctggtcatgcccgagtgtatgcaggccgccttgagacacggtggcaggccagacacctgcaaatgcaggagcgacagccgtcatacgccagcccagccct

SEQ ID NO: 42094 - DNA, 30 bp, Homo sapiens
  chr8:145745121-145745151
  hypo
gtgttcttgagcacacggcaggtgctgcag

SEQ ID NO: 42095 - DNA, 77 bp, Homo sapiens
  chr8:145753490-145753567
  hypo
gcgtgcaggtgggggcggggaagctcaggaggtcctgaagctcgggaggtcctgaaccggcccgagcccacttttcc

SEQ ID NO: 42096 - DNA, 106 bp, Homo sapiens; identical to SEQ ID NO: 15212
  chr8:145758572-145758678
  hypo

SEQ ID NO: 42097 - DNA, 18 bp, Homo sapiens
  chr8:145919061-145919079
  hypo
ggccgtaaaattctttga

SEQ ID NO: 42098 - DNA, 192 bp, Homo sapiens
  chr8:145979452-145979644
  hypo
gatcagactgatacccggggacaaggggcaggaccctcttctttgggatccaaagagccaaagcagcctcccaagctcctcagaggcccccactgcgaaccaggccaagtgcagagagcctcacccagagaggccacgttcccatagttctccagcatcacatcccggtagagcgcccgctgctgggggccc

SEQ ID NO: 42099 - DNA, 30 bp, Homo sapiens; identical to SEQ ID NO: 15213
  chr8:146013567-146013597
  hypo

SEQ ID NO: 42100 - DNA, 30 bp, Homo sapiens
  chr8:146050247-146050277
  hypo
gtttccagggacccacgactataacttctt

SEQ ID NO: 42101 - DNA, 98 bp, Homo sapiens; identical to SEQ ID NO: 5087
  chr8:146079215-146079313
  hypo

SEQ ID NO: 42102 - DNA, 35 bp, Homo sapiens
  chr9:2727012-2727047
  hypo
gtgccaaagaggttggggaccgctgttctaaacta

SEQ ID NO: 42103 - DNA, 17 bp, Homo sapiens
  chr9:5230606-5230623
  hypo
caaacctttttgaaacg

SEQ ID NO: 42104 - DNA, 105 bp, Homo sapiens; identical to SEQ ID NO: 1581
  chr9:6756353-6756458
  hypo

SEQ ID NO: 42105 - DNA, 30 bp, Homo sapiens; identical to SEQ ID NO: 15216
  chr9:7164747-7164777
  hypo

SEQ ID NO: 42106 - DNA, 17 bp, Homo sapiens
  chr9:15277136-15277153
  hypo
aatttatgggctgggcg

SEQ ID NO: 42107 - DNA, 29 bp, Homo sapiens
  chr9:15533122-15533151
  hypo
cccggccagaaagacgtgtttactacaaa

SEQ ID NO: 42108 - DNA, 126 bp, Homo sapiens; identical to SEQ ID NO: 32413
  chr9:21970940-21971066
  hypo

SEQ ID NO: 42109 - DNA, 30 bp, Homo sapiens
  chr9:26958024-26958054
  hypo
acaggcgtgagccaccgctcccggtcgctt

SEQ ID NO: 42110 - DNA, 21 bp, Homo sapiens
  chr9:26976277-26976298
  hypo
aagaaagcttgaagtcgtaaa

SEQ ID NO: 42111 - DNA, 31 bp, Homo sapiens
  chr9:28641312-28641343
  hypo
cgtgagccaccgcgcccggcctcagaggttt

SEQ ID NO: 42112 - DNA, 145 bp, Homo sapiens
  chr9:32999975-33000120
  hypo
aaaaggtaacaaagagtaggtgtctgggagcttaatggacagtcgaagaaaaacaatatagaacagtggcgaagatcaaggtctctgaagttggactgcctgaattcaaacattggttctaccacctactcgctgtgtgacttga

SEQ ID NO: 42113 - DNA, 24 bp, Homo sapiens
  chr9:33647199-33647223
  hypo
gcgagactgcgtctcaaaaaaaaa

SEQ ID NO: 42114 - DNA, 30 bp, Homo sapiens
  chr9:33862299-33862329
  hypo
tagtttaaccccattcggttgtcatacaca

SEQ ID NO: 42115 - DNA, 20 bp, Homo sapiens
  chr9:34046353-34046373
  hypo
gtaaaggcttcatgccgggc

SEQ ID NO: 42116 - DNA, 39 bp, Homo sapiens
  chr9:34062515-34062554
  hypo
agtaataacatgggccgggcgcggtggctcatgcctgta

SEQ ID NO: 42117 - DNA, 99 bp, Homo sapiens
  chr9:34063196-34063295
  hypo
aaaaaaaacaaaaccaaacctcaggtgttacttttatgatctaaataatgtttaagcaaatatttagggctattgaaggttgtacgctttcagagagaa

SEQ ID NO: 42118 - DNA, 57 bp, Homo sapiens
  chr9:34224348-34224405
  hypo
tgttatggaccagctcgttattaaacgcattgtagacaacatcgatgatccttgttt

SEQ ID NO: 42119 - DNA, 56 bp, Homo sapiens
  chr9:34574808-34574864
  hypo
tgagatcagcatgtgcgtgccctgctgcacgtgtgtgcgggcgtgttgttggggga

SEQ ID NO: 42120 - DNA, 30 bp, Homo sapiens
  chr9:35696547-35696577
  hypo
ctgactaaagaatcacgcatgaaaatagtt

SEQ ID NO: 42121 - DNA, 95 bp, Homo sapiens
  chr9:35816242-35816337
  hypo
caataagtcaggtttgcactgctggaatatatatttttgacataagaaacgtggggtcacaaaatactaatattctcagacgctaggtaagtttt

SEQ ID NO: 42122 - DNA, 22 bp, Homo sapiens
  chr9:36036080-36036102
  hypo
aggcacagtggctcacgcctgc

SEQ ID NO: 42123 - DNA, 53 bp, Homo sapiens
  chr9:36257376-36257429
  hypo
gtttggcttcaactgcggcgctcctacagttgggttaacgagttacctatact

SEQ ID NO: 42124 - DNA, 23 bp, Homo sapiens
  chr9:36274726-36274749
  hypo
ttttttctcttgagacggagtct

SEQ ID NO: 42125 - DNA, 30 bp, Homo sapiens
  chr9:37134066-37134096
  hypo
aggtaaacaaattcccggtaattctttcat

SEQ ID NO: 42126 - DNA, 30 bp, Homo sapiens; identical to SEQ ID NO: 5089
  chr9:37467610-37467640
  hypo

SEQ ID NO: 42127 - DNA, 30 bp, Homo sapiens; identical to SEQ ID NO: 5090
  chr9:37467940-37467970
  hypo

SEQ ID NO: 42128 - DNA, 31 bp, Homo sapiens
  chr9:38646913-38646944
  hypo
caggagccaccgcgcccggctctcctttcta

SEQ ID NO: 42129 - DNA, 117 bp, Homo sapiens
  chr9:71223828-71223945
  hypo
cagcgcatccccgggcgcggcgcccaccaacactcacagtgcaagggcttggctccgagggggctgggagcccgggcgccctggagtgaggggggccaggagcgggctctggaggct

SEQ ID NO: 42130 - DNA, 106 bp, Homo sapiens
  chr9:71425241-71425347
  hypo
atctaatggagttagcgcaattcataatcgaagagaagtggacagcagcagagatggacatgaaacccaggccttcggaggcctatcccagcgttcttccaattca

SEQ ID NO: 42131 - DNA, 19 bp, Homo sapiens
  chr9:71501084-71501103
  hypo
actccgtctgaaaaaaaaa

SEQ ID NO: 42132 - DNA, 26 bp, Homo sapiens
  chr9:71655284-71655310
  hypo
atgtaaatatttatacgctgccgggc

SEQ ID NO: 42133 - DNA, 120 bp, Homo sapiens
  chr9:71734802-71734922
  hypo
cagtaacctggcccaaccagttctgccatcgcagataggaacagaagacatatgaaaacctaacttcgacccccgcctgattccatctccaacctgaccaatcagcactccccacttctc

SEQ ID NO: 42134 - DNA, 27 bp, Homo sapiens
  chr9:71921187-71921214
  hypo
tctgggcaagatgatcgccctgaataa

SEQ ID NO: 42135 - DNA, 44 bp, Homo sapiens
  chr9:72819967-72820011
  hypo
gttcctattcggccatcttggctcctccccgcttattttttaat

SEQ ID NO: 42136 - DNA, 16 bp, Homo sapiens
  chr9:73032801-73032817
  hypo
aacctattctttttcc

SEQ ID NO: 42137 - DNA, 173 bp, Homo sapiens
  chr9:74469850-74470023
  hypo
ttctggcaatatttccggcagactggacagcaaaactggctcaggtagtgagagaaagccctcagggaagaaatacaagtgctggcagctggcaagtgggcccgtgtgcactgaagtggtacagattaaggaatatgagtgaggcaccaaagcatcttcgtggaaatttcaat

SEQ ID NO: 42138 - DNA, 30 bp, Homo sapiens
  chr9:78557098-78557128
  hypo
gctgcggagctggctcggtgttgccaattt

SEQ ID NO: 42139 - DNA, 44 bp, Homo sapiens
  chr9:79073406-79073450
  hypo
tttaaacaacatggaaacaaataagacctcgttctgttttctag

SEQ ID NO: 42140 - DNA, 30 bp, Homo sapiens; identical to SEQ ID NO: 15224
  chr9:79231349-79231379
  hypo

SEQ ID NO: 42141 - DNA, 17 bp, Homo sapiens
  chr9:79448387-79448404
  hypo
aaaccaaatacaggccg

SEQ ID NO: 42142 - DNA, 140 bp, Homo sapiens
  chr9:80852180-80852320
  hypo
gccaccgcgcccggcctgtcttcattttttaaggtgtatataagaagtttgtaaagtgctttacaaatacaagccatttgtaaatgtatagtggtataattagggatccagactctctgattattcggaaaatatgttag

SEQ ID NO: 42143 - DNA, 30 bp, Homo sapiens
  chr9:81359075-81359105
  hypo
tgtctacagtggattcggcagggacttggc

SEQ ID NO: 42144 - DNA, 30 bp, Homo sapiens
  chr9:84294960-84294990
  hypo
tcctctggcgaaggacgctcctcaatttgc

SEQ ID NO: 42145 - DNA, 30 bp, Homo sapiens
  chr9:87326719-87326749
  hypo
aatgaccttagaagacggccctgacccttc

SEQ ID NO: 42146 - DNA, 30 bp, Homo sapiens
  chr9:88832474-88832504
  hypo
gtcaataccagaaggcggcgatcacaggga

SEQ ID NO: 42147 - DNA, 165 bp, Homo sapiens
  chr9:90322123-90322288
  hypo
ctgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcct

SEQ ID NO: 42148 - DNA, 132 bp, Homo sapiens
  chr9:90421580-90421712
  hypo
ctgctcaaggtgacccgagtcagaactgcaggtcagccccttcctggcttcctccgcaggcactgtctgctcctgaactcccaccacaatcctcagcgatgcattctccaaagaagccgctgtgacagctgt

SEQ ID NO: 42149 - DNA, 39 bp, Homo sapiens; identical to SEQ ID NO: 15227
  chr9:91914149-91914188
  hypo

SEQ ID NO: 42150 - DNA, 138 bp, Homo sapiens
  chr9:91995955-91996093
  hypo
gaggagtcactcacccgggcacacagaagcatcgccgctcatctcctgaatcaaacccctgcaaaacaaccggcacgtgttattcacccacacacatgggggacatccccaggcagcgcatcccgccccatacctgct

SEQ ID NO: 42151 - DNA, 159 bp, Homo sapiens
  chr9:92897057-92897216
  hypo
aaagtgatgggattacaggcgtgagccaccgcgcccggccaccggggctccagtacttcagggagactggagcacacctgacgtgacccacccccgggacaaggaagcaggaagatcatcctccaactcccatcccgctggctgcgggctgctggcaag

SEQ ID NO: 42152 - DNA, 77 bp, Homo sapiens; identical to SEQ ID NO: 15229
  chr9:92980516-92980593
  hypo

SEQ ID NO: 42153 - DNA, 16 bp, Homo sapiens
  chr9:93462711-93462727
  hypo
ccgttctcctgcctca

SEQ ID NO: 42154 - DNA, 28 bp, Homo sapiens
  chr9:93698029-93698057
  hypo
gagcaggtggttggccgggcgcggtggc

SEQ ID NO: 42155 - DNA, 30 bp, Homo sapiens
  chr9:94572598-94572628
  hypo
aggtgagagagttcacgtggcaaacatgag

SEQ ID NO: 42156 - DNA, 53 bp, Homo sapiens
  chr9:94573085-94573138
  hypo
cacacacagggaatgcggccctaattaggaccccacttcgctgtgaggaagac

SEQ ID NO: 42157 - DNA, 141 bp, Homo sapiens
  chr9:94658109-94658250
  hypo
agcgagactctgtctcaaaaaagaaaaaagaaatacataaatctatttaaaaaaatgactctactcttaattggtaattcaggcatttggtgatacagggaagccaaggtccctccatgtcacccgcgtgccagtacctcc

SEQ ID NO: 42158 - DNA, 81 bp, Homo sapiens
  chr9:94863469-94863550
  hypo
gagagaaaacttaatcgaataataaaaaaaaacaagccatagcctgaatgagaaattcaacaaagacatagataccattaa

SEQ ID NO: 42159 - DNA, 138 bp, Homo sapiens
  chr9:95417482-95417620
  hypo
ctttgcctaactcaccgacacatctgttcttccctcacgtggccctgtgtggccctgcagatgcagcgaccctgaggggtgcatcgtcagcctggaatgggctctgcacctactttcccactgcgccagagcccagcg

SEQ ID NO: 42160 - DNA, 30 bp, Homo sapiens
  chr9:95485122-95485152
  hypo
agcctccacagggcacgagaggggctcagt

SEQ ID NO: 42161 - DNA, 17 bp, Homo sapiens
  chr9:96230169-96230186
  hypo
cttttttttttgagacg

SEQ ID NO: 42162 - DNA, 54 bp, Homo sapiens
  chr9:96362025-96362079
  hypo
gcagcaagggggattcggagcacgaaagggatttagaggcgccggtggggccag

SEQ ID NO: 42163 - DNA, 327 bp, Homo sapiens
  chr9:97317331-97317658
  hypo
atgcagtctaggaaccggcatgcgcataacctcaggatataaataatgctgaagcagagttacgttttttttgttgttgttttttttgtttttgtttttttaggtttccgtgtgtttctattgagctgctcagtgcccggcttagaagaccaggaaaaggagtcacaggtcgtatgctggaggcttgagccgcggcaccgtggcgcggctcgcctcgctgcggttggtggtggcggtggacattgcagcgcggctggaggggtaggaagaagaagatagttttgggatagatagaggtgggtaaagagtgtggttagtgccaaaggg

SEQ ID NO: 42164 - DNA, 30 bp, Homo sapiens
  chr9:97682189-97682219
  hypo
tgaaattgtgaaaagcgttgaatccataag

SEQ ID NO: 42165 - DNA, 30 bp, Homo sapiens
  chr9:97807798-97807828
  hypo
ccgcaccttccagtgcggtcaaggatgctg

SEQ ID NO: 42166 - DNA, 30 bp, Homo sapiens
  chr9:97863868-97863898
  hypo
attctcacagcccagcgagggcacttactc

SEQ ID NO: 42167 - DNA, 96 bp, Homo sapiens
  chr9:97864916-97865012
  hypo
ctggaagggttgggccgttctgggagggtgaacaactgccttggttttcccaggactattctggttttactgcctcaggtccgacagcccaggaca

SEQ ID NO: 42168 - DNA, 30 bp, Homo sapiens
  chr9:97887619-97887649
  hypo
acaggataaatttgtcgctccctgttatat

SEQ ID NO: 42169 - DNA, 317 bp, Homo sapiens
  chr9:100397395-100397712
  hypo
aggtggaggcagaatcgcatgcatttagttttaatagtgaaacaccagatttctacgaaggaatggcttgagaggatattctagtccagctttctatctgacacctaagggtctagagactgagcataactaagatggagggacagctgtcagttcccaaacaccagcaagagcgaatccagtccggggctctcttcactacacaggtataaattaaataactatgctgcgtgctttgatttctaacacgaggtttcttgtgtaacctctgtacaaggcacagaaaatacaattccctcccttttttttttttttct

SEQ ID NO: 42170 - DNA, 41 bp, Homo sapiens
  chr9:100843360-100843401
  hypo
gaaggtgtgtcctgccggactctactcggttctgctgccgt

SEQ ID NO: 42171 - DNA, 120 bp, Homo sapiens
  chr9:100935554-100935674
  hypo
ccactctttgagaatcgctgctctacagcccagctctatgattcacaactatcgctcagtttacccctcacaaccatctgggggcgcggaggattatctccacttcgtgagtgtggccgg

SEQ ID NO: 42172 - DNA, 30 bp, Homo sapiens
  chr9:100981193-100981223
  hypo
gagagaagaggaagccgcctggctgggggc

SEQ ID NO: 42173 - DNA, 94 bp, Homo sapiens
  chr9:100981840-100981934
  hypo
tgatttagcctactacgcacccagctagatggtgtagcctattgctccgaggctgcagacctgtgcacctgttacggtactgaataccataggt

SEQ ID NO: 42174 - DNA, 30 bp, Homo sapiens
  chr9:101557939-101557969
  hypo
agaaaccttcccccacgtctccaaaatggg

SEQ ID NO: 42175 - DNA, 19 bp, Homo sapiens
  chr9:101982656-101982675
  hypo
tacataagaatgtcccggc

SEQ ID NO: 42176 - DNA, 30 bp, Homo sapiens
  chr9:102107331-102107361
  hypo
acacactcacacacccgagggggcacgctt

SEQ ID NO: 42177 - DNA, 37 bp, Homo sapiens; identical to SEQ ID NO: 15233
  chr9:103174717-103174754
  hypo

SEQ ID NO: 42178 - DNA, 101 bp, Homo sapiens
  chr9:103176794-103176895
  hypo
tgatgtatgaaataacgaaggctatagcgggtcacatcctcgagttaatgaaatacagtgttcttttttttttttttgagaccgagtctcgctctgtggcc

SEQ ID NO: 42179 - DNA, 196 bp, Homo sapiens
  chr9:107221358-107221554
  hypo
accgaggtttcttaccggctctgacaataacaagatatgtgaccttcaataagtaagttcactctcagagactcgcttgattttctttaaacaggactgatacgactaagtcacctgtctgaaggaaggctagtgaatctagctataaaaccctttacataaatttgaaacttcttccgatcgaaggctagcctag

SEQ ID NO: 42180 - DNA, 76 bp, Homo sapiens
  chr9:107396386-107396462
  hypo
cgccctgagctctgccgggggcctcactcgggtcctccggactcgctccgcccgctcggcccggaaggctgtgttc

SEQ ID NO: 42181 - DNA, 30 bp, Homo sapiens
  chr9:114710299-114710329
  hypo
ttctgtgcagctctgcggcattcagagcct

SEQ ID NO: 42182 - DNA, 42 bp, Homo sapiens; identical to SEQ ID NO: 15235
  chr9:115067926-115067968
  hypo

SEQ ID NO: 42183 - DNA, 30 bp, Homo sapiens
  chr9:115087309-115087339
  hypo
ttacacataaatgttcgtggtagctttatt

SEQ ID NO: 42184 - DNA, 24 bp, Homo sapiens
  chr9:115087591-115087615
  hypo
ctaagggcccgtctgcacactggg

SEQ ID NO: 42185 - DNA, 146 bp, Homo sapiens
  chr9:115172301-115172447
  hypo
aaaaaaaaaaaaagacgtaggttttagttatttaaataacagtaaggtcattctcattatgaatcacactttattgtaaccaataaaaacactaatactttcttgggctttgccggggaaatgtagactatcgaatgaaagaacat

SEQ ID NO: 42186 - DNA, 17 bp, Homo sapiens
  chr9:115479233-115479250
  hypo
ctcggtctcaaaaaaaa

SEQ ID NO: 42187 - DNA, 30 bp, Homo sapiens
  chr9:115599305-115599335
  hypo
catggggcggacagacgtgagcagtgtaaa

SEQ ID NO: 42188 - DNA, 30 bp, Homo sapiens
  chr9:115773781-115773811
  hypo
gcatatacaatttttcgaagtgcattcaca

SEQ ID NO: 42189 - DNA, 30 bp, Homo sapiens
  chr9:116065790-116065820
  hypo
cagcagaaaaatagtcgggagacggttgag

SEQ ID NO: 42190 - DNA, 30 bp, Homo sapiens
  chr9:116128876-116128906
  hypo
ctagcccgggtggttcgctgtagacttcac

SEQ ID NO: 42191 - DNA, 30 bp, Homo sapiens; identical to SEQ ID NO: 15237
  chr9:116331277-116331307
  hypo

SEQ ID NO: 42192 - DNA, 32 bp, Homo sapiens
  chr9:116633864-116633896
  hypo
aattccacctgccgacgtgtgcgctttctcta

SEQ ID NO: 42193 - DNA, 30 bp, Homo sapiens
  chr9:117050981-117051011
  hypo
ggccctgtgggtgatcgaggagaccgcggg

SEQ ID NO: 42194 - DNA, 30 bp, Homo sapiens
  chr9:123150500-123150530
  hypo
gtggtgtgggggctgcgggagcagaggtgg

SEQ ID NO: 42195 - DNA, 30 bp, Homo sapiens
  chr9:123272513-123272543
  hypo
agccagctgggtgaccggtacgactttaat

SEQ ID NO: 42196 - DNA, 30 bp, Homo sapiens; identical to SEQ ID NO: 15239
  chr9:123287840-123287870
  hypo

SEQ ID NO: 42197 - DNA, 30 bp, Homo sapiens
  chr9:123294978-123295008
  hypo
tgatctctgggagtgcgcctgggacacagc

SEQ ID NO: 42198 - DNA, 30 bp, Homo sapiens
  chr9:123295496-123295526
  hypo
atagaagcaggacaacgttcagccctgcat

SEQ ID NO: 42199 - DNA, 30 bp, Homo sapiens
  chr9:125551770-125551800
  hypo
cactgctggccatctcgtgcagtgacacca

SEQ ID NO: 42200 - DNA, 39 bp, Homo sapiens
  chr9:125623471-125623510
  hypo
taagaagtcaaatttcggccgggcacggtggctcacacc

SEQ ID NO: 42201 - DNA, 30 bp, Homo sapiens
  chr9:126110108-126110138
  hypo
catgtagtgtgtgtgcgttgtgatgtatgt

SEQ ID NO: 42202 - DNA, 30 bp, Homo sapiens; identical to SEQ ID NO: 15240
  chr9:126125543-126125573
  hypo

SEQ ID NO: 42203 - DNA, 103 bp, Homo sapiens
  chr9:126132916-126133019
  hypo
gcgaccctggagctacggctctggcatgagggctgccctgcccggctctgtgtggcctctggtcctgtggccctggcttccacggcttcggcaactccgctgc

SEQ ID NO: 42204 - DNA, 224 bp, Homo sapiens
  chr9:126133716-126133940
  hypo
tgcctccaggacctgcgactcgatggctgccacctccccttctttcctctgccactggataactcaagccagcccagcgagctcggcggcaggcagtcctggaacctcactgcgggctgcgtctccgaggacatgtgcagtgtaagtgtctggtggcggtggtggtggtggggtggggagtccttttcccaggatctgtcctgtgtcaccggggcttagtgtgt

SEQ ID NO: 42205 - DNA, 162 bp, Homo sapiens
  chr9:126140319-126140481
  hypo
ctggttctccagctccggtccttcctagcagcctggtgagctcactccttcccctgatgactggctgcctctacacagactcggcgagaggacttgaaggaagccctctgggttgtctgctgagtacaggggctcagtgaacactggcgctgcctctgagtc

SEQ ID NO: 42206 - DNA, 36 bp, Homo sapiens
  chr9:126141357-126141393
  hypo
acaggtgtgagccaccgcgcccggcccgcgtgcctg

SEQ ID NO: 42207 - DNA, 30 bp, Homo sapiens
  chr9:126145363-126145393
  hypo
cctggcccaggtcctcgttcccagcaggga

SEQ ID NO: 42208 - DNA, 37 bp, Homo sapiens
  chr9:126153029-126153066
  hypo
accctctcctgtgagcggggctcggagtagatgcaca

SEQ ID NO: 42209 - DNA, 297 bp, Homo sapiens
  chr9:126154254-126154551
  hypo
ccccacggctgctcccgcctctgcccaccttgtctccgcgtggagttcccatgcagatgacttcccgaaccccttctaatgtttggtttaacgtgtcgccggttagcgcgcgcgtgtgacagtggtgacaggcgaggctgttcctttttaaataccatgtcagagacacggcgtcaggaagcagggacgtgctccatgctctctgccgcgccgggatcgcaccggcttattttttaatgaggaagatctgcatctcgggagtttttttcatgtgtcacatcgcgtggacaaatcagc

SEQ ID NO: 42210 - DNA, 34 bp, Homo sapiens; identical to SEQ ID NO: 15243
  chr9:126158010-126158044
  hypo

SEQ ID NO: 42211 - DNA, 17 bp, Homo sapiens
  chr9:126160660-126160677
  hypo
cttttttatttgagacg

SEQ ID NO: 42212 - DNA, 44 bp, Homo sapiens; identical to SEQ ID NO: 15244
  chr9:126169447-126169491
  hypo

SEQ ID NO: 42213 - DNA, 23 bp, Homo sapiens
  chr9:127950771-127950794
  hypo
gcagtatacctaggccggcgcgg

SEQ ID NO: 42214 - DNA, 30 bp, Homo sapiens
  chr9:128750886-128750916
  hypo
ctcagggcctttgcacgggcttgccctctg

SEQ ID NO: 42215 - DNA, 122 bp, Homo sapiens
  chr9:128759852-128759974
  hypo
gctctgccagggaggcgctgccccaaaggtggcctggccaccgtccagaatggaggcccccggtgctggcctgcccagcagcacctgcggctcagtccctccaggatcggaaggaatcacac

SEQ ID NO: 42216 - DNA, 30 bp, Homo sapiens
  chr9:128777807-128777837
  hypo
tgcccagcggaggtgcgtgcaggagtgggc

SEQ ID NO: 42217 - DNA, 166 bp, Homo sapiens
  chr9:128824568-128824734
  hypo
ctacgcggcacacaacggacccagtccctgccctcggggctctcgcctgcagacctgggaggcagaattcatgcaggtgttcagtagctagtgagtcatggttgtgctaagagcacaaaagaggggaggctgtgtgctgtaagaggctgaacgggcctcacctggc

SEQ ID NO: 42218 - DNA, 113 bp, Homo sapiens
  chr9:130179969-130180082
  hypo
gggagctgtgctaggcgggtgggaggccctggggggggttcataaagggacatttgagatcttcaatcatttttctccttatattctatttcctacctcgccctcttggcaac

SEQ ID NO: 42219 - DNA, 38 bp, Homo sapiens
  chr9:130248346-130248384
  hypo
tgtgtggcaggcactcggctaagcgatgaaccacattc

SEQ ID NO: 42220 - DNA, 21 bp, Homo sapiens
  chr9:130326077-130326098
  hypo
tcaccgcgcccagcagagagg

SEQ ID NO: 42221 - DNA, 18 bp, Homo sapiens
  chr9:130505479-130505497
  hypo
ttaaatattcagttacgg

SEQ ID NO: 42222 - DNA, 30 bp, Homo sapiens
  chr9:130534900-130534930
  hypo
taaggattgaaaagccggggactcctttgg

SEQ ID NO: 42223 - DNA, 30 bp, Homo sapiens
  chr9:130676213-130676243
  hypo
ccagatcttccaggacgagacaggcaagaa

SEQ ID NO: 42224 - DNA, 30 bp, Homo sapiens
  chr9:130857460-130857490
  hypo
ttcccacacacctgccgccttccagtatga

SEQ ID NO: 42225 - DNA, 21 bp, Homo sapiens
  chr9:131060946-131060967
  hypo
ccaccgcgcctggccccttgg

SEQ ID NO: 42226 - DNA, 30 bp, Homo sapiens
  chr9:131095785-131095815
  hypo
atgggccgttcagaacgggcgcagagcccc

SEQ ID NO: 42227 - DNA, 20 bp, Homo sapiens
  chr9:131417485-131417505
  hypo
aaagttagcctgggccggcg

SEQ ID NO: 42228 - DNA, 278 bp, Homo sapiens
  chr9:131504870-131505148
  hypo
cattgcacaggtgcacggcgatccgctggatagactcgtcctgccgcgtggggttgaggatgctgagcaggagctcgttgacccggcggtactggaattccagctcctcggggatgctgaagttgcagagcgtcaggcagcagttccgctgcacctgggccgggacaggacacaagtggggcacattcagggtcagactcaggagcagggctctaggaactatctagaggtatgagctcatccagagttgtggcagtccagcccggttttctggaaga

SEQ ID NO: 42229 - DNA, 105 bp, Homo sapiens
  chr9:131579999-131580104
  hypo
gttttttggaatattcgccccaggtttctgttccagccagcagccagcatcagccgtctgcatccttgtcctcaaactgctgttaattaaaatctttgccaatct

SEQ ID NO: 42230 - DNA, 34 bp, Homo sapiens
  chr9:131822149-131822183
  hypo
agaaccggagtgggtcggccgagccacgcaccct

SEQ ID NO: 42231 - DNA, 338 bp, Homo sapiens
  chr9:131854116-131854454
  hypo
caggaaactataaggcgagccctggcctcgaatcatagctaaaaaacaaggatccgagaggtagatttaacagcagatgagagagagttaaaaaggaaaagcaaactggagggtgtgtcagaagacatcccggctgcagtgtggagtgggaaagctaccgggagcagcttcaggcgcacccgcccccgctaactcatcgccttcacttcatccacactcacctgcttaccctgaccccgctccaacctgcccaaggtgcggtgctgggcagaagcccaactcttcaagccctcagaagcctctttgaaatatccacttttcgcggctgggcgcggtgg

SEQ ID NO: 42232 - DNA, 32 bp, Homo sapiens
  chr9:131868926-131868958
  hypo
aaagtcctgacctgacgcgtctcagcaaatgt

SEQ ID NO: 42233 - DNA, 144 bp, Homo sapiens
  chr9:132040507-132040651
  hypo
cccccataagaatgccgcagttccccacagtctcccagctccacccttctccacacagaagctaaaagacccttttaaaatgcaagtcaaatcccatctcttgccggctcagaaccccccaggggcttgcggagaggaagatgc

SEQ ID NO: 42234 - DNA, 451 bp, Homo sapiens
  chr9:132402765-132403216
  hypo
cccagcgtcgggccgcgtttaagccacctgcccacccccggggctctcgctgaccttcaaagttgagattggccccatgccgcaagagaacgtcggccgcccgcgtcagccccagctcagccatcttgagcagggcgttgctcacgccttcctggtaaaagggagagtgggctttcctctccagcagctcagtgagaacaaggattcggctctcctcgctggcgacataactgggcctgggacaggagagaggctgagggtaggcacagctgtgggaccgggtgaccgcgcagcctgtgggttggtgggctttagtcctgctatcatcatcagcaagcagggccctggctctgtgggtcacaggggcttgggggaagctctgaagtagagagagggccacgctgcatctcttaatacgggagcagactgggatttgcggagaatgggctgg

SEQ ID NO: 42235 - DNA, 93 bp, Homo sapiens
  chr9:132491528-132491621
  hypo
caggaactgtatgatcgtaagcgtgtatagttttaaactggcaacttgttacacagccataaaaaactaacacaggtgggaatgaagcttgaa

SEQ ID NO: 42236 - DNA, 27 bp, Homo sapiens
  chr9:132815103-132815130
  hypo
ccaaagcaggttgggcgcagtgactca

SEQ ID NO: 42237 - DNA, 30 bp, Homo sapiens
  chr9:133510031-133510061
  hypo
tgcttttgtgttcttcgcacaggccagcag

SEQ ID NO: 42238 - DNA, 30 bp, Homo sapiens; identical to SEQ ID NO: 15253
  chr9:133518455-133518485
  hypo

SEQ ID NO: 42239 - DNA, 30 bp, Homo sapiens
  chr9:133767827-133767857
  hypo
gcctgcagccactcccggctgagcgtgggc

SEQ ID NO: 42240 - DNA, 193 bp, Homo sapiens
  chr9:133773730-133773923
  hypo
gggtggcatggtgcccgcttaggcagtgttcactgctgctgctagggagggcgcagggtggtggcccccatctaagcccgggtcccctgggctgttggcaactgccgctccggttctgctggccgaacccctcctgccctgggaagccgcttcccatgctgttgggcaccatttctcgcggaattgcatgagc

SEQ ID NO: 42241 - DNA, 126 bp, Homo sapiens
  chr9:133779518-133779644
  hypo
aggaggaccactccacgccgtcggcataggaggcgtgcgcaccgcgcaggtactgcccattgaggttggacgtgtggcagttgcggtaccaccaggcaccgcggtagaaggcggcacagttgttct

SEQ ID NO: 42242 - DNA, 30 bp, Homo sapiens
  chr9:133782157-133782187
  hypo
ccgttctcagcccttcgtgcagatgagtga

SEQ ID NO: 42243 - DNA, 64 bp, Homo sapiens
  chr9:133864850-133864914
  hypo
gagcagcagacgtgccggtcactccctgttatttaggggcctccgttggcgggctgccctgcct

SEQ ID NO: 42244 - DNA, 189 bp, Homo sapiens
  chr9:133865355-133865544
  hypo
cccactgcacagagtcggacggggaccgtgctagccgtgccaggtgcgggggatgcgcgaaccggccgacagcggcccagcccttcgcggggccctgccctcggagtcacagagaggctcagtggctgagcctggggtcatcattgatccccaggactgtcccctgctggggaccggacaccagcctgt

SEQ ID NO: 42245 - DNA, 30 bp, Homo sapiens; identical to SEQ ID NO: 15257
  chr9:133928236-133928266
  hypo

SEQ ID NO: 42246 - DNA, 30 bp, Homo sapiens
  chr9:133936721-133936751
  hypo
ggagagcccagcttacgggcagcaggcatg

SEQ ID NO: 42247 - DNA, 31 bp, Homo sapiens
  chr9:134119973-134120004
  hypo
gtcataaaatgtgggcggcaagccacccagg

SEQ ID NO: 42248 - DNA, 126 bp, Homo sapiens
  chr9:134135879-134136005
  hypo
agtttttttaaaaaacggaaaaagcagtgtttcagggaatctgttacaagtgagcgactgaaactgagaaaaaggagaggcaaggagaccagaggtcaccctgagggcgcacgtggggtctgtctg

SEQ ID NO: 42249 - DNA, 41 bp, Homo sapiens
  chr9:134136231-134136272
  hypo
ccaccagcggctgcccgtacttgggccgccacatgaggacc

SEQ ID NO: 42250 - DNA, 133 bp, Homo sapiens; identical to SEQ ID NO: 15258
  chr9:134191085-134191218
  hypo

SEQ ID NO: 42251 - DNA, 271 bp, Homo sapiens
  chr9:134191463-134191734
  hypo
cactcatcctgtgtgcggctcccacccgccccatccaaaaagtctcagggaggcagcggcacaagggctggctctgggcagtttcctcatctgtaagatgcgtcgatgctctgcgccagcgtatggagaggcagccgctgcagtctgtgccccccacagtctgtacattgaaatcccaaccaaaacacgagggtatgaagaggtgggcgtttggggtcattaggtcatgagggtgggcccacacgacgggattagtgcccttacaaaaaag

SEQ ID NO: 42252 - DNA, 96 bp, Homo sapiens
  chr9:134207916-134208012
  hypo
gtggctttgacttaccgtgtaagactccatttcctcatctgtaaaatgaggagaaccggccagccgggcgcagtgactcacgcctgtaatcccagc

SEQ ID NO: 42253 - DNA, 76 bp, Homo sapiens
  chr9:134717269-134717345
  hypo
gggaagagaaaaagccgagaaaaaagcggtttgaacggggggtgatgtcaccggttacacgcgtggtttctgatgg

SEQ ID NO: 42254 - DNA, 30 bp, Homo sapiens
  chr9:134724244-134724274
  hypo
tgtctgcgtgaaccacgcagctgtggtcaa

SEQ ID NO: 42255 - DNA, 30 bp, Homo sapiens
  chr9:134818649-134818679
  hypo
aacagacccaaccttcgaaacacaaatcaa

SEQ ID NO: 42256 - DNA, 198 bp, Homo sapiens
  chr9:134913048-134913246
  hypo
gcaatgacagaaaaccggagctaccctgctggtgatgggaaatgacaatggcattgcaaagaggctctggaaacatcaccaaatgaaagtgggcaaaacagtcaggctttcaccgggcagctgtagactgggaaaagtgctgtgtttctgacacatgagctttggctgacacacaacatgtcccgaccccagacagga

SEQ ID NO: 42257 - DNA, 30 bp, Homo sapiens
  chr9:135027845-135027875
  hypo
caatcctgttcttgacgcatgtctctcctc

SEQ ID NO: 42258 - DNA, 30 bp, Homo sapiens
  chr9:135054774-135054804
  hypo
tgaggggatcaagagcgtcccctaagccca

SEQ ID NO: 42259 - DNA, 114 bp, Homo sapiens
  chr9:135102332-135102446
  hypo
tgcaagaagaatttccgcacccggtcctggcgggccggctcctacctgccgctgccccatggctctcccaacgcctgtacgtgccatgccccggggccacgagcccacatggct

SEQ ID NO: 42260 - DNA, 204 bp, Homo sapiens
  chr9:135512910-135513114
  hypo
ggagagggggcctgccgtctctctgagaagggacgcagcacactcgcctctgacgccttcccggcctgccaaaagtcattactgccgtgtgtggaaagccatcagcagggtccaggcccccgttgtccgggtgacagattgggctgcgtaatcagaggaggaaggagagagtgcagaagctgtcagaggcgagagatcttggct

SEQ ID NO: 42261 - DNA, 41 bp, Homo sapiens
  chr9:135548238-135548279
  hypo
gcccagttcttggcacgctgtaaatgctcaaggtgaaaata

SEQ ID NO: 42262 - DNA, 74 bp, Homo sapiens
  chr9:135768018-135768092
  hypo
tcttagtgctttcagcgagaaaaggtgagtctcattacgcagaacttttgtttgctcttcggttctttccttct

SEQ ID NO: 42263 - DNA, 30 bp, Homo sapiens
  chr9:135833429-135833459
  hypo
agtaggggcagatcacgaggggtcatgtga

SEQ ID NO: 42264 - DNA, 153 bp, Homo sapiens
  chr9:135865042-135865195
  hypo
tggagtgtcctgttccgcaggggatcccggccgggtccagtcctgagcctgcacctgaccccccggggcctcatttcctccggcaggagcgcagcttcgagtgccgcatgtgcggcaaggccttcaagcgctcgtccacgctgtccacccacc

SEQ ID NO: 42265 - DNA, 246 bp, Homo sapiens
  chr9:135898878-135899124
  hypo
gggatctggatgcagcggctggggttggcagggcccactgcagggaaacggttaaaatgcgctgggcttcgtttttcccggaagccctcattacctggtattaccttaggtgtggattcctttattcgcctgctgtctgtctctgccaatcaaatgtgagctccgtgagggcggaggggggcggtcctctcggcttcatcatccgagcccagcacaggatcgggcacatcgcggggagcatttggt

SEQ ID NO: 42266 - DNA, 56 bp, Homo sapiens
  chr9:135908143-135908199
  hypo
aagggacataaggatcgaggacataagtcctttccacctgccgaacaatcttcccg

SEQ ID NO: 42267 - DNA, 138 bp, Homo sapiens
  chr9:136375595-136375733
  hypo
gaacctccgcacctggccggacccatgtgactattcgaacttaaattatttaaaatgaggataacatttaaagatccaggtttggggttgtaccagctacgttgcagatgcccaggcaccaggcgtgttgggcagccc

SEQ ID NO: 42268 - DNA, 70 bp, Homo sapiens
  chr9:136383935-136384005
  hypo
acaggggagaggtgacgggcctcctgggtccccgttcatcgaggctcgcgcagtacgcacccactttgcc

SEQ ID NO: 42269 - DNA, 30 bp, Homo sapiens
  chr9:136521608-136521638
  hypo
atggcccggggctgacgggtctcctccaac

SEQ ID NO: 42270 - DNA, 30 bp, Homo sapiens
  chr9:136559282-136559312
  hypo
gtcagcagcccatcccgtccatcctgccct

SEQ ID NO: 42271 - DNA, 45 bp, Homo sapiens
  chr9:136573425-136573470
  hypo
tcctcatgttgcgcccggccagcggctcatcgtgggggaagacga

SEQ ID NO: 42272 - DNA, 30 bp, Homo sapiens; identical to SEQ ID NO: 15265
  chr9:136999528-136999558
  hypo

SEQ ID NO: 42273 - DNA, 30 bp, Homo sapiens
  chr9:137248217-137248247
  hypo
ttgtttagctcccaccgggaacacacctgg

SEQ ID NO: 42274 - DNA, 33 bp, Homo sapiens
  chr9:137427038-137427071
  hypo
gctgccgtaacaaatcgccgtgaatttaaaacg

SEQ ID NO: 42275 - DNA, 93 bp, Homo sapiens
  chr9:137457467-137457560
  hypo
tttatcccatgttcacgacagggatctgcagagacagagctgtggtctctcaggaatgaggggctgcggggtagcgggcgatggctaaagggc

SEQ ID NO: 42276 - DNA, 30 bp, Homo sapiens
  chr9:137539456-137539486
  hypo
ccggccccagctggacgggagaggaggaga

SEQ ID NO: 42277 - DNA, 174 bp, Homo sapiens
  chr9:137580733-137580907
  hypo
tgagaaatgcggcttcgatttccctccaccctggtctccttcagagccctgcccaggctgctgtcttccctgcactgtcagctggtcatggcgggggtgggggtggcacaggttcctgtctgtacctccttgtggcctgcgcaccaagcacagtgcccgcgctgagtcccctgg

SEQ ID NO: 42278 - DNA, 35 bp, Homo sapiens
  chr9:137602268-137602303
  hypo
tgctccccatcgagacgccccgtctgttgggtgca

SEQ ID NO: 42279 - DNA, 30 bp, Homo sapiens
  chr9:137624178-137624208
  hypo
ctgtgatggagggggcgggataggtgctga

SEQ ID NO: 42280 - DNA, 30 bp, Homo sapiens
  chr9:137631987-137632017
  hypo
ctttcacagcatccccggcctggcagccac

SEQ ID NO: 42281 - DNA, 30 bp, Homo sapiens
  chr9:137638965-137638995
  hypo
ggttcatgggggtggcgacattctttcctt

SEQ ID NO: 42282 - DNA, 221 bp, Homo sapiens
  chr9:137656925-137657146
  hypo
acgagcctcgccgaccggagagggcgtgccagctcttgcccagagtagcgtcctggaaaagatctgtaccccacgcctccttctgcacattcagtcttggggttcccaccagggactagtttcacctggtgctctcctgcccgcaccctctgaccctgtgatatcataaaaacaatcgtatgtcgctgcggaggggaattcaggagcgagccggtaatgag

SEQ ID NO: 42283 - DNA, 30 bp, Homo sapiens
  chr9:137667327-137667357
  hypo
cctcgttacatggggcgcacagctccagag

SEQ ID NO: 42284 - DNA, 35 bp, Homo sapiens
  chr9:137685677-137685712
  hypo
ttgaagaactggaaccggagcgcattgttaaaaag

SEQ ID NO: 42285 - DNA, 119 bp, Homo sapiens
  chr9:137694532-137694651
  hypo
ccaggcagtgagcagcgtaccaacacccaccctctagatttttgccgggaagagaaggcttgcaaaggcacttggaggtttggtgtgcccgcagcagacctttgcgtccatgaccaggg

SEQ ID NO: 42286 - DNA, 347 bp, Homo sapiens
  chr9:137710245-137710592
  hypo
tggcgctgtgacacccggtctgtggtcggcgcagtcagcggagacgggatccctgctggcctgggagatgatcgggatggagacttgaccagggcagcttccacaggcaatgaaatgtggagaattagggcaaccccggatatggggtcacctgggactcctccagaggtgcccagggtttccgagcagtggtcctgggccagggtgcctggagcctagagctccggacctcattctgccctccgccgtcctgcagggagaagccggcttggaaggccctcctgggaagactggccccatcggcccccagggggcccctgggaagcccggaccggatggccttcgag

SEQ ID NO: 42287 - DNA, 30 bp, Homo sapiens
  chr9:137711104-137711134
  hypo
cagctcgggagatcccggaggcccctgcgg

SEQ ID NO: 42288 - DNA, 30 bp, Homo sapiens
  chr9:137716969-137716999
  hypo
gacctgcttgaacctcgtgttcctgacctg

SEQ ID NO: 42289 - DNA, 240 bp, Homo sapiens
  chr9:137718850-137719090
  hypo
caagcctgcagctctcgtgcccctgcatcagcttgaacggcctctccttcatgagctcgcagttgtcgcgtggccccaggcaaaggccgcccatttctggggccgcagcggtttgctgtgcaggtccagacctgtgcgcccctgcagcctctgcttcctaacaacctcagtgccccagaagcagtttcctgccaggggaagagcagctacgttctccccagggaccgccatccccttacc

SEQ ID NO: 42290 - DNA, 78 bp, Homo sapiens
  chr9:137719540-137719618
  hypo
cacaggctgcagcctcgggcctgggctacagctgcttggccaagggcaagtggagacgctttccgaggtggccccctt

SEQ ID NO: 42291 - DNA, 40 bp, Homo sapiens
  chr9:137724640-137724680
  hypo
gccctgggactgcagcgtgttccctcgcccctgggaaggc

SEQ ID NO: 42292 - DNA, 30 bp, Homo sapiens
  chr9:137726926-137726956
  hypo
agtggcctggcaggacgcagccacgggcag

SEQ ID NO: 42293 - DNA, 30 bp, Homo sapiens
  chr9:137730841-137730871
  hypo
cgtctcatttaattacggaggctgctgcag

SEQ ID NO: 42294 - DNA, 60 bp, Homo sapiens
  chr9:137734084-137734144
  hypo
atgacttcggtgaagcgtcacagaaatttggatttgaagtggggccggcttgcttcatgg

SEQ ID NO: 42295 - DNA, 30 bp, Homo sapiens
  chr9:137851369-137851399
  hypo
ggctccaggtggaggcgccccacgccacct

SEQ ID NO: 42296 - DNA, 17 bp, Homo sapiens
  chr9:137854747-137854764
  hypo
cccggccgctccttaac

SEQ ID NO: 42297 - DNA, 30 bp, Homo sapiens
  chr9:138265242-138265272
  hypo
ccactgcttcatggtcgcccactccctctg

SEQ ID NO: 42298 - DNA, 34 bp, Homo sapiens; identical to SEQ ID NO: 15269
  chr9:138289547-138289581
  hypo

SEQ ID NO: 42299 - DNA, 30 bp, Homo sapiens
  chr9:138290031-138290061
  hypo
tactgaggcacagcacggcagaccacacca

SEQ ID NO: 42300 - DNA, 235 bp, Homo sapiens
  chr9:138393554-138393789
  hypo
gggctgctgggctcccggctccccacctcggtgtcacagaaggcacttgggagcaggggtgggcgggaactgcgctctgcctgtctctgctgccaccggtgggagacgcagcgtcgctcctcctccctgccgtagatttcaacgacaagattttgaatgagcccctcaagcactctgacttcttcaatgtcaaggaactgttttccgtgagaagcctcttcgatgcccgagtcca

SEQ ID NO: 42301 - DNA, 30 bp, Homo sapiens
  chr9:138416397-138416427
  hypo
ccagggtgggcctgtcgtgccgtccatcct

SEQ ID NO: 42302 - DNA, 30 bp, Homo sapiens
  chr9:138506224-138506254
  hypo
tcaggcctggaacaacggcttgagtgtcac

SEQ ID NO: 42303 - DNA, 123 bp, Homo sapiens
  chr9:138557664-138557787
  hypo
gggtccctgtccctgcgctgagagccccctctgtccttccagatccctgctactccaagcattacaggagcccgcccaggcctcccatgcgtgagctgcgactcgggacgggcagggggctgg

SEQ ID NO: 42304 - DNA, 78 bp, Homo sapiens
  chr9:138562725-138562803
  hypo
tctgccagccatgcccggcttgtgtggcccctcaccatagcccgcccagggtctctcgggcatcgaaaggacaagctt

SEQ ID NO: 42305 - DNA, 221 bp, Homo sapiens
  chr9:138563059-138563280
  hypo
tgtggggtgagcccccgcctctgtttccccaaatgactggtatgttcctgggcacacatccgatggctgccagcctgcacgtcacgcccagctgccggagctactgcgggattccagaacaaggaacgtgacatgctcggcctggagcggaacaaggcacctggctcccgcaccctcgacggggccctgcccagtggacacgaccacgtggaagcctcttc

SEQ ID NO: 42306 - DNA, 30 bp, Homo sapiens
  chr9:138577404-138577434
  hypo
agggatgcgatgagccgggggtggggtgac

SEQ ID NO: 42307 - DNA, 168 bp, Homo sapiens
  chr9:138577710-138577878
  hypo
ccggagggtcctcgacggatttgtgcatgagaaaccagatcgcttctacctggggtgggcagctctgctcccgggtggccttggcgctccttggctggctccctggaactggaaagggcagccctggggctcctggtcactgcagggggagtgcgtgggcccctgcac

SEQ ID NO: 42308 - DNA, 30 bp, Homo sapiens
  chr9:138587151-138587181
  hypo
cccacaggctgcccccgaggacctcgtgac

SEQ ID NO: 42309 - DNA, 30 bp, Homo sapiens
  chr9:138591441-138591471
  hypo
cccccatagcgcatgcgctctagccctccc

SEQ ID NO: 42310 - DNA, 30 bp, Homo sapiens
  chr9:138598276-138598306
  hypo
tcctcacaacagtgccggggtgtggtgtgt

SEQ ID NO: 42311 - DNA, 186 bp, Homo sapiens
  chr9:138627615-138627801
  hypo
gagggctctgccacccggcactgctgaggacaggggcgcatctgacagcctcctgcctctaccgagctggcttcggggcagctgggcctcccggtgccaataccccccggctgttacctgcctgtcacctgggcgagtcacctggagccgcgtctgtgacatggaagggaacggttacaaaagcca

SEQ ID NO: 42312 - DNA, 50 bp, Homo sapiens
  chr9:138634173-138634223
  hypo
ggcctgggctggcttcgtgctgagcagggccagggcgagtgcccaaagca

SEQ ID NO: 42313 - DNA, 30 bp, Homo sapiens
  chr9:138637950-138637980
  hypo
ttttgtggtggtgctcggagaagtgggcgg

SEQ ID NO: 42314 - DNA, 30 bp, Homo sapiens
  chr9:138642836-138642866
  hypo
gctctacattgtgcgcgtcctgctcgatga

SEQ ID NO: 42315 - DNA, 48 bp, Homo sapiens
  chr9:138650116-138650164
  hypo
aggtacaggctgccccgtgggcctcagccgagacgcaggtgtggccgg

SEQ ID NO: 42316 - DNA, 30 bp, Homo sapiens
  chr9:138651295-138651325
  hypo
tgcattgtcagccagcgtcaggcaggaggt

SEQ ID NO: 42317 - DNA, 39 bp, Homo sapiens
  chr9:138651662-138651701
  hypo
ggtcatcatgatctgcgtggccctcgtggtgctcccact

SEQ ID NO: 42318 - DNA, 30 bp, Homo sapiens
  chr9:138655771-138655801
  hypo
tgacagcagagcccccgccagcaccatccg

SEQ ID NO: 42319 - DNA, 240 bp, Homo sapiens
  chr9:138659727-138659967
  hypo
gctcccactcagggccgtggccaggagaagctgtcagctggtgtctccaggacacaccatccatagcatctgaccccctgcccccacccgctgtcagcctgcacacactcgggggacaggtgtggctcctgacccctgcccccacccgctgtcagcctgcacacgctcaggggacaggtgtggctcctgaaccctgcccccaccctctgtcagcctgcacacgctcgggggacaggtgtg

SEQ ID NO: 42320 - DNA, 439 bp, Homo sapiens
  chr9:138660771-138661210
  hypo
tcaagtttgctggtgcgtctggggcacacgtgggtgatggtgtatctggggcagggcacgtgtgcacacgtgggtgatggtgcatctggggcagggcgcatgtgcacatgtgtgacggtgcgtctggggcaggacgcgtgtgcacacgtgggtgacggtgcgtctggggcaggatgcgtgtgcacacgtgggtgtcggtgcgtctggggcagggcgcatgtgcacacgtgggtgacggtgcgtctggggcagggcgcgtgtgcacacgtgggtgacagtgcatctggggcagggcacgtgtgcacgtgtgtgtcggtgtgtctggggcagggcgcgtgtgcatgctgttgggtgatggtgcgtctggggcagggcgcgtgtgcacacgtgggtgacggtgtgtctggggcagggcgcatgtgcacgcagttaggcgagc

SEQ ID NO: 42321 - DNA, 513 bp, Homo sapiens
  chr9:138661428-138661941
  hypo
gggcagggaccatgccgggtgcccggggaacggggggcaggccccatgccaggtgcccaggggacaggggtcagggcccacatggagtgcccaaggcacaggggccagggcctgccccgccctggaactcctcgctgagctgggagagaagcacaggagcgatggaaggtccaccgaggctcagaccaagtagggggttgaggtccacagactctcggggcagagatgctgaagccggacagcagacacgggggtgccaggcaagggtgcatctgcatagcaccttcaggaagtgagcaggtactgtgggggaggagagagccggcagagcggcaggtggaccggcctcccccactgcccgcagaccacgtggtgtgtgaggaggagtgcaagtacgccatgctggcgctgaactgcatctgcccggcgacctccaccctcatcaccctgctggtgcacacgtcccgcggccagtgagtgccccgtgccccgggggaccgacctccatggcgg

SEQ ID NO: 42322 - DNA, 148 bp, Homo sapiens
  chr9:138666455-138666603
  hypo
gtgtatgttgtgtgtcgatgtgtgtgttgtgtgtctgggtgtgtggtgtgtatgttatgtgtccgtgcacgtggtgcacgtgtgcatacgcctgcatgtgttcatttctgtgcgcatgtgttgtgtgtgtgtccgggtgtgtccattt

SEQ ID NO: 42323 - DNA, 73 bp, Homo sapiens
  chr9:138671215-138671288
  hypo
gcctcagcatcaccacggagctcacccacccttccaacatgcgcttcatgcagttccgcgccaaggacagcta

SEQ ID NO: 42324 - DNA, 50 bp, Homo sapiens
  chr9:138675763-138675813
  hypo
tcatgcacacatgtacggtgcacacacagtgccctcgaccccgtggctgc

SEQ ID NO: 42325 - DNA, 38 bp, Homo sapiens
  chr9:138678379-138678417
  hypo
ggcgcgggtgggggccggacggacggactgggccaggg

SEQ ID NO: 42326 - DNA, 74 bp, Homo sapiens
  chr9:138743697-138743771
  hypo
ctatgcgtgtacagacgggtgttgcccaggcatactctgagaggggactcgctgggccacgagctaggcacgcc

SEQ ID NO: 42327 - DNA, 284 bp, Homo sapiens
  chr9:138780586-138780870
  hypo
aactcaaggtaaaagcgaccagtagtccacgccccagctccatcctggagaggccagacacaagggtaagaaaagctgatgtaatggtccccacagggccaagaccacctgacccccacccagggacaaccagtaacaaactgcaccttgacagcggagcgccaggtgcacagacaagcacacaccccacagggcgctggcccgggcatgccacaccaggctcaggtgcagacttggcttccagccagaaggccagcaagggagaccctcgggaaccctcagag

SEQ ID NO: 42328 - DNA, 30 bp, Homo sapiens
  chr9:138781904-138781934
  hypo
gcctccttccaggcacggtggaccctgtgc

SEQ ID NO: 42329 - DNA, 66 bp, Homo sapiens
  chr9:138831936-138832002
  hypo
ctttcaggtttgtcccgatgactgtgtggataagactgtctcggcagccaccgcaggtttacccca

SEQ ID NO: 42330 - DNA, 30 bp, Homo sapiens
  chr9:138851606-138851636
  hypo
agcttagtgatgccccgatggttgttcaga

SEQ ID NO: 42331 - DNA, 30 bp, Homo sapiens
  chr9:138873468-138873498
  hypo
gagacggacctagggcgtccttctccagca

SEQ ID NO: 42332 - DNA, 87 bp, Homo sapiens
  chr9:138994353-138994440
  hypo
tgtgaaggtggaacccggaggaatgaggagggctgggagggaaggggaggtggggagcgttcggactgaggccgggcaggtgggccc

SEQ ID NO: 42333 - DNA, 246 bp, Homo sapiens
  chr9:139000396-139000642
  hypo
aggcctgtcccatcccgagggaggcagatcctggctggagctggcggagacttacggccacaccctgccaaggtgtgcccactgggacccgggcccagcctgtcacggcgcctctccctgtgccatccgccagcccaggcttgattgagctccatatgaatattcatacagcattctgctgggaccgtcgttaatattctgaggaagcggcaagaatgcccgtccccatgtcgtgagccatggtca

SEQ ID NO: 42334 - DNA, 139 bp, Homo sapiens
  chr9:139012272-139012411
  hypo
ccctcccatgtggctcgtgctgggacgccggcaccgtgagatggcgcccgtggccagatagagggtggcgtgtaaagcaggtggtcacccgtcactcgacttttcgcgtgctggtgagggtggtcgcatgtccatggat

SEQ ID NO: 42335 - DNA, 30 bp, Homo sapiens
  chr9:139047603-139047633
  hypo
cacgggaaaacacggcgagcctgggagcgt

SEQ ID NO: 42336 - DNA, 99 bp, Homo sapiens
  chr9:139077555-139077654
  hypo
agggcctgccttcttcgcagtggccggccacgtccctgggccacccaggcggcacctgcccctcaggtgactgagccccacctccggagccagctcccc

SEQ ID NO: 42337 - DNA, 141 bp, Homo sapiens
  chr9:139078960-139079101
  hypo
cgggcctgtggccttcggtaatgataaaatcaaaacagctttggctaaaattcagaacactgcattccaactaaccgttcatttcagtgacaagaaggctccttcctccgtcaaccgtgtcattgccgcacccaagaagtc

SEQ ID NO: 42338 - DNA, 30 bp, Homo sapiens; identical to SEQ ID NO: 15282
  chr9:139100397-139100427
  hypo

SEQ ID NO: 42339 - DNA, 40 bp, Homo sapiens
  chr9:139103561-139103601
  hypo
caggaggatgagccacggactcggccgccagggcccaaag

SEQ ID NO: 42340 - DNA, 30 bp, Homo sapiens
  chr9:139111268-139111298
  hypo
gtggggaccttaaggcgttttgtaaagctg

SEQ ID NO: 42341 - DNA, 30 bp, Homo sapiens
  chr9:139133153-139133183
  hypo
gccccgccaaatgcccgctgacacctgcat

SEQ ID NO: 42342 - DNA, 136 bp, Homo sapiens
  chr9:139265293-139265429
  hypo
tccagctgcaggtcacggttccgcatgagcgcggcgcccttctcctcactctggtgcgccaggcgcatggccaggtcgtagttctcctccttgcagcgcttgagctcgcggctgccggcctcgcactcctccttga

SEQ ID NO: 42343 - DNA, 30 bp, Homo sapiens
  chr9:139268822-139268852
  hypo
aactgtgcacttcagcgtgtgggctgccag

SEQ ID NO: 42344 - DNA, 65 bp, Homo sapiens
  chr9:139317772-139317837
  hypo
gtgttagtttggacacgaatttagtctaaaaagctgtctggttgtataaacggtgcaaacaatgt

SEQ ID NO: 42345 - DNA, 28 bp, Homo sapiens
  chr9:139375871-139375899
  hypo
gagccaccgcgcccggcccagggaattt

SEQ ID NO: 42346 - DNA, 30 bp, Homo sapiens
  chr9:139412504-139412534
  hypo
ccctgaagccagaatcgacttctcatcggt

SEQ ID NO: 42347 - DNA, 30 bp, Homo sapiens
  chr9:139419942-139419972
  hypo
aaggcagcagcctcacggctcaggccctgg

SEQ ID NO: 42348 - DNA, 181 bp, Homo sapiens
  chr9:139421932-139422113
  hypo
cttccatgagtgacccgcaccccaccttccaccgtccccgcatctcctcctatcaggggcggtggggagacccctctggggctaaaaagtgaggcttgagatagggaacgccagtctcccccgactggacgagagagctgccctgtccaccaagccacccagctctcgggctcccacggag

SEQ ID NO: 42349 - DNA, 40 bp, Homo sapiens; identical to SEQ ID NO: 15284
  chr9:139472499-139472539
  hypo

SEQ ID NO: 42350 - DNA, 30 bp, Homo sapiens
  chr9:139487465-139487495
  hypo
tggagtgcttggcagcgtagacagtcccag

SEQ ID NO: 42351 - DNA, 30 bp, Homo sapiens
  chr9:139504374-139504404
  hypo
ccccgcccctccctgcgatgctgcctccct

SEQ ID NO: 42352 - DNA, 157 bp, Homo sapiens
  chr9:139504823-139504980
  hypo
aggggagggcgacttcggtgttttccagcattattctagtggccacagcccccaggcctgtttcctctgtaaatggagatggcagcccaccccacgggcgctggaggggagctgaccctcaggccagtcaggagccctgtgacgggactcgctggag

SEQ ID NO: 42353 - DNA, 101 bp, Homo sapiens
  chr9:139505621-139505722
  hypo
gccaggcagggggggcggccgtggggggcaggtgtgggcaggcagggagggatccctacaggtggcagctcacgctgcaggaccagcggccccaggaacac

SEQ ID NO: 42354 - DNA, 76 bp, Homo sapiens
  chr9:139506440-139506516
  hypo
cccatgggtgggtgacggatgaaccgggtagaccgtctgtacaatggaatatttatccttccgccacaaaaacaga

SEQ ID NO: 42355 - DNA, 30 bp, Homo sapiens
  chr9:139517238-139517268
  hypo
ccctagccacggtgccgcccctgctgtctc

SEQ ID NO: 42356 - DNA, 46 bp, Homo sapiens
  chr9:139546557-139546603
  hypo
ctcctgtgagcacaacgctgtgtgtacattgcgcgtctgtttgaat

SEQ ID NO: 42357 - DNA, 51 bp, Homo sapiens; identical to SEQ ID NO: 15286
  chr9:139634047-139634098
  hypo

SEQ ID NO: 42358 - DNA, 130 bp, Homo sapiens
  chr9:139638401-139638531
  hypo
cttggtgacgacccccgccatcctccccgcaattccccggctggcccccagtcaaaagcatccttggtttgctgtggaatcgctttattctgagctggtgctgggccccgggagccgctgagcgaggtgg

SEQ ID NO: 42359 - DNA, 138 bp, Homo sapiens
  chr9:139654706-139654844
  hypo
ccttctggacaagggcgatttggtgttgccccccatgtttcccaacccagcgggggtgtgcagggagacgttggtgcagacttgtgcaaagctgaacagccccagtgtccccaggcaggacggcgagtctccagggag

SEQ ID NO: 42360 - DNA, 30 bp, Homo sapiens
  chr9:139662292-139662322
  hypo
cccctctgtgcacctcgcagaccatggaag

SEQ ID NO: 42361 - DNA, 595 bp, Homo sapiens
  chr9:139698658-139699253
  hypo
ggctgaatgcacttccgtgagttctaggtggacctggccaggaggcagctgggggccagcggctggagggcagcagagcgtctgggctggcacatgctctgaggcatgggcaaggagggccgtgagctgaggggccacgggcacaagtggtttaggaaaagggtgtggccattggccggggatgcagttccaaagtctagtaaggtgagcatggccaaccgcccgctggctttactgccattaggggccttgttgagacagctccccaaccctgtgcccacccgcatgtccccagaggaacatgaggcaaagggaggcgtccttcatcgaggagcgccgggcaagggagaaccggctcaaccagcagaagaagctgatcgacaagatccacacgaaggagaccagcgagaagtaccgccgggtaagccccaggccagggcctggctggctgcccatccccatgacagctgggtggacacaggctcagggccaccactcagggcccactccctgccaaggatgtctcatcccttccccgcccccacctcccatcagggccagatggacttggacttcccctcgaacctgatgagca

SEQ ID NO: 42362 - DNA, 41 bp, Homo sapiens
  chr9:139703929-139703970
  hypo
atgaaagttggtgtccgggccgggcacggtggctcatgcct

SEQ ID NO: 42363 - DNA, 340 bp, Homo sapiens
  chr9:139704090-139704430
  hypo
aaagttgatgtccgaaccaagggccgtattggcttttcttatactctagaacatacgacgacaaagaagattttgatgaagttcaaattagagtcagcgtgctcatcagaaagaaagcgcagccaacacgtttaggaacagaaacggattatgttgaagacaaacaatccattgcgtttgtgttcagtaacccaagcatcaaaggaacttgtggctggggagaaggcttgactatttgaaatctcaggactcctctgtccaggagctcccagactcccgtggagtggaagcctgggggctcgctgaagaagtcacgtgactggaacgtgcttaatgcttg

SEQ ID NO: 42364 - DNA, 99 bp, Homo sapiens
  chr9:139705312-139705411
  hypo
aatattttacagagcgtaacagaccagcaatgtgatcaagacagagtcgagggttttgggggtgagagtttctgggaactgctgcgggtttccaggagt

SEQ ID NO: 42365 - DNA, 98 bp, Homo sapiens
  chr9:139714085-139714183
  hypo
gtcctagtgctacagcgacagtgatgccatatgcagaatatacttcaaaatgaaagagagcgggtagaaatgtgaagggttaccgcaggctcagagaa

SEQ ID NO: 42366 - DNA, 216 bp, Homo sapiens
  chr9:139717731-139717947
  hypo
gctgccccctgggcccggttcgccgttgatgctctgtgtgctgccaggtgtcctcctgatgggagaggttgccatggtacccacccatcgtcttcctcccctgcctgccggtcacctggtctgattctagcaagaaagatgaaacaggtggcagcagaaccggctctccttgtagttgctcttaaagctgcagcttgggttcggttcgtttaattt

SEQ ID NO: 42367 - DNA, 175 bp, Homo sapiens
  chr9:139734923-139735098
  hypo
ggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctgga

SEQ ID NO: 42368 - DNA, 30 bp, Homo sapiens
  chr9:139779368-139779398
  hypo
gcagccaggaggagacgccttcttacgttt

SEQ ID NO: 42369 - DNA, 104 bp, Homo sapiens
  chr9:139794879-139794983
  hypo
ccagataatgctgcccgcagggaggtggagagcctgccggccgtctgtcccagtgatggatgcacctggaaggggaccctgaaagaatacgaggtaaagatgcc

SEQ ID NO: 42370 - DNA, 312 bp, Homo sapiens
  chr9:139809779-139810091
  hypo
gcattgtgggagcaccgtctcccgagacttgccagcacagtgtggtgtgaaggttggacgtgccactgtgatgtgtgagaaacacatcagtcctctgtatcgggggtccacgccgtggatccagccaaccgtaggttggaaatgttcaggtaaaaatgcactgaacacgcgcggacattttttattgacacagcgttcacgttgtattggtcatgagtcaccgagagctgatttcaggtatgagggagggtgtgcttaggctctgtgcaaacactctgccatcttccatcagggactcgagcatccttgggt

SEQ ID NO: 42371 - DNA, 282 bp, Homo sapiens
  chr9:139818340-139818622
  hypo
gcgtatctacctgaacggcgacggcaccgggcgaggaacacacctgtccctcttctttgtggtgatgaagggcccgaatgacgccctgctgcggtggcccttcaaccagaaggtgaggccgtccctgcaggcttcgctagggccgcacctgggagtccctctgggcagtgcagcttctgtggtgcagggttgtgcgggacaaggtggcttgggctcgctggaccaggtgtctgcagcaggcacgtcaccctgtgatgctgtgtcacgcggtggagagctctg

SEQ ID NO: 42372 - DNA, 227 bp, Homo sapiens; identical to SEQ ID NO: 15294
  chr9:139859041-139859268
  hypo

SEQ ID NO: 42373 - DNA, 299 bp, Homo sapiens
  chr9:139888764-139889063
  hypo
actggaagtgccctgcggggaggggagcgcctgccccgggacaggattgaggaatgtgccagcccccatccacctggggcaccccgccccaccccggcctgactggtttgggagcccagtccggtcctggagatccctgaggccaccggttgcaggaggcctggagtctgcgccttcttagcgtggaggatgggaccggcccgacccccggcgctcctgcccctgtggttctgggctatcgggctgagcgtcccaccctggggtttggggatgggaagtgatcccgagacctctggccc

SEQ ID NO: 42374 - DNA, 30 bp, Homo sapiens
  chr9:139904297-139904327
  hypo
cagccggcttgtctgcgtacttggtcagct

SEQ ID NO: 42375 - DNA, 30 bp, Homo sapiens
  chr9:139913362-139913392
  hypo
tgaactggatccagccgcaggccgcgttgt

SEQ ID NO: 42376 - DNA, 30 bp, Homo sapiens
  chr9:139916163-139916193
  hypo
gctgcctgggtcccacgacatgcctctacc

SEQ ID NO: 42377 - DNA, 82 bp, Homo sapiens
  chr9:139978914-139978996
  hypo
cgcgccgggccggttgctggcatcttaatgttctgtaggtggaatatttccaataaacacaaggtgccgtaattgactgcta

SEQ ID NO: 42378 - DNA, 49 bp, Homo sapiens
  chr9:140030248-140030297
  hypo
ctcacctgggagtcacgcaccattacctctaccacgttccatttgtaag

SEQ ID NO: 42379 - DNA, 41 bp, Homo sapiens
  chr9:140030498-140030539
  hypo
ccacccttagaacagcgtctggtacacggtaggtgctcagt

SEQ ID NO: 42380 - DNA, 40 bp, Homo sapiens
  chr9:140041778-140041818
  hypo
acacacctggacacacgctcaggtgcgctcctcatgtgca

SEQ ID NO: 42381 - DNA, 119 bp, Homo sapiens
  chr9:140043219-140043338
  hypo
agagagagcacagaacgagcacaggtgagcgcgcaggctgaagacaggacaggaccggagaggcgaggccaggccaggcaaggactgaggaaggcaggcggaggcgcaggtggcaggcg

SEQ ID NO: 42382 - DNA, 30 bp, Homo sapiens
  chr9:140052371-140052401
  hypo
ttcactgatgtggcccgatgggtacaatgc

SEQ ID NO: 42383 - DNA, 196 bp, Homo sapiens
  chr9:140107128-140107324
  hypo
accagcttccagggtcggcccctgcgcgcctcagggccctcgcagtggtactggcttctccacaacgctccctggtgggcaccccaggcttcacgctgcggggagggcacagaggggagcaggcagggtggcaaagggctgggctccagccacgctgacgtcacacaggcctacctggcgccggtccccactttta

SEQ ID NO: 42384 - DNA, 177 bp, Homo sapiens
  chr9:140108225-140108402
  hypo
ccacaggttcaacttcgtggccaagaagctgcaccgacggctactgcagcttgggggcagcgccctcctgcccgtgtgcctgggcgatgaccagcatgagctggggtgagtctgcgggcgtggtacccgcctccacagtctggtctggccacacgcagggtccgctcaggccagcgc

SEQ ID NO: 42385 - DNA, 30 bp, Homo sapiens
  chr9:140115123-140115153
  hypo
acttggggcaggactcgtagagaatctgca

SEQ ID NO: 42386 - DNA, 516 bp, Homo sapiens
  chr9:140127654-140128170
  hypo
ccacagggctttcagcggctcggcggtgcacgggatcttcaactggctcacagtgctggtcctgctgccactggagagcgccacggccctgctggagaggctaagtgagctagccctgggtgccgccagcctgacacccagggcgcaggcgcccgacatcctcaaggtgctgacgaagccgctcacacacctcatcgtgcaggtgaggacggccaccgcccccgcccagagagcctgagcaggccggatgggaggaggggaggcccgccctgccctgatggagggtcagcggagggtctgggccctgtcctgggacaggggaggagagggcagcagtgggcagggctgggctggaccccgcgggcgccagagccccgggtgagtcctgagagagggtgcagcacaccgtcacgacccctctggcccccagttggactccgacatgatcatgagcagtgccacaggcaacgccactaacagcagtctcattaagcactggtgcggcaccacggggca

SEQ ID NO: 42387 - DNA, 87 bp, Homo sapiens
  chr9:140137230-140137317
  hypo
ctcagtccaccagctcgtagaaaacacagacgagacctactgcattgataacgaagctctctacgacatttgcttcagaaccctaaa

SEQ ID NO: 42388 - DNA, 180 bp, Homo sapiens
  chr9:140137557-140137737
  hypo
caagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacat

SEQ ID NO: 42389 - DNA, 30 bp, Homo sapiens
  chr9:140140759-140140789
  hypo
cagtagcctcctgcacgggaagagaactgg

SEQ ID NO: 42390 - DNA, 54 bp, Homo sapiens
  chr9:140144171-140144225
  hypo
gaggttcccagagggcggcaactagcgaggacatggaagcgccagcccctcccc

SEQ ID NO: 42391 - DNA, 56 bp, Homo sapiens
  chr9:140147052-140147108
  hypo
ggctggctgagggtccgtggggagcaccctgccctgcagcccgtctcctaccccct

SEQ ID NO: 42392 - DNA, 30 bp, Homo sapiens
  chr9:140167020-140167050
  hypo
cgtctaagctggaggcgttgcagaaggccc

SEQ ID NO: 42393 - DNA, 30 bp, Homo sapiens
  chr9:140198590-140198620
  hypo
caggtgggctcaagccgggcctggagaagg

SEQ ID NO: 42394 - DNA, 237 bp, Homo sapiens
  chr9:140245670-140245907
  hypo
acccagcaccctccccggggcacacggagggaagggtcaggcaggggtgcgggctgctttctttctggactgggcagggggccccagggcttcactcacccagcttggtgatagaggggtccgagaggagctgggccaccagccgggaaaaggcctgggctccctgccctgttggtggctgcgagagtgccaggacgtccagaaggaacacgtggccctccacggccacctgcagga

SEQ ID NO: 42395 - DNA, 120 bp, Homo sapiens
  chr9:140265734-140265854
  hypo
tgcattgtcctgtgccgggacatggtggcttctcagcgccatgcacccgccgcgagacgacggccccgggcgtggcaggtgacagcgccaggggtggggcccgcgcggcccacacagggg

SEQ ID NO: 42396 - DNA, 30 bp, Homo sapiens
  chr9:140266433-140266463
  hypo
ccaggctcaggacgacggggctgtgatgct

SEQ ID NO: 42397 - DNA, 61 bp, Homo sapiens; identical to SEQ ID NO: 15304
  chr9:140267262-140267323
  hypo

SEQ ID NO: 42398 - DNA, 158 bp, Homo sapiens
  chr9:140274104-140274262
  hypo
tcactcattgtgaaacggctggttttatatgtcgtgcatcttaccccaataaagcattcgatgaagccgacgctccgtggctctgatttggggtgcgctctcgcccaggctggtttctgtcacccccggagttctgcagcacccgttctaaccacagc

SEQ ID NO: 42399 - DNA, 30 bp, Homo sapiens
  chr9:140274632-140274662
  hypo
ggtccctcctcccttcgagcccttcactgg

SEQ ID NO: 42400 - DNA, 30 bp, Homo sapiens
  chr9:140325615-140325645
  hypo
tggggccacgcgggccgggcacaggagggc

SEQ ID NO: 42401 - DNA, 30 bp, Homo sapiens
  chr9:140327964-140327994
  hypo
gtggccctgagggcacgaagaggagccgac

SEQ ID NO: 42402 - DNA, 41 bp, Homo sapiens
  chr9:140332500-140332541
  hypo
cgtgtgggaggagcccgcatcaaacacgatcccaaactggg

SEQ ID NO: 42403 - DNA, 217 bp, Homo sapiens
  chr9:140332929-140333146
  hypo
gctcagacggtctcccgtggccttagaggcatctccggggctcaggcggcctcccgtggccatagaggcatctccggggctcagacggcctcccgtggccatagaggcatccccggggctcagacggcctcccgtggccatagaggcatccccggggctcagacggtctcccgtggccatagaggcatccccggggctcagacgcctcccgtggcca

SEQ ID NO: 42404 - DNA, 48 bp, Homo sapiens
  chr9:140352105-140352153
  hypo
ccgccccttcaccaccgccagctcaatggcctccgcctcagggctggg

SEQ ID NO: 42405 - DNA, 68 bp, Homo sapiens
  chr9:140382557-140382625
  hypo
cctcatcctgagcttcggcctgaacgctgctctcgtggtctgatgtctcgtcccgagcttcacttgca

SEQ ID NO: 42406 - DNA, 178 bp, Homo sapiens
  chr9:140389309-140389487
  hypo
tgccctcacctgctccgtgacctcatccactccgcgccttcacctgctctgcgctctcacctgctccgcgccctcacctgctctgtgccctcacccgctccgccctcacctgttccatgccctcatccactccacaccctcatccgctccgcatcctcacccacgccatgctcacctg

SEQ ID NO: 42407 - DNA, 264 bp, Homo sapiens
  chr9:140392377-140392641
  hypo
aaatccaggaggccacgaagtgtgtttccgagctaagctggggtggggctggggaaatccagccttccatgtgtggtttccacagtaacttccgtgtgtggtttccacggtaaccgtgctttgcccatccccagctcctgcatgccagggcagcatggatgcggagtgtgtggcacccacggcctcacctgtatattgctcgcccggcctccacctccacccagtccagggcaaagtcgatttgccgcacgaaggacgacatcc

SEQ ID NO: 42408 - DNA, 167 bp, Homo sapiens; identical to SEQ ID NO: 15310
  chr9:140396560-140396727
  hypo

SEQ ID NO: 42409 - DNA, 68 bp, Homo sapiens
  chr9:140397029-140397097
  hypo
ggcgcgttgtcagcccgaggaggagccgtgggaggttcttcaggagaagaaagcggcctccctgagga

SEQ ID NO: 42410 - DNA, 71 bp, Homo sapiens; identical to SEQ ID NO: 15312
  chr9:140400208-140400279
  hypo

SEQ ID NO: 42411 - DNA, 30 bp, Homo sapiens
  chr9:140401540-140401570
  hypo
aggggcgcatgtctccgaggcttacgctga

SEQ ID NO: 42412 - DNA, 82 bp, Homo sapiens
  chr9:140507337-140507419
  hypo
ccctttgcagccatccgggtgacctgcataggttcctgcggggtctccaacaaggctaatgacacagcgtgggtagtggagg

SEQ ID NO: 42413 - DNA, 30 bp, Homo sapiens
  chr9:140508520-140508550
  hypo
acaagctggtgaagacgggcagcgtggtcc

SEQ ID NO: 42414 - DNA, 23 bp, Homo sapiens
  chr9:140511850-140511873
  hypo
accgcacccggcccagtcaacaa

SEQ ID NO: 42415 - DNA, 152 bp, Homo sapiens
  chr9:140512180-140512332
  hypo
ggagggccatgaaggcgctcgtgtctcctgcgagggctcagggtgctcggcctgtcataaatggacttaggctttgacagagcagtttagctgccctaaagaaacctgggaaggttcccttggcacttgggattgtccgtttccttttctgt

SEQ ID NO: 42416 - DNA, 33 bp, Homo sapiens
  chr9:140615444-140615477
  hypo
cctttctcccctcctcgccggcgtcctcgccag

SEQ ID NO: 42417 - DNA, 207 bp, Homo sapiens
  chr9:140657710-140657917
  hypo
tcagagggttcagcacgtcccgtctctgctgcctctgggacaggaggggggatcaggcagagcacagacggaattaatgttttctgagaatttctccagttctttttaacacgatttctttcagccctcagagcctcgtgaccatggctggccatggtgagggtctgagcaggaggcttgttggcaccaggccgagaggcaccacat

SEQ ID NO: 42418 - DNA, 76 bp, Homo sapiens
  chr9:140664584-140664660
  hypo
ggcccactttatttcttcagtcttgtgtttttttctttctttctgggattccttgtacacacgttagattgtttga

SEQ ID NO: 42419 - DNA, 45 bp, Homo sapiens; identical to SEQ ID NO: 15313
  chr9:140680320-140680365
  hypo

SEQ ID NO: 42420 - DNA, 34 bp, Homo sapiens
  chr9:140682888-140682922
  hypo
aaaggaggttgcaggcgtacggaggttgcaggtg

SEQ ID NO: 42421 - DNA, 30 bp, Homo sapiens
  chr9:140693933-140693963
  hypo
gggccacctgcctcacgagtgaatgactgg

SEQ ID NO: 42422 - DNA, 156 bp, Homo sapiens
  chr9:140708986-140709142
  hypo
tcaggtggtaagtgccgctggtccgggtctgcaaaaacagtgcaggcgtctgtgaccccagcgctgtcgtggcagcgtcgggaaggagttggaggtgagctgggtgtgacaggcaggggaggcacagcgggcaccagcacccgagtcagggtcgtg

SEQ ID NO: 42423 - DNA, 60 bp, Homo sapiens
  chr9:140727525-140727585
  hypo
cgccgtgaaggttgacggagagctgctctcgtccacgcctttacccgcttgttggtttgg

SEQ ID NO: 42424 - DNA, 82 bp, Homo sapiens
  chr9:140770013-140770095
  hypo
ctaccacaatctgtgcgatctgtgcaaggcgcagggaagtcccaagggccaggattcaccatgcctgcgtgatgccatcccc

SEQ ID NO: 42425 - DNA, 37 bp, Homo sapiens
  chr9:140793786-140793823
  hypo
cacctgtcttggcctcccaaagcgctgggattgggat

SEQ ID NO: 42426 - DNA, 58 bp, Homo sapiens
  chr9:140969282-140969340
  hypo
tgttagtctggcagccgcgctgaaggacaggcctgacccgcggcgggggttacatgct

SEQ ID NO: 42427 - DNA, 177 bp, Homo sapiens
  chr9:141022582-141022759
  hypo
cttatttaactttaacgatggtttcccactggcatcagaacaggggtcgcagaactgacctggcccccagtccctgagcgctcccacctgctgccctctcccgcccagcccagcccagctgcctgcgttgcggcctccacctgcagggacacagcaggctctcgggagtcttgggaa

SEQ ID NO: 42428 - DNA, 30 bp, Homo sapiens
  chr10:482288-482318
  hypo
gcactgctgggtcatcgtgaccatgggcag

SEQ ID NO: 42429 - DNA, 60 bp, Homo sapiens
  chr10:524611-524671
  hypo
acacatccaagttcccgtcttattctcactcatctcgtgtccgggcgtgctgggggtgta

SEQ ID NO: 42430 - DNA, 35 bp, Homo sapiens
  chr10:769828-769863
  hypo
catcaccatgcccagcgtcacgtgacatggataga

SEQ ID NO: 42431 - DNA, 30 bp, Homo sapiens; identical to SEQ ID NO: 15317
  chr10:833307-833337
  hypo

SEQ ID NO: 42432 - DNA, 44 bp, Homo sapiens
  chr10:851432-851476
  hypo
gcctggcggcctctgcggagcgccctctgcggagctgcctctgg

SEQ ID NO: 42433 - DNA, 194 bp, Homo sapiens
  chr10:978811-979005
  hypo
ctgggatcaaggccccggcccttccccaaacccccaacccacacccgggaccaaaaggccccggccccacgtttcctagaggcgctgggttcgggcccacgttgcaacgagtcagatgctcttggtagctcagggaggtgttcacactcctgccgtttccgtgaggatggtgacgactccgaactatagcagca

SEQ ID NO: 42434 - DNA, 149 bp, Homo sapiens
  chr10:1156723-1156872
  hypo
atcgccaaggacatccgtgagcctccgatgggtgtccagcgtgttagcgcccagacccacagggcctggcaccctgataggtgggaatgttggcccagggccgggcctgaggcctgcaggactgcctgctcatccgggaagtagctctg

SEQ ID NO: 42435 - DNA, 52 bp, Homo sapiens
  chr10:1209169-1209221
  hypo
catcacgtgggtgtgcggtctggctgctgggtccacgcgggttctcaatcat

SEQ ID NO: 42436 - DNA, 132 bp, Homo sapiens
  chr10:1233108-1233240
  hypo
tggcagctgccaccccgagagccgggagggacaatctggcccgttggccgctgtggctgtcctactaggcaggggccgcctgggcaggaggagccagccaccaaggccagggatgaccgggcactgggagag

SEQ ID NO: 42437 - DNA, 30 bp, Homo sapiens
  chr10:1248527-1248557
  hypo
gggacgtaagatgcccgttctcagatttgg

SEQ ID NO: 42438 - DNA, 41 bp, Homo sapiens
  chr10:1252314-1252355
  hypo
ctccttgaactgggacgtctcctcctcgtgcctgtgtggtc

SEQ ID NO: 42439 - DNA, 221 bp, Homo sapiens
  chr10:1259797-1260018
  hypo
ctgtgtccagcatctcgtgggtttgcacctgtgcccggacctgccagtgttgcgtgggtttgcacctgtgcccagacctgctggcatcgcgtgggtttgcacgtgtccagcatcatgtaggtttgtacctgtgcccagacctggcattgcgtgggttcgcacctgtgtccagcgttgtgtagctttgcacctgtacccggacctgccggtgacacataggt

SEQ ID NO: 42440 - DNA, 30 bp, Homo sapiens
  chr10:1438451-1438481
  hypo
ccttgagagtgctgccggactgaacttccc

SEQ ID NO: 42441 - DNA, 127 bp, Homo sapiens
  chr10:1506252-1506379
  hypo
tggaggggccaggaccgccacacacatgcgctgggggcagtcacagcgggcagtgtgccggagaagagggtggacacacactcccccacacacgcgcggggggcagtcacagcgggcagtgcgccgg

SEQ ID NO: 42442 - DNA, 30 bp, Homo sapiens
  chr10:1555620-1555650
  hypo
ggagtgtgtggctagcgatgacggccgtcc

SEQ ID NO: 42443 - DNA, 40 bp, Homo sapiens
  chr10:1558592-1558632
  hypo
cctgcttgtgaccagcgtgcattctcgacatacacgcttc

SEQ ID NO: 42444 - DNA, 46 bp, Homo sapiens
  chr10:1585353-1585399
  hypo
ggtgcaggatggcggcgttgagagccagaaacgaaaccctgagaag

SEQ ID NO: 42445 - DNA, 140 bp, Homo sapiens
  chr10:1669194-1669334
  hypo
gtcccaccttttccccgggccccggcgcacccgctagcaccgctttctgcccaccctggcctggacgcctctccctccccacaggctcacacatcagtcacccactcgaactggagccgggccctcgggtgaatcgttag

SEQ ID NO: 42446 - DNA, 180 bp, Homo sapiens
  chr10:1716300-1716480
  hypo
cactgggaacggccccgtcggccgggggcccaggaatcagccctgtgcagagtgcattccgtaatgtgtgcaccttctctacttcagaaaaaaatattctttgaaagatccattttttaaagcctccaacccccttgtgagaaaattggcaactgtgggggcccccgcagcctcaaattt

SEQ ID NO: 42447 - DNA, 90 bp, Homo sapiens
  chr10:1850230-1850320
  hypo
gtgcgcaccgcgcctcgtgtccgcctggcgtgtgttgctccgtggtgctccgggggaaggtttgggggacccatgcggcagcgttggcgt

SEQ ID NO: 42448 - DNA, 80 bp, Homo sapiens
  chr10:1995028-1995108
  hypo
gaaggggctggagcccgggcactcgggttaggcaacgtcaaggggctcgggaggagagtgggctccgccaaggcggtggc

SEQ ID NO: 42449 - DNA, 30 bp, Homo sapiens; identical to SEQ ID NO: 15322
  chr10:2283030-2283060
  hypo

SEQ ID NO: 42450 - DNA, 102 bp, Homo sapiens
  chr10:2452926-2453028
  hypo
catcttcaaaggctctttggaagcaacacgacaccagcagcacagacagaccatgtcactcggctctgcgttaggacttcaggaccgcggcagtctcatcat

SEQ ID NO: 42451 - DNA, 30 bp, Homo sapiens
  chr10:2706731-2706761
  hypo
aaacctcacccccaccgccgctaaaaatat

SEQ ID NO: 42452 - DNA, 193 bp, Homo sapiens
  chr10:2758979-2759172
  hypo
cttgaaggagaggcccgtgactcatcgcgttctgtcactttggtgcctggaatacggtaaccactcaataaatattaattgccattataatgattaccattgctgttatcagtgttattcttctccactgtagcgtaatacttgctatgatccagatcaggtttttgaagcaacttcacgcttggcatttcag

SEQ ID NO: 42453 - DNA, 30 bp, Homo sapiens
  chr10:2775311-2775341
  hypo
agagagagagacagacgtccccacagaggg

SEQ ID NO: 42454 - DNA, 78 bp, Homo sapiens; identical to SEQ ID NO: 15323
  chr10:3161042-3161120
  hypo

SEQ ID NO: 42455 - DNA, 84 bp, Homo sapiens
  chr10:3216467-3216551
  hypo
gggaaaaagtcccaacgtgtctaccctaaactctccatagggcagccagttctgggctgcaggtaaacacgtacctccttattg

SEQ ID NO: 42456 - DNA, 19 bp, Homo sapiens
  chr10:3285550-3285569
  hypo
agccaggcgtgctggcgct

SEQ ID NO: 42457 - DNA, 79 bp, Homo sapiens
  chr10:3285689-3285768
  hypo
aaaaaataataacaataaatagcaaacagcagagagcatcatcttaaggttttgaaaatacatacgtattactattatg

SEQ ID NO: 42458 - DNA, 74 bp, Homo sapiens
  chr10:3329710-3329784
  hypo
tgttgtaattgagtgcgtgcacactcagtaaatgcgaaatggtttcatcacaaccgcaccgatgcagttcctaa

SEQ ID NO: 42459 - DNA, 191 bp, Homo sapiens
  chr10:3330427-3330618
  hypo
agcgagcaggtgccacgtccacaccgggtgaggcgtgaggtgagggctcccccgcgccgccctggcgtccaggtggtgagggctgcacggaaacgtggacttcggcagaacatgtgtgcgccacggagcggctgcgtgcagcccgcaggtgagaccgtctgcataactctgccaaccgtggagtatccaag

SEQ ID NO: 42460 - DNA, 30 bp, Homo sapiens
  chr10:3641392-3641422
  hypo
gcgaggcgggcggatcggatcatgaggtca

SEQ ID NO: 42461 - DNA, 216 bp, Homo sapiens
  chr10:3678616-3678832
  hypo
agacaccgtgcctggtccaaagagatgtttttatgtggttcaccttcgaccttcatcagggtgactcaggaggcacattctgaagccactctccaacacttaagttttttgccaggtatttttcacaaagcaacgatttgaacaatgaaggagaaaatgtagcctcgcaacttcattcgtaaataatccagactaaccgcacggagtataatggat

SEQ ID NO: 42462 - DNA, 98 bp, Homo sapiens
  chr10:3895354-3895452
  hypo
gttcccaccacacagcggcggctcaactgcccaggctgtggggtttccagctgtgtcgtgttgacttgaaccgactcagcaggcggtgccctcctgga

SEQ ID NO: 42463 - DNA, 216 bp, Homo sapiens
  chr10:4599789-4600005
  hypo
aagcgtttcacagtgcggtgacgatgggatccgcccatgtttgcacgtgccaggagcagcggtagcagcagctccagggaggtgcacacttgtcagcggcagtggggtgctggcgggtgccagagggcctgccgccctaaggtcgttcacgatggtgtcagcggcaatgcagctggggtggagggcctgctggcagctgtgcgtgcagtgacactg

SEQ ID NO: 42464 - DNA, 185 bp, Homo sapiens
  chr10:5507960-5508145
  hypo
tgcaaattctacaaacgctgaatttaaatgctgagcaaagcggcccaggctgttttcatctggaggtctgggctgcaacctctcactctcagacaataactacttaggaaaattcgacatccagaggcctaggagcctcagggcccaaccccaggccgccctagcctgtgcgggtgaacctttca

SEQ ID NO: 42465 - DNA, 30 bp, Homo sapiens
  chr10:5523260-5523290
  hypo
cgccacaggcaccagcgtgcttctcctcag

SEQ ID NO: 42466 - DNA, 43 bp, Homo sapiens
  chr10:5530764-5530807
  hypo
gcttccaggtgcagccggggttgggaatcgctggcttatgcaa

SEQ ID NO: 42467 - DNA, 70 bp, Homo sapiens
  chr10:5531049-5531119
  hypo
cacctgcttctccagcgggaacggagggcgacctgcgcagcctaggcactgcggccgtggttcacatgca

SEQ ID NO: 42468 - DNA, 48 bp, Homo sapiens
  chr10:5538890-5538938
  hypo
gtctgcccgagagcacggcaggtgggaaagagacgaatcctgactcca

SEQ ID NO: 42469 - DNA, 877 bp, Homo sapiens
  chr10:5540651-5541528
  hypo
agcacacatggaactcggcagtcctttatttagatcaatgcggggctgaggggccctcattccactgcagggcaaagggggaccaggcccaaggaggcctccttctgcccaaggtctggaggcagagaggggctcgcaggcggcccgagggcgccgcatccaggccccggagcgcaaagccttcctcccagggggaggcagtttcccatccaccgaccaggtttccccggagagtcccagcacaaaagcagcagcgggcggtggccctgaaggctcagagcgcagccagggggacacaggcggggagcctcactcctgggcgagcatcctcgcgaactcctcgtagttcacccgcccgtcctggtccacgtcggcctcgcggatcatggcgtccagctcctcctgcggcagcggctgccccagccccgccatggcccgcctgagctcgtccacggtgatgtggccgtcgccatcctggtcgaaggcgcggaaggcgacctgcaggtcctccaggccggccctggccttcttcgccgccgtcaggaactcctggaagctgatttcgccgtcgccgtcgctgtcaacctcggagatgagtttccttagctgggcctccgagaggttcttgcccgtggccttcagcgccgcgcccagctcctgggcattgatggtgccgtttccatccgtgtcaaccgcggagaaagcctttttgtactgggcctcctcctcaggagtcagctcaccggccatgcctgcgtctcctgcacctcgcggagcctccgagctgctgcccaccggccctcaacctgctgctctcagagctcgtggtccagagtgcaggcagccgcagggatccgggcagcgtctgtcccagaca

SEQ ID NO: 42470 - DNA, 47 bp, Homo sapiens
  chr10:5553281-5553328
  hypo
ctgcaaagggaaggccgctactgctcacacctcgacttctcagggag

SEQ ID NO: 42471 - DNA, 74 bp, Homo sapiens
  chr10:5567136-5567210
  hypo
cccgcgagctgggcacggtcatgcggtccctgggccagaaccccacggaggccgagctgcgggacatgatgagt

SEQ ID NO: 42472 - DNA, 30 bp, Homo sapiens
  chr10:5588268-5588298
  hypo
gggggacagaggggacggtccccagggaag

SEQ ID NO: 42473 - DNA, 160 bp, Homo sapiens
  chr10:5868078-5868238
  hypo
aaaaaaaaaaaaaagatggttcaatagaaactaatctttccccatctcccaaacagtgctccattcctgcttaatcaacagcagtatctcccagcattctgtgaggaagtagagcctcaggatgctttccaaggaaagagttccacggtcatataaattt

SEQ ID NO: 42474 - DNA, 570 bp, Homo sapiens
  chr10:5874775-5875345
  hypo
tcagcagttcaaaaccgtgctgacctgccagtacaagcaggccttgaggtcagtaaaaggtaacattacagacatcaaaagcaaattaaaaacccacagcctcagagaataactcctgatgccagctccttctcatggcaccccctgccccatcccaccagtgtcaggtcacaaagccccacactgcgccgggtggggatttaagattcccgctcccccacccctgccaccctgtagaacaaggcgctgccactcaagccagttccctgagaaccagtcggaccaggacaggcccctgaccacacccggcaaactggagtcctggccaaaggtgctgtgagtccatgaggtgctggcagggaggtgctcagaggagggtgcgcagaggcggagggagccaggatggaggctgcagggagcaggggcaggcaggcacggcagggaccacgagctcctgggatgcagacaagacttgcgggggtgcacggagacagagcaatttccccagtactttgttgccacgtttttgtgctgatggcatcagatgaaagagaaaaggggccgggcgca

SEQ ID NO: 42475 - DNA, 48 bp, Homo sapiens
  chr10:5952951-5952999
  hypo
gtgaatgacatccagcgactgctcttctgcctccggagacccagctcc

SEQ ID NO: 42476 - DNA, 45 bp, Homo sapiens
  chr10:6003482-6003527
  hypo
tgcgctggccgaggacgctcggagcggctgcgtgtgaaacacggg

SEQ ID NO: 42477 - DNA, 21 bp, Homo sapiens
  chr10:6009743-6009764
  hypo
gggtgcggtagctcacgcctg

SEQ ID NO: 42478 - DNA, 30 bp, Homo sapiens
  chr10:6024581-6024611
  hypo
ctgcagtggcaacaacgttgctttctgggc

SEQ ID NO: 42479 - DNA, 205 bp, Homo sapiens; identical to SEQ ID NO: 15336
  chr10:6042309-6042514
  hypo

SEQ ID NO: 42480 - DNA, 24 bp, Homo sapiens
  chr10:6127024-6127048
  hypo
gagccaccgcgcccagccttcttt

SEQ ID NO: 42481 - DNA, 159 bp, Homo sapiens
  chr10:6159807-6159966
  hypo
gaacttccttgtttccctcctccccgcaagagactagaaacttgctttcccagcctgtcttgcaggttgagtagggttgtgcgcttgggatctctgatcagaccggcaccgcagtgtgggagagaagctgtgtgaagagtctgtcgtctgactttggca

SEQ ID NO: 42482 - DNA, 87 bp, Homo sapiens
  chr10:6162138-6162225
  hypo
ttttatggcacttgacgctggtaaccactcccttcccgaggacggagaccgcggccctgccagtatcgctcacgctttacctcttcc

SEQ ID NO: 42483 - DNA, 24 bp, Homo sapiens
  chr10:6199196-6199220
  hypo
tttttttttttgagacggagtctc

SEQ ID NO: 42484 - DNA, 133 bp, Homo sapiens
  chr10:6462190-6462323
  hypo
cacccgcctaggcctcgaaatctccttttaatacacttaaacacaccatgccttcgaatctgtgagttgggcttcttccctaagggagctgctttgtgtggacgctccactcccttgccgtctgactggttgt

SEQ ID NO: 42485 - DNA, 186 bp, Homo sapiens
  chr10:6505370-6505556
  hypo
taagtgaattctttccggcatgaaaaatgcccgatgatttctctgctgcagaaatccagtaaaattacctctgggtgcattgctgaggtttcccagagcaatgatctcagcagagtgctacccactagatgtgataaacagccattccagccagggattttaagaagctggcggaccaaatccatt

SEQ ID NO: 42486 - DNA, 30 bp, Homo sapiens
  chr10:6528008-6528038
  hypo
ctcaatcatggccagcgcttcagccattag

SEQ ID NO: 42487 - DNA, 140 bp, Homo sapiens
  chr10:6531036-6531176
  hypo
ccggcctaaaatctttactatagaaaggatttttttttttcatgattgtgctccaaattccacattgtcggcaaaactcgcataactcacattcgccctatttagaaggtgtcaggtttcaacttcggtagccccagctc

SEQ ID NO: 42488 - DNA, 15 bp, Homo sapiens
  chr10:6564170-6564185
  hypo
cgggattacaagagt

SEQ ID NO: 42489 - DNA, 118 bp, Homo sapiens
  chr10:6577643-6577761
  hypo
tgtttcaaaacagcccgtgtccacctcccctcttggtcttttgaagtctcccctcgccgcgcctctttagacgcacctgagatccatcaaagcggacagatcccgattacagtcccct

SEQ ID NO: 42490 - DNA, 21 bp, Homo sapiens
  chr10:6586866-6586887
  hypo
ccactgcgcccagacccacat

SEQ ID NO: 42491 - DNA, 171 bp, Homo sapiens
  chr10:7139938-7140109
  hypo
tgctgccagtgcctccgggagcccagctcctccagcggggttctctccagatccttgcagaccccaaacagagagatgatggggcctgcagaccttgcctggctgtcagaaattttccacccgctgaagaggtggctggcagtggtctacgctctgcgtgtggccttccta

SEQ ID NO: 42492 - DNA, 65 bp, Homo sapiens
  chr10:7203062-7203127
  hypo
acggagagtcttgggcgcttggctccacgggaagcaaacactttcccctgcgacagtggctgtat

SEQ ID NO: 42493 - DNA, 82 bp, Homo sapiens; identical to SEQ ID NO: 15342
  chr10:7205705-7205787
  hypo

SEQ ID NO: 42494 - DNA, 364 bp, Homo sapiens
  chr10:7212745-7213109
  hypo
gagggagaagggtctcgcacacctgccgagcagcgccgaagaaccccctcgcaggtgtcacgaggaagccggctaggacacgaggttcatttcagatgcagagtctcagcacatcaaacaatcgacacgcggcaaccaccgtacctgctcctgaaatatcttggccaagggggcacagtctgtcagcttaatgaacctcaccacgtcggtgaccgtccactccaacgggttgctctccagaaccagtctctcctcctcctcctgtttcgtgtcctgcagagaaagggcaggaggagctcagctgcggcacagtcagctggctgggtcctctccagcactctccaggcctcggccgttcctggcc

SEQ ID NO: 42495 - DNA, 30 bp, Homo sapiens; identical to SEQ ID NO: 15344
  chr10:7213658-7213688
  hypo

SEQ ID NO: 42496 - DNA, 108 bp, Homo sapiens
  chr10:7214167-7214275
  hypo
gtagcggtggccccgcggtcagaccctgggcccagtgcagaccacctagcaaaccctcggaaatggagccagtggtcccacccgtgggccctacgaggcccttcccag

SEQ ID NO: 42497 - DNA, 30 bp, Homo sapiens
  chr10:7215974-7216004
  hypo
ccacctcctcccctgcgtttgatcacagca

SEQ ID NO: 42498 - DNA, 155 bp, Homo sapiens
  chr10:7236090-7236245
  hypo
cgccaaggcctgcttcgttctgagtttgcttatggggtacgtctggacctcagtggaccattgagtgactctggttccagcttctcccaggtcccctacctcccctcgctgcaccccctcgaattgaggccagacacgctcgtggtcctgccaaa

SEQ ID NO: 42499 - DNA, 30 bp, Homo sapiens
  chr10:7258531-7258561
  hypo
ggctcaagtgactaccgagctatcttgctg

SEQ ID NO: 42500 - DNA, 22 bp, Homo sapiens
  chr10:7288388-7288410
  hypo
gaatgtgagagaggccgggtgc

SEQ ID NO: 42501 - DNA, 37 bp, Homo sapiens
  chr10:7290469-7290506
  hypo
ctctaggggctgggtcgaagagcgagggaggaaaacc

SEQ ID NO: 42502 - DNA, 70 bp, Homo sapiens
  chr10:7339992-7340062
  hypo
aggcctggaggtggtcgtgctgctgttggctgctcgcccagcacccagaggccctcgcagcttgtccttc

SEQ ID NO: 42503 - DNA, 30 bp, Homo sapiens
  chr10:7391910-7391940
  hypo
gaggcaataaggctacgtcagcacctcata

SEQ ID NO: 42504 - DNA, 23 bp, Homo sapiens
  chr10:7414166-7414189
  hypo
gccacgcccggccttcttgaaat

SEQ ID NO: 42505 - DNA, 44 bp, Homo sapiens
  chr10:7414544-7414588
  hypo
ccaagaagtttagagcgtcacagacacagcgaagtgaactagag

SEQ ID NO: 42506 - DNA, 34 bp, Homo sapiens
  chr10:7472551-7472585
  hypo
gagaaatggacatagcggccgagcacggtggctc

SEQ ID NO: 42507 - DNA, 30 bp, Homo sapiens
  chr10:7608124-7608154
  hypo
tgacggtgacattggcgttggcagacacgg

SEQ ID NO: 42508 - DNA, 58 bp, Homo sapiens
  chr10:7765067-7765125
  hypo
tggtgtggtgtggagcggagtgccctggcatggcgtggagtggcgtggcgtggagtgg

SEQ ID NO: 42509 - DNA, 30 bp, Homo sapiens
  chr10:7780425-7780455
  hypo
atgacagagggagcccgagagaactctgga

SEQ ID NO: 42510 - DNA, 34 bp, Homo sapiens
  chr10:7985160-7985194
  hypo
cttgaatgaaacaggcgctcgatgttggcctcac

SEQ ID NO: 42511 - DNA, 30 bp, Homo sapiens
  chr10:8025070-8025100
  hypo
ctcatctggcctctgcggtggcagaggtgg

SEQ ID NO: 42512 - DNA, 30 bp, Homo sapiens
  chr10:8067803-8067833
  hypo
gcagaagcacacctacgtttgtgtatatgg

SEQ ID NO: 42513 - DNA, 30 bp, Homo sapiens
  chr10:10770967-10770997
  hypo
agacatgtaaagcgccggctgtatgtggga

SEQ ID NO: 42514 - DNA, 35 bp, Homo sapiens
  chr10:10867443-10867478
  hypo
attacaggcatgagccaccgcgcccagctggatac

SEQ ID NO: 42515 - DNA, 30 bp, Homo sapiens
  chr10:11344374-11344404
  hypo
agccccaggtggtgccgatgcgggcgaggc

SEQ ID NO: 42516 - DNA, 136 bp, Homo sapiens
  chr10:11357646-11357782
  hypo
aagtggtagctgtgccgcggcctcattgttttattccagttagaaccgcctccagctttgacttttccagcagccaagtaggagcctcactgccttgacccccatttccggtacagctcctcgctctgaccttgtc

SEQ ID NO: 42517 - DNA, 151 bp, Homo sapiens
  chr10:11472842-11472993
  hypo
taaaccctttggcaacgacacacggctccgagaacacacgcatgaataaataaaaccaatactctgctgctgagacatcgctacatccagaaggacccagagcaacagacgcagagaaaagcaacatggaccaccgcggcctgacagcagg

SEQ ID NO: 42518 - DNA, 30 bp, Homo sapiens
  chr10:11486576-11486606
  hypo
caggggtcctggccccgcccccccgtctcc

SEQ ID NO: 42519 - DNA, 30 bp, Homo sapiens
  chr10:12139715-12139745
  hypo
gcacctcattgctggcggactcatgacgca

SEQ ID NO: 42520 - DNA, 47 bp, Homo sapiens
  chr10:12531976-12532023
  hypo
tggggcaggtgtgaacggggcaggcacactcacgggtctgggctctg

SEQ ID NO: 42521 - DNA, 29 bp, Homo sapiens
  chr10:12554507-12554536
  hypo
cctcagcagctgcccgttgggagactcgg

SEQ ID NO: 42522 - DNA, 30 bp, Homo sapiens
  chr10:12844882-12844912
  hypo
cagaaaaatcatgaccgtctgactgcagag

SEQ ID NO: 42523 - DNA, 17 bp, Homo sapiens
  chr10:13130744-13130761
  hypo
gggcgcagtggctcacg

SEQ ID NO: 42524 - DNA, 78 bp, Homo sapiens
  chr10:13137622-13137700
  hypo
tgctcacctcctgctgttcggtctagttcctgagaggccacaggccagtactggttcaccacccggggtttggggacc

SEQ ID NO: 42525 - DNA, 30 bp, Homo sapiens
  chr10:13140531-13140561
  hypo
accccttacaggccccggggggaccctttt

SEQ ID NO: 42526 - DNA, 23 bp, Homo sapiens
  chr10:13140997-13141020
  hypo
agccaccgcgcctggccctcctg

SEQ ID NO: 42527 - DNA, 126 bp, Homo sapiens; identical to SEQ ID NO: 15352
  chr10:13355078-13355204
  hypo

SEQ ID NO: 42528 - DNA, 43 bp, Homo sapiens
  chr10:13426126-13426169
  hypo
gattacaggcgtgcgccaccgcgcccagcggagtatggtagac

SEQ ID NO: 42529 - DNA, 149 bp, Homo sapiens
  chr10:13751257-13751406
  hypo
ccaactcaggctctaagctgctggacctgacacaagttacagcatttcctttagcctcagttttcccctctgtaaaatggcaaaaataacccctctaaggtagatctcagcagccacagatcgtagcacagtaccggcacaaagtgacc

SEQ ID NO: 42530 - DNA, 161 bp, Homo sapiens
  chr10:13898478-13898639
  hypo
cacaaccaatcacagcgaggtgtggccatgtcataagaaagaaacgcagtacagactaggcggagggggtcagggaaagccttggtggagggtgtcttccaatttgtgatgtaaagacctaagagagaccagccaggtccagggcgcgggggtgtgggaag

SEQ ID NO: 42531 - DNA, 86 bp, Homo sapiens
  chr10:14997207-14997293
  hypo
attgtacctggctttccaggcctccataacacttgaagtcccactttgtgcacagcactgtgacaaaccttcgggtagcattcaat

SEQ ID NO: 42532 - DNA, 38 bp, Homo sapiens
  chr10:15000601-15000639
  hypo
aacatgtaaattggccgggcgcggtggctcacgcctgt

SEQ ID NO: 42533 - DNA, 98 bp, Homo sapiens
  chr10:15003062-15003160
  hypo
ctcctcaatttaactatgggattatgtcccaatacacccatggtaggtcgaaaatgcatttaatgcacctagccaactttaaacgtcctcagaacact

SEQ ID NO: 42534 - DNA, 19 bp, Homo sapiens
  chr10:15131223-15131242
  hypo
taaatatgtattggccggg

SEQ ID NO: 42535 - DNA, 30 bp, Homo sapiens
  chr10:15255872-15255902
  hypo
tgtcattgacctggtcgacagaactgcagc

SEQ ID NO: 42536 - DNA, 30 bp, Homo sapiens
  chr10:15484112-15484142
  hypo
gggaactttccagctcggcctctacttacc

SEQ ID NO: 42537 - DNA, 25 bp, Homo sapiens
  chr10:15568453-15568478
  hypo
tgtgagccaccgcacccggcccatt

SEQ ID NO: 42538 - DNA, 29 bp, Homo sapiens
  chr10:15783189-15783218
  hypo
tgagccactatgcccggccgtgattatta

SEQ ID NO: 42539 - DNA, 16 bp, Homo sapiens
  chr10:15932019-15932035
  hypo
acgatgccaagcatta

SEQ ID NO: 42540 - DNA, 30 bp, Homo sapiens
  chr10:16714330-16714360
  hypo
ctgccatatgacccacgcattccactccta

SEQ ID NO: 42541 - DNA, 30 bp, Homo sapiens; identical to SEQ ID NO: 15355
  chr10:16715583-16715613
  hypo

SEQ ID NO: 42542 - DNA, 96 bp, Homo sapiens; identical to SEQ ID NO: 15356
  chr10:17429165-17429261
  hypo

SEQ ID NO: 42543 - DNA, 96 bp, Homo sapiens; identical to SEQ ID NO: 15357
  chr10:17429561-17429657
  hypo

SEQ ID NO: 42544 - DNA, 95 bp, Homo sapiens
  chr10:17579985-17580080
  hypo
agactctgtctcaaagaaaaagaaattaaatgtgaagaaagttctgtaaaagtagcaagaatacagatgcttttctttcccgtatccctcctcca

SEQ ID NO: 42545 - DNA, 139 bp, Homo sapiens
  chr10:20069005-20069144
  hypo
caataacatgctgtgcgatattgtagcctaggagcaacagactattcattccatataacctggatgtgtaggaggctctaccatctaggtttgtgtaagtacacccaaggatgtttgtcaacaacgaaatcacctatcg

SEQ ID NO: 42546 - DNA, 137 bp, Homo sapiens
  chr10:22033212-22033349
  hypo
tctcttctcccaaggcgaaggattaccttccctctagaatgacaggtgactcatccatcaactcctgcgagtttaattcctcaacatgtgtcctttgccttagctgcatgtttgtaagtgtccgcttctgtagctct

SEQ ID NO: 42547 - DNA, 41 bp, Homo sapiens
  chr10:22450029-22450070
  hypo
tatttaagaagaagtcggggccgggttcggtggctcatgcc

SEQ ID NO: 42548 - DNA, 33 bp, Homo sapiens
  chr10:22567375-22567408
  hypo
cagtgttcgagcgggcagcgggagtgagcatag

SEQ ID NO: 42549 - DNA, 30 bp, Homo sapiens
  chr10:22823530-22823560
  hypo
caccaagtggaatgccgttaagtctgctat

SEQ ID NO: 42550 - DNA, 30 bp, Homo sapiens
  chr10:22833980-22834010
  hypo
ctttcactgcattcccgaatcccggcaggc

SEQ ID NO: 42551 - DNA, 30 bp, Homo sapiens
  chr10:22870025-22870055
  hypo
gcatgaacacaataccgaagagtgttcctt

SEQ ID NO: 42552 - DNA, 41 bp, Homo sapiens
  chr10:24841812-24841853
  hypo
aggtataattattaccgtgccatgcacgcacccatcagcag

SEQ ID NO: 42553 - DNA, 24 bp, Homo sapiens
  chr10:24842550-24842574
  hypo
caggaaagggccaggcgaggtggc

SEQ ID NO: 42554 - DNA, 30 bp, Homo sapiens
  chr10:24908432-24908462
  hypo
aggcggactggtactcgaggcttttctttc

SEQ ID NO: 42555 - DNA, 42 bp, Homo sapiens
  chr10:24988521-24988563
  hypo
gggattacaggcatgagtcaccgtgcccggcctagaattact

SEQ ID NO: 42556 - DNA, 148 bp, Homo sapiens
  chr10:25592447-25592595
  hypo
aatgactcatcttcccgaaataccttgagagcatcttaggaataatagtggcgcaaaccgttaataagttaatatgtgttatatgaacattgtctttcttggcagtcaaactccgcctttatcaaaataaattcgatgataacccctt

SEQ ID NO: 42557 - DNA, 32 bp, Homo sapiens
  chr10:26127993-26128025
  hypo
agaaaagcacttccacggcctggcgcggtggc

SEQ ID NO: 42558 - DNA, 30 bp, Homo sapiens
  chr10:26211012-26211042
  hypo
tttaagaccaggtctcggccgggtgtggtg

SEQ ID NO: 42559 - DNA, 80 bp, Homo sapiens
  chr10:26638401-26638481
  hypo
aatattgggggcaggttcccccaatactggcatctataggaaatgtatatgagggatggaagagacgagaggtggggaga

SEQ ID NO: 42560 - DNA, 30 bp, Homo sapiens
  chr10:26720842-26720872
  hypo
actataattcatgatcgccagtttcaaatg

SEQ ID NO: 42561 - DNA, 132 bp, Homo sapiens
  chr10:26733284-26733416
  hypo
aggattctgagaaggcgaataacatgatctgacttaaggctcactctgactgcttgagaataaacctgggggagcagaggtgaaagcaaggaacccatgacaaagcgttggattctgcgtatattttgaagg

SEQ ID NO: 42562 - DNA, 30 bp, Homo sapiens; identical to SEQ ID NO: 15362
  chr10:26739045-26739075
  hypo

SEQ ID NO: 42563 - DNA, 21 bp, Homo sapiens
  chr10:26791280-26791301
  hypo
gtctcttgggccaggcgtggt

SEQ ID NO: 42564 - DNA, 39 bp, Homo sapiens
  chr10:26801561-26801600
  hypo
gtcttgctctatcaccgaagctacagtgcaatggcgcaa

SEQ ID NO: 42565 - DNA, 99 bp, Homo sapiens
  chr10:26801660-26801759
  hypo
gagtagctgggactataggcacacatcatcatatttctcatttttaataatgggacagtcgtctctcaggagagctgggtgggacggagaattgcctgt

SEQ ID NO: 42566 - DNA, 20 bp, Homo sapiens
  chr10:26832097-26832117
  hypo
atgtttgttgaatgacggcc

SEQ ID NO: 42567 - DNA, 41 bp, Homo sapiens
  chr10:26877719-26877760
  hypo
atacaggagcagaggcgcccagaacacgctgtcccccaatg

SEQ ID NO: 42568 - DNA, 21 bp, Homo sapiens
  chr10:26907322-26907343
  hypo
agccaccgcacccggcccaaa

SEQ ID NO: 42569 - DNA, 30 bp, Homo sapiens; identical to SEQ ID NO: 15364
  chr10:26926812-26926842
  hypo

SEQ ID NO: 42570 - DNA, 45 bp, Homo sapiens
  chr10:26942249-26942294
  hypo
gacccccctggacttcgtgctccctcccctcgctgtcgccaagag

SEQ ID NO: 42571 - DNA, 22 bp, Homo sapiens
  chr10:28791009-28791031
  hypo
gccaccacgccctgccagtatg

SEQ ID NO: 42572 - DNA, 30 bp, Homo sapiens
  chr10:29164934-29164964
  hypo
gaaacagcgattacacggtaggtatttctt

SEQ ID NO: 42573 - DNA, 32 bp, Homo sapiens
  chr10:31006068-31006100
  hypo
ctcctttcactgagtcgcggggcgcttctccc

SEQ ID NO: 42574 - DNA, 208 bp, Homo sapiens
  chr10:31892881-31893089
  hypo
catgctgcaaattcccgtggccagcacccgaggcctgctggctccgatctgggccacgtgtacaaccaggtgtgcccccttagcctcacgccctcctcctgttgcctccccatccctctagccttcgggacttggggttgcaatgaatcttaggttttttccaggagtcttttattcctccagcgtctccgtgcgcctgtccgctcca

SEQ ID NO: 42575 - DNA, 16 bp, Homo sapiens
  chr10:32171091-32171107
  hypo
tcggcctcccaaagtg

SEQ ID NO: 42576 - DNA, 151 bp, Homo sapiens
  chr10:32499025-32499176
  hypo
caaattctccagtcccgcctcagacctactgaagcggacacactgtgggtgctgcccagcaatctaggttttaacaagccctccagggcattctgaagcgctggtaaattgagaactgttgctttagattttcgaacgtggttgaactgta

SEQ ID NO: 42577 - DNA, 30 bp, Homo sapiens
  chr10:32638913-32638943
  hypo
attcttttatctgtccgaaagattccttga

SEQ ID NO: 42578 - DNA, 21 bp, Homo sapiens
  chr10:32736537-32736558
  hypo
taaaagggagcagggcgcaca

SEQ ID NO: 42579 - DNA, 30 bp, Homo sapiens
  chr10:33233494-33233524
  hypo
caaaggaaactcatccgagatgatgtcatg

SEQ ID NO: 42580 - DNA, 31 bp, Homo sapiens; identical to SEQ ID NO: 15367
  chr10:38078895-38078926
  hypo

SEQ ID NO: 42581 - DNA, 61 bp, Homo sapiens
  chr10:38445833-38445894
  hypo
agaggggtcctggctcggcctggaatggggctcggggagggtcagacggtctattgggctc

SEQ ID NO: 42582 - DNA, 30 bp, Homo sapiens
  chr10:42777495-42777525
  hypo
tctaaaactactccacggccgaggaactgc

SEQ ID NO: 42583 - DNA, 30 bp, Homo sapiens
  chr10:43047017-43047047
  hypo
tacagacctttcttgcggctgcacctctga

SEQ ID NO: 42584 - DNA, 36 bp, Homo sapiens
  chr10:43265217-43265253
  hypo
ggcgtggcctcctggcgcgggcgtggcagggcagca

SEQ ID NO: 42585 - DNA, 30 bp, Homo sapiens
  chr10:43615515-43615545
  hypo
tttttcctcacagctcgttcatcgggactt

SEQ ID NO: 42586 - DNA, 54 bp, Homo sapiens
  chr10:43858319-43858373
  hypo
gagtccagtagtcctcgtggagacagctgggaaaggcctcggggcaagggacct

SEQ ID NO: 42587 - DNA, 45 bp, Homo sapiens
  chr10:43905839-43905884
  hypo
gccctgtcattcaggcgggagtgcagtggtacaatcacggctcac

SEQ ID NO: 42588 - DNA, 44 bp, Homo sapiens
  chr10:43906064-43906108
  hypo
tactggattgagccacgcatctggctgaacgttattttttaaat

SEQ ID NO: 42589 - DNA, 118 bp, Homo sapiens
  chr10:44197833-44197951
  hypo
cgagctgcccccccacgctgccaccggcgctgccacctgcccatatccccgccttccgcagaggcttcagcctcccctgtacagaggcggggcatggagccggcggctttcagaactc

SEQ ID NO: 42590 - DNA, 30 bp, Homo sapiens
  chr10:44433895-44433925
  hypo
aggagacagaagccacgcaataatttggac

SEQ ID NO: 42591 - DNA, 37 bp, Homo sapiens
  chr10:44500784-44500821
  hypo
cgggctctggaagtccgctgttcggggtaaattggca

SEQ ID NO: 42592 - DNA, 86 bp, Homo sapiens
  chr10:44547328-44547414
  hypo
tatttctggcactcacggtgctgaactcgtttcagctgagtaagcactagtgactcaactccaaggcacaccgtagacttcatctc

SEQ ID NO: 42593 - DNA, 38 bp, Homo sapiens
  chr10:44594208-44594246
  hypo
aggacattacaaggccggatgcagtggcttatgcctgt

SEQ ID NO: 42594 - DNA, 34 bp, Homo sapiens
  chr10:44869035-44869069
  hypo
actgggcgtggcagacgcacgaaggcacagagag

SEQ ID NO: 42595 - DNA, 30 bp, Homo sapiens
  chr10:46009848-46009878
  hypo
ccctgtgcttgatgccggggaacaggcgct

SEQ ID NO: 42596 - DNA, 28 bp, Homo sapiens
  chr10:46221028-46221056
  hypo
acaaacaaacaaacgacaacaaaaaaaa

SEQ ID NO: 42597 - DNA, 162 bp, Homo sapiens
  chr10:49393632-49393794
  hypo
tacaatttctcggcccggttcagctataaagctcttcctcctattattctttgagcctagaggtagaatcagagcaccacattgtgcttttcccccaaattatttgggagctaatacaaaaggagtaaacagcatttcacacacatgcgcgcacacacattc

SEQ ID NO: 42598 - DNA, 30 bp, Homo sapiens
  chr10:49541963-49541993
  hypo
agcagtggagcctggcgcttctgccatctc

SEQ ID NO: 42599 - DNA, 58 bp, Homo sapiens
  chr10:49652949-49653007
  hypo
cccagacggctggctcgcgtgtcagtggccgagcaaagacagacgccactctccccag

SEQ ID NO: 42600 - DNA, 30 bp, Homo sapiens; identical to SEQ ID NO: 15370
  chr10:49929928-49929958
  hypo

SEQ ID NO: 42601 - DNA, 30 bp, Homo sapiens
  chr10:50007569-50007599
  hypo
ccagcacgaagaggccgaggcgggtggatc

SEQ ID NO: 42602 - DNA, 30 bp, Homo sapiens
  chr10:50105263-50105293
  hypo
gcagggcagctttcacgtgtcagcggccag

SEQ ID NO: 42603 - DNA, 253 bp, Homo sapiens
  chr10:50507469-50507722
  hypo
ctgagcagctggacacgcagagagcggaaggtacagcccagacacttgtctggctccttagcgtgggcagggaggctcaagttcatggcgggagggatgttcccgctgggccgatgctgtgctggggaagtagttcggtgccagggtgctgtgcagggtggtatgtgtgtgccgggagcccattggtgttggggctaaggttcttggtgtgctggatgggcctcggggaccacgtacccggaaccgtgtacat

SEQ ID NO: 42604 - DNA, 41 bp, Homo sapiens
  chr10:50748353-50748394
  hypo
ggattacaggtgtgagccaccacgcccggcttgtaacttgc

SEQ ID NO: 42605 - DNA, 17 bp, Homo sapiens
  chr10:57918195-57918212
  hypo
atttgaatgtaaggccg

SEQ ID NO: 42606 - DNA, 47 bp, Homo sapiens
  chr10:69310972-69311019
  hypo
tgaacattgagagggcgtcgagaggaggagatcggtggaagaagaca

SEQ ID NO: 42607 - DNA, 30 bp, Homo sapiens
  chr10:69578014-69578044
  hypo
aaagatccacataaacgttcagaaagttgt

SEQ ID NO: 42608 - DNA, 33 bp, Homo sapiens
  chr10:70232362-70232395
  hypo
tctgtaatcccagctactcgggaggaggctgag

SEQ ID NO: 42609 - DNA, 80 bp, Homo sapiens; identical to SEQ ID NO: 15373
  chr10:70288112-70288192
  hypo

SEQ ID NO: 42610 - DNA, 96 bp, Homo sapiens; identical to SEQ ID NO: 15374
  chr10:70476540-70476636
  hypo

SEQ ID NO: 42611 - DNA, 18 bp, Homo sapiens
  chr10:70483311-70483329
  hypo
taaaagtaaatgggccgg

SEQ ID NO: 42612 - DNA, 30 bp, Homo sapiens
  chr10:72489875-72489905
  hypo
cgcgggaacccctcacgcagcctggagcag

SEQ ID NO: 42613 - DNA, 136 bp, Homo sapiens
  chr10:73466313-73466449
  hypo
gttgtcatgattgtccgtgttgccatggtcgttgttaggtgcgtactggagagaggttctaaggttttctctcctccctttgacagctgagcagcaataagcccccagggcacagggacagcgggagggtctggag

SEQ ID NO: 42614 - DNA, 30 bp, Homo sapiens
  chr10:73553133-73553163
  hypo
gcaccgttcctctctcgggcacagccattg

SEQ ID NO: 42615 - DNA, 23 bp, Homo sapiens
  chr10:73976938-73976961
  hypo
aatgaaagtgtaggccgggcgcg

SEQ ID NO: 42616 - DNA, 84 bp, Homo sapiens
  chr10:75501525-75501609
  hypo
atgagccaccatgcccggccctagtgggtgcaaccttaagcaagacagaggatatttactttcctatatcgatatgagtcaagt

SEQ ID NO: 42617 - DNA, 36 bp, Homo sapiens
  chr10:76784730-76784766
  hypo
aagaagaaaaggggtcgtaaacgcaggaggatcaac

SEQ ID NO: 42618 - DNA, 23 bp, Homo sapiens
  chr10:76997760-76997783
  hypo
accgcacccggccaagaatccat

SEQ ID NO: 42619 - DNA, 212 bp, Homo sapiens
  chr10:77022117-77022329
  hypo
ctcactctatttgggaacagggtaattgaatacagatgggaggaggtaaatgaaagaatttagcaaatatctcagtggaatagctaatgggaatgagacagaataggaaattaaaaattattcgaagcagatggaccattctttgagtttttaaaaatttattagggccgcgagaaaatgtgtctgtttattttctgcggccatgaaattaa

SEQ ID NO: 42620 - DNA, 187 bp, Homo sapiens
  chr10:77893300-77893487
  hypo
ccaatgtgtggagagcgaggaggggcctgcaaactctgcttaaaacaaacaagtgctaaattaaaaagaatgttaaatacagatcagctgcctggctcctgacagcagatttaattcttccctcctctcacctgatggagcttcgcctgcagggtttgcatcaattactcgacgacatgtggaaaat

SEQ ID NO: 42621 - DNA, 38 bp, Homo sapiens
  chr10:78600985-78601023
  hypo
aggcttgagccaccgcgcccgaccgccgatgtacatct

SEQ ID NO: 42622 - DNA, 71 bp, Homo sapiens
  chr10:81070800-81070871
  hypo
ccttcccagcctccccggcagccgccacaggccgctcccagcagccatccacacagcgacctgacctttaa

SEQ ID NO: 42623 - DNA, 32 bp, Homo sapiens
  chr10:81921303-81921335
  hypo
tgacccatgcgggagcgcgatttacatctgtt

SEQ ID NO: 42624 - DNA, 25 bp, Homo sapiens
  chr10:81966571-81966596
  hypo
aacaagctgctggttcgattttcct

SEQ ID NO: 42625 - DNA, 30 bp, Homo sapiens
  chr10:82607464-82607494
  hypo
tcgatctcctgacctcgtggatccacccat

SEQ ID NO: 42626 - DNA, 42 bp, Homo sapiens
  chr10:85949293-85949335
  hypo
attcctctatttggccgggcgcagtggctcacccgtttaatc

SEQ ID NO: 42627 - DNA, 23 bp, Homo sapiens
  chr10:87967335-87967358
  hypo
tactaatggtttatgcgatggca

SEQ ID NO: 42628 - DNA, 40 bp, Homo sapiens
  chr10:88414219-88414259
  hypo
gtctgagtgagctggcggcatggagcgactgagcatgtgc

SEQ ID NO: 42629 - DNA, 30 bp, Homo sapiens; identical to SEQ ID NO: 15378
  chr10:89605951-89605981
  hypo

SEQ ID NO: 42630 - DNA, 23 bp, Homo sapiens
  chr10:94603312-94603335
  hypo
aagcatgcatttggccgggcgcg

SEQ ID NO: 42631 - DNA, 120 bp, Homo sapiens
  chr10:96304100-96304220
  hypo
aaaaccgtctctaccaaaaaacaaaaacacacaaaaaccccaaaccaacaaaaattagcctggaatgggctaatgtccgacactaaaatgtccgggcgtggtggcacgcacctgtagtct

SEQ ID NO: 42632 - DNA, 30 bp, Homo sapiens
  chr10:97202907-97202937
  hypo
ggagcttactgaaaacgtagaagcggccgg

SEQ ID NO: 42633 - DNA, 300 bp, Homo sapiens
  chr10:98129781-98130081
  hypo
catcacactctgccccggccccagcgtctccgggacttaccccagagccacagaagcggccgagcctgggcgctgagctgtcgtagccgtcgtaggcttccatgtagtcgtagccgcagtcggcctcctcctcaacctcaaaggtccggaatgtcagctccacgccgtagccgtcctctgccacgatcacccagtcacagcgggcctcgctcgggtagttgttgtccccaaactgggcgtgggaatagagctctttggtctgcacttcagccttcagcctgcccccgcactctggagcag

SEQ ID NO: 42634 - DNA, 59 bp, Homo sapiens
  chr10:98808749-98808808
  hypo
cgcttgttggcgaggcgccggggactggcacagcgggcaccactcgtctcgatgggatt

SEQ ID NO: 42635 - DNA, 30 bp, Homo sapiens
  chr10:100217214-100217244
  hypo
tggggttactaaggacgcaaagcaaaccat

SEQ ID NO: 42636 - DNA, 16 bp, Homo sapiens
  chr10:101493058-101493074
  hypo
ccgtctcaaaaaaata

SEQ ID NO: 42637 - DNA, 30 bp, Homo sapiens
  chr10:103814237-103814267
  hypo
ttccccctttacagtcgtaacaagagggat

SEQ ID NO: 42638 - DNA, 18 bp, Homo sapiens
  chr10:103818196-103818214
  hypo
acacgaagagaaaaccca

SEQ ID NO: 42639 - DNA, 37 bp, Homo sapiens
  chr10:103930124-103930161
  hypo
ggcgtgaggcaccgcgcccggccgagaagggaggttt

SEQ ID NO: 42640 - DNA, 30 bp, Homo sapiens
  chr10:104160106-104160136
  hypo
ccagctctgctggatcggcatggagactca

SEQ ID NO: 42641 - DNA, 30 bp, Homo sapiens
  chr10:104161739-104161769
  hypo
tggccccagggctcccgagcacatgcccta

SEQ ID NO: 42642 - DNA, 70 bp, Homo sapiens
  chr10:104823178-104823248
  hypo
ctgctcagcatgtggcgcatggggaagtcccgccttgagccgcatgcactgatcccgggttggcactgtt

SEQ ID NO: 42643 - DNA, 23 bp, Homo sapiens
  chr10:105119651-105119674
  hypo
aaaattgaacacagccgggcgtg

SEQ ID NO: 42644 - DNA, 30 bp, Homo sapiens
  chr10:105127046-105127076
  hypo
gtaatgcatgcagctcgattaacttttaca

SEQ ID NO: 42645 - DNA, 101 bp, Homo sapiens
  chr10:105155380-105155481
  hypo
ccttccgtgcctctctccacctgtgagatgggcactttattaaaggtccaaagtgaccagtagctcttgttactttctctgttcctcgatattgctatttt

SEQ ID NO: 42646 - DNA, 177 bp, Homo sapiens
  chr10:105413740-105413917
  hypo
gtcgcagccccaccacgccctgtactcctcgctctgcctgtctaatcccttcattctcccagccctgctcaatgcctccaggaagccttctcgactatgcttgtcttcacccctgacacttcagctctgcaccatgcaacagggctactgagggaccatcagcgtggggttgtcatg

SEQ ID NO: 42647 - DNA, 30 bp, Homo sapiens
  chr10:105796706-105796736
  hypo
cttccaaggctcagacgaggacaaggtttg

SEQ ID NO: 42648 - DNA, 21 bp, Homo sapiens
  chr10:108522437-108522458
  hypo
agccaccgtgcccagcctatt

SEQ ID NO: 42649 - DNA, 143 bp, Homo sapiens
  chr10:108578381-108578524
  hypo
tacaggtgtgagccaccacctccagctggaattttttagggtttaattagcatagtaagatagcagtggaaattaacatgttttacgagtctaaatagacactcttaatcatttaaatctgaaaactacgtcaagatatgcat

SEQ ID NO: 42650 - DNA, 36 bp, Homo sapiens
  chr10:110168394-110168430
  hypo
tttgtataaaattaacgggcggccgggcgcggtggc

SEQ ID NO: 42651 - DNA, 54 bp, Homo sapiens
  chr10:111902849-111902903
  hypo
cctccaacctgcttccggagagaatggcttccttaggaccgtacctgtagcagc

SEQ ID NO: 42652 - DNA, 33 bp, Homo sapiens
  chr10:111946090-111946123
  hypo
aaactgctggctgggcgtggtggctcatgcctg

SEQ ID NO: 42653 - DNA, 32 bp, Homo sapiens
  chr10:111979836-111979868
  hypo
tttcgtttgacctgacgcgattgaacataaca

SEQ ID NO: 42654 - DNA, 30 bp, Homo sapiens
  chr10:112079213-112079243
  hypo
aaaaaagccgggggtcggaaagaaaactcc

SEQ ID NO: 42655 - DNA, 79 bp, Homo sapiens
  chr10:112524488-112524567
  hypo
ctagggaggcacatgcgcaacacccaaaatgactccaggcttcgatagccgcaggtcagcccgtcgtgccaggcaccct

SEQ ID NO: 42656 - DNA, 30 bp, Homo sapiens
  chr10:112553736-112553766
  hypo
tgcgtagcatggtgacgcttgctcaagagc

SEQ ID NO: 42657 - DNA, 30 bp, Homo sapiens
  chr10:112582575-112582605
  hypo
tgttttttacctgcacggatctgagtttcc

SEQ ID NO: 42658 - DNA, 83 bp, Homo sapiens; identical to SEQ ID NO: 15387
  chr10:113623006-113623089
  hypo

SEQ ID NO: 42659 - DNA, 30 bp, Homo sapiens
  chr10:113748400-113748430
  hypo
aaccgggacatctcacgtggccagagcaga

SEQ ID NO: 42660 - DNA, 26 bp, Homo sapiens
  chr10:114571159-114571185
  hypo
aaggtgagtgcagaccgggcgcggtg

SEQ ID NO: 42661 - DNA, 34 bp, Homo sapiens
  chr10:114752064-114752098
  hypo
gcatagattccattccgcacgccaccctcgcctc

SEQ ID NO: 42662 - DNA, 213 bp, Homo sapiens
  chr10:114829478-114829691
  hypo
tcattgagggcccctcgctggatgtttcagccactccctcacaggttctcgtgtctgcttggtacagttgagatctgcaagagctgattcatcggcctgattgagattcctttgtaaaaccagatattcaagaatactagtggcaagaatgctttggtgagcgtaagatagcggctcccactggatcacatggctggtcggtgtcagggagat

SEQ ID NO: 42663 - DNA, 30 bp, Homo sapiens
  chr10:115479125-115479155
  hypo
aggcaaaacagattccggatatttctcttt

SEQ ID NO: 42664 - DNA, 34 bp, Homo sapiens; identical to SEQ ID NO: 15388
  chr10:115844821-115844855
  hypo

SEQ ID NO: 42665 - DNA, 72 bp, Homo sapiens
  chr10:116331126-116331198
  hypo
ccattgaatgtgactcggtctccgggtggaaacgggcgcctggaggcagaaagacatcgccctcaaggttat

SEQ ID NO: 42666 - DNA, 30 bp, Homo sapiens
  chr10:117011803-117011833
  hypo
tatagattctttggtcgtatactctctttc

SEQ ID NO: 42667 - DNA, 73 bp, Homo sapiens
  chr10:119807026-119807099
  hypo
gcctcagtgttttcacgagtaaaaaagccagttctacctcatgtctaagactccatcacgactctatgggctc

SEQ ID NO: 42668 - DNA, 101 bp, Homo sapiens
  chr10:120767098-120767199
  hypo
tgaagtctctgccttcgtgacactaacactccagggtcacctccggggaggtaatgatagagagtgggagtcaaggagataaaggaaaatattatccttgt

SEQ ID NO: 42669 - DNA, 42 bp, Homo sapiens
  chr10:120791236-120791278
  hypo
tagctctgagctattcgtgtattaactcgtattcaagaaggt

SEQ ID NO: 42670 - DNA, 30 bp, Homo sapiens
  chr10:120922882-120922912
  hypo
tgttaaacagatgtacgcttttcttttctt

SEQ ID NO: 42671 - DNA, 30 bp, Homo sapiens
  chr10:121249991-121250021
  hypo
cttaggcagaccacacgacctatccctggt

SEQ ID NO: 42672 - DNA, 43 bp, Homo sapiens
  chr10:121256846-121256889
  hypo
tatgcctcatttctgcgactggcatagacgtaggcaatcaggc

SEQ ID NO: 42673 - DNA, 17 bp, Homo sapiens
  chr10:121354427-121354444
  hypo
cccggcctgaaggacaa

SEQ ID NO: 42674 - DNA, 30 bp, Homo sapiens
  chr10:121398024-121398054
  hypo
ccctacgacaagaagcggaagtatgagttg

SEQ ID NO: 42675 - DNA, 98 bp, Homo sapiens
  chr10:121651072-121651170
  hypo
aaggagacagggtctcgctgcacagtgagtggcaagatcagggttaatttggcctcaagcaatattcccgcctcagcctcctgagtagctggcaatat

SEQ ID NO: 42676 - DNA, 30 bp, Homo sapiens
  chr10:122394238-122394268
  hypo
gaaacaagaatcctccgaaaacagacttgg

SEQ ID NO: 42677 - DNA, 120 bp, Homo sapiens; identical to SEQ ID NO: 15393
  chr10:122492432-122492552
  hypo

SEQ ID NO: 42678 - DNA, 139 bp, Homo sapiens
  chr10:123820813-123820952
  hypo
aaaaaaaaggagggagaaaagaatcgaggaagattcctgaagctttggcttgagtgactgggcaggtgggaccatatgctgagatgtgaaaagcactaaggtcaggtgtgtctgccgagttccacggccacagacctgg

SEQ ID NO: 42679 - DNA, 38 bp, Homo sapiens
  chr10:125919683-125919721
  hypo
acacaatattttacacggtattccgcaccatattccac

SEQ ID NO: 42680 - DNA, 186 bp, Homo sapiens
  chr10:126198949-126199135
  hypo
agctgtgcacccagccggccctggcgtcccggcccccagcctccgcctccctcgccgacagcttcccggggctctgcctggaggcagcctcgctttatcccgcagaacctccacgctgttcctgcatgagaactcttcctccaagagaccacgttcctctggtcctgtctccgtgggccacatcca

SEQ ID NO: 42681 - DNA, 30 bp, Homo sapiens
  chr10:126314006-126314036
  hypo
ggattcgatgcagcccggtggtgtgcacac

SEQ ID NO: 42682 - DNA, 73 bp, Homo sapiens
  chr10:126314814-126314887
  hypo
ctgtgctcaccctctcggtcctgctcggagcttcccactgacctcctctggcataaggcgcaggtagcggggg

SEQ ID NO: 42683 - DNA, 28 bp, Homo sapiens
  chr10:126479341-126479369
  hypo
cttctttttttgagacggagtcacgctc

SEQ ID NO: 42684 - DNA, 28 bp, Homo sapiens
  chr10:126479609-126479637
  hypo
gcgtaagccaccacgcacccggccctct

SEQ ID NO: 42685 - DNA, 224 bp, Homo sapiens
  chr10:126697796-126698020
  hypo
tatggcaccggggaacgagcattccaaacagagccaagcgattcacggcttcatcagcccctgtgacctgcaggtggcctgggaggcaggaggagcctaagcagccggtgtggctcccagcctcatgcacaatgatccaggaagaaagaggagacaaaaccacacaaactccagaggccggggcgggacagggagtgacccaacacagccgaacctgaggcccc

SEQ ID NO: 42686 - DNA, 45 bp, Homo sapiens
  chr10:126712043-126712088
  hypo
ctggctcgcagccaccgccggagggctccgcgacttgtgccatag

SEQ ID NO: 42687 - DNA, 87 bp, Homo sapiens
  chr10:126809890-126809977
  hypo
aatgctttactcacacggcttggtgaattcgagaatccacagtcctggaaagaaaagaggcctgaaggaaaccgggttctatttaat

SEQ ID NO: 42688 - DNA, 30 bp, Homo sapiens
  chr10:126814656-126814686
  hypo
cctgtaccactagaccgcagtgcagcggtg

SEQ ID NO: 42689 - DNA, 194 bp, Homo sapiens
  chr10:127380217-127380411
  hypo
agtccagcctccaggcgtgcaagtacatgtggggactatttagcgccagcatcccaatgtggaggtgttgatgccaccgtgctgggcccagagatttggggacagagtctgtcattggtatgcacacagctcactactgtatgatttttttaagtaatttgatgtgtctaattgttctgcggtgagataagaac

SEQ ID NO: 42690 - DNA, 36 bp, Homo sapiens
  chr10:127451959-127451995
  hypo
tctggaaagaatcaacgttatcgtccacctgctggg

SEQ ID NO: 42691 - DNA, 75 bp, Homo sapiens
  chr10:127463306-127463381
  hypo
cgcgggggaggaagacgctccccccggccttgcggggcaggtcgcgcagggcaggtcgtgcggggcaggtggggg

SEQ ID NO: 42692 - DNA, 30 bp, Homo sapiens
  chr10:127475463-127475493
  hypo
cctactcagccttcacgttctcaggaatct

SEQ ID NO: 42693 - DNA, 29 bp, Homo sapiens
  chr10:127601468-127601497
  hypo
gttgggattacaggcgtaagccatcgtgt

SEQ ID NO: 42694 - DNA, 30 bp, Homo sapiens
  chr10:128888749-128888779
  hypo
tttatttcttaattgcggtaaaatacatat

SEQ ID NO: 42695 - DNA, 135 bp, Homo sapiens
  chr10:129888855-129888990
  hypo
cccaagaccctcactcgccctgcaccttacatttctttggctctgtatggcagtcacagctctaaagcttctagttgcagaagttactccagtgggaatactccaagtatgcctcgtcctcgcttgccttggctt

SEQ ID NO: 42696 - DNA, 107 bp, Homo sapiens
  chr10:129925726-129925833
  hypo
tacacaggattctatcggggtctgcttcagttgcgctggtggccatgtgggctcagtaggccacctggggtgaagtgaatggagcctaaacacgcttttggtgacaa

SEQ ID NO: 42697 - DNA, 30 bp, Homo sapiens
  chr10:129947242-129947272
  hypo
taggtgatgggtacacggggtttgtgtatt

SEQ ID NO: 42698 - DNA, 24 bp, Homo sapiens
  chr10:130065702-130065726
  hypo
gcctagcagcgaggtctggaggct

SEQ ID NO: 42699 - DNA, 189 bp, Homo sapiens
  chr10:130203362-130203551
  hypo
ggcccacagtgtgaacggcgccctccaagatgagcagtgtgatgctccgcagagtcgtagacaggaaaagtggaggctgaagtgggaccggacagcactggcacggcttgactttggcaatggacaacagggaaaatggaggcgcaggtgagaaaggaaggcaggtgaagcgcccgactcactccaagc

SEQ ID NO: 42700 - DNA, 55 bp, Homo sapiens
  chr10:130577739-130577794
  hypo
agcctccgaggattccgcctgaggacacggccccatgagccggctcacgctcaga

SEQ ID NO: 42701 - DNA, 20 bp, Homo sapiens
  chr10:130754356-130754376
  hypo
gacgccgatgctcctgcaga

SEQ ID NO: 42702 - DNA, 179 bp, Homo sapiens
  chr10:130946123-130946302
  hypo
ttctcatatttcacccgagaacctgcaccgccaaagagccgatgatgtacctctcccatcctggttctgttcctgcccccctggcccagtgtgattcctccatggtccttgaatcctccactgtcactactctttcatcattatctaaggtgatcggtcagctccgtgccaccccctgt

SEQ ID NO: 42703 - DNA, 30 bp, Homo sapiens
  chr10:130946893-130946923
  hypo
tgtttgtttttgagacggagtctcgctctg

SEQ ID NO: 42704 - DNA, 208 bp, Homo sapiens
  chr10:131058908-131059116
  hypo
ggggaaggtgcaggccgttctccgttcagtggcctgtggatggatatgcccggaggcagcgccgcctccacccaccttcagcgaggtggccccagcagggcagggggtgcttccaccctgctcaccgagcctccgttaatgaaattaagcgggaaggtcagctgcattcccataggatcttcttccaggatcccgcagcattaagtag

SEQ ID NO: 42705 - DNA, 185 bp, Homo sapiens
  chr10:131606695-131606880
  hypo
ggcccatgcagcacccggggctctgcaggggaccccactccaaagcagaatgagacacacaggggttttctgatggttctttcatcccctcagctcctctttcttcaaatcgcctttaacctcagtcagaatgccagtcttcgccaggttggcccagtgcccagcaccctcgcacccacgcagag

SEQ ID NO: 42706 - DNA, 120 bp, Homo sapiens
  chr10:131641071-131641191
  hypo
ctgcatgctgtggggcgcccatccagccctccctggttcccagcggcaccaacaccgtccacccgccactgcacactgcagatgggtttcaaggctgtgcactcccgctgtgacaagttt

SEQ ID NO: 42707 - DNA, 218 bp, Homo sapiens
  chr10:131647719-131647937
  hypo
atttgatgattaacacgccccacctcagcaggtgtgcaaggtgcgggggcggacacaaagactgcggcttccggagaggacggctagggggccgcctttgcaagtgctctccaaaataattggtcaccgttctcgagtgcttgggcgtcggcgcatcttgtaagcaacgcaggaagcctcgcacgtacactcaataatgcgcccgaaagttgaggacc

SEQ ID NO: 42708 - DNA, 118 bp, Homo sapiens
  chr10:131739072-131739190
  hypo
gaaggcagagggcaccgcccaccccggaaacctgtcaccagggctgccataaacatcccacactcgatcctcccatgttgggccacagcaaacaggactgcagcgtaaaaccaggtag

SEQ ID NO: 42709 - DNA, 30 bp, Homo sapiens
  chr10:131739627-131739657
  hypo
atgtctgttctgccccggtcatcacaaaag

SEQ ID NO: 42710 - DNA, 242 bp, Homo sapiens
  chr10:131825216-131825458
  hypo
ggttcccacacccaccgcccacctgctgccaggccctgggggagctctagtgagaaacgtccacgtactactgcccaacatgctcgccgctcctgaagagttttgtttgaatagaaatgtccccgtgtccacggccattttgctggaacagactccaggctgcacagaggcgccaacactgtccccagccggaggccaccgctgctgccctcacagctgccatctcacggtctccccctgcc

SEQ ID NO: 42711 - DNA, 284 bp, Homo sapiens
  chr10:131844059-131844343
  hypo
aggagcagtcaggtccgtgtcacctgtggcttccactcccaggaagtctgatggctccggtcgtggctgttgtggggaatccgtcgtgtggagaacgtgcctgccacgtgcgggggagaaaggagccaccttccgagtacgcgacctcacctgccgggcgtgaggtgctggactgagaccagggtggggctctgggcatgggaggtggggctgggcgtggggcacgtggcacagagggatgcgcgtggtagggctcagggcagacggaacgtggaacagggagt

SEQ ID NO: 42712 - DNA, 92 bp, Homo sapiens
  chr10:131844600-131844692
  hypo
cgctcccccgcccagcgcctcccccgggacctgctccagaagcgccagttgcgggaccccacacggaaggcagtcttcggtggttctcactg

SEQ ID NO: 42713 - DNA, 192 bp, Homo sapiens
  chr10:131845044-131845236
  hypo
gaggttcatttaatccgtgcgtctatgcagcgcctaggcctaactctcccaggaggcgccagtcacgttccccagggggagctccctgacctttctgggggtgacagagtggggaagtgggcagtgtgagcccacccctgaggcgtgtgtgtgtaagcgtgcacacttgctttttaacgttctgtattctag

SEQ ID NO: 42714 - DNA, 79 bp, Homo sapiens
  chr10:131936587-131936666
  hypo
atcgggattacaggcttgagcccccgtgacctgccctgttgatctaaattgagtgaaattttgccgactgaatttgaat

SEQ ID NO: 42715 - DNA, 222 bp, Homo sapiens
  chr10:132001294-132001516
  hypo
cccgcacagcccacacggtgccctcacagcccgcacggtgcccacacagcacacacagcacacacggtgccctcacagcccgcacggtgcccgcacagcacacacagcacggtgcccacacagcccgcacagtgcccacacagcacacacagcacacatggtgcccacacagcccgcacggtgcctgcacagcacacacagcccgcacggtgccctcacagc

SEQ ID NO: 42716 - DNA, 30 bp, Homo sapiens
  chr10:132050805-132050835
  hypo
cacagaaagatagagcgatggcgctggccg

SEQ ID NO: 42717 - DNA, 30 bp, Homo sapiens
  chr10:132317215-132317245
  hypo
gagcaggcaagatggcgctggtcaaagtaa

SEQ ID NO: 42718 - DNA, 207 bp, Homo sapiens
  chr10:132365689-132365896
  hypo
gaggcgcgaacggagcgggtagaaatgagacggcgcaatggcggaaagcaaagcagaaatggcgtgacagccacatgtgcggggccggggaagtggaggctggctgctcctcacgggcactcgggtgaggctctctccacctcgcgcaggggctacccgctcgccgtgctgagcccttccagctctgccacgcgcaggaagccggtg

SEQ ID NO: 42719 - DNA, 174 bp, Homo sapiens
  chr10:132525800-132525974
  hypo
caggtgcaatgaaggcgcgcgctgagggctcaggggtcccagaggcatatgagggatggcttgtgccagcagagttcacacggcctggggagcagggcctggcatgaatgccagtgtagccccggcacacgtggcctagagttaggccaaggaatgcgacgcttctgtccttcc

SEQ ID NO: 42720 - DNA, 165 bp, Homo sapiens
  chr10:132586486-132586651
  hypo
tctcttagggagtcccgggtcgtactccctctgagcccaggtgccttcttggctgagccactgtctgtacctgtgccgttactgagacaaaaggaaaagtgaaaacagcgatgatgttttcagaccttttgagcatcacaagccttgcagcgctcaatctgtgtg

SEQ ID NO: 42721 - DNA, 30 bp, Homo sapiens
  chr10:132609284-132609314
  hypo
acccccacccgccaacgcccagctctctta

SEQ ID NO: 42722 - DNA, 167 bp, Homo sapiens
  chr10:132811738-132811905
  hypo
cgtcgaggtttcttgcggctggttggtgtatggggctggctctaaccggccatcttccatgttgacctctggaatccatgcttcctccaccaggatgccattcatctagggtgccagcatcttctcaggtccaagatccggacagcgcagtccgcccacacggacgt

SEQ ID NO: 42723 - DNA, 164 bp, Homo sapiens
  chr10:132818146-132818310
  hypo
cactgcctgagccaccggcagggacatctgagttagatgacttgcagctggctggctttcagcaggagaaggcagcaaatcttagagtggtggcgtgaggtcgggaacccaggacagatgggaagagggcaagcagcatgtctgtgccccgttccaccttcttc

SEQ ID NO: 42724 - DNA, 30 bp, Homo sapiens
  chr10:132873813-132873843
  hypo
gaagccttaggtctccgtgcactgggcgca

SEQ ID NO: 42725 - DNA, 119 bp, Homo sapiens; identical to SEQ ID NO: 15408
  chr10:132976493-132976612
  hypo

SEQ ID NO: 42726 - DNA, 191 bp, Homo sapiens
  chr10:132977044-132977235
  hypo
gaagatctggctctccgcacttgaggagcctctctttgatcaagttaaacaacagaatcaacagatgggactccactgtacactccgcagagctgcaaatgaattgtttaatgagaaggcaaagcggttccagcagagccccgctcactactcatgtatgctcatcagtgctcgtgcggtccctcagggac

SEQ ID NO: 42727 - DNA, 57 bp, Homo sapiens
  chr10:133058363-133058420
  hypo
caagcaaagcccaaacggccccagccgaatgtttccctcaaccggagccgggcttca

SEQ ID NO: 42728 - DNA, 30 bp, Homo sapiens
  chr10:133516048-133516078
  hypo
acagacccgccccgacggcaagggcttctc

SEQ ID NO: 42729 - DNA, 186 bp, Homo sapiens
  chr10:133532610-133532796
  hypo
tgggagccgctccctcgccgccttggtggggcacacactccctttgactccctggatccaagccccaggccacctctgcctgctcccaggggcttcgacccacacaatgccttgggtatcagctttatttctgggccccagcaatgctaattttctctaacatgacggtagcgtttaattttcatt

SEQ ID NO: 42730 - DNA, 30 bp, Homo sapiens
  chr10:133555035-133555065
  hypo
accgccgcagagcctcgggtgctgatgggc

SEQ ID NO: 42731 - DNA, 251 bp, Homo sapiens
  chr10:133913806-133914057
  hypo
gcccttggcatgagccggctggacctcccgcatggctgaagcccatgccacacccaaggtgggggtgtctgggccaccaccagctgagatctcccactcccgcagcctttgggtctctctccagtcgccccgtctgcctcccaggagggtgtcaggaaggccacgagaagacgtattgaccagaacagcctcacacacccttgagactggatgattctctgcaccctggttccttacgagggttggggggt

SEQ ID NO: 42732 - DNA, 30 bp, Homo sapiens
  chr10:133921177-133921207
  hypo
gccaagtgatcacagcgcctcttggagtca

SEQ ID NO: 42733 - DNA, 119 bp, Homo sapiens
  chr10:133947276-133947395
  hypo
ccctcccgtgggccccggcctcatcacccttctgctgcagttcatggcacttgctggcccggagtccggccctgggttggtgggaggaggctgtgctgggtatgcgctgccaccatctc

SEQ ID NO: 42734 - DNA, 86 bp, Homo sapiens
  chr10:133949349-133949435
  hypo
ctgtggtcagtcagccgactctgcgtggagacctgctggttctccgtcacttaaagaacaatcacatagtgcgttgtctttcagtt

SEQ ID NO: 42735 - DNA, 556 bp, Homo sapiens
  chr10:133951469-133952025
  hypo
ggagccagggcctcccgctgtggtgtggggacaagccagcccagacaccgtcttccctgtcatccaaatgatggcacacgggcagtaaaccgtggactgaaaccggtggagctgctctaccacttacacaacctcttcaactggcttccgcaggagcgggacaagctgttaagattccggaagcaaagaaagaaaatggcaaaacttcccaaggtaaggaacagcacaccggcacgtgcggagagtacgccgggtgtgtgcggagaggaccacgcccgcgtgtgtggagagcgctggtgtgtgcggagaggggtgcgccggtgtacgtggagggcgctgggtgtgtgtgccgaggaccgcgcccacgtgtgtggagagtatgccgggtgcgtgtggagaggaccgcgcccgcgtgtgtggagagtacgccgggtgtgtgcggagaggggtgcgccggtgtatgtggagggcgctgggtgtgtgtgccgaggaccgcgcccgcgtgtgtggagagcgctggtgtgtgtggagagcgtgctggcgtgtgcttagtagg

SEQ ID NO: 42736 - DNA, 77 bp, Homo sapiens
  chr10:133955427-133955504
  hypo
tggccaaggaggagacggagctgaggttccggcagctgaccatggagtaccaggccctgcagcgtgcctacgctttg

SEQ ID NO: 42737 - DNA, 176 bp, Homo sapiens
  chr10:133962619-133962795
  hypo
actgagggatgtgcccgtgggctcagggtgggactgcccaggccacgtggccagagtgtgatgaactctgcccggcacatctggggtcagcgaatatacaggggcagtccttgtgggcaggtccaggtccagtgcagattctgccaccactgctgccgctgcggtttggttttcat

SEQ ID NO: 42738 - DNA, 35 bp, Homo sapiens
  chr10:133979192-133979227
  hypo
agcagtcgccttagacgggccgtgtgtcatcccac

SEQ ID NO: 42739 - DNA, 52 bp, Homo sapiens
  chr10:133982909-133982961
  hypo
acgccgccccacactcggccccggcacctgaggtgtccgctctggggaggcg

SEQ ID NO: 42740 - DNA, 171 bp, Homo sapiens
  chr10:133984033-133984204
  hypo
ccccacagctgccctcggtgacatctgggacttggacatccatggacggcatccctggatggagccatttcctgggtactggacctggaggtgactcggagcttctcctgctcccagcgtgtgtccatgggggcggtcagggtagacaggccacaccgtcatcagggaggg

SEQ ID NO: 42741 - DNA, 153 bp, Homo sapiens
  chr10:134012330-134012483
  hypo
tcatccctctcatctcgtccccaggtggaggctgaggcggtgtaccgagctgtcaccatcgccaagcaggcaaactgcccgctgtacgtcaccaaggtgatgagcaagggggcggccgacgccatcgctcaggccaagcgcagaggtgagcac

SEQ ID NO: 42742 - DNA, 220 bp, Homo sapiens
  chr10:134014330-134014550
  hypo
ctggcttgtttccagcggggacctccaggtgacaggcagcgcccactgcaccttcaccactgcccagaaggctgtgggcaaggacaacttcgcgctgatccccgagggcaccaacggcattgaggagcgcatgtcgatggtctgggagaaatgtgtggtgagcacaggcctggccggggcacgccgtctggggagcggctgtgggcgggattgtgatggc

SEQ ID NO: 42743 - DNA, 303 bp, Homo sapiens
  chr10:134016136-134016439
  hypo
cctctctccccagaacgtggagtacaacatcttcgagggagtggagtgccggggagcgcctgccgtggtcataagtcagggccgagtggcgctggaggacgggaagatgtttgtcaccccgggggcgggccgcttcgtccctcggaaaacattcccggactttgtctacaagaggatcaaagctcgcaacagggtagggcggcacccgcaagggtgttgtgcaggtaggcaggtgggcgctgagttctaggcccagaacgcacccctggtcaacctggcccggcctcccgaggggtcaggaag

SEQ ID NO: 42744 - DNA, 30 bp, Homo sapiens
  chr10:134016763-134016793
  hypo
tcaggagctcagccacgggagccccccccc

SEQ ID NO: 42745 - DNA, 30 bp, Homo sapiens
  chr10:134019334-134019364
  hypo
ggctgtgggctggtccgacgactcctgcag

SEQ ID NO: 42746 - DNA, 96 bp, Homo sapiens
  chr10:134022845-134022941
  hypo
ggcttggacttgctccgtggggcctgcaggaccaggcagaagctgttctctgcgggactttgctggaaaccactcccttgccgggcctttcccgtc

SEQ ID NO: 42747 - DNA, 30 bp, Homo sapiens
  chr10:134058791-134058821
  hypo
gctgcgcgcagaagccggagggctaattcc

SEQ ID NO: 42748 - DNA, 119 bp, Homo sapiens
  chr10:134093662-134093781
  hypo
cacgcccctgcactccgtgaccacgccacctgcgctccatgaccatgtccctgcactctgtgatcacgctgaggcctccacaccgtgaccacgcccctgcaccccgtgaccacgcccct

SEQ ID NO: 42749 - DNA, 243 bp, Homo sapiens
  chr10:134094008-134094251
  hypo
catgtccctgcactccgtgatcacgctgaggcctccacaccgtgaccacgcccctgcaccccgtgaccacgcccctgcaccctgtgatcacgccactccactctgtgaccacgcccctgcactccgtgatcacgacactccactccatgatcaccacactccactccgtgatcacgcacctccactccgtgatcatgaacctccactccctgatcacacccctgcactcggtgatcacaccct

SEQ ID NO: 42750 - DNA, 243 bp, Homo sapiens
  chr10:134095563-134095806
  hypo
aggcagcagcccagccgctccgggggtgggggcgacaggtgctgggcggggaggcgctacattgtgtaacactcagcagccacgctacacttgggaagagcggatgtgctgaaaatgcccagtgcaggaccaaggtgcgccaaccagcccgcaccacgcccgagaggcttcgcagccgcccaccccggctctcacagcgcccatccctgccacacgccctgccagctgcgccagcttccccag

SEQ ID NO: 42751 - DNA, 30 bp, Homo sapiens
  chr10:134118399-134118429
  hypo
ggcgggctaatgccacgtcaggctggagac

SEQ ID NO: 42752 - DNA, 230 bp, Homo sapiens
  chr10:134123040-134123270
  hypo
tccagtgcacagagccgagttttcagcccttgcagctgcgaagctctgttccctgctctccctcaaagttgccattctccagcaggcacgcagaaggcagtgggttcagcacctgcctcagaggaagccctcggtgcccatcccagcaggagtggtgaaggagcgtttggaaggggaggtaccaaggcagggcagtgcctggaaccctgcgtacccggtgcacacatcag

SEQ ID NO: 42753 - DNA, 140 bp, Homo sapiens
  chr10:134272738-134272878
  hypo
gactggagggtgtgccgcagtgggagaggacacagggcagggtgtgactggagggtgtgccgcagtgagcgaggacacaggggtctcccattgatctcggcccccggcatggctccccgcaccaccgcagaccggccgtg

SEQ ID NO: 42754 - DNA, 30 bp, Homo sapiens
  chr10:134292599-134292629
  hypo
agccatgccttctcacggactcctctctgt

SEQ ID NO: 42755 - DNA, 299 bp, Homo sapiens
  chr10:134301017-134301316
  hypo
gtcctgttttgtcttcgatgcttctctccggtgagctgcaggtggccacagagtcaggcttgggaagctgtgccgcaagcgggaatgagtggacggggctgctcacgcggctgcttttccgtcacggatgccccacccggtcctgtgcgggaggccctgttgaggtgagctccgccctgccgagtgtagggactttgcctccacctccagggttccacatccttccagtaggacacaggcagacatcgccttgggaggctgaatttgctcaaacggcaaacacacgatgagagcctggg

SEQ ID NO: 42756 - DNA, 29 bp, Homo sapiens
  chr10:134315613-134315642
  hypo
cgatctcctgacctcgtgatctgctggcc

SEQ ID NO: 42757 - DNA, 30 bp, Homo sapiens
  chr10:134341480-134341510
  hypo
acaacagtgaccccccgccccccggggcca

SEQ ID NO: 42758 - DNA, 371 bp, Homo sapiens
  chr10:134481125-134481496
  hypo
taatgacatttgaatcgagcattaacaggcttaattactttaaaattgtcattttaatttacactgatatagtattgatcatacaagcagagattaagctgttcagtggagcagatgatggggaattaaacattaaagggtcctcagggggccgtgtgcgctgcccggcgcgagccggaagagggatgatatttctcggtaatgaactggcggcatgcggggacatgaatcttgggctcttggaaaaggggaaataatggggtttgggaggcatttgcaggttattcattcgccgccatgcaccaattctccagtgattcatccgcctcaccaacatttatttatccagcaaattccggagctttgacctt

SEQ ID NO: 42759 - DNA, 30 bp, Homo sapiens
  chr10:134499348-134499378
  hypo
tcagaattcagctcccgaaatcaagctaag

SEQ ID NO: 42760 - DNA, 167 bp, Homo sapiens
  chr10:134518611-134518778
  hypo
tgggagcatggagcccgctgtggggcatcagcagcacccacttctccccacagctcagcttcccactgatgtgtttccattgcagacacagttaccgacaggaaatgaacacagaggctccccggggcaaatggcctccccgagagaggaggcggacatgtttggaa

SEQ ID NO: 42761 - DNA, 60 bp, Homo sapiens
  chr10:134542152-134542212
  hypo
aagtcaagaagaacccgcgaaagaccaaagccgatcaatcccgggcgcccagcaattggg

SEQ ID NO: 42762 - DNA, 152 bp, Homo sapiens
  chr10:134566190-134566342
  hypo
ggcatggagggggtgcggcgtggaggcggtgcggcatggaggggtgtgtctagagcatctgggagcaattgtctttcatgtggatccaaagtcctccttttctctcagcattttgacacagagcacgcccctgctgtcggtagccaccatac

SEQ ID NO: 42763 - DNA, 298 bp, Homo sapiens
  chr10:134607898-134608196
  hypo
ctgagccccaccctgcgagggtgctctgagctctcagggcgttgcttctttgcccatttatcccgggtcttgggtgagttccagtggcggacagagctcagacaagagcagtgctcgcagcagcgccagcagggacagtggcaatacgagggtcacaggtgtgatcggaggccgccagcctgtgctgggtcaccgtgcggtgccagtgaaggtgccctctgcccaggagctgtgggggagccgggggtgccgccaggacgcagtgtgggtcgctgggaagacccgaaagaggggagga

SEQ ID NO: 42764 - DNA, 221 bp, Homo sapiens
  chr10:134610702-134610923
  hypo
tcctgcgggtggcagcggatgggggtgcagaactgcctttttgctgtttgcctgtttaccctctttgtgcccgcgccaaggtgggagccgctacacccagggaggcgctggagcgtgtgcggaggtcagagcctgatgccgcctcggtctctgggtgccggggcagccattccttcaaacaatggggtgcttccaaaccggtgcctcgtgaggaattggga

SEQ ID NO: 42765 - DNA, 30 bp, Homo sapiens
  chr10:134640686-134640716
  hypo
agacacaaccccacacggtgctcgtcaggg

SEQ ID NO: 42766 - DNA, 30 bp, Homo sapiens
  chr10:134647659-134647689
  hypo
aacagagataacaaacgcttggaatatagg

SEQ ID NO: 42767 - DNA, 57 bp, Homo sapiens
  chr10:134648015-134648072
  hypo
ctgggagcaggcaggcggcgccgagtcctgaacaaaggcggccgagaaggcacagca

SEQ ID NO: 42768 - DNA, 87 bp, Homo sapiens
  chr10:134662545-134662632
  hypo
agcaaaaggcaggtacgtcccggcctggcctgcatggggcgggggccgcggaagaaccctgcgccctccacacgggacttgacgtct

SEQ ID NO: 42769 - DNA, 30 bp, Homo sapiens
  chr10:134664613-134664643
  hypo
caattaccaggccgacggaagtgtagtcac

SEQ ID NO: 42770 - DNA, 203 bp, Homo sapiens
  chr10:134665029-134665232
  hypo
cctcatgttccctcccggtcacctagctgcctgccggcaccctgcattccttggcattttccagaaccgtacctaagtggaggcgcacagagtgctgtctttccgtctggttcattttcctcggtaaagtcaccgtgagactcccccacgcggctgcacgcatgctccttccctctcacagccggcgtcggtgcaccgtgtgc

SEQ ID NO: 42771 - DNA, 51 bp, Homo sapiens
  chr10:134671588-134671639
  hypo
tgcaaggacaatgtacgacatccacagtaacagacacggctcaggtcagac

SEQ ID NO: 42772 - DNA, 30 bp, Homo sapiens
  chr10:134672451-134672481
  hypo
gtcctgtggaccccgcgggggtgcagccgg

SEQ ID NO: 42773 - DNA, 162 bp, Homo sapiens
  chr10:134682685-134682847
  hypo
agggaagagggtggccgcgcagctggctttcacctggccgcaccaagggcgagactcaaaccccaggcggcgcagggtgggacggcacacacctggcctgctccagctcgctgacgcacacctgcccgaccgcctcttcatggcgcgcggctgcttctctca

SEQ ID NO: 42774 - DNA, 21 bp, Homo sapiens
  chr10:134683679-134683700
  hypo
atgagacggtgaactgagtcg

SEQ ID NO: 42775 - DNA, 38 bp, Homo sapiens; identical to SEQ ID NO: 15428
  chr10:134690510-134690548
  hypo

SEQ ID NO: 42776 - DNA, 156 bp, Homo sapiens
  chr10:134692252-134692408
  hypo
ctgcccacggctgggcggtggccctcttgatcctgagatgccctatgggggctccgggcaaactcatcctcagaagaaaggcctgccatgcctggcgctgccctgctggggtgtagcctgcgggaggcctagacagacgcacggggaggcccccga

SEQ ID NO: 42777 - DNA, 42 bp, Homo sapiens
  chr10:134693701-134693743
  hypo
ccccatgggactctccgtgcgcacctgcgctccccacagagt

SEQ ID NO: 42778 - DNA, 42 bp, Homo sapiens
  chr10:134699364-134699406
  hypo
ccagcaccttgaggccgccctcccagtcgtcctggtcggcat

SEQ ID NO: 42779 - DNA, 345 bp, Homo sapiens
  chr10:134699728-134700073
  hypo
ccttggagaattctgcgttcacaaacacagacctgtgtttccacgtattaaagattggcgagcaggacttggggtcctttcaggagttgcatggaaagctcccccgcggccgaggacacagcgccacgtgcacgctcgggagtcctcatgcttggtgcccgcagcacgggaacaatccccgagtctccacgcaggcagcggagccatgtgacacgcagaggcaaaggtgcctgccttcagggcacacacaaaaatcgcctgcctgccgggaggtgagccccacccagcctccatagggcgccctgtgggccatcagtgcccccaaatgcacgaagccagcagggt

SEQ ID NO: 42780 - DNA, 32 bp, Homo sapiens
  chr10:134726267-134726299
  hypo
ctgatgatcaggcctcgcgccaaggtgttgca

SEQ ID NO: 42781 - DNA, 30 bp, Homo sapiens
  chr10:134729962-134729992
  hypo
gggtgtccctccccacgccagcctgagtgc

SEQ ID NO: 42782 - DNA, 30 bp, Homo sapiens
  chr10:134730720-134730750
  hypo
acatactgcctaaatcggcaggtgccctgt

SEQ ID NO: 42783 - DNA, 177 bp, Homo sapiens
  chr10:134731838-134732015
  hypo
gaacccccctctccacgacgcacctcagcaccgatgaacccccctctccatgacgcacctcagcatggatgaaccccacctccgcgaacttccgcagcaggtcggggcacacctgcctctgcaggacgacctcaggctggctccaggtgtcctgcaccgagccgtccctacctcgct

SEQ ID NO: 42784 - DNA, 865 bp, Homo sapiens
  chr10:134732884-134733749
  hypo
gacagacgtcccacacgccttgtttccgggccactttggccagctctgcccaaatctgtatcctgctcaccgagaacccaaacgagtgaaaggtgagtagacaagtgtggttgctgaagttagaaaacacctgggctggctgcctgagaaaaggccactgtggctctgcagtttcaaggtggcaaggagcccggcactcgcgctgggtacggcctggcgggtgcatgtcccagggtcgggcgcagctctccgctctccctgccagccagctgtgcgcggcacctcccttccctgtggtgagaagaaaggccacacaatccactccccgggggagtgcacgggacaggcctcccggggatggtaccgaccgcagggtcggtaccaaaaatcagcctgctctggtcacaggcgctgcgtgtcctccgagtgacagcagtgacaggcgggacagggcagccgcacacctcataggccgtggctgtcatcacaggctggggggtcccgtctgtggcgggactcccaggcagggacctcgtcccaccatcctggagcaggtggcctggcgagtccccagacggccacatgcagggtcagctcagccgccacagacactggccctcgggctgagcgacccccgggctgagctgtgcgtggcgctctggccttttcctcactcacctctccttgtcgttttcgttgcccaggcgccgcaggtgcccggcagctttgtccacgctgacggtgtggtgccacgccttcgcacagaggtaggtgaaccggcccctgttcttcccggtggagactgagggcggaaatgcaaaggcaggtgttgcagctgctggccaagggccggggacgtgcccat

SEQ ID NO: 42785 - DNA, 193 bp, Homo sapiens
  chr10:134734077-134734270
  hypo
tgacgccagatgttccgaatcaccgctccttttcctggcaaataatcacgagcacccggaactcagctccacaccctggggggcctcctgtgcatgggcgaccccgggggctgggcctcccctggctggtgtccaccctctcggccagcacaggggttcaccttcaggagccactcaacggcatcctcccctg

SEQ ID NO: 42786 - DNA, 543 bp, Homo sapiens
  chr10:134738145-134738688
  hypo
tcctcctatgcgccacgccctctgtggaggacacagcacaggtgagcgccccacctgtccagcttctccagcacgtccgcaacgccagccaggggcttccgcaggtggtgccgcaggttgtgctgcagcaggggcaggcaggtgttccactgcgtggcgcacaccacgtggatgacccgggggtcgcccaggcgcacggctcgctgcagcgcgacgtctagcctctgtatgatatccagctgggcctgcggagaagacgtgggggattctagggaggttgctggctcgagctgcggggctggggcggcacctgcgtgcagggcacactgagaacgcaggccctaaattcatcaccctgcgtggcgtcatgctcaaatctgtccgtgaaaatggccagagtgactctttctaggaggaagtggacgtctcacaagatattacatgcaggaggcttggcggtgcccacacatcgtggctgcgcccgcctcccccgtgtggactcagcgggcgctgctcccttcctgatcccgtctctttcctggg

SEQ ID NO: 42787 - DNA, 87 bp, Homo sapiens
  chr10:134739185-134739272
  hypo
agaagctcagccccacggaggcagacccaggagcaagtccacagcggcatcggcacccgccgggctgtgacacgtgtgccaggcagt

SEQ ID NO: 42788 - DNA, 30 bp, Homo sapiens
  chr10:134757661-134757691
  hypo
ggcagccaggtgggccggggcacagggcag

SEQ ID NO: 42789 - DNA, 67 bp, Homo sapiens
  chr10:134773913-134773980
  hypo
cagccatacagaggacgccccgcatgcaggtggggacccacaatcaggcccccggggcaggtgggca

SEQ ID NO: 42790 - DNA, 34 bp, Homo sapiens
  chr10:134788083-134788117
  hypo
gggagaggtggatgccgcccgcacctgcctctcc

SEQ ID NO: 42791 - DNA, 32 bp, Homo sapiens
  chr10:134793940-134793972
  hypo
tgcccagcgagtgcccggcgaatgcccagtga

SEQ ID NO: 42792 - DNA, 30 bp, Homo sapiens
  chr10:134794902-134794932
  hypo
ctggggctgtgcccccgcccgacaagccca

SEQ ID NO: 42793 - DNA, 44 bp, Homo sapiens
  chr10:134797644-134797688
  hypo
gctcaggcgtctgtgcgagttgctgcgcgcgtgtgggtgtgcgg

SEQ ID NO: 42794 - DNA, 54 bp, Homo sapiens
  chr10:134832061-134832115
  hypo
gggacccgcagggagcgtggtgacagagaccgtggtgaccgggaccgtgtgcag

SEQ ID NO: 42795 - DNA, 30 bp, Homo sapiens
  chr10:134834266-134834296
  hypo
tgccacccttctgcccgaagggacagccac

SEQ ID NO: 42796 - DNA, 304 bp, Homo sapiens
  chr10:134834639-134834943
  hypo
gtgattgagactggtcgctccagtctgcacctgtctgcggtgacggccgcccttcccgtcagcccctccgcggtcccggccccagccctgggttgagggagggctggggaggagcagggacagacgggcaggcaccaggacgctggctgctgcgtgaatgtcacctgtggtcacggccgacgcccggcgggcctgggcatggagtcaggaccggaaagcgaggccggcagcagcaccagctcctcagcaaggcccccgctgccgactgggcacgggcactccaaggggacgcctggcacgtgcc

SEQ ID NO: 42797 - DNA, 95 bp, Homo sapiens
  chr10:134855674-134855769
  hypo
gggtctgggaaggcagagtccggtaaggctgggtccgggaaggctggggtccgtggggatgggcagggtctgtggggacacgcagggtgtcccac

SEQ ID NO: 42798 - DNA, 60 bp, Homo sapiens
  chr10:134875820-134875880
  hypo
caacacgttaagtaacgtgtcacgtgcctgctggccaccaccgtccgctcctgggaagaa

SEQ ID NO: 42799 - DNA, 41 bp, Homo sapiens
  chr10:134886279-134886320
  hypo
tgttcccaccccttccggcacggcaccggcaccgtcctggg

SEQ ID NO: 42800 - DNA, 49 bp, Homo sapiens; identical to SEQ ID NO: 15439
  chr10:134895296-134895345
  hypo

SEQ ID NO: 42801 - DNA, 177 bp, Homo sapiens
  chr10:134898411-134898588
  hypo
tgggtccctcatggccgcgtgagccgcttcctcactgtaaagctcttcacctatgtaactatgtatcaatgtaaacaggaacgtatcctccgcctctgcatctctggtgaatccgggcgatacgtggtgagacaccttaataaacacctagatagaccctgccgtggtgagcacctg

SEQ ID NO: 42802 - DNA, 96 bp, Homo sapiens
  chr10:134912118-134912214
  hypo
gaaaccctcctttcccgtcccacagcgccatccgcatcagccgcaagggccggcacacgctcctgaatttctgcttccacgcggccctgaccttca

SEQ ID NO: 42803 - DNA, 216 bp, Homo sapiens
  chr10:134913796-134914012
  hypo
accacagcaagtgcccgggaaacgccattgacgtcccgcctgtaagtgcctgcgagaggccgtcaccatcacgtctgcactttgccaccaagtacgccccacactgggatgaagcctgctggatccgcgggtgaggccccccgagggccttcagcaaaccccgcccgcgccttcgggaacacctgccactgcttgcctggacggagctcctggggc

SEQ ID NO: 42804 - DNA, 60 bp, Homo sapiens
  chr10:134916714-134916774
  hypo
agcctcctgtgctaccgagttgctggcgtgagaccctctatgccccgcagggcagccaca

SEQ ID NO: 42805 - DNA, 102 bp, Homo sapiens
  chr10:134930914-134931016
  hypo
cccacagaggccaagcgctcagcgtggccacaccagacctgccccctgggaggtccggtgcactgtggacgtgggcagggcagagcccgggagactgcctgg

SEQ ID NO: 42806 - DNA, 255 bp, Homo sapiens
  chr10:134937581-134937836
  hypo
cttggcactgggtcacgtggtgatgcactcagggctggtcccaggctctgcaccctccccggccagcccaccctcttgggctctgcaccctccccggccaggccaccctcttgggctctgcaccctccccggctctgcaacctccccggccaagccaccctcttgggctctgcaccctccccggctctgcaccctccctggccaggccaccttccccgggctctgagcaatgtgctctgccgtgagtcagctccc

SEQ ID NO: 42807 - DNA, 371 bp, Homo sapiens
  chr10:134940913-134941284
  hypo
tggggaagcccaggacgaagcagcaaggcctgggcctggacctggggcttgccgagagctgcgcccctcccagctcgcacccccgaggagtgcgcagcgccccctcctctcccagggagtccaacctaatctttgcctttggacaaggcaggcctggtttgccttctatgggaggggcctggggacaaatagcgatttggcaacagcacagagctcagctgagaagggaaaccccatcgagtaggaacggcggtccagccatcagtgcccagagccagcctggaacctctcattcagggccctcagttccttctgcggccccaggatggcccgcccgtctgccctccgccttgccccgcccacccagctcc

SEQ ID NO: 42808 - DNA, 187 bp, Homo sapiens
  chr10:134941647-134941834
  hypo
agggccaatagggcccggttcccatccacactctcagcgactctagaaacgcccaaggcccccaagccgcagctgtgcaaagccactcgctaggccgggtgggtgcagggccctttgctctgcagggggcgtcctgagtcctggccgtgctggccccgctgacactgacgtgcgtctccccacagct

SEQ ID NO: 42809 - DNA, 656 bp, Homo sapiens
  chr10:134942483-134943139
  hypo
cgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagccgttcacacccctgc

SEQ ID NO: 42810 - DNA, 30 bp, Homo sapiens
  chr10:134943582-134943612
  hypo
gggaccctccgctgtcgtgtgtctgagcca

SEQ ID NO: 42811 - DNA, 30 bp, Homo sapiens
  chr10:134945693-134945723
  hypo
cgtgtgcctgtgtgtcggatgcaatggagt

SEQ ID NO: 42812 - DNA, 104 bp, Homo sapiens
  chr10:134955053-134955157
  hypo
cgagcaacaaggacacgcacagtcctgtaccgtccccttcccaggcccaggagccacccgcaggggctgagccctgggagcatcccagccgggctctaagggaa

SEQ ID NO: 42813 - DNA, 30 bp, Homo sapiens
  chr10:134970630-134970660
  hypo
aggagaccgtgtttccgccagagccacagg

SEQ ID NO: 42814 - DNA, 30 bp, Homo sapiens
  chr10:134992431-134992461
  hypo
tcgacgctgggcagccgcagcagacagtcc

SEQ ID NO: 42815 - DNA, 651 bp, Homo sapiens
  chr10:134996258-134996909
  hypo
tgtccctccagaaagcgcagaggggcggggccatggccagcacagatctaggcccaactgcgcgggcggcgagggcgcgggcagtgtgggcgcaggtggtgtgggcgtgggtggcatgggcgcaggcggcaagggcatgggtggcgtgggtgcgagcaatgtgggcacggacggtgtgggcacaggcggtgtgggcacaggcggtgtgggcacaggcggtgtgggcacaggcggcgtgggcacaggcggcaagggcatgggtggcatgggtgcgagcagcatgggcggcgtgggtacaagtgaggagggtgtgggcggcgtgggcacgggcagtgtggacgtgggtggcggcaggggcggcaaaagtgtgggcggtatgggtgtgagcagcgtgggcgcgggcggcgagggtgccagcggcgtgggcgcgggcggcaagggtgtgggcagcgtgggcacgggtgctgcttcccctcaggggaatctcacgattcctgaaacttgagctcctggcccggagaagtgctggccgcggtcggggtggcgcacacgcagagactctggagctgacagcctgtcgtgcccacaggcgcacatctactctctgggggccacgctgaaggccgccctcgagtacgtggcagagcccac

SEQ ID NO: 42816 - DNA, 35 bp, Homo sapiens
  chr10:135001392-135001427
  hypo
ccgccccctgcaccccgtcccgccctccacctcca

SEQ ID NO: 42817 - DNA, 195 bp, Homo sapiens
  chr10:135002007-135002202
  hypo
tgtccacactgacctcgccgctctcctgcccacagtgggtgtccctgcaggacctcctgtcccagctgggccggcccttccgggagtacgagctgtgggccctgtgcctggcctgcctccgcgcactgcagacacgccctgagcacccaggtgacgcacgcaccatcccatcccccccgccgtccccacccccca

SEQ ID NO: 42818 - DNA, 30 bp, Homo sapiens
  chr10:135010585-135010615
  hypo
cgaggcatggacagccggaaaatccttgcc

SEQ ID NO: 42819 - DNA, 225 bp, Homo sapiens
  chr10:135011834-135012059
  hypo
ccccaggcttcctgccggtgaacagcgacaccgggcttgtggctgtgccagggcccgtgcccggccagcacccctgcggtgaagaagccacccagctgcctgcagcgttcacctccgaggccacgcacttcaagcccattgtcctcgcgcagaacgcaagtgtggccaggtgagcatcgtccccacaccccggagctgctgggtcccgggcgcaggcagcccctc

SEQ ID NO: 42820 - DNA, 42 bp, Homo sapiens
  chr10:135012659-135012701
  hypo
cactcccagggaggacggcctgcccgtcgctgcaggaggcca

SEQ ID NO: 42821 - DNA, 601 bp, Homo sapiens
  chr10:135014788-135015389
  hypo
cctctctctgtcacccggccccgtgcggcagttcagggtcccagcatctcccctgcactgggaggcggcagccgtgcccggggggcgcccgtggtgggcgggtgcaagagagaagggcgtcgggtgtgcaagcaccaccggcctcccattaacagcctgcccgggctccgcccacaggagccactgtccacgtaacctgcgtctctttctttcaaggaaaagagaagccagccatggccaggaccagcagcagggccccctgctcacccacctcggtgtcggatgtggactcggacgcactgtcacggggaaacttcgaggtggggtttcggcctcagaggtccgtaaaagccgagagagcgcagcagcctgaggctggcgaggacagacggccagctggcggggcctcagacgtggaggcagtgacccgactggccaggtccaaaggggtcggcccagccttgtcccccggcccagccggattccagagctgcagccccggctggtgcagcgccttctacgaggccgactgcttcggggccgacgtccacaactacgtgaaggacctggggcggcagcaggcggacggggccctgcccga

SEQ ID NO: 42822 - DNA, 377 bp, Homo sapiens
  chr10:135017049-135017426
  hypo
atttcctcccttcagcgctgacccccacctactggtgccggccgtgtgtgctgggctcagcactgcgggtgccctggggctgtggagctggcatccgcgtctcctgctgttaaaacaagcgtggctcccagagtcagcgtggacagcactggtgtgggttcctcccccgtctgtctgcaccggtgaagcctggcctcgtgtttccctcctcactgccccacatgtggtgtggattttagttaccgtggatttattaaaatcagtcaagaccgtcctcctcatggagtccgcctgtggttcccgcgtgaggagcgcccccgacggacatcgagtctgactgtgaacggaggccgtggaggtgccggccagagaggagt

SEQ ID NO: 42823 - DNA, 42 bp, Homo sapiens
  chr10:135018357-135018399
  hypo
caggaggctgcgggccgagggctgccgcgcctctcacctctg

SEQ ID NO: 42824 - DNA, 30 bp, Homo sapiens
  chr10:135018962-135018992
  hypo
actctgggcaggttccggagaatcacaccc

SEQ ID NO: 42825 - DNA, 189 bp, Homo sapiens
  chr10:135020704-135020893
  hypo
ccgcaccctgcgacacgctggacttcagccccctggacgagtcctcctcgctcatcttctacaacgtcaacaagcacccgggcggccggcagaaggcccgcatcctgcaggccggcacgccgctggggctcatggcctacctgtactccaggtgcgttgggagaaaagctcacccggaaaaggagacgt

SEQ ID NO: 42826 - DNA, 30 bp, Homo sapiens; identical to SEQ ID NO: 15452
  chr10:135023111-135023141
  hypo

SEQ ID NO: 42827 - DNA, 164 bp, Homo sapiens
  chr10:135023434-135023598
  hypo
gtctcctgagggtggcgcggtttcacccagtgaagacccagaacctttgagcgtgcagcattgcgcccggtcccgaggcaccagctccctcagcttcccgagctaacgggtcctgcgagtggagacgtcacaaagccctgcatagggctgcgttcagaaaggcc

SEQ ID NO: 42828 - DNA, 26 bp, Homo sapiens
  chr10:135025729-135025755
  hypo
acgtgtgcaccctcacgcaatccaca

SEQ ID NO: 42829 - DNA, 30 bp, Homo sapiens; identical to SEQ ID NO: 15454
  chr10:135035009-135035039
  hypo

SEQ ID NO: 42830 - DNA, 30 bp, Homo sapiens
  chr10:135035302-135035332
  hypo
agacgcggcggctcacgcctgtaaccctag

SEQ ID NO: 42831 - DNA, 42 bp, Homo sapiens
  chr10:135037546-135037588
  hypo
gcccatccaggcttggcctttctttgccgtaatggacgcccc
